United States Patent 10,724,096 (METHODS AND COMPOSITIONS FOR INHIBITING AND TREATING NEUROLOGICAL CONDITIONS) - sequence listing, part 136

SEQ ID NO: 2453 - DNA, 2298479 bp, Homo sapiens
ctgcataacactgacatttttattagaattcatttgtaacaaatggaacttgtgtcagcaaagaactgattttcatacagacttctttcgccaccaatgtaacgaagtaagaaaataaaaagcacgcctttcattctgtaaaacatttacgcgtactactaattagaggtaattgtattttttaacaagccattttacaagttatttgttttaatttttcagtctatgcatccaaaacgagagcaaagaacacaactgttattatctttgtaaagacactccaagctgggatggcaaagccacataacggatggatagaatggatctgtagccttctgatctctgctggagtatcagggcacccataaacccaaaaggaaccaaaacccaaaaagaaaaacaaaaagggaattaaaaataaaaggacttaaagcaaaaccgaaaataaacaggaaagaaaaaaaatacgtgcattactgcagacttttttcccttcctgtttctatgttgtgttatttacatacacacaaatgaatttccgaagcagtttcttacagatgggttcaagtaatatcattattgggtgtagaatcaatagggcagtgcatagtacaaaggtatagaaagtgcaaagttccctagaggcccttccctcccctggctgtcctcgccgttttctaaccatgcaaatcatttttaaaaaagagctaaaataaagttctgtacaaatcactttttatatattttgattttttttaccattgtaactaattacaaaattatacataactacacgtacataggtaaataatagcaccgtactggttatgatgatgaaaataactggaaacttgaaagcttgtggtaatggcagataaagatggttcacctgggaaattaaaacttgaatggttgtacagaaaagcacagagtggaatgcacatcaatgacagtaagggagttagttctaggaacagctcctgaacagtaagattcccgcaatagtctccgcctcgttcgtctatggtatgcatcccattcattttcttcttctgattattgtcatctttccctttgccaaatgggcagttattgtttcagggagagaagctgctcattggccaatcattctggtgtgcagtgctccatcggattctacatgtccaacaaggcatgtctggatgatgcaatgtctgtctgaccccctttgtttaactaaaagaaaattatagcactgagtaatctggcacttggataaatctccaaaaagatacaaactaaaagaaaataatgataacagacccacatagtgcacattcttctctggttctgatgtaggttagagagtctcattctgaggtagccttctagatacttttttttagtattatatatattttcttttttttctttttctttgttttttacaaaagtgctcaaatacaatgcttgcaaatgtttggtctcttggatttcactctgctagcaatgggaaaatgtggaaaacaaaaatccttccatgcagaacatccatgaagctaaaattaaaccaaagtagtatactcataccaaaactctttaagagttccttgggtattttgaggattatttaaaatcatgtaatatgtggcaaacttatgccatcatccatggcttcctatagaaattctgttggaagaattgggggtaagatacatatatatatatagtttatttccccttttagaaaaatcctaatggaatatcaaatatattccaaagttgccaatgatatttgttactaaaataagtttggtgcagttactgcatgttccagagcggatttggaagggaatataaataaaacaagtagctttttctgatgttgatgattgattataaaaggaagaagggccctgattatccaagtgctttgggctggtacaatcactaacatccccgacttggctgaaaactaggaatgcatattattcaaagagtttttgtacatgtggtaaacagataatgctttaatagaaagtaacagatacgaacagtgaatggaaatacgaaccaaaagctaaaaagaaatgctattaaaataggcatcaattataaggcactctaaatgcaaaactaaaaccaaaacgaaacaaagtacagcacttcccaggaatgctgtatgccacaaaatgtttctgactgaacagagtaacatgaatttggctttgcccctgttacatatcataaatgcaaatttcatagcacatactatagacaatatacgattgaatacactttttttaaacaactcgatagctgatatattacaacattctcccctcctaaagggatatgcactgacctttcccacatgcacacctcttagctatttaataataatttttattgcactagagtgttagaaatattgaactttgttggaagcctgactaacaaacaaacaaaacaatttgtggatgtgattgattggttaggtgggggtagattaggtaggaaatcagggggtgaggtttgacaatcaatcactgatgtgcattcctcatttccctttaaagaaataccaatatgtcaaaaaattaagaataaatggaaagagatgtttacaatagcttttctacgtttaaaaaaactaaatcatggaagaactgactgactgataactgtatctattttttgtgtggacacactgtctatatatacatagacacccttataaaatatggatatatatgtatatatgttagcagcaactttatactttgcgcctccctgttgattccaaaaacaaaacaaaataataattatctttgattatttgaagagaatgggtactttctcaccaatcaaaactgaagtgtaaaattaatatatctgacgagactgatactgtagattgagttttgcacaaaaatgtgcaaattttcaaatgatttgatatttctacagcaagatattacagataacagttctacagcttaaaaaaacctacgatttggaaataaaaaaatgaagagttatgtaacttttttaaaattcactttatcgaatgatacattttgttaaaaaaaagtttacacagttagaaatgaagcacaggtcagcagtatctttacaatactaaaaaactaaatcaaggactttctttttaaacattccctcccctttccccctaaaatgttattatgagcagtatggtgggaaggggcgatgtcaaagcagagtccgtttcattgtgagaagccacaccagcacatatcttgtgctgaactgcagcattctggcaatttctccttgcacctttcaagcaatcctgaataagatggtggttctttgctgtgatttcttcttcccttgattttgaatccttgaggtatctgtaaataaaatccttcagatgcctcatcagtcaggattctcttcattatttttcaggttagattattaaactgtgaattcttggtccacctggaataatttgtttttaatttgttttgtgtgtaatagtcccactaagtagttgttagctagaagttaagaaggacttctcaagtgccctgtatggctcagaagagactccatggatattgaagggcctgtagtaaaaatccagaatgggtcaggggtttctacgttgcatagtggtcaaagctgcccaggtactctagtgcggcacgataggaaaactgatattgatcctgcaggagacaatgaatggggagaagcaaaagaagggaccatgagcatattttaatagaaaaataaaaatcaatattgcataacaaaataacatctatataggggcaaaatcactactttcgtcaactggtctaatccaatgaccaattgtttatagtgaacaaagaaaaagccacatggggtgttgattaactttgccaatcaatttgactaaaacgatctcccaattccaagcagtggcaggtcgagtgaacattaccttcccagacaagtgttttccaagtagtatcaaaccattaccaccaattgaacacataaacttcttacatgccttataagcagataatgatgaaaatcatcctttacaattatctgcttattcaagataactaattctcagtttaaatatttaagagaggctgatacagacacaaactgtcctgagaaaaatctgaatttacttatcttctgaactactgccaacagaatttgaatttttaaaaaattatgtttggacagtagagcttgcagtgagaatcactcacagtcatttcagctaccctttggctgtctctctcacttacatatgatgttcatatacagccagaaggtagctggtgcggcacaccaggcacacaaatccatttacacagggcactggacttccaagctttccatccctgaaaatggcttcacaggactggctgcccacatcaaaaaatacctgtaaattcagcccaattctgtgtgattgctagttgtctgttttagagaggcacacactaaaaaaaagcagtatgaagcatggcctttttcagacaacgaagaacactatcatattggaataaattgaagcattgttggagagatggaaaaatcacaatttacagctctctatagggatgaggaaaaggattttccccataaaagaaacctattttcagtggccaatcgggctgaaagtagacagatagtttctattttgcttaaatgtgcatttttctgtaataaaaatggttggtaatgcaaaataaatggtgtttactttcctatcttgtcacagtaagttgcttggctgagtgttaaggctttttaaatgtccaatttccctctgtaacccctaagacccattaagtttgtcaagctggcataatgttttgactattgcaagccaaacacttgcactactttgaaatccgtctgaaagatactgtggatgatgaattgaggaacacatataagttgtataatttggtggccttttgcagaacataaactctatcagtaatattatctttagaaatgaatgctcaatagaccagactggctatatcataaactcttattattacgagaaatatccaaatttccatattaattattggaataggaaatgaggggctaatattaatatctctaggcttatccagaatcaaaatgttttgaatggccattgttaagacatgaaatatagaagagctgatacctctgtaggcatacagagggagaatggagaagttaaatgggctgagattatattatgtactaaatattatgctttctatatatttatatatttatattataggactatgaatataacgaattttatgaaattgccattttattggtcaaaaatggtccagtagtaaaatttaacatagctcaatctaacatataatctcacataatttctatagcaacactaagacactaataatctcatcccatttaaaaagggggaaaatgaggttcaaaattattaaacagtttgatgctttccccacagtattttgtgtctggtgttgagagagtatggagtccgggaggtccaggctagcaaaacgtaggctcttgagatgcgaaaaatgcaatggattttctcacctctgtctgtaccatagctggtcgttgtgttcttaacattttgacagtctggaagatatctacaactccttcatatctcattctttccaaaacaatgcttagcgttatgaagactccagttcttccaacgcccgcgctgccacaataacaaaggcgatgttactgggtgagatgttcacagtcttggccacatttgcttgggtgtggacatacttctaccagcttccacactccgtatctctttatagccatattcaggaaaacatggtatcacattcatcaaatgattactcttgggatactgagttgtaacagcatgtgataatgaggatgaagtaattaggagtaagtctaataaaaggtcttttcaatggggatttataccattttagaaagaccaaggaaacataacaaatgaaaagaaagggtaaataacatataggtttataatattcatggagattctgaaatttacaacctgcctacttaatatttttaaagtatgaaataattcagaataaggtgaagtgaatttggcatcttcaacttttctatcacactgttcacattttgcagttacttaaaatacatatgcgatgcccataacctaaatgtatttgcctataactagtcaaatgtttacactggttttattatgagaaaagagatggtataacagggtatatacgtgattttcacttagtcttcaggagggtttatgactatcctgtaagtgtacgtacacatgaagtaaatactatgttgttttcttatttcttgagacttagaactttcaacagattctcacaggggtctctaatcttaaaaaaaaatggttaagagccattgatctctgaacttagctaccatttttacatgatcagcaactaaaaccacattagaaaggttttgagtttctctctgttgtcttcattgttttaagataactccagaatcttcacggtagcaagaaagaaaattaattcatagctcttgtgcacttaaggaggaaagcaatgggaagttcagataatgagggaaacagtgaataatctgaaaaatccctgcatttttggatcctaattaaacagcatgtgtaacacttgggcacgggctgtagaaaatagatggattcatttactggagggtgtagctgacaggcatatataaatagtgtgtccctttataaatggggtttctacagtctaaacagaaatgttaagtgaggtttgaaaatccaagcggagtcagtctttaagaagtgattgaagatgtctagcggcagtgaaaccttctgttaagatgaagcagatgaccttgaaggtcccttttaaccttgaaagtctctcttagttgtgagaaactgagatttattatctttttgttgaatgatctaggtactccagagtctatcttaccttgccagagtctatcttaccttgatttgatagctcgaatgcaacaaaaacattgggttactttctactaagtattttcaaaaaaagaacagacattggactcacaacttttcaatttactggttttatcatcttactttaataagttataaataagaaaagtggtattttcagaacattcctaaataagaggaaatatatagaagtcttctttgtgtgtgtgtgtgtgtgtgtgtgtgtatatatatatatatatatatatatatatatatatatataaaaggtatatgcatcgcaattcctttagcattatactaaaggaatattaaaattattttatgacaaaaacaatgagaacaggcacacataacacatttatgtacctatacatataaggatgcctaaagttaagaagatgtattaaattaaagatactcttttccttagagattattttagaaaagtttaaattagcatttgggcaaattatgagtaaagataaaagaaatatccaggtaattcaatcccaatatataccatctactttgtctgaatatgggtatacactgttttattgtgctatactttatggagttttgcagatactgtgtttttcacaaattgaacgtctgtgtcaatcttgcattgaacaagtatattggtgccatttttccaccagcacatacttggtttgtgtctctgtgtagcagtttggtaattcttgtaatatttcaaattttttcatactattacatctgttaaagtgatctgtgatcactgatctttgatgttactactgcaattggtttggggtgccatgaaccatgaccataagacaacaaacacttaattgacaaatgtgtgtgttatgactgcttcaccaaccagcagtttccccatctgtctttttctcctcaggcctccctattccttgagacacaacaatatcgaaattaggccagttaataaccctacaatggcctctaagtgttcaagtgaaagggagagtcgcgtgtatctaactaactttaaatcacaaactagaaataattaagcttaaagcccagatgtgctgaaagctaggcctctcgcaccaaacagcctagttgtgaatgcaaagttcctgaaggaaattaaaagtgctactccagtgaacacatgaatgataaggaagtagaacagctttactgctgatatgaagaaagttttaaaggcctgcatagaagatcaaatcatttacaacattcccttaaatcaaagcctaggccagagcaaggccctaactctcttcaattctatgaaggctgggaggtgaggaggctgcagaagaaaagtttgaagttagcacaggttggcttatgaggtttaaggaaggaagccaaccccataacataaaagtgcaaggtgaagcaataagtgctgttacagaagctgtagcaagttatccagaatatctagctaagatcattgatgaaggtggctacattaaaaaagagatcttcaatgtagacaaacatcattatattggaagaagttgtcatctaagactttgatagctacagaggaggagtcaatgcctgacttcagaacttcaaagaacaggctgactctcttgttaggggctcatgcagctggtgacattaagctgaagccaaagctcatttaccatttgaaaatcctagggctctcaagaattacactaaatatactcaagtgaaaggaagagttatacatctctcattttaagtcaaaagcttgaaaaaattaagttttagtaaggaaggcacgttgaacatcaagacaggctgaaagctcgacctcttgtaccaaatagcccagttctataaatggaacaagaaagaatggatgataagacatccgtttatagcatggttgactgaacattttaaggccactcttgagacctactgcttagaataaaagattcttttcaagataatactgctcattgacaacataccttgttacccaagagctctggtggaatgtacaaggagattaatgttctcatgcctgtgaacacaatattgattctgcagcccaatggatcaaggaggaatttcaactttaaagttttgttatttaagaactacattttataaggctatacattctatagatagatagtgatttctctgataggtctgggcaaagtaaattgaaaatttactggaagtaattcaccattctatatgccattaaaaacatttgtgattcacgggagaagatcaaattatcaacagtaacaggagtttggaagaagttgattccaatcttcatggatgactttgaggggttcaagacttcagtagaggaagaaattgcaaaaatggtggaatagcaagataactagaactagaagtggagccaggagatgggactgaactgctgcaatctcatgataaaacctgaatacatgaggagttgttccttacggatgagcaaagaaagtggcttctcaagatggaatatactcatgaagatgctgtgaacactgtggaaatgacaacaaaggatttagaatagtacataaacaaagttaatagaaaagcagcagggttgcagaggaatgactccaattttgaaagaagttctactgtgagtaaaatgctatcaaacaacattgcatggtgcagagaaggctcttgactttgtcacttagtcacttgatgtggcaaacttcattattattttcttttaagaaattgctacagccacctcacccttcagaaaccaccgcccatcgattagtcagcagccatcaaaatagaggcaagaccctcaaccagcaaaaagattaaaacttaccggaggctcagatgatgattagcatttttttttttttttaaactttaagttctggggtagatgagaaaaaagtgctggtttgttacataggtataaatgcaccagggtggtttactgcacccatcaacccatcatctacattaggtatatctcctgatgctatccctcccccaggcccccaccccctggcaggccctggtgtgtgatgttcgcttccctgcgtccacgtgttctcactattccactcccacttataagtgagaatatgcggcgtttgattttctgttcctgtgttagtttgctgagaatgatggtttccagcttcatccatgtccctgcaaaggacatgaactcatccttttttatggctgcacagtattccatggtgtatatgtgccgcattttctttatccaatctatcattgatggacatttgggttgcttacaagtctttgctattgtgaatagtgccacaataaacatatgtgtgcatgtgtctttgtagtagaatgatttacaatcctttgggtatacactcagtaatgggattgctgggtcaaatggtatttctggttctagatccttgaggaatcaccaaactgtcttccacactggtttaactaatttacacacccaccaacagtgtaaaagcattcctatttctccacatcctccccagcatctgttgtttcctgactttttaatgatcgacattctaattggtgtaagatggtatctcattgtggttttgatttgcatttctctaatgaccagtgatagtgagcattttttcatatgtttgtctgccgcatcagtgtcttcttttgagaagtgtctgttcatatccttcgcccactttttgatgaggttgttgttttcctgtaaatttgtttaagttctttgtagattctggatattagccctttgtcagatggatagatagcaaaaatttcctcccattctgtaggttgcctgttcactctgatggtagttttttatgctgtgcagaagctctttagtttaattagatcccatttgccacttttggctttagttgccattgcttttggtgttttagtcctgaagtctttgtgtatacctatgtcctgaatggtattgcctaggttttcttctaggggttttcatcattttacatcttaggtttaagtctttaatccatcttgagttaatttttgtataaggaagggatccagtctcagttttctgcatatggccagccagttttcccaacaccatttattaaatagaggagcctttccccattcttgttttccctcaggtttgtcaaagataagatgtttgcagatgtgtggtgttacttctgaggcctctgttctgttccattggtctatatctctgttttggtaccagtaccatgctgttttggttactgtagccttgtttgaagtcaggtagcatgatctctcaagccttgttctttttgcttaggattgtcttggctttgtgggctcttttttggttccatgtcaaatttaaagtagttttttcccattctgtgaagaaagtcattggtagcttgatggggatggcattgaatctataaattaccttgggcagtatggccattttcacgatattgattcttcctatccgtgagcatggaatgttcttccatttgtgtcctctcttgtttcattgaacagtggtttgtagttctccttgaagaggtccttcacattccttgttaagttggactcctaggtattttatcttttttgaagcaattgtgaatgggagttcactcgtgatttggctattattggtgtataggaatgcttgtgatttttgcacattgattttgtatcctgagactttcctgaagttgcttatcagcttaaggagattttgggatgagatgatggggttttctaaatatacaatgttgtcatgtgcaaacagagacaatttgacttccactttttctaattgaataacatttatttctttctgttgcctgactgccttggccagaacttccaatactgtgttgaataggagcagtgagagagggcatccctctcttgtgctacttttcaaagggagtgcttccagtttttgcccattctgtaggatagtggctgtgcgtttgtcataaatagctcttcttcttttgagatacgttccatcagtacctagttttttgagagttgttagcataaagggctcatgaattttgccaaaggccttttctgcatctattgagataatcatgtggtttttgtcattggctctgtgtatgtgatggattacgttcattgatttgtgtatgttgaacaagccttgcatcccagggatgaagccgacttgatcgtggtggataagctttttgatgtgctgctggattcggtttgccagtattttattgaggattttggcatcgatgttcatcagggatattggcctggaattttcttttttgttgtgtctctgccaggttttggtatcaggatgatgctggcctcataaaatgagttaggaaggagtccctctttttgtattgtttgcaatagtttcagaaggaatggtaccaattcctctttgtacctctggtagaattcgtctggtcctggactttttttggttgctaggctattaattactgcctcaatttcagaacttgttattggtctatgcagagattcaacttcttcctggtttagtcttgggagggtgtacgtctccaggaatttatccatttcttctagattttctagtttatttgcatagaggtgttgatagtattctctgatggtagtttgtatttgtgtgggatcagtggtgatttcccctttgtccttttttattgtgtctgtttgagtcttctgtcttttctatctattttgttgatcttttccaaaagccagctcctggattcattgattttttgaagggtttttcgtgtctctatctccttcagttctgtagtgttcttagttatttcttgtcttctgttagcttttgaatttgtttgctcttgttactctagttcaattgtgatgttagggtgtcgattttagatctttcctgctttctcttgtgggcatttagtgctataaatttctctctacacactgctttaaatgtgtcccagagattctggtacattgtgtctttgttctcattggcttcaaagaacatctttatttctgccttcattctgttatttacccagtagtcattcaggagcaggttgttcagcttccatgtagttgtgtggttttgagtggtttttttttttaaatcttgagttctaatttgattgcactgtggtctgagagactgtttgttatgatttctgttcttttgcatttgctgaggagtgttttacttccaatatgtggtcaatgttagaataagtgcaatttggtgctgagaagaatgtataattctgttgatttgggtggagagttctgtagatgtgtattattaggtctgcttggtccagagctgtgttcaagtcctgaatgtccttgctaatgttctatctcattgatctgtctaatattgacagtggggtgttaaagtctcccactattattgtgtgggagtctaagtctctttgtaggtctctaagaacttgctttatgaatctgcatgctcctgtagagggttcatatatatttaggatacttagctcttcttattgcattgacctctgtacgtaatgcccttctttgttggtttaaagtccgttttatcagagactaggattgtatcccctgctttgttttgctttccatttgcttggtaaatattcctccatccctttattttgagcctatgtgtgtctttgcatgtgagatgggtctcctgaatacagcacactgatgggtcttcactcctctttatccaattggccagtgtgtgtcttttaattgggggcatttagcctatttacatttaaggttaataaggttatgtgtgaatttgatcctgtcattatgatgtttgctggttatttgactattaattgatgcagtttcttcccagcatcgatggtctttacaatttggtgtgtttttgcagtggctggtaccagttgttcctttccatgtttagtgcttccttcaggagctcttgtaaggcaggcctggtggtgacaaaatctctcagcatttgcttgtctgaaaaggattttatttctccttcacttatgaagcttagtttggctggatatgaaattctgggttgaaaagtcttttctttaggaatgttgaatattggccccactgtcttctggcttgtagggttgctgtcgagagacctgctgttagtctgatgtgcttccctttgtgggcacgccgacatttgtctctggctgcccttaacattttttccttcgtttcaagcttggtgaatctgatgattcattgtgtgtcttggggttgctcttctcgaagaatatcttagtggtgttctcagtatttcctgaatttgaatgttggcctgtcttgctaggttggggaagttcttctggataatatcctgatatcctgaagagttttctccaacttggttccattctccccttcactttcaggtaaaccaatcaaagtaaatttggtgttttcatatagtcccatatttctcggaggctttgttcatttctttttactcttttctctaatcttgtcttcatgctttatttcattgagttgatcttcaatctcggacatccgttcttccacttgattgatttggctattgatacttgcgtatgcttcacgaagatcttgtgctgtgtttttcagctccatcaggtcatttatgtttttctctaaactgcttattctagttagcaattcctctaaccttttttccaggtacttagcttccttgcattaaattagtaacatggtcccttagctcggaggagtttgttattacccacgttctgaagctgacatctgtcaatttatcaaactcattctctgtcctgttttgttcccttgctggcgaggagttgtgatcctttggaggagaagaggcgtgctggtttttggaatgttcagcctttttgtgctggtttctccccatcttcgtggatttatctacctttgacctttgatgatggtgaccttcagatggggtctctgggtggacgtgctattcctttctgtctgtctgtttgttattttccttctaacaaacacccaggcctctctgctgtaggtttgctggaggtctattccagacgctgtttgcctgggtattatcagcagaggcttcagaacagcaaagattgctgcctattccttcctctggaagcttcatcccagaggagcacctgccagatgccagccagtgttctcctgtatgaggtatctgtcagcccctactgtgaggtgtcacccagtcaggatacatgggggtcagggacccacttgaggagagagtctgtcccttatcagagctcgaacactgcactgggagaaatgctgcgctcatcagagctgccaggtggggatgtttacgtctgctgaagctgtgcccacagctgccccttccgccaggtgctttgtcccagtgagatgggggttttatctgtaagtaagtctgtgattggggctgctgtctttctttcagagatgccctgcccagggaggagtaatccagagaagcagttggccttgctgagctgcagtggactcagccctgtttgaacttcctgctggctttgtttacactgtgagggtaaaacaaacagcctactctagcctcagcaatggcagatgcctctcccctcacgaagctcgaatggcccaggtggacctcagacagctgtactcgcagtgagattttcaagccagtggatcgtatcttgctgggctctgtgggagtggatcgtatcttgctgggctctgtgggggtgggacacaccaagccaggcactggagggaatctcctggtttaccagttgtgaagactgcgggagaagtgcagtatctgggccagagtgtactgttcctcgtggtacagtctctcacggcttcccttggctaggaaagggaaatcccctgaccccttgtgcttcctgggtgaggcaacgccacaccctgctttagctcaccctttgtgggctgcacccactgtccaaccagtcccaatgagatgaaatgggaaacgcagaaatcccctgccttctgtgtcaatctcactgggaacagcagaccagagctattcctattcagccatctttccagctcttgtaagtacattgttgtttgtttagacctaatgctattgcacactaaatagactatagtataaagtaaacacaacttttatatgcactgggaaaccaaaaagtatgtgtgactccctttattgtggtaatctggaactaaactcccataacgtctctgaggtatgcctgtatttgattccatgtgtcatttcctacaagctctttggttggtttgcaaaggatgtttaataactcaatagaaagtagaaagcaaatgtacatagataaaggtttgcttcttataacatgcctgagaaacaaaggatgctagaagggactttaaacctcagctaagataactgaagtccagagaaacttcattatcatagagccaaataatagaattgagattagaacacagctatcttagcccaagtctaatatttgtcctattttgagatcctgccttctatgtcgtaaagaactatagttttctttgatgtgctgaagcaaaatatattttttaataaactctctcaagagtttcaccataaaaagattagatgtcaagttgccagaaccctaaaatatattagtttaaataaaattagatgaattgcttttgttagaaggtttttgcatagcaacttccaaaaacactaaatttatggtgaatgtctgaactatttacttgctatttatttctattaacttcaatgacttgagttataaaatgctctagaaactattgaaaataattaacttgaaggtgcttcattttctgatatagcaacaattttcaagcaaattgcattttttaactgaggtaccatactaagcacttattgactggcagaacttaatattgtcattaggatttatttgatagctattcatgaggttttcacaaacagaagaaagacagttatcagtgcattgctatgaaagcaaaagcaaatatgaaatgattaacaacgaattattactaggggaggtaccaacaattcccattaaggtaaaattggtaatttggtttgtctaataggaagcaaattttttgggggataaacatttttttggggctaaacattttcctctgattattttcacttattttcactttatgaaaagaaagagaaatcaatcctgctttaagttttgtaatacattgccaagaataaaatttcaaataagcaaacttactacaaaaagtgtatacagacaatgaagaaacaccaccacttatcactgctttattcacaaatggaaacttacctgcaatggactgaaatgggtccatcttggccaaactgttcttttgttttatggacttggccgatgaagtcaataaatccttctccggactttggcactccttgctctggccagtcagtgaactggaactgccttactgttcgggactggccgtcctttagaaggaaagccacatacccggccgcaaaggaagacgccaggaggattcagcaagcatacggaccacaagaacaatcattttcatttcccgaaaacaaaaagggtagaaaaagttaggaacatgtttaaatagaaacttagttatggtttatctgctataaatattgtccacactcacatacctttaaatcctaaatttatttactcttgaaatcctaaatttatttactcttgcagtgcccagttaaaaacctggttctcgttagtagccatccacatagttcccccattaacaaatgtttctgagacccaaagtgggggttcgtaaccattcatcatgtctgcattccttccaaaatggaacatataaaatggaacatatatattccatttcaaaaatttcagaaactaattactttgtaataaatattgaaacaagcacctaggcatgtcatccagaccagagcttttgcagttgtcgcaataacttcacatctgctgtgcttgcgtatttctaccgttgtcaaatgacaaatggtgaaatttaaagtatctgacacaaacccggtagttgctgttaacctggatgccccccatgtctcagaggaataccatttctagccatggcaggggacatagcatgaaccatatgactgtgctgttaagtgggaagtaaagcatccctcaaggataccaacgactattagcaaacaaatgcccttttctgaaaaagagctctccctggctgaccacaggaattaacagtctgtggagagctttaacatagataaaccaaaaggtagaaaaaaaagccagattgaagagcagtctttcttttttagagtgattaggtaaaactgctctgactcacgaagtatatctgggttgaaaagaagacactaaggcatttctgatcttctgatcccttgtggaaatttaaggtgtttctagaagtacaagaaaagtggaagggagcctctgtttatagaagcagaaataatacattgcccatcaaccttctcccctgactcatcagcagagagaaataatccaagcttagagagaccgatctcatttctcatttgaagaggtcctactcctaaatggtctcttctcattaaagagccttcaacttgttcctccattgtttctgttaacacattatttcctcatcaaactttttttagatacacgtgtgcatgttcccaaggttctgggtaagtgaacagggactcaatcctttatcattcactcatattgagaagagagaggatctcagtgtgagatgagcactcatcacctcgcctggtggttttcacagggacatgccagattcctgactgatgttatttggggatggagataaacaggaagatgacaccaagtgtgtgggaatactgagaaatagagaaaactatttggccccataagtactttatggatggttaccatggaagcatgatttacttccctctgtttctggaaaagatttggaaagcacaggaaggagacccagaagctaggtaatacagatttattctcctctgaatgtcctggggatttcatttctgaccacagttgctttcaatagcaagaagaggtcatgtgtgcaaataccttctatttggaggagagactgcctgacttcatttaaaggttacctgtttaacaatactgtaattttcaacccagaattgcatatccagccaaattaagcttcataagcaaaggagaaataaaatcctttacagaaaagcaaatgctgagagattatgtcaccaccaggcctgccttacaagagctcctgaaggaagcactaaacatggaaaggaacaactggtaccagccactgcaaaaacataccaaattgtaaagaccatcaacgctatgaagaagctgcataattaatgggcaaaataaccagccagcatcataatgacagaatcaaatttgcatataacaatattaaccttaaatgtacatggactaaatgccccaattaaaagacacggactggccaattggataaagagtaaagacccatctcacacgcagagatacacataggctcaacataaagggatggaggaagatctaccaagcaaatggaaggcaaaaaaaaagagcaggggttgcaatcctagtctctgataaaactgatgactttaaaccaacaaagatcaaaagagacaaagaaggccattacataatggcaaagggatcaatgaacgaagaagagttaactatcctaaatatatgtgaccccaatacaggagcacccagattcataaaataaagcaagttcttagatacctacaaagagacttagactcccacacaataataataggagactttaacaccccactgtcaatattagatcaatgacacagaatattagcaaggacattcaggacttgaagtcagctctggactaagcagacctaatagacatctacagaactctccaccccaaatcaagagaatatatattctcaacaccacattgcacttattctaacattgaccacataattggaagtaaaacactcctcagcaaatgcaaaagaaagaatggaaatcataacaaacggtctctcagaccacagtgcaatcaaattagaactcaagattaaaaaaaaaaccactcaaaaccacacaactacatggaagctgaaccacctgctcctgaatgactactgggtaaataacagaatgaaggcagaaataaagatgttctttgaagccaatgagaacaaagacacaatgtaccagaatctctgggacacatttaaagcagtgtgtagagagaaatttatagcactaaatgcccacaagagaaagcaggaaagatctaaaatcgacaccctaacatcacaattgaactagagtaacaagagcaaacaaattcaaaagctaacagaagacaagaaataactaagaacactacagaactgaaggagatagacacacgaaaaacccttcaaaaaatcaatgaatccaggagctggcttttggaaaagatcaacaaaatagatagaaaagacagaagactcaaacagacacaataaaaaaggacaaaggggaaatcaccactgatcccacacaaatacaaactaccatcagagaatactatcaacacctctatgcaaataaactagaaaatctagaagaaatggataaattcctggagacgtacaccctcccaagactaaaccaggaagaagttgaatctctgcatagaccaataacaagttctgaaattgaggcagtaattaatagcctagcaaccaaaaaagtccaggaccagatgaattctaccagaggtacaaagaggagttggtaccattccttctgaaactattccaaacaatacaaaaagagggactccttcctaactcattttatgaggccagcatcatcctgataccaaaacctggcagagacacaacaaaaaagaaaattccaggccaatatccctgatgaacatcgatgccaaaatcctcagtactggcaaaccgaatccagcagcacatcaaaaagcttatccaccacgatcaagtcggcttcatccctgggatgcaaggcttgttcaacatacacaaatcaataaacataatccatcacatacacagaaccaatgacaaaaaccacatgattatctcaatagatgcagaaaaggcctttggcaaaattcaacaccactttgtgctaacaactctcaataaactaggtactgatggaacgtatctcaaaataagaagagctatttatgataaacgcacagccactgtcataacgaatgggcaaaaactggaagcattccctttgaaaactggcacaagacagggatgccctctctcaccactcctattcaacacagtattggaagttctggccagggcaatcaggcaagagaaagaagtaacgggtattcaattaggaaaagaggaagtgaaattgtctctgtttgcagatgacatgattgtatatttagaagaccccattgtctcagccccaaatctcaagctgataagaaacttcagcaaaatctcaggataaagaattaatgtgcaaaagtcacaagcactcctatataccaataacagccaaatcatgagtgaactcccattcacaattgcttcaaagagaataaaatacctaggcatgtgaaggacctcttcaaggagaactgcaaaccactgctcaaggaaataagagaggacacaaatggaagaacattccatgctcacggataggaagaatcaatatcgtgaaaatggccatactgcccaaggtaatttatagattcaatgccatccccatcaagctaccaatgactttcttcacagaatgggaaaaaactactttaaatttgacatggaaccaaaaaagagcccacaaagccaagacaatcctaagcaaaaagaacaaggcttgagagatcatgctacctgacttcaaacaaggctacagtaaccaaaacagcatggtactggtaccaaaacagagatatagaccaatggaacagaacagaggcctcagaagtaacgccacacatctgcaaacatcttatctttgacaaacctgagggaaaacaagaatggggaaaggctcctctatttaataaatggtgttgggaaaactggctggccatatgcagaaaactgagactggatcccttccttatacaaaaattaactcaagatggattaaagacttaaacctaagatgtaaaatgatgaaaacccctagaagaaaacctaggcaataccattcaggacataggtatacacaaagacttcaggactaaaacaccaaaagcaatggcaactaaagccaaaagtgacaaatgggatctaattaaactaaagagcttctgcagagcaaaaaaaaaaaaaaaaaactaccatcagagtgaacaggcaacctacagaatgggaggaaatttttgctatctatccacctgacaaagggctaatatccagaatctacaaagaacttaaacgaatttacaggaaaacaacaacctcatcaaaaagtgggcaaaggatatgaacagacacttctcagaagaagacaccgatgcggcagacaaacatatgaaaaaatgctatcactggtcattagagaaatgcaaatcaaaaccacaatgagataccatcttacaccagttagaatggcgatcattaaaaagtcaggaaacaacagatgctggggaggatgtggagaaataggaatgcttttacactgttggtgggtgtgtaaattagttaaaccactgtggaagacagtttggtgattcctcaaggatctagaaccagaaataccatttgacccagcaatcccattactgagtgtatacccaaaggattataaatcattctactataaagacacatgcacacgtatgtttattgtggcactattcacaatagcaaagacttgtaaccaacccaaatgtccatcaatgatagattggataaagaaaatgtggcacatatacactatggaatattatggtgagtgagtattccataaaaaaggatgagttcatgtcctttgcagggacatggatgaagctggaaaccatcattctcagcaaactaacacaggaacagaaaaccaaacactgcactcaaaagtgggagttgaacaatgagaacacacggacacacggaggggaacatcacacactggggcctgttgcgggtttggagtctaggggaacgatagcattaggagaaatacctaatgtagatgatgggttgatgttgcaccaaaccaccgtggcacatgtataattaaattatgtaacaaacctgcatgttctgcacatgtattcaggacttacactccaggagcacagacaaacagcaaatgtagtagctaagaaaattatacaatcacagggagactttaaaaaaaaaaaggtgagcaacttccggtttcaatcttcttttgtttattgtgatcagatttaagttgtgcatgtgtggaataggaaaggtgtctctgccattggtggggcctggtgccttttctttatcaccaggaatagttggtgagtttactcaaaatgcactttctattttcactcacatacctagcttcaaattctgaaagagcactattttttttttttttaaacggtggggcaggttacactcaagacctagagatttaactgctgccttgaatactgtcaccttcagaatagttaatataactttctgggattaacaggtctgtcacctaggccaaccctcctgctaaccaatttctctttcacttaaggtcaacagccagggccaggctttggggattagcagacaatctccaaacctaagtttggagaaagctgctttccagaaaaaacaatggatcaactaaatagctttaccctggagttttattcaacccacccactgtgacagttccaaacacaaggcaggtctttgaactgacctggtctcccttaagatgtgtttgtaatcatgggttgaaagtggccaaaggcgaagatatcagagtttatgcatagaacatcttacatcagggctgaaccttggactcaacaatccagataagaaatgcaggatgaaaattagccaacaagggtcatgggagcacagctctcatggacagacacattagcacactgaggaataagccatgccaggaatcaaattagaatgtgcaaagcttgtcagatttttctaaagaatgccatttgctctgcggttttaaaatcataccaaattaacctctgggtccatatgacctaaagggctttgcaaaacaacaacatatttagagcctcaagtaatgaagaagtcaaaaaagctccaaagagcatgagctgagaaggtgaatgtaagcacagccaaccaatcagtaaacacttcccagcacgaacactcaccaagtgcatccccaaggttgagctgccagatgttatgtttgaatgaaagccaaactaaggtttgtgagaaagcttgccagacagaggaaaagttactcttacatattaaacataaaaaaaaacgttctccagaatgaatgatttctctttgggacaacagtcaagtggcaagtgcttctcccagagagagagagagagaggtatcttagactacttttcagctaatggttaagagttgaagactgtgccaacttaccctggcatctgtgaccttgaattcccttaggatatactgtggcatgttgtactcagccatgggatctacaacaaagtactggtatcttgcagaccgttctgctggccagtattggtgacatttctcctaaaaggagagaagattaatgttaaactatgcaaagtataaagaacattctgtatattatctatctatctatctaatctatctaatttccttatcccattaataaaatttcaaaattcaaggcaattccaattgcatatgactcatttcctcttagaaaccatgagctcccttcatagggaaaccctttggttcagtatttgcctatggcatccagcacggtctctggcagatagtagctgcttaatatacacgagttgaattgagaattgaatactttcatagggtaagcatcttcatacctacaagttatccaaataattacatcagtccttggacaatgctggccatgacaataacacattgcaccaccacagcatacttgcaccactatggtttggaatgaagagaaccatcagtatggacatagaaagaaacctccgaattgatttgttccaatcttacttgtcaaggaaacgaggggcccagtccattttaatgacttggctaaaccctgcagagtcattggccaaatcagagtaagtcagttactttcctcgtctgatattctttttgttctctccgggggctctacaagttgggctttagctgcacttctatttaatttacacaaagaagacagaaagaaaatatctgaagcaaatacgaaataatgcttacatcaagtcaatctaagaggtatctctaaataatattaggtcatagtggtagagcagtattaatagtagaaaccttaagtatttctaatactattttatgtgtatttcaaaaaaaaacaaaccacttttttcaaaagtggatctgggattaccaggttatatccttagaaaaactatgttgctttccaacactttattcaatgggagtgaaaggtaggcaagtaagaatttgcctcaggaagaaaagaaagtcaagttccttcataagtagaaatgatggcacatcaaactctagcctgtccagaacaaaaggcagtaagaatatgctaaaagaagtccgacataagtcaaacggggacacctgctactcatttgtctccatgcttgtgcttcactggaaacaaatcactagatctttctttaaaacacataaatttaaacacttgatgtggctttacaaatttagaaactaacaaggaatgatggtccggattatgtccagagtgcactgcatttcaaaaaaaatgatctagcacaagagttattgaaacaaagtcttcatttctccacagagtaaatgtcttatgaggagacacacaagggccacacacttactctgcccatttcacgcagcttggtgagcatcacaactatggtggaattgtgttcccagagcatccgccagaagtcttcagtggtctctgccaagggcccctgggtagcgatgtaggctttctgttgtctgaattacagagaatgaaaagaatgtgttaaagtatttagagaacatgcaaaagctcacactggatacataaacatcaacctgctaataaaaaacgaaaacatattattaatgcaattgaggtaaattcctgctaagattaaataatcaaataagagcatttaatacattttggggacttcgcaaactaaattgcttgttaatattatgatgtatgtctttatcattattatttgaattttagcgcaatgctaatagctcaatttcattgtcatacaaattacttaagaaacacttagatgtgcagcttcattttctagaaattattctcacacaatctattaaatttatgaaatatggtacaaaacagattctttattaactacttacatatccaattggcttatgaaagaagagtgcagaaggccagattaaacacttcataactactactcctaactcctatccaaaataacaaaaaaacaaataccaagggactaaatgatgacctatgcagaaagaaaatgtctttgaatggagatgaaatttattctggttattaaactagggcacatgtaaatatcaaggctttggatagtcaggggagcaaaagtagatacctgtatccatcaataaaactggcattgatgtaatcagatccttctactccacggataggctgcaggcatacccttgtggattcatatggcataatattaacaaggcgatttttgaatttattacatggaagattggcactgataaaccttgaggtgtgagcttttgagctggctagacgctgttgaataggaaaaaaaaaaaaggaaaaacccaacaaagatcattttcacctacagtttgaatgcagtgtaccccagatttcccttttagatataaatcttttgtttacttaaagtaaatgactattcaaattgtactgcttttcacatctacctaatcactctctatagcctattggatttctatatattttctgaaagtatagtctctcaagttaggagacataagggctcaagatattgttaggaagcaaagaatagaagaggaaaaggggaggaatacattttataatcatacacctgagggaaaggtcaaatgaatcttgtacttcacaaatttgaaaggttaaagtaaagccacgactcaaagacaaacccagaatgacttgctcctgaataaccacatcacatccaataccataccttaaattcgagctccattcctgtgacattctctcccgtttctatttgtgtcagcttctgaatgtaggcatacaagtttctagctggcacttcggtatttccacaagtcactgcttctaacagtgcatcatggataaagatgtattggtcttctgtttgaaccatatagttcctctgggctctcattaaagttacatggccataaatatctacagttttttcatgctttattctttctaacatggcatctatgacgatgaagcaaccagtccggccaactcccgcactatgaggaaaatagagaagaaaagcccaaataaacctatcagaaaatcaatacataataaaagtatttttattattcttattaactagaccttacatccattacttctactcaaatagctattgggatgactttgtaatactctaaagtcaaaagtattatctaggcaccataatcagaggacagggaacaaaagactgagtaaaattagtttagttttaaaatgtaaaaaatattaaatccataatcactatgttccttgatcatgcaatacaaagtgaacattatttcgaaaacttttgaagtcattatgaaaaaaatacaaacatttagtctgtccatatttagaagatagttttatatattggtccagatctggctaggctatagttcttgcaaactctctcaatctgttttcgtcccatgtacaaaacataaagattgtttttacagtctcaagctaaacctcgcatgcttcctatttatcaaacccttcaggctgaggacatttatgtgtcaagtatggttcaatccaaaatactttctcttcctgatcatgcgggtttatcaggctggtaaacatgtcatcaacaggaataggtatataataggtgtatattaccatcttaggtaacaggcaacagacagcctccttcatttgctacatgctatgtttcctgtcatctgtgtatctatgtgttcatttattgtccatccctcattgatctgtccatttcttcattcaataaacaatgaagtactctgctaagtgaaataggggatacgacataaagatgacttagatgctatctctaaagagctcagagtgtatcgaagggacataatactttatacacagctatttctaaacaagaaagaaaaaggatgtattagttttgtatatgatgtggcatttgaagtaggacttgaaggacaggaaggatgaggaattaaagatgttgtagtatgaacaaaggacggatggctttggtaatcacactgctggctctgggagctacatgtgaaattttcataggtctggcaaggcacctttgcaacgaagataccagaactccaaaacaaatgagttaatgctcaccagggtgcctgtctcaactgaaatggcagtttctgtttggtatcatagtggctgcaaggcagtaagagatcattttttttttaaacaaaataatacctttatttaactgctgaacagtgtatatcaaagctagcttgcatacaggagctctgtggtttacagactgggctaactagctgggaatttgatataaccactactttaaaataggttacttttttatgtcctatgccagagggctcctgaatactgatgccaagaatccaatcccaagtataaacccacaaattgacatgacattgatatatcatgcaaaagccttctgagacagagagtcctacaaatgatagcacataccttagcacagaccaattggcaacctgatgcaaacattaatatagagcaaagtcggcctggtggttccagttccttgagatccatgaagtctcattttatttagttggttctaaagaaacctgttagatggcgagttttccctgacattccccattcctaccctcccaggtggttttaatcatcctctgcctcagatccctggttgccctcaaatacccctttactacaattctaaccaaattatattattaatttagggcagccatccataaacaacagcatacatcttgagagcaggaactgcattaaaaaaaatatttgtgtgccctacacaaagcatgcagtaagtgctcaacagtgtttgtgaaataagtaaacaaattagtgactggcttgagatgcctgcagtaatgagcagcccgtcccggtaaggtaagcctacttaggaagcaggactcttcagaccatgcaaaatcctacatttgacaagggtttggaattatgtaaggagtacccgaggactcctctgcatagtgtttgatcaggaataaagagacaggaaaatcactttaagtagtctctttgctggtctcctgatatgccatcagattgcagttaaaggaacctaagtcagactcaacctggaaaagatttgtctttctgggtttctttcaaactccatgtttggcaggtcctgagactccaagtaacatctttcgttctttctgtgttgtctttctaaattgtcttcattgcagctgtgaatcgtttctcatggacacagttttatgcagttcttcccagtggaaaccacactgtaaaccttagaactgagccctatacatcaagtcaattctagataatggcaggactattttctcaaaatatgcatcagggaccattcaaatgtctggatgatgcatggttctatattctggcagaaagatactacagaatcttgcaaaattggtaggaataactccaactctaaacagtatcaaccttttcataatggtgattttttttttccaaaaaataagggaaaaaaatcaaatacgtgtgagtccaaatcatgaattgtgggatgaaaagaaataacagaggctatgacttgaacaaaacctattttttcccccacaattcaaaatattgttaactgcccaatcctgctattcatatggaagatagggaaggagctgacgtttggaacttaatgtgttaccttcttctaggatgaagaattcttgagggatttaaacattaaataagtgttttcgcttgaagcaagaccttgaggcttaaggtacctcttcagacatcaatggctgtgtgtccttgagaaagacattttaaccccttccttatattcccatatttcttaaatgatagtgacagttaactcttattaacgttaattttctagtgagtctaattatccagtaagtcttaaggctaaattaaaaataccaagtgttttgcaaacataatggaaaaggcagttactttctaggtacaaactccattttaacattcagtctctaaagctgacaatgagaaacaagcaatgtaatgctgggaaaattatgacagaattactttagaaacatttgagatttggcttttaaaatcttgctttcgtctactctctcaagctgctcttcctttcctctgccttctttccaataaatgtgccttatacctgaggagctttctgcgttcacatttatcatcgtggcaaatgagatggcaggcaagggccttcctaccacagtgcttgacacctaagaagcattcagtaaatgttggtttcctttccccttctctgacaacacttgggaactgccctgaagtcctacagtcatgcacgccatacctggatagcagagaagactcaaatgcaggttctgaggtgttaaaatttagcaccctgttcccagcacccccagtgcttcacaatgctttccaccatttaggtcagcagtcattgccaaatatggtgactttcctgtagagcgctcgtctgtgatatttcattggcagcatttgactatccctaatgcaggttcctagaaaagctttctatccttggttttaaggacactagtcaagggagtatgggaaacatcagatactcccttggggttaatggtagcaagggtggagattgtgtcattactccagacacaaaataatccaaaacaggtagtacacgaaatcagcccaaaataattgtatcatgatcctgtatcacggttccattgattctgtaacagggtagaattcctaccacgtttgaaatcgaaatcaaagatgaactctaaatgtcatcttcagaaatctactggcatccgttcagactgtgcctcagtatgtttcgttttgttttttttatttgactccagtgctaattctctacctgcctctctggattcttccatctgtatcaatttcacggattacatatctctgccagtccccaaaatgtagataatgctccaaaagttctgtccttctttctctcagtagtagtctccaaaggattcctaaagtgatgcctttctttttcagcacaagtggagatctatatttcaaactgtcttcaagtttatcaaaaataaagattctaagcttaatcagtatcttctcctttcaaatctgctcctcccactctcaggctctccttgacactcaggtttaaaactgaaaaatcatcttagactctttttgcctcttaccctgcaaaataataaattataaattgttatgtattcaaactccacgattatcttcaactccccatcagtggtgtgctagagctagcaaaagccaatccttacattttcagggattatttgctgaaataaatatattaaaaataaaggtaatatataaaactcattgtttcttaattgtttcaaattattttatgctcttgaggtgaaaacatcatatagagtagtccccttttatctgtggttttgactttctgcaatctcagttatttgcggttaaccacggtctgaaaatattaaatggaaaattccagaaataagttttcaatgacatacttttctgaaaagtgtggtgaaatctcaagccctccctttccatccagcccagggtgtgaatcaatccctttgtccagtgtatccatgctatacaggctgcctgcctgttagtcacttagtagccatctcggttatccgatggactgccctggtattgtagtgtttgtcttcaactaacccttattttacttgatggccccaaagtgcaagagtagtgatctgggcaatttggatatgccaaaaagcagctgcaaagtgcttcctttaagtgaaaaggtgaaagttttcaataaggaaagaaagagaaatcgtatgctgaggttgctaagatctatggtaagaatcaatcctctatatgtacaattgtgaagaaggaaaaagaaattcatgattgttctgctgttgcacctcaaactgcaaaagctacggccacagtatgtgataagcacttagttaagatgaaaaaggcattaaattttgggtgaaatacatgaacagaaacatgccatgactgatggcaagtgagcttggtactctctggggactcaggcatccactggggatgttggatcatatcccctgcggatagagggggactacactaataatgtgctggtgatcgtctctctctagtgacctcatgtttgtagcttgaaatcatccatgggaatatttacaccaaagaaatcaggaaatactactttttttctccccagagagcaggtttttacatatttaccagcacatatgactatgctaaagcatccattcccaccatccagggacaaagaggaagagttcctaactttgttcttccatccatatttgttgtattttcatgactctgtcgcctactattccacaaacatttactgagtgcctaccatgtgctgagacatcgaagaaggaatgagcagaacaaacgtgatctttcctgtcggagcttacagtttagtgggggaatctgacattaaataatcacatgaataaacatctaattacaaatctcaagcggcgctgtgaggcaaatgtgaaggatgctggtagagcacctttgaggaagtgccattgaaactgaaatctgttatgggctgaattgtgtttttcttctcaaaattcatatgttgaaacgctaacccccagtgtgactgtattggacacagggcctttagggaggtaattaaggttacatgaagtcacaaggtgggagctttaatcagataggatggatgtccttgtaagaggaagagacaccagagatctttttctctatgcatacacagaggaaaggccgtgtgacggcacagtgagaaagtagtcatctaaaagccaggaagagaggcctctcctgaaaccaactctgccagcaccttcatcttggacttccagcatcctgaatggtgagaaagtaagtttctgttgtttgagccactcagttcggagtattttgttatggaagccccagcagactaacgcaatacctaaaggtcaagtaactgtttgctaaataaagagggtggaaaagcttttgaaaagatatcctaaaaaaaagtgctagaatagacaacatagcacatttgaataactaacagaaagccatcggctgaaaggcagtgagggaaaaagagggcatgttccacatagttattttccattttagggactggctataacatttttattaaacttataaccacatcagcagcatttatttagaataattctgcctcacatgtttcacagtttatctttctgacatggctcatctattcttgagtttattttgatgcatctattggttggctggaatatgtctttgaataatgctttatataagatatgcatggatgccactttttctgatgccttatatatctgagaaaccctttgtgggtttctttttttctttacatatgaccaacaacttggttttgtgcaggattactgggctccaatattatctcttcaaactctaaatacattgcttcacggtctttgttgtcctttgacaaagtcataggccagtctggtttctggtcttttaatagtaatttttgccccaagtaattgggggttgtttctttaacttggaggttcaaaaatttcatctagatatgctttaggcattgatctcactgttaaaaccgcagggccctcaggtaatattttcattacaagattcttggctgttcctcagcactagttcaaattaaacatgttttatgctttcccacctctgggcgtttgtgacgctggaccttctacctccttctcatctgttgacatgtactttccttcaagattcacctcaactgctgcaccctgaatcaacatttccttttgatttattcctccttggactcttttgacaatttataactattttttcagcaactgccttactttagttttgttttctggttattatccttatgccagttggcgctctcctccagggaaaagacaacagcttcgttgtctctactgtttggcaatttccatgccagggaaattgaaggtgctcaactcgagtgacaaaatttataaaaaaaaaaaatttaaaaaactttaaaaataggaagccctctcccagatcaataacacataggggaacatttccccgaagcccccagcatgggaaaattcctttgatacatgtttacaaagataaagtaatgcttataatttgatgagatgcaaacaacctgtgcttatgcttcactccaattgctgagaaataacaaacctccggcacttatttttccttaagaaattgaatgttgaaaattcagagcttttaaaagtatcccagcctacttttgtttgaatttccaagttcccacagcagcatatatttattttgtttccttctccaatttactctttttttgttcacccatcagtatctgagtgcagtgcacctctcaaaatgaaggattgtacttctaaaagcaaatgcatttttctttgatcctgaaaaactcagctctccattgcagtgataatgacggaaccctatttagtgctgtttgtttttcatcatttcaacagccttcaacttgaaacatgataagaacagcaaaactgataaaccacccttatttttatctgttttctgtcagagtagttgccaagcactgagacagatttttctaaatatctttttaaaaaaggagtgcataaccctgtgcttcaggctgaggccagcacaatttagtacatttattatgttatgttacagaaaattccagcaaaaagagaacggcaagtttaaatggagtctagcattatgttggtctctgttatccctaaagtaaaatcaactttttattttccggtgaggacaactattccactaatgagaatcagaacacaaactctatatttgtttgacttcagcagcaaaccaaattattgctaaactttagtggttttttttttttttttaaatttcagtaagtgatagacgttccagtgtttacaagctgaaagactatgcaatccattaaacaagtatgcctactaggaaattgttattacttcaatattatcattcatccagttacaacatttgttttcaatttctaaaaacatgattgagttagtcccacgagttgaaacgggcttaatgtcccgtgatgtgatacagtagtaatgtgcaaaaagaaaaaattaagaggcatacagggactgttttatgctaaagtcattctggagatgtgtttaaaagttggcttttctgattaatgtggtggagttttaatgctgaccctttcctggtacttcactgatctggcaaagaaagacaatagaattaggatatttcacacatcatttagttgggtgccaagacagtaaaatatggactaaaaaaatcattgtgagcattttgtacatatgtcagcttataatttgattggatatagttcacctatcataatggtatatgaactacaagtatttgacatctatgagaaaagattgagttttacgactcaggtttataagattaattaggtgactcttttaataaaactgtgatgtgactctgatgaggctgccattgtgaaaaccttctttcattctttgataaaaatcaacatttaactttataagcagatactgggcatctctacgatatttggggttcactacaaaaaacagacccacagataggttagtttcttctagcatctcttttacctaggataactagagaaattatattaatttctttgacaaaatattcagctgtctaacttttatatattacaaaattaaaatgaaaaaaaattgaacaaattgtcattgatacgcagtcaaatttgtccatgctattcaacatacactatatccctatactaattaatatatagtagttatagcagttttaaggggtagttttgcaatcttcattaaaatttcaaatgcacatactctttgacccagcacctccaactctagaaatctagcacggaggtctatctacacatatgcacaaagagagtagaaagagattttattgtagcattgttgatgtagcaagttaacttagtaaaacaatcatggctagggaactagttgaataaactatggtatatcaataccatggatgtgatgtagcagttaaaaagaatgaagcgaatccatgtattgaccctctccaaaatagcatctaagacattgtcaagcccacttaaatatattgcagaacaatatatataacataacaccacttacattgttttaaaagtccattcaggattacatatctctatttgtacacatgttaatgcacaaaacatggtctgaaaagatacacaaatcagaatagttctgagaaggatcggtaatggtggcagtacagataaactttcactttagttgaagtatttttttgtagcttttttttttaacaaggataacataataatctaataatggaattaagaagaaatataaagcaatgggtaaaaagttactataataaatatcataattacagttcaataaagagttgaggctccaaagacacagagagaaaagatggaacctaattaactctagctcaggaatactgccttgctcagtgatggactgtcagaagtctgggtgatgttggcagctcctgtgtagcccagacttagtcctgccatctggtgctggcttttaaagagtggatatcagaaagtaaggggatataggagtcattgtagagaggagactgcttggcaaagagtaaaaaaaaaaaaaaaaaaaaaaaaaaaaaatctagagttagggagatgacccagagccatgatcactccagaaaggtaaaatgtagtacacttgagtggtgtcttctgaggataaaggaagttcacatttcatcaacagagaaggggcagaaactaagcacaaagttcccaaactgcctgataaggatccttgtatagaatactgaaagatcagggatgagctaccaggttatatccctttgggtgttttatttttccatgctgggtgaaaaggtaatttcctaaaaaaccaaaactccgtctcgagaaagaaaaaaaaaatccacatgggcctaatctgattttttttttttcaaatatgtagactcaaactaaaatcttccaaagacttctgcatgatcttggctttgtcccaatattatctgctgaacacactccctattattcttaaaatgtgattctcatgataaattagaaggctaatgtgttcgcgtaaagaacacctgaatatgccgcagcaggtctcattttacagatggatagaacaggccattaggcatggatagagcagactcagctggctctgataattggtagttgacttgaatctgaatagaggtcaatcaaatgatgctacggaagtttagagaactatatcattcacacagagattttccttgtaaaccataccagctcactccgtattctaaattctgtttagagtgatacaaaattgcccactttttgaaagaggagacaaccatttaccaggcctgccaagtaaagctgcgtgggttgtatactgctcaacccaaaggaagttacaatcacatggactacgtacaacgtgtgcaacctgctcagtccacacagcaggcttgtcattagaaatataaatgctattactcctgattcaggttaagcaagattcaaagagaggagccactggaaggtacttggagggcatttgaactttagcaactttgattagtttgtaaggcatatcattttcccacacagacaagattttactatgtacacaaatgccaggagttttttggtttttctttttaaaaaatgctattattgcccaggcatggtggctcatgcctgtaatcccagcgctttgggaggctgaggcggacggatcacgaagttaagagattgagaccatcctggccaacatggtgaaaccccgtctctactaaaactacaaaaattagctgggcgtggtggcacatgcctgcagtcccagctactagggaggctgagacaggagaatcgcttgaacccagaaggtggaggctgcagtgagccgagatcacaccactgcactccagcctggcgacagaacaagactccgtctcaaaaaataaataaataaaagaaaaaggctattatcgttatttaaatggtattgtccaatagtttggaaggctctaaatctgtggttccttgtttcattttgtccttttgtttgactcctgcaagcttttataaggcagtgagaatctcactctcaatacaatcagtttatgattgtttgcaacaccctagcaacctccagcaggcctttgtgttggttttgtagaggcctgttatggcttctgatccggcttcttaaactcatgggtttctgaattatgaatcagtatgcctatttatttatttatttatgaatgtatgaatgaatgaatgaatgaatgagatggagtctcactctgctgcccaggaggctggagtgtgctggtgtgatctcggctcatcgtaaactccgtttcctgggttcaagtgattctcctgcctcagcctcctgagtagctgggattactggcacacgccactacacccggctcattttccttatatttagtagagatggggtttcactatgttggccaggctggtctcgaactcctgacttcaggtgatctgcccgcctcagccccccaaagtggtgggattacaggcatgagccactgcacccagccagtactgcccattgcctcttctaacccttttgcctactcacattcgtatacatatacaaatttgagactccttctcaaaaaaaaatatatgtatatatgtatatatgtatatatgtatatatgtgtatatatgtatatatgtatatatgtgtatatatgtatatatgtatatatgtgtatatatgtatatatatgtgtgtgtacatatatatatatatatatatatatatgtttttttttttttgagaaggagtctcactctgttgccaggctggagtgcagtggtgcgatctcagctcactgcaacctccacctcccaggttcaagcaatcatattttttaaatatgtcttttatttattacataataaattgaaatttttaataccttatttatatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctcttttagaatattttggtctatggttgaccttttagttcgagtggtatgcatacatactgacgaataaataagagctagtattaagtgtatttagaataacctactggtcatgtttaaggatgacagtagagaggacagggtttgcctctcatgcagaataatactagaagatgggaaacagttaagagactgtgacaccaaagagctgaaggttaatattcaataattcaactcaatggatgcaaaatgggagattcctcttctatgtatcaatcgccatgcagtgtaccccaggcatatatacattatatgttcaagtagtctgaacatgctgctagggactgtgagagcacggagacctgggctctgtcccagaggttcttattcagtaagtctggggtgggaccaaagattgtgcatttccaacaagttctaaagccatgctgatatggctggtcgctgggccacactttgggtaatgaggatacaggcacattgctaacatttttatatgtaaatacagacaaaaaggtgcacagaatacactcataataatgtacatatgtgtgtgtttacatacatacacataaatttaaaaaaatcaaaatctctcattcataaggattttttgtccttagcaatgtaaagttcaatggaaaggagagaccgcaaagggctgctttcaaaaacgcaaagtttgcttttcattttttttaagaccaaatactttactatctccagatacctgaaaatatatggaattatcttgtaataaaactcagatgcccaaagcccaccttttgagttttctttgcaagaaacaaccccaaatgcgagcaaatcagataccatgtaataagacctaaaagtatttttccaaagacagaaagaaaaatatctaagcaatagaacccagattggaaagacaccaaacaaagataacagaactatttttaagcctcattttatgaccaaggggcacagcaaaatagtttgaaatagaaagttttcatgctgattacatgaaatcaaaatacacactgttcaaaggcagccaacattattattttttaaatgcagtctagttcatgcaataagtttcagtgttctttcagtctgggaacatttcaaaatacattgcaggtacagctgggaaaactcagtgatacccctgtccagatctcagctattaggttataaaaatattttcacatttcctgcagatgtctagattcctttctttggtagtaattttaattcagacctcattattgacagctgtttgttctgatagaacttaattgctcttctaccagactcagctgcaggcaggctgatttcctttccttatagagtatattacatataaacacaggcaggaaaaaaataaccaattaactaaatacgtgtgcataaaatgattcattgagagctctgatcaagtaatgtatccaactgcaacataggtcaaaggaaattacagcacttatagtttacagtattaaatataattatatagaaatactcaaaagcactaaaatatatagatgatgagtggcagcatctgaaaatctacttttatcaaagaaatttataaaattactatatttgagtaactggaagggtatttattctgctgacggattaactcatggatatctattttacataagctatacgctacaaagaacctgagatgccttccataactgacaaagtcatgaggaacccagcatgctgtgggatcacactgcaatgccaacaattcttcttcgaagggcagagtttctggggacacaccaactcttttcctcattctccagtcactgctgtggatgagctgcttttcctaactttaccagaaaatgaatacaaattctttgaagttaaagctattccctctgtttgaagacaatgcctcattttagcagctcaccaagagatgcaggaatagcttggcaattttcattctatcaaatgccttggcagcctcactcatggagtctaggcctatttggagaccccaagctgccttccttactggactggaacccctgaagagggataaaccgagggctgaattcatcaaagaacatataagcagcaaatatactgcatttgagacaagcaatagttccttttattggctctgtctgttttggaaatggagagaatgtggtgagcagggaagaacaaactgctccttagtaaggaacccactcaaggaaaatgaagtttttttcttaatactagggacgctatatggtgcatcccttttcggggccaataaatgcttctctttgcagacttaatctacctcatatagggaggaagatattgggaataggatgcttattaccctgataattctcagggatgcagcatacatttccattaatactaggcataatgctaattacaatgcaagccccacactcaacatttacaaaccctgacaaaatgaatgtaagtatcctacagggtttggtatccacaaaatctggtcaatagcctactcccagtccctccctttcccctaagtaacaaaggaaaccaatacttcttggtctttgagagtaattctactaagtcccgtattttttagtctatacatacagatcattatacccttcagattcttgcatggtatgactcctggcatcgttttggattgtgacacttctactctaatgctcactttatttagtgtctgtttcacacatggcatagttctaagggaggatgcaatgtgacctcatagacaccatctccaaccacgtatctctaacggttgaaagttacagcctggggaagaaattcagttttggctcatggaattaaagacttactacactttaaaattccccccatcatttttttttttcttgaaggttcacttcttactggttaaaatagtttaaacataatttaaagtcctgactgagttgatgatactgactattttgttttcaattaagcataacagagcaaatggtctttgatgtgatgtactcattttatgaaagaaccaggctggcaaacaaaaattttatggaatttagagatactaactctggctcttccacctgcagcttgtatcttaaatacatcatttatttattcttccagagcctctgttttctcacctgtaaaatgtaaacctatttcctaagttttctatgatactgtcagcaaaatacattttaaataatagcttcttgatcaatgttaatttcagtactcttttttctatgaattgaggacctagaattgaatattttaattcagttagcctaaccacagagtagatatgcaaccttcctattcttgcatagtttattagacttctactaataaattttatgaaaccaatatttaactttattttctggtttaaatcctctcaggaaaaaaaaatgtaatataaaattgaatcagatttcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccgagattgcaccactgcactcccacctgggccacagagcgagactccgtctcaaaaaaaaaaaaaaacaaaaaaaaaaaaaaacaaaaaaaaattgaatcagattttagattcggcagggatcttagagatctggtggttctcaaagtgcggccccatgaccagcagcatcagcagcatgtaggaaactgttagaaatgcaatttttcaggccccaccccaacctagagaatcagaaactcaaggggtggggtcaagcagtttgaattttattatttcattatttttgagactgagcctcgctctgttgcccaggctggagtgcagtggtacaatctcagctcactgcaacttccacctcccaggttcaagcaattctcttgcttcaggctcccgagtagctggaattacagacatatgccagcaaatttataaaataattataaattttatagttttagtagagacagggtttcactgtattgcccaggctggtctggaattcctggtctcaagtactccacctgcctcagcctcccaaagtgccaggattataggcgtgagccaccccacccggccagctatttgaatttttaaaagcccctaggtgattctggtgcttgctaaagtttctgagccacccatcaagccattctcttgcattttacaggtggagagactcaggaacagagactaaaataaaatctctgtatttcagttgcattgctttgtttgtgtcaaagttctgttttcctccccttatctcaagtaccacttagtgtttgttccatcatttcttcctttccttaggcatatggctatcaatatgcatggtcttatctgacttccatttaaccaatttaactcaagctttccttttcctccaaaaagctcctcccattgcttactgcactaggtcagctcaatgtttgttaggaggctactctccaggttgtctgtggctctagaatgtttgtggtgtcatcatgtttattccaaaaataatcagtcatttcatttaagtaatgtaattcttagataaaatgacgagatatagttacaaaataaatgagttgtttctgtaaaaaccaagttaattactttggaaagatagacgtaaaagtaatttgtgtcccgtcatagccaataaagtaccattgaattaggtaagggtgacacaactgcaggtaaatggaaaaatatttataaacatctagatggattctaaagttgcttaactttagaaacaaactactgtttgctgttgatattaaaaacactaaatctgctaatcattggtcatactcaaataagagttcttagtcccaaattttaaaaactggtgaatctaatatacagttatgcatttgaggttaatgtcaactgtatacatacattttagggttctttgcttcacttgaggttttgtctaaatgatcaagtctaaactgaacatatagatcaaggttccttctgaatggtcttgattgctttagatctcttcatatatgatgattaagctttttgaaggagataccatactctataacccacagttttgcacagtgaagttgtaataaatatttactggttatatttatatatacattttattgaatgttgctaattgattagccaattacacttagtagttcatcatctcgttttattactgtgagccaaattatccaggctatgaaacatttcttttatgatagcacttcctggagtccttagagaaattccaaggggggacaaatagttctataaatttcctcttgaaggctcacaatgcattaggctgagaaaccctgctgtaaagaaaccagttaaacttacttttacccatacttatttgactacagaaattcacccccctgcatcaattaataatccatgattcaatgtgcacatatattgatgaggtatcccaaattttctaagtgattttcattcttatgttcaaacctttttttctgtttctgtagattttctcatacttcttataacccagaataggtgtgaattatgtatgccaattatgaatgcgtcagattaaatggtcaacatacggatttgtaaaacttagattggtaaaactgctatttttttctattttcttctttcttctcaatgaagtagcagaacattttaaatctagctctgctttcacagattaaaagaaaaattttagcaggggaatgtgaaacttagaatgtcaaataacaggcagtggtggaggctttgatgaactgagcctaattaaaagtaaaggtgctgagtgaaaattttaaaagactgcaagccaaatgttgctaaggacaatttggggtacaagctttccaaagagggaggtggttttaatactctgtaatcattttgaaacttcatgctataaaagacttcagatgtagaaaagcagtctaggtatcagattataacagcataggacacctagtctaggagcactcaacctggagtcgagaaagcagtaataaatgccctttacactacctctgtccatggaaattgaatatttacctgagataaggttgcccaggctattaaaatctcagatgttgaatggcagttatgtaatgagtttctttgaaaaacagaaaatgaattgccatttaacaaacactgcctggaatgttgataattgaagctgtgtgatgcgtgcttgggggttcattatacattctctccactttggggtatgtttgaaaatgaccaaactaaaaaaaattctgaaaaaacagcctcctttgttcccgcttaaggtaaagcactttctaagtgtacagaagtcccccacagggcagaaataacaaagaggatcgtgttcagacccactcaccttcttccaatagctaggactggactattggtttcttaagccatagccaaactgtgatatggtgaagctttagcagaaaaccatgtgacttgatgagattgcccatgcagaaatgcaggcaaagaattcagcaagaggtatgtagaccaccttgggaatttgtacctttgtacagtatgcaggccacaaagcttcactctaaaaatgacttacatgtagaattattatctcagattttaaagatgtgtttattcctaagcctttagaaaatataaacacaacaacaaaggcatacatacctatctcttgtaactggactacattcacagagctccttactaaattctggaagaggttttgctaagcttgtagctttactattgtaccctacaaaccaataagtttgagtttaattgaaccaagatagcaaatggatttcagactatagtacctcagagaaaatagtctgaaaccaggtcaatcattttcagacacacgaaagagggatgaaatattaaccatagattgtagaggaggatttttgtggtttgtaacatgattggttatggtttttcaaatctaagtagcaagcatgagtccagactgagaaagcctctgcccaattgattagaattggagttggttcaggttgacaaagtgagagtttaggatgtgaagaatgactgaccacctataaaccaaaatttggactgaagttgtttcttcaaagaaacagatttctagaaaaccaatcaccatcatcataatcatcatcagagtaaacaagcatttaatctatctgattttatccagttttcctctgagaagatgccattggcaaatgaccagactgttctctacctttctacagagctataacttcagtcaagtgagtgacttgcacaagatcatacagttttatccaatatctcttatttttctacatttctacaattatcatttttttgatcctgaaagctaagtatgtagtgaaagtcatggaattcagagttgtttttattaagacacacttaaaatgaagatttaaagatccaggagcttgatttatcagtttaacattttaaaattgcctactatatatgcaattgcctactgctttaggaagtatttgatttttactagggtttttgagcatgtgtaaaacatagattatatctggagaccattcgtggtctctgtttgtccatacaaaaatccaacaaccctagctcttgataaaatttggaggcttaccattgtgaccatttgaggttgcatcttatatacatttatcttctgcattcatttacagtattcactcttagcttggaggacagtataatttaaaaaacccagcatcttcaaataatctgtatttagacaacacataggtcaaatctcaatataagctctgcttcagtgacaaggaggagccttaccgcagtgaagggaaaaatcacagaaaaaggcactccaattcacaactcttctatacacatctaggggtagttagggattcaagaggaaaaagcaaatcaaccaggtgaaaatggcaacaacaacaaaaaagatcaggtggctgttctgaaaaaaattaaaaggccctttttcctcctctcttacctattttatagattgaccaaaaaaccctcagtttgggttgtacttgggggttttgctcttctcatccagtcctgtgaaggaaattcacattgcacttaactgggtgatcagaatagagcagtgagaaagaaattaataagcctttgcaggctgaccaatgtcctattggggctcaaaagtttgatgggataacttggaaggtccagcaacttaggagagtttgaagacagacagcccccacccccagctatgttttgtatccaaaaagaaatttttgctagctgaattcatcatcatttactttgtcctcagcacagagactgcttgcatatgcaagcttttatttcaaaagggattctcttctgattttggtgtcactttatacatttctgtaacaagaaattctctcggcagctgtacttatgttagaaacacaaatgtaccttattaatgccagttatcaaggcaaagggtttgaaaatacttgctaaacatttgtttatttatatacaatatttcagagttttacacagctaaatactggcatataacaaacactgtgagtgtgtgaaagaaatataaatgattccagcagatggcatggtcagaagcaaagggtttgcaagtgcaagaaatagcacaaatccaaattgagaaatctgaatggctgtaattgtaacacatctacaatggaatcaagaaggtcatttacattacgttaagaaatacagaagcagagtcttatataagcgtgttacacaaaatggagatttggcacatgggttatcattggacagtgtaccacacacagtttttatttcggttccagcagaaaaacaatattgacaaatttctttctctctttgcttcctactttatcgaatagaagaggtaacaatagcatctgctgcagctggctggagcctgagatgaggaaattgtagctgatgggcctcccaagcatatcgacactaaaaagctcatgctacagccacggcacagccaggctagcactccaacgggagcggcagatacacaaggcagccactgtgaaccagagcagggcctgccaagacagcatgtcaagtaatttttagtggcctgaagtggtttccaccatcacagctccaggcactgccgcaaggcaggacaagtttatctatctctgacatcttctccatctccctttggcatcgctctacgattttctgctgcggtagcctcactgaccaaattggtacccagtgcattcagggtgctccctggctacccatcagcctttcttcccattattcatgggcttgaagatctgggatgcttaattgggtctaatgtgtcaaaattacctactccaatcatcttggtgtcaaacataacacttcctctcaatatacaggtgctttctggttattttcctaatgcatctagaaaatgttaagggaccctttaatcaaattgatttgaacaaaattttaaggaccatactgcagtggaaaacatactagacccgcagtctgaagacttgagtccagcagaagcctatgggaaagctgtcaacctcattggcctaattttgttttctcaactcaactctgaaatttaaaaaaaaaattaaaaaaagagaaggctgcaggaggggaagtggtctgagagtctggaaatgtcccttccacggctatgattcactgtgaatgaatcatagtcctgtttctgagttcaaaaagaggcccactagccccagtaaatcttgaattacaggaagatgtaaagaaaatatttttgagttaggatgtaaggagagttaagagcacaagtttctcctacccacaagctaatattttaccagaagtaatcaggtagcagttatgaaatgcatttttgagaatggacttttttcctactttcttacctatttcacatactattcataaaccctgtattttggggtcagcttagggggcttggctcctctcatcgagcctggggagggaaattcacattgtatttagccaggctgatgagcatggagagcagagttccaccaatccagtaaataaggttcagcaatgtggcactcagaggtagaataaatgaggtcataaatgagttgttgttttcccatccaaaggtggagtatgcttccccattccttgaatctggaatggcccctgacttgttttaaaccaaggaatgcagcaaaagcaattgtctcaaaaggccttgtagcttcccctttgatgtcctcagaaccctgagcccactggaccaggatgaaaagccttggggagaaagagagaccccatttggctttcccagcccttcaagctgactgagaaaaagagctcaggagagataggcagaagatccatgtcctgccccaagtcaacccacagacttgcgagaaaaaacaaattactgtggttttaagccacagtgttttgggttggtatttgtaggtagcaatgctaactgacagacataccctccgttctgccaactcctgtggcacacaggtgtaccagaaacagaaatacggttatagtattttaaaatatgattcaatgctcaacaccaaaacaaatgaacaaaaacagagagaaaagaaatattctcaaaataatcataattctcatcatcctctccctttcagacattaaatgaaatttgagcaagagcaagtggctgtttaccattggaatggaagagccacagttaatcctgactcattttatctagttctttttttaatatactagagatatgacaaaccatacactcagcaagcaccactgtgcactggtgaaacacttaactgctgcctctcccttgatgaactgcaatgtagagaagaattttggggggaagtggaagaggtattgagggaggtgagatgggaagagacagaaaaagcaagactgctcatgtcccttggaagaaagtagacaaaaacaaaaaatgaaaaatatttaagtttttcataagcaactcatctttggtaaatttctgtgatttaaaaataagtgtgctgtcccagaaatctgaaccctcaaaaatcaaagggcaaagaatttcaggaacctgcaagcttgaggaggcagtctgacattatgactcactttctttccattcatctcatctgttatctttggcctccattaaacaatgagaaagggacagtcactaagtcatatgccacttgagggcactcctggggcttattgtttggaactgccaaaatgctggacgtcataccaagtgtgaatacgaagcaatgtgactaatatcatagcacaaaagactagcatttatcaactccaaagagcatggcccttaaaactagccactttgagaggacaaagatttaatgcaacgctgccatggtgcaaaaatatttttggaactccttcttggcagtagagttaaacgcctacggcctgttcttttgaatccagtaatggtggcacatctttgtccttgaaagtggatttatttatttatttttctagtgccaagagatacctggagccaagcgtatggtttgtatggttggtgaccaaggtaagaaacactattagatttcttttcaagtaatgagcctagttctctgtatgctttaaaaggttataattaaagtaagtctcacaaagaagttctccaaatatttaaaataagagttgcattcaaataagcattttttttttaagttagaagctttgaggtgggttatcgtttggacccaataattctgccaaaattaaaaattagttttattaccataagcagtggttttcatgtaggggcgattttatatccaaggggacatttggctatgcctaggacatgtttttattgtaacaatgtgggggaagggaggtgagggtggtgagcaaagcccaaggacgctgctaagcatcctataatgtataggacggctctcatagccaaaattctacgatctaaaatgtccaaactgctgaggttaagaaaccctgcttatagaaacaattggttctaataagcaaagcatttattttagtgcaatgatataattataacagtacttaacacatttttccgtgttaaatattccagttgccacccatcttctatgttaatgtatacatgcacatgttttctactcttctgaatcaacaattacgtagaactcaaactcacagtccagaaaatataatagtattctttgtggacattaacagagtcaatttaaataactgtgaggtaaaacaataatttttaaaagtcagtaactgtaaacatttgttgacttctttctatgtaacaggctaatgaatcactttacacggctcttatttaatctttaaaaccaatactatgaaagaaataccactattatccccacgttactgatcaggaaattgagtcttagaaagattgtttaatgtgctcgaggtcacagatgcagtaaatagtacagctaagatttgaactctgtttgttagaacaatttcaattgcagagttttcactaccatacaatgctggcccctaagagcagctctatgtgctaggagccatctcatttgtaggttagggacagttctacccccatttgtaggatacacattgagcaaaatggaaaatggcagtataatatacacatagatcagaaagggggttctccttctgattccgcttactagttaagtacgttttcttcagcaaatcacttaacttctcagggtctcaatttccttagctggcgagtgaggaaagtaataatgcacatctgccactcttatcataaacatcaaataaaataagtgatggggagatgctctgtaaacagtcacttacaacacaaaagtgagttggttgctattcttaggcacgaaatgggaacaggattggtgataggttctcagttgcccttgaaggaaccttcatcaaatagacctgatatatgattttgaagttagatagtattgtattactattggcctcacctctcttccactgcatttatatctattatgcttcttttcaaataaattctgcatttcatcaggcagccagaatgctcttcctagcacctcaacttctccattttgagttttacactttatacctactggggacactatgcaattccttttaatgcttttttttttttttttttggttccattacttttaaactattttggcagaaggaagatatttttctatcataggactgtgccatcaacagactgaagacccagcctcctgtttttaacactatgttgtttcataaactacgcatttgcttcttatacagaattattggtgtatgaaaacagaatctggcataatgggttccacatggcataattatttttccttaccttaaaatgtttccataaataaggacataatttgtacactccacccattcttatcgagatgttggcatttttaacaatcctacctttcatctacagaaggctagcatctcctattccgtaatttacacataaagataaaccccaggtttaaggaaaacatgggtctatggttcacgtttgtcagcatctcaaaactatcacatgctttggcaatacttgtggtctttgatctgaagagacatttgaatggaacattagaagaaataaaaatggaatttagaatgaatggttaaaaatgtattaaacaattttccacagcactcttagcttctttggatcacaaggtcttttgtttttatgctcttatgcaatgctttccaaaatctttcttttgactttgaaaaggccattttcatcactattgggttgggcttaggggtacatggttatgctatgaatatggcctacatagtttcctggttgtgcttccatatgcaaagtcaaaaagtattatgaagattggaacttaggagtttttacaaccccaaactggcatctgattttttactgggccattttagtggcctgttggtgcttctaggaccttattgctctctatgtggtatgcagtccctattccttccagttctgaagagtggtttgattctatgattgtgatagatttaagtgatactcaggaagcttattttattttccttgagactgtttcacttagaagatcaattcaggagttgtgatctatccccttttcaatttttttcataaataaatgtttctcttatgaatagaaagtcttccttttgtcttaaaaagagttaatgtgacataagatttagtatcatgggtcaaggttttataactgattcactgaaattacagctttttcccaatgtattcattctagtatcatgggtcaaggttttataactgattcactgaaattacagctttttcccaatgtattcattcctaacaaatgcaaatacttagagcaaatcagttgtcatgtccctctggtactagaatatagtctttatagaatatgtggtttagaataaagccacaaattattctataaaacaacataaggaacaaggctcaaaagtggaacaaaacggccttagtttctaagtggaagactaagacgatataggaaaatgtaatccatgacctcttaagaaaatctcagtttaataaatagaaagttctgccccaaaatcacattttataaataagataaaaacaatactatatgtctctattcatgcactgcacatatatatatacacacacacacacacacacacacacacacatatatatatatgtgctgtgaagagataatggcaaatatctgacaacctttacacatgtgcagtaaagagctaagtataagggactaggtggtctctgcaatacgaagagtaagaactggatataatgatgggtaaacaggccatggactttgaaatcaggatgaaatgtatatgctgtatgaccttgaacaaatcacttattacctccctgtgcggaatgctctttgcaagcaaaatatactattttctggattaaatgactgctcagtaatacttggaaaacagtaatggctccatgattggtagctattgtgattatttatgttccagtgattaaagaatggaaaagactcacatgctagcaattgcctttgatttagaaagagtgaaagaaaggccagaatatagcaatgtggtatggaatcagaaaggaaggagtggctcattctgaccaggtcaccagggaaggcttgacagagaaatcagagaaatgcccccaaagggacagcagaaaggggagctaaaaaccatcatgggacctaaagtctggagaatctgcctgatttatagggccatgcaacatggggaacataatggccttgccaccactagtagtatgagctcaggcaagcaagctgatcttacctggcctctgctgttttttcttctgtgaaatgggagactaaaattactccttgtaaattaccacgggaagcgaaaagcagtaacacatataaagcacttatgacagggcctcttcagttggcaagaaagattatttgatgttgaataagtgctcaactatcctgaactattagtattgctacaaaatggggagctatgtctaaatttaatcatggaatagatggtatgtgggaaagaacatgaaatgtagagtggtagaaaaaggaactcagaaatagttataagtaaggcaaaggcaatttaaaaagtaagctctcataaagaaataccccaatataaagggaaaaaaatatagtctctaaggtgaaaacacaaaccaaaaaaatcagtccagccttgaaactcttactatttttgtaaaaattactaaaatgccatatgtaattcaacaaacttggacaagcaattattgagtgcttactaaggtgtaagagctgggggtaaaaatgtacataagccatgactcatgccttctgagatctcaaggtacgtatgatctgcacacatatagctaaacttgcacagtgtgaacctattctatgagaatttacagaatatttaattcttcctgtgggaagataaatggggaataagcttaaaatgtttctccagagttacaactcaaatgtctacaagataaagcaatgtcataaatgtgtgtaaaacaatagggagtgggaagggtttgcaaaactggatagtgcattccagcttaaagaaattcatgctcaaattttaaaaaaattatcgtgtatatcaacaaaactatctgaagccagtttgcaacctctgcaatacaaatagaaaatgctatttaagttggattatgcatcaaggttgaacaccatcaggtagagaaggggaattgttgaaattctagaccagataaatatctttggctgagatccagagatgaagatatttggaatgtgtagctatcagaagatggcccaaggagtcaacaatgaggtgcgaagggtgagatcagcctaaattacaaaggggcatgaatgcaatgataagcagttcacacctcatcttgaaggcatcaaggacaatggcattaagttcctttaacagcatcattttaagagttgaaaggtttctcaggtctttatacaaacagatgtattattataaatgatcctctctaacacatagcatcaacatgttctctctcactgagaaaagtctcatgggattgccatagtagaaaatatgtacatttgaaaaaatccattcatttaatgatttggatgtttataaacatctgttatttaataaaatggatggctcaggttacgtagatgatatccaaattcatgttgaatttttcttctcagagttctaaatatacacacagcttttaaaaggtactcagtaatgaataattattaataatttaaaattactgcatacttctatatgccatgcactgtctcaagtgctttatatgtatctattttatgtcatcttacttaatttttataaaattctcattgctatagcgttatcccattttacaggtgaagaaacagagattaaataatttgtccaaaggcatacagccagtaagtaaacaagctgacattttacttaggcagtctatctctccagagtgtgtactctcaatgttgagattctatgctctgtatgaactgatagataactagagttggcctttccttgcttgcctgtttgaactagaccttctttcttttagaaatctggtagactctgtcctccttgaccttccaaggccttgtctgcgcttgttgcactaggctatccctaaaattcttttttgttgttgattgttagaatttcttttacttaatggctcatttttgtcttagtccaattacagcacagaatcattggaggaccataatttcctttttctgtactgcaccgccagcctgaccttttttgggctactacctgacttctttgaaacctcctccattctcacaggatatattgggcagaaggcttggatctactttgtcactacttctttaatatagaaaaaaagtttagtacataataaaagaaatcacaacacaaaatacagtattcaccttccagactattttttgtgattatgtgtaacatgatcatgattaaccgtgatcagtatccctttgtaacatggctattgtggctttttgcatagtttctttctgctcagaaatggtttctaaactagcatttctgggatgctacacggataactgtcatttaagaatgactttaatctgctgctttgtcacaaaacattatactgtcaagttttaacttggcttgtattcaactcaaggattcaagataacatggatgttgacgatgttgacatgaccctcctaaataaagaggccaaaacttcttaccagacatgtaaaattacctatgggtaattatttcacagagctcagtttatgcagttcctttccctcattgtttcgaagttgctaacaaatttcttccaccaatatacctactcttctgttgtttgtttcaataagcagcttctccagagcctcaggcacagcacttccaaatgtcagcagctattagctcagcacattcatctttgtttccttatttctcctgagtagcctgtctctctcagaggtgagtccaggtggcttaacataacatggatgcgggtgtgtgtgtgtgtgtgtgtgtgtgtgtgtgtgtgtgtgtgtgtattttctcaaaataaggcattacagctatttaatcttatctctcatatttgctatttgcttgcaaacatttttgtatctgtcacggtgcctagcatgaaacccataccttgcttataatctacagagggtgaaatgcattttaaaaattatgtatgtatgtatgtatgtatgtatgtatgtatgtatgtatgtgtatgtgtctgtctgtctatctatctatctatctatctatctatctatctatctatctatctatctacctacctacctatctcagttttctagtgcctccactttaatttacggaaatgggaagaacatttggagaaagcacagattctgtattttgaaatgcaatgtgaaaaaaatcatcatgctgtttttcagtgaaaactcccaaattatgtgtctctaatttttgttcccattattttaaacatataattacacacgtgtctgtgtgtgtgtgtgtgtgtgtgtgtgtgtgtgtgtgtgtaccgtatttttgccattaggcatataagggcaacatttcttctgctagaccaaattttctgtttctctatcctttggccaaactctatctgaaaacaattcatgtgtttcatgtgtgatttttataatcaaggtcagatctgaccaagcagaggcaccatataatcaggtacattggctctttgaggcctgcaaagaactgtgagcatacagactgatcaaactagcacctgaattaaaaccaaaaggcaggagaaccagaagtctactttcatgatgtaaaaccacttgctcaaattaaaaataatttttaatgttttacaatcatgcagaaaactgcaactggagtggccagtcctcaaaggaccctgtcttggatgtagggaaacaagaatctagataagacttgaggccgattacgccatcaccttcttagttatcagtacttgaagcaaactttgtagcctctcacttctcttgacacgacataattctcttaacccaacatactgttgttatgaacatcaaacaaaataaagcataggggagtgctttgaaattagtaaaatactctccataaatacaaggtaatgttattactagtttttatctaggaaaacatttgctggaaaagagaaactttatcctgtttggaacttgccagctcattgtttaacaatgagcattgtagcatggtttggctaggtgaatttcactgcttttattctgatcagcccgttgaccccatttctaaaaaactagctccttttctagggtctactgtattatatttatattatagtataatatggggtatgaaagagagtgatggtattaagtcacgatagaagtgatttacgatagatgctttcttgggtttttcctatactcccagacttctattttacttatctgtggaagaagcaatattttctcatatttgaatttctcaggttataaagaactatcatgaaattatatgcactatacatttatatagtaataaatagactctgaccagatagcttgagtagtctgctaataatgatacttaagaggcactcaaacaactggaagaaatcagcttaatatttaaaaatctataaacatttatatatatcgcaatctgagtggtgatgtagctgttagagttaagcaaaaaatacaaactatacatttcgagagaaatacaacttattacctttgagtacataaaacgacttcttccaaattatagaacttgtatatattctattaaatacatttttaaaaatcaaattagtgatttgtcatgagacttgatattactaatgtacagaaggcatctttaagcaataagatagtctccctaaagcttgtatgatatattattattttgttcagtaatttttttcccctataaatagtaaaaaggttgtatcagtccagcccacaagaacttgtcaaacaatacaaatttgtttttaagaatattcccccacatattattttttgttttacatatttatagccatgtgcccacttaattttgtgtttatttatttctcttcactgggaaaagacaatagcagtggaccatagctacctactatctccaggggaaatatgcatctatgtcaaatccatcctattgatgttagcataggcctcatttgaccaaaagagagctgtattatttatgaagacatttactattccagaatgtcaagaagttgcagaaacatccaatgagagtcaatttagctttctgtttcctgactgcaagtgaacaaacgcttcttacctgcagtgcacaaccatcggaccagcatcgggagggttacaggttttgactctacgtaagaaagctagaaaaggtgtagggtgttctggaacaccatgatcaggccaggcggtgaactggaattgtctcacttctctcttctcacttgaaccattctgtgaaataggaatatcagctgaaattctgttttccaagcctcaggtggtaatgatgaataacagggaagaggtaatgctaaaatgtgctattttaattcctttctaccaccctgtagcctttgggaagacacactctttggaaatagaaaccccaagctatttgtaaatgacaaatatttgcgcaggaagacaaaattcttaggtgagaagcattatatttttcaggtttaactaccaggagagctcctatcacattttacaggaagagctagttcttcttcatctactcttcattggctgaaactttcatttggagcaagagttttatatttactgataaatcgccagacaagaagaaaaatggctgagtgataatggaagatctatttcattcttcactgttgccattgagatcaagatttaagtaaagccttaagagatttcatttctcaaaagaagctttctttaaacaatagagaagggaaagggaggagaaaaagatgaaaagcaaaccttgtaaagtgcaaatgttcgaacacaatatgtggccagctccacagtatcaagcagcgttacttgaacgagtccgtgggtttctgtgcctctgctaggccaatactggtcacacttcacctacaagaaacaagtgacacattcagggcaaatgctcatcaatttctctattaactttgctttgagttgctgttgaaggaaaacagcttttctgcacttcattttatgttgatctttttctggcatgcatttttgttatcccaatatatgtaaattactgctctgatgccaatataaaccacatttttcaaactggtaggaatactaaacagtaacagattcaattttcctggagaaaaataagttgcagattgttgctgggtaaaatacagagagagggatttgaaacttcagtgagcttgaagagaaaacaaatttgtcctgggatagacgttatgaatcacatcgggaggatgacactttgtcatttaaactacatggtaagatagtgttacttcatcaagatttaaaaagcacaacttccaaatatgcttgtttaaagaaaagtagaaataattggaaaatctatcaaagtataataaacaacataagcatgtgctttttttttgaacacaagataaatgttatttgtatccaaagcaaattaaacctataatgtctgcaggaaaaagagttgtctgttccttaaaaagagtctcagagggtcacacactaacagtgcaaagtttaaataatttaaaattcatccaagatgaataatctacaatttctatgtgaagtggaacaaaagcacataaaaagttttcagcctaattagtttaacacacaacaaagaataattccaagtctgcagtaaacctcaaattcactgaatgagtctgttgggcattaaaaagtataatgaaaagtaacaaacacagcacaatatttttggagtaaggccatagatctgactatatttaccctttctatctcagacttttttttaatgggactaattcttaagagaacccaactgaaatacatttctctaggtaaagaaagctcctagcagtattttacaatagggaatacacctttctatttgaaaaagaacagaaaatcacaatctttggatttaaacaaaggcaataaagcattattattagagacactagaattttttgggtccagcaaatagaattattacataatgatttgcttttatgtttaatatgagtatttgtaacattctgtgaataatactgtaattttctctttcacagagatagcatttgctcctctgagaattcaggctctttccatgaaactattggcccttctaagaaagggagaagttttatcctgtacagaatttcccagacaagacaaaaaagaaaagcactttatagctatacagtaagctagatattaaattcacaaggtttgattcctatgccttgatttcaactttgagaccacacaaacatcatctttttgatgaaaacaaacaaaaattgtccacagtaagacaaaaattttgccttaataagatgtaaagaatattttgtgtgtttcctagttgtacaaaatagccttctgtgttttttatttctatcatttgccctgactcaaagagataacaacatagggaaatgataattcttgaaggagaatactgacgtagagtgaccaggcatgggcatctctatatgttctttcaccataagctaaaacccaggtcacagatgacatatttagcaaaagctaccatctgaatagaaccaacactacttcagcagtcatgatatagatgagaaaaaaaaaattaacaaaaattatgccaaaggctttgttttaaaccatgaaatagatgtcaggtggatgtctcccagcagaggacaagaggaactctggaggcctcatattgtaatattcaagaagatgccaacaatgggttgagttgaagattcaagagagaaactcaaattcatcatttaacagtctcagctggagagcaaccctttcggtttaaaataaactaatgaaatccctaaggacaaatatcactatgatatgcacaaaaacagcacattaatgcaacaaaatgatctatacagccagttcaatgcactgaaccaaattcaatataattatattttaaaactgggactcgattacatttagaccttctagtgaggtaagaaaaggagatgaaggaaagaatgagaaggcaaccttcatacaacttttggaaaaatgactctccatctacaaatcttctccattcctaagatgcaggaagaactaaaattatactaatccttacatttctagtaataagtttcaaactgcaactattattggcttagactctgacccctttagaaaaaaaataccaggaagcattactgtaaggagtaaacgctgtgaaaatttctagctaaaagaagaaaaaagttgcttttgaacaatgcatttttagtatttaccaaaagaaaaataaacatttcaaactcaactgcaaaaatcagaggcaattttttaaagcggatatgtctaaatattaccattttctctcaggaaatatttctcaaaaggaccttatgaaaaataaatatcctaacgtatgtggaaatgcacacacatggcctcagcagtgggattagaagcttttcctgagcttatctgaatagtgacagcaatacatttttccctttgctggtaagcacctcagtacttcctttctcgatctcattctctgagtagcctgcacaccttcatctgattttggagggctgaatttaagggcttagagttactgacaaatattattttaagtctccttttttgccatatgctaaacatatgatttctgatttcagcattagggagcaagtatgaaatgtagtgagaaagaaaaaggagaacaatagagatattttttctttcctcattagccagtataaatgaactatctccattttcctctcttaaaatgttttcctttgacaactttccttcccctactcggtcttcttaagagaaaatatcataaggtatttctagagagagttactatttgttaggcttcacacataaagctgattgtgagatgagaaatgaaggcagctccctttgagtacataagaactagaaggcaggagctactgaatacgaatacggttttttgcctttttctatttgatttagaatggatacaagcggcctctaggactgattcatggaaggtcaggcagagtctccctggatgcctggaaaattgtttctctgtttccaggaccaaagtctggccgcctcatctgtgaaatgggaacagtgtctccagcattacagagctattgtggggattgaagtgatgcccctaaaacacttaacccaaatggctggcacaaacaggcattcaacaaacactagctatcattggttatcagtttgatgacattctggatttttgtgtgtggggggttgttgttataaattacctaaatcagtctaaatgtgaaaaaaaagaacatgttattaatttcagcagatactgatttaggattttctaggtgcaaagcaaggtgttagcagttgtggggcatcaaggtgacataagacccagtccctgccctcaatccattagccttactgactaagtggggtgtttctaaacctccttgttcttcaaataggtggttctgagattccaaacaattctcttcatctatgtgggccccaatgtcttctgaaaagagtatgtgttcaactcagaggtggaaaagaagaacagcagaacttgtcactcaggctgtggtttagaaacatcacccagtaactttacttgaagcttaaactgagacagttcagatttttggctaaatttgcgggaggcatttcttttcattatcacaaagttattacccttaagtggagctttcatttttctataattacggaaagaacagggtgaccattgctaaatttatgcaatggaattaatttattttacctttttcatgacaaactatcaaaatcaagttgatggaataataaaacatatttaaatttatttttaaaactcttgtcattgcaaatatctggtaggagctgatccattaggtctgctgaacatgctttgggagaagggctctcgttctaggctatttttactcccatatggcttaccttgggagtgctcagcatattgtaggcacttaatgagcggtagccaactttataatcaattaactagattggcttatttttaaattgtctaccactttctgaaaacaaaacctcctcatctcaatttaataaagacttactgagcatggcaacatggcaaggcatcagaattccaactgtaacaaactgataccttgaaagggttctagcattgctaatccaaaacgtatttgccacgagattatttagccaaagaaggacttagaagaggcaataaatgatacgtgggataccataactattgctaaaagtgactctaaattcgtacctagtaagtttgggcagagtggttgttcaagcattagtatcctgtaaggaatggacaaacaggctaacattagataacacaagtcacagttatttttgggagtaaggaaatgttggtacccttttgtcaatacccatttaatgagggagactataataaaggaaagttttagataaatttcattaattttagtgggcagaaaaaataaatgctgaactatttatttctacaggttatagtaactattctggaaatttttaagaccagattgaatacttgattttccacgataaggacagagagcatctcagtgattctcttttaacaacagtgtagttctctgcactcaatcaatatttggctatatctattcccaactggcagtcagtctggtttgtgtattcccccattttattatatctttactaatcactatttagtggaggacaaagaggcactacaatatttgaaatgagagtgatattaaagcatttgaccaccagtgcagcttttcatatatacagccataaagttgaaaaatattattctcaaaataaaccaaattacatgtcataaaattgcctaccagttcattgaaccattcgcacactttctaaactgcttattaactttaaaaaagttattcccttttgtttgatgtgtctgccagaagttgacatagggagctgccgtaaacttttccaatgacttcccccattaaactgaaagtcattaagtctcaagtttctggcactttgtcctaaccagagcagaactgtgtgaggtgcctctttctcgtggccaagtagcactttgatatcagctcttcccacatgaggtgggtcctcagagtatccacctcagacctaatcactcctgaggatcacctgggtgccccacatagccctacagccacctctgcttctgccttggtctgcccagcagttgcctttgactccagtgtcacctcttccaaacagtatcattagatgactcaatgtttcaataaaaatataatttataggtaccagccagcatcaatgcagttcaatattttaacaaccagtacaactatgttgggtatttaccagttgaacatcagcctttccagacattctgctgataaagaacagagaaaaaccaaacattggaccctaaacactagtaaacagagattaacacatacttctgaaaactttagaaatgagacctaatccagcacaggagaaccacagacatgaatgcagagaatgagagaggctttgtacaaagtcatcaggagcaaagttgcatctcctcctcccattccagctctttactcaggtcatcaggactctaactggctttaagaggaatgctttgagccagaatctgtcagctgcctttctaagtagagcaggtggggtggggaaagaaggtagataatccagaaagctaacaaacagcaagaaattggtgggattctttctcttttatctgacgctgtgtctgctgacaagagaaaaccaaaagtgtagaactttctagataaggaccccaacatcctttagattgccaacatgagcatcattctttttgttgccagcgtcctatttacattaagtatccaccactttcaaaaacaatcccatacatcatgcagactccaaaggcaatgtttgtgctgctggtcctaaagttgcttaaggaaaaaagcagtttctgttgccctagataggcagcactttaggctgcagtttgagaaattaaatgttcacggcctttggcgcttccagttccatttggaaaaggacacaaacctggcatttggaaagcatttgctctccattaaacttaccgaaccttgacaaaccagaagggccaagaattagtctgccactggccaaggctggactttccaaaactgataacagcaatgaaaacaatagcactgccatttataatcttcaatgggattctgtcaaattttaacccaaaaggatctcacaatctgaaaagaatctcaagctttgttttataggaaaagaagaaaatgtttgagcacaatctctttttctactgcttcatgctcagaattgcccttttagccatagaacaaaatgtgaatgtctccacctcaccttcactttgtgctagggtaagtttactaaggtgacattcaaggactggggaagacataggaggaggagtgagtggtcattaggtcagaagtgttccaccagccaaatgtcaagttccctaaactgttaacaaagtgaagttaacaccagcccagtctctttggccctgacagcatctaacctgcattcattagcacaaaccacaaaatttagtagggcaggaattttcccattctttggcctaagatagaactcaagtcacgatgcacaaaacatttgatctgctttactaatatatggcatcatctggtttgtatgattccctatttggaaacagaaaatgggacttaagatagcttggaaaccaagaattaggattcttcatttctagccctatattttcactactaattggcacagcccacattggattacaataaaaatcatgactgatttgttaagtgtcaaaatttcactccccatctccaacatttataacgctaagtacatttacaaacagctctttaagtgaatcaacccccactataaagcttgcaagacaagataaacattgagtctctactatgggcaaggaatgaaggcaagctggtgaggtgaagtaaaagtcagatatattctaaccctgactaagcctttcaactgctaatactaatcagggttactcaagaattttctaagcatgaggttgatgcattctctctgtgttctgtatttcaagatgggagacagagtaggagagaaacagtcaagagaagatagatgaagggaaaaaggtgaacactcacacactaaataataatttaatatacacttacttaaaaaagcagatgaatcctacctcggagatgccaattctgcaagcaaggctgccaatcatgtgccccagtcatcaaaaataatatccttggagtggaaatcccagctgtatacattttactttccctacaaaatgcttcattttttccaaacagtttcctccttccatgtggttgcccagaccaattcgtgtgcttattggcatgttatgaaacatggaaacaattagaaaccacattctagggaactagaatgacttgctacagaatcaatgaactacgcaaaacttgagaggatttggcaataaagatggaaactagggaaaaaaaaccactaacagtatttcatattacacagtacattctacaacagctttaaactgatctgtgtgtttcagcagaactcatgctttcccttcaaaatctccagcttctatcattgtttttttgtttttgttttgagatggagtttcactcttgttgcccaggctggagtacaatggtgcaatcttggcccaccacaacctctgtctcccgggtcaagcgattctcctgcctccgcctcctgagtagctgggattacaggcgtgtgccattatacctggccaattttgtatttttagtagagatggggtttttccttgttggtcacgctggtctcgaactcctgacctcaggtgatctgcccgccttggcctctcaaaacgctgagattacaggcgtgagccaccgcacctggcccgttgtctttgtatttctttatataccctaatgaaactcatatgaaatattcaacttatacttttccttcagggttgatagctgaatgtatacaccaggcaaagagtcttctcagttaagattggaattctttaaaggccacatttgaagggaagtaatagcatttgaaaatcaaagaactcatgttttcaaataatcaacttaagtcctaagtcatagttcacacttataagggtttctttagccatgcaaacactaagaatgatcagttctcaaaacagatgctagtgaaacttctaatacctgctaaggaatccagaagccttttgtctcagtgagctgttctaactcaccaaaggtattaatacaagcgctgttgataaacctcagacctgagcgacagcttaagagtgagccagccaggcacgggctggctcaagcctgcagtccaaacactttggggggccaaggtggaaggactgcttcaggccaggagtttgagaccagcctgggcaaaaaagtgagactctgtctctacaaaatctaaaaattagctgggggtgggtgctgtgcacctgtagtccctgctgttcaggcaggattgcttgagcccagaaatgttagattacagtgaactatgaccacaccactgcactgcagcctggacaacagagtaagactctgtctctaaaagaaaaacaaaaacgagtgaaccaggctgtggcaaaacagaacgcttgaaaagagagatgggctctaaggcaggacaatttcgtagcaccataaaataaccaaaaaaggggagaggggatgtaaaactgaacaataaggaaacgtatcttcagtggcacttatcactacatgtaacccatgtctatatcacttatgattttcatgttgtattatagtcaatgtagcagccggaatgttctattttggtctgttccccggctgatctctattctggagatcctgtcctgggggagagcaagtaggaaagaatcccatggtctgagctcctctctcctcttgaataaaatgcatgggtgtgccacactgggaaacgtgggcataattaaccatgttcagggacatggagaggttggtcaggattcatcgtcaaccatagagaaataaactcttttcatttgggaacacagagtgaattatttggaggctatcttttggggaaactgaagttgtcactgtaaagcccccaacttctttaccaaacaataccatttgagactcactgagccaccttgccacatcctttatctcagtcaatacccacaataacccttccgcataatccaaaaaaggaaaaatgagaatttgaggagtcaagtaaacttgctcattgtcacacagctagtagaggctagagttggtatttgaactcagacatctgactgcaaagtgccctacttggaactgtcccatagctgtcctctctcatggtggtatccccatgcagtcctgcgtaatatcaagctatcttctcttctctttccttttctcccctcttccctgctgcaaatctatggtcagtggcagtctagcatacttctaattcacagcagcatttacaagacgcacacatattttcttcatgtaccataggaatgaatattattttaagaacctgagccttaatctaaataatgacatttcaagcttcagctcttggagaggtaatttgtttacgttacctggactacctccctttatgaggaagactggtgccacttcccttcatagggccaggctagttccaatgtctgctttgaagttggctgctgggaattgaaaattcactgagtcccaaggtcagcccacagaacccaccacgttcctgaagtctggagctatagatttcactaacaactcacccctagttataacattgtttttatagtgaaagccaattccagctcttgtttgggaatccaggaatgccttctcctttcttcccgctactttaggtaaaagagcaactggatagggaaagggtgagatgggaatgatgggagggaggaagacggaagagcagatgaaataatatgaggctccagtgctttgttaaatctctccaggacatgtggtcatttagtcccaagtgttctggactggagaacaaaggacttttgggccttggggtccagggctcatgtgtattgtcagattggtggtggctgagactccccaaatgcctattggcttatgcaggtcatcacaaatctgggtacaggctgaaccaccacagaataaaaatcacaagacagcattttaattggcttccttaggccatttaacaaaggagaaagctaacttgcaagagcaaagagtaattaatgaagggagcaaacagaggttcatttagtaacttccaaataagttcctctggctgaggggagttgggggagaaggtagcctgcaacagaaagataaactgtaggtatttaagtcacaatgccttccgccaagaactgctcattaccatcagatgttgcagtggcagtggggccagttagaactaactttattattagaagcaattagggagaaaaggggcagaatttcatttggttatttcaaaacaagtttctgtgcacagtttaatgaaggcctgcagtgtcaagataaaatgtgtgttttactgaaaacagcttttgcaaatgactgcttgttaccagcagttatctccaggcagaacagactgggtaggttggatttacatgcatgccgtaatataatagttcagctgtctcagtttcacagaagtgtcaacaggcagtatggcttgatggtgaagcacgtgtgttctggagccagactgtctgtcttcaattcctatccctgaccttggtagctgaatgaccttgggcaaagcttctgtaatgttctgggccccagtatactcatatgtaaactggaggtcacagtagtgtttcttgtaaagggctgttatgaaatatcaatgcacctaatatgttagacattattatagttatgaactattatatccaagatcacttgggaggggagttgtttttaaagaaactgcttgatatataggagttaccttaagtacaaatcagtaacaaatccatttacatcttttgaattgggtttgcatgtaaagtatggcagatatttgtcttcagtgtcatttttatcttaattcccattttagacaatatttcaacatctctatacaattcagatgttttgaaaagatctaattgctttttagttttgctaaaccaaccatttatcactgcttttgatttcccacctttgaggttacagttgtggctttttaatatgtttctgtctgagcttttcccttataaatctcttgggcagcttttaaattgtccctcatatacacgcccaggcttagagaaacttccatgtgttgagcttagaagaacatttacagaacctcaactttcacacagtaaatggggaatcaggctttcttccttctaaatatcctttttgagactactataaccacagtaaaagaggcctctcacttgtggtttcaaattctgtcttgaatgtccctattcttcaatgaaagtatctgctgtcttcaatgaagtttcagagatcccatcattaatttctcaaggttaaaggttgattttcttcagatgctacaaaatgtacacatgtactcaggaatatggtatactgcttacccattattttttagtccttcaaaccaacagcatttaactaatgtgccatgcaccataatattggacccatacgatgaataaaactcttttcttggaccttaccaagctatgactccattattaaaatctactcattttggagaagtttaaactagcaaaacgccctctatgcatttatgttttctcagccgtgtattcagccacatcatttttccagctgccctgacttaatttatactaatgtgaataatttaagcaaaagcctctttcacagaacttaagtcttatgctgcagattttaagaaagaaaaagttgaaaatagtggaagtacatattggtgggattctccccaaagcccgtaggttcttgttcaatggtgtttttgaaagaggttcaagcaaatatttattttctctaatcaagttgtctattcctgtgaatattccttttttttttttttttttttactttttagcaaccacacacatcataacatgggagaatttcttttgtgaaaacacccagaggagttttaaagaatggtttaattagagttgttgatgcccattcataattagtatctgttagaaagataagccttagggaaaggttagattctgaacagaataaaatatgcaacatagggactctgagggaaaatttttaaaaggaaagaggtggatacttattcttacccttgatctttcttctagttttgtcatcatgacaactgtggcactccgttgttcccatatcattctccaaaagtccccaaatgtttcggggagagatccctgtgttgcaatataggcattttgcttcctatacccatctatgtagttggcattcacatagtcacttcctgggatccctggaaaacaaggagtgttattcaaccaggtgagcacatcacaagaggaaacagcctgggacatgacctaatggcagtgctatcttactgttccacctcacactagagaagtcacaatatattgaaggtcgggtttcaagcaagattaaaaacaggtcctattagaaccgtcatgttaaaaaaaagtatgcaaaaaagtgtcaggtctttataatacgacaaagaaaaaatacaatagatggtccatagaatgccttttccttcactggttgttggttttctctgttgcactggcaaaaaaaatagtttccaaagaacaataaacaatctggtaacattcctcacccatgtgcttcccaggcaaaaactagataaaagaatgcctgagtctgaaaatacaaaatagagtggaacacaccataataatgaaaaattctttgtagatttagttaacaggaaactcatatataaactcatttaatatttacaacaactctgcagtaagtcctgttatgagtcctgtcaggagaaaactgaggtgcaaagaagttaaagaaacttgagcaagttgctcaagttggtggaatcaggtttaatcctaggctactcgtatgtgtcttgacctctgtaaagtattgcttctcatttaaaactcgtgatttgttgtaagcagcacatgaacctcctggattaggacagctgccccctaattggatgtccatcttctacttttgtcctctccagtttgttctccatctaacatgagagcagttttaagaaatttatttcagacactgtaacttcttcaaacccaacaatggcttccccttatacttcaaataaaatccaaactctgaacatcgcttacaaagctctgcaacttcccaaactcatctcattccactcacctccttgcctttaaaactctagacactggtctgcttcaattattagaaaacatttatttccctccttagctcaatccacatcctagaatatactctgtctccttcccatcataaaacacccagccgccatcccagaaggcctgccctggagtaccctgagacatcagaactcccttgacagccctttatactactgattaaggttgtaattatatatttacttgtctgttaagttgctttattgcctattttgaccatgtctcttttattcacctttgctaccctaatgacaaaagagtaaataattttccccagttccaacatgtaatcagtagcagagatgtaatttaatgtagatattgtgatttaaagcctagttttccatcagcacatgcctttaagagagacagaggcaaatttgagcttcttccaagaagaggagccacagtgattaagggaatgaaagctactccataagagaaagaatgcatattatagcctagcaaaggaaatggtaggaattgggataagagctgcctgtgagaagaagagaggtttagatttactctgttgagttccaagttttaaattctgaaagatttaactacagaaacatgaatttcatctcaaatacaataaagcattttcaaatggtcagaatcaaaaagggagttaagtttccttggaaggtcatgagttggctatctgtaggggagaacaagcactttataggaatgtcagcatgatatgggaaggtacactagaacttgtgcatgatcccttctaccctgggaaatatgaatcttggaattacggggtaaccattttttttttctttataatgaaacatatgttcccaagctcaaattgttatatttcactgattgccacttgcaatgactttgactgcttttctgattccggttgtaaagttgatcctctcaagaaaggtaatgaaaatcagatggaaactactgcactctgagatgaacacacggatatggaataccaccagcattagttgaaaagccttttgagcaaaacttgaaatgcatggttggctgtaacattattcatctattacagctactcaagaagcagttggggttttggcagctctttgttgataaagatcctattcctccccaacaccagattactgtagattcaaatgacggtttaaataaaattctcaggttacaaacactgggacgtgcacacatcttacatatccataggatttggttctgagtcaagaatgaatccatctaacaggaaaaacctactttcaaaactttaatttagcagttagcaacattaaagaattgataaaaaggattctggctaagggcctcactcagctgccaatatacagaaaacttttttctaagaaaactcagaatggagaaatctgggctaaatgactcagaagattcatcacctgggccctgtgccacctccccccttatcaaggaaagcaaatgtgtctgaacaatgcatctgaggatggaggagatgcacaggagaatcattcctaaagacagggaatcagacccatccaaccctctttgggtaaaaatgttaatcagttattatgtaatgaattggggttttttgcatactgcccaagtttgaataataaattctttttgtttaacaaggagggggtaggctgctactgaataatgattgcacttcccaggataagaatacaaaaatgttgcctgaagactactaggcaccaggaatcaatactatcactaaatgctttaagaatttaggaattgggcaaagtgtagtaattcatgcctataatcccaacattttgagaggctgaggcaggaggatcacttgagcccaggagtctgagccagtctgagcaacatggtgagaccctgtctctacaaaaaaataaaaataaaaaattaggctggcatggtggctcatgcctgtaattccgacactttggggaggctgaggcaggaagatttattgagaatagcacatgacaagtctgggcaacatggcaaagagaccctgtctctacaaaacactaaaaacttggctggatatggtcatgcacgcctgtagtcccagctacctgggagcctgaggtaggaggatcatttgagtccaggaagtcaaggctgcagtgagccataattgcaccaccacacttcattcctgggcgacagagcaagactctgtctcaataaaagataaataattaatattctgaaaaatacgtaattgaaaacaaaatggaatacctggtagagcaaattattaagccaatgctttatgtcctgaaaataatgctaagattcctcttatagtttgatacctatttgtaagaaggtagtacatggaatgaaagcctccttctggcaaatctctttacgcgctctggtgaaaagacatttcaggtaagttctctctcacagatcctctgcaaatgtggagataagagagatggctatgttctccagaagctctaagatctaatgagtcctgtattcataaaacccaatataacacactgtgcagaaagatgaaggagaaaaaattttagaaaggatggtggtgtgtcctaaaaatattaaccccagattggaagctaaagttaatcagcagtccatttcaagtagatgagactctggtttttaatgtgacatatttagaaagacttttcaaccaacactgtgaaaataaacaatatgctgctttccaaatgttttggtgccatgaaatgcttcttcagtagttcttgattaggatgtttctgctgggaggctggatctaacattcttccactttttggggggtgactttctctaagtagtgcatatttatttaattttcaattccctgccttttccaaaaaatgatttgcttctgctaatgcaacattaatcagagtgcacttctaatccaagagaagtgtgtgagaattaacttaattcctttggggttatgaaggatggaaatgtaacttgaaatgtagtactgaaagagtatagaattactataaattaggtgattgcttttcattcttggagtcaaggagaccttcctccaatactagaataacagtgcttgatttgttttttgggtttcctgtttgtttgttttttggttggcgaaggagctattaaaacaggaggaacatgacaaagatgtttgccttctgctcctcataagcaaaattttagaacacattggccctgctgcaggaactctcttggagtcagttggtcttagtgtctttgttcaagaacagcttacctctaagactggttctttcctaggagtccatggctctactgcatttataaaactgagtgggttttcatgatttctcatgcattgtttcatgtgcattctctaattaataacagtgatgtcaatagttgtaaccccataaataattgtttagccttctaatcttacacatgagaaacctaaggctagaccctctaacttcatattataccaatatgctccattcctgggttaaagtgtatttcctcagttaatgaactgttctttcttgtggcatttaaaaatattacttacatgctttatactgggtctttgtgttctgggctaactaaacctggctgttaatgcaagcctgtaaagccgacagagattgtgatgaggtgaatgattggtagagctgtgcttctgttgtttttcatgcacaacaagccatagcaaacagctatttgaacagaattaggcacgttttaggctctcattttatttgctgttgattgctagttacagttttcagtggaaaaatgagcctggatacagactttgaataatggggtcatgtggattttttaaaaccaccaagaagaaaaaaaaaagcaaacaaacacccaacttgctatggatttgatttttggggccagaagataattcgatttgaaaagatgtctcttgttgaaggggtgtttacaatgatgaggggtttataataaagccttaagtcctgatattaagtgaaaaagcaggatgcaaaataatacatgaattattttgtgaaatcaagtaatcctaaggggaaggatcataattttgcatcacattacactgtaggtaaagtcacgtgtgcattttaaagtcttgggacaatagcaagcacttgctaagaatttagagaaactgaccaggaaacctggactcctgtctagggctgctggtagtttactctgtgatctttggccagttactcaacttgcccagaactgtaattgtttatttgctaaacaagatgtgttggacaaactgatgccctccagttcttttgagttctaaaataaggtgtctgtctgtgctattcttaaccttcttggactcagacatctctgtgaagttattttaagataaatagaggctttgtgtctctcagattaggtaggaacgcactctgatgctctttcaagctgattcctattgcttctacctttgatgtgctgagatgagatttttcactgaggctgctacttcacatcttgattggaacctgatggggcaaaaaataaacaaaaagcaagaggaagtagtggtactaggtggtctgtccatggaaagaagctctccttggactttagcgggtgataataactaagaggcagtcttggagggaaggcagaatcccaccgtggctccagtggatgcggctgcactacagagatggagatggatgttcagctgagcgtcttaccctgctccaactcacaatttggcttcaaatcccaggtacttttattttctttaagttctataaatccctaatgaagtaaggactgtgtcaaaaagaaattgctttttggcaaacaagtttgttctttgttgtaagacagaagtactcaagacccgacagagcacaaaagctacctttcatttgttaatgtcccctcctctactccaacgcacaaacgaaaaagcataacactatattgctgttaatataggttaagacctagattgcaattttacaacaatgtggcaaaaatgtttactttgcagtctccagaaaaactagaaaacaggaaataggaaagcaaaatctaataaacatttacaagcaaattgattaaattctaaaggacacaggcctttcccccgacccttcacctgttcaatgacagccacacgtggctgcatcagacctggtgacatgaaggattctttctgcaacataccaaataaagcaaacatttattgcaaagacacagtctattgtttgccagggtatcccctggtatagctgcagtctttccaagtttctacaaaacacatagaatttttttttttaaaagcatgcctgttctgtgggcatcgtagctcaaccccacagtgagctaatggagaaacagatgatattcagagtatttgaacccaacctgcaactcctcattaatgtatgtcttcctctacttgattttccatacccccacactgctgaggaggctgagttttgagaatggacacaggaaagtagacggctgattgaactatctttgaatacattgcaagatcagcaacatgagttggggaattaccagcacctgtgatagaggggcgtgctttttggttagacagcaacttgccttaaaatacagtagaccttaggccactgaagcttaactttcagccacatcatggagttgtggtccaattagctttatactaataaggaggcaattattatagaggttcatcaagcaatgaagtagtcaacaatcaagcatgagacatgactacagaagctctatgtgtaggaaacactcagatgctcagtctcctcatcactaatatgaatatcataatcaaaaagtcctggaaccaacacctctgtgagaattaaatgaatcaatacatctgaaatttccaaaatgtcatatggattttagttactattatgattgacgtaaaaatggaaaaagtctgcttattcttaatgccctcctgataaaaagtaattccaaatctggaaggcccctttctagcttctactttaagaaaaactatcagacaggataaaaataattcttttacaatttcccagcaatctgctacctgtatctatattctaaaaacagaaccatagatgatgtaggtttatctacggcctcagagtaatgaagtgtagattcattagagtaagctgcatagatgtacaattaaaaaaaacaaaaaagctccaatgaactgaagacaatagagataaaaataaactcactcccagagctttctgattttactcttcgattagctttctgagaacaagagtaaagcaaaaaacaacacagccagccagcccttaaaaatgctttttctcttttccgggtaagaaacatcagcaggtatagtctaaggtaggagctagggaataacagatataacagcacttgcttggctacatgtaagagaaagatgccatttacacagctctaattagacagctcttagaaagactgcaagcaacctgtgaaactgctccaggtttcccaggctaagtgctatctacctttctatttaaaagaaattaagctataaaaatttgtctattcactgctactcaaaaaaaggaagtgcttttatgtatttttttaaaaagtaccacgaaataaaatgattaaacttcatcacagttgcaaacgattaacttgaaaatagaaaaactgaaaatgctgcagaaaccatgttatcagcctaaatcaatgatttatgctctgaagagtgtgagaaaaatgaactcaacaaataattggacaggatttattgtttttaaatgagttttttaagggatgggatatacattctaacaaatttcctttagtaccttaaatagaatttcaagagcaaggtaaaacaaacatgaggtgccaacaaactattcactagtgactgggaaagagagggagagaaatccggagggagaaaaagggatcatatttattgaggtaatatgggaaggagcacacagcaactatcaaaggacttctttattgggtgaaataattgtaattgttttgatgttagaacttcacatggaacatttatattcactataactaacattccattagaaaatgttggatagactgtattaacatattttcctaggtttttttggttttgttttacttattgaaaatacatccagttaccagatatgccccttgcccaaaaaaagaaaagaaaaagatattttacagcatgggtacaatgtgaaattggagaatacgttagcatgtgctcacagctgtttcaaatgaattgctatagacttacccacagaacactctgcagaagagaggctaagacacaactgaaacctagagcactagtgtggtggcaaatggtggataacattacagaaggaatagcagtagtttcttgtctttatttatttatttttaactggatttatcttagaggtggtgattccatgtgagcagctttctcatcttaaaggtgctaaattgcccatctcacaaataatcaagttattgtaacatcatctatattatttatgcttggatttttttgaattgctcctgttttgcaaatcaaacagcagatgatatatatttgaatttccatttaaaagaatagattcttgcccctgttgaaatctgtaatgctcttatgggtctggtttccatttatcaagcaccagtgttttcttttgcattacagagtacttcaaatatatgcagctttctcatttggatattagtttttccatagatcacatatcaaagaaattttgtctgcacttaaaagggcctatctgtagtagtaataaaatgcataacactaaagataatcttaacaattcccaatatttattatgtattttcttggtgccaggcactcttctaggtgctttacatatgttagtttatttaatcctcctagtaattgtaggaagtaggtactattaataatcccattatacagatgaggaaagcaaggctcagcaacttgtccgagcaagctctgcagaagcaagcagagcttcggatgcgttatcaggaaagaggttcctgagcagcatataggccctcctaagaaggtacttacttttacttattaaagagatgaagtgaataaatatatttatgttttggaactttaaatatatgaccctttctgtaagaaaaaaataacacactgctctgatcagaatgtgttcccgtaaattcatatgttaaacctaatcaccactgtgatagtactgagaggtgaggtcttaggaaatgcttaagtcatcagggcagagccctcatgggtgggattaggatccttataaaaaagcttgaaagattaagtttgccctttttctatcgttttggccatgtaaggacacagcattctttccctcaggggatgcagcaaaacagagcaccatcttggaagtggacagactgggccctcaccagaaagcaaggctgctggcaccttgatcttagacttcccagactctagaactacgaggaataaatttgtatggtttataaattacccagtctgtggtattttgttatagcagcacaaatggactaagacatggatccctattttactaagctttttaaaaaaaatcagattaataagcactagtgttaaagaatgcatattacatactaggtttattcttcatcacttctaaccctctcatggataaaaccatttaaatctgttttggtgagagtcacatagtagccaataatcctatttagaataagcccactaagctttttttttttttttttccttgaagaagctaatcatctcatactgtctaagatttaatatttatttgcctacttatcttttgatctcaggatttagaatcaatgttcagaattctggagatggtagagatggtcttacacatccttgttttataagaaaacaacgaaagactctaagtcataggttcttcctaaactggagaatgggcttgcaaagagattgtatatgcatgaactttctgaaattagtgtacaaataaagtatgtaagtgctctatgttttcaagtggggtttaaatgttcgtgaaattatcaaaaggatccagcttccccaaagagtgaatgttaactgcattaagtgaaatgctcaaggtcacattgttgtttaaactgaaatttagttttcagttttctgtctctttattcagtatatttcccaatataccttaaaacgtgagattaaacaaacaaaaaaacacacctgaaaatcatttctgtgtcatttattctttggaaaaattcattttgacttggagtctaagaacacaactgaagatctctagttctaagatttctatcctaagtgtttcaaaatgtgtatttgaaaattcttacacaatcttcccagccaaaaaggcatcagttttgaattaggtttgatgtacacaggcagggctattatgatttcaaaagccgctctgggcctgcgtagactaatgggaagaacagctgccttgagactgacatatattagtattttgaatttgtcacttattagctattgatcatacttaagtttgctgactttttaaatgcttccatttcctcatctgtaaattcagatcatgacaactagcttttggggttgggcctccataacatggtgctcggcatgtaatagataaccagataatcatatctattataatgtcttgtctttgttgttgaattgaaaagcagaattttaattttgctttatatttagacttggctaacacttttctaaaaatccatgtcaatagggcttttaaaacaaaatgttaattataatcctactaatggaaacagtactggcagcagtgaagattaattatactttagaacaacaacctcttttttatccacaactgcaataattaatttttgctaattagaaggcattataataaataacctgccactaattgataccccttggtcaacaagaaattaaagatacatacaacaatatttaaggtaagcagatcacctgtattatcattaggtttacatgtacttgacatttgttctgcaatcttatgactctggtccacctgaatgatgcatttgatgattcccatattgtgtccttgcctcaggttagtcatgccataaaataggaaatgagataggaaataggaaatgaagttctaaaacctaatatttatgttatccataaggctaatgccaaaagataaaatagatttttaggcaaaaagataagactgagcttttccacccatgctaagtgacttcagacactgtcacatcctgcaccggtaggaaagtgttatgagtgatgtgggaaagtggaagacccagaccaggaatcagaagagctggattctagcaagttatattatttatattctgtgtgactgtgtgactctgggccaatcctgtctgagcttcagttttctcatctataaatgtgaatacctatatatctagtaaaatactcacactgccgcttcactagactgttgtgtacagccaataaaacaacggataaggaaactacatagagataactcttagaagtcagaaatgaaagagattaccactaagaaaactgatattcagagaagtcaaggtcacctagctagttagtgacccaacctcagatttccttgttcttcatcttttggtttgtccattttcttttcctcataaaaacatactttctgaacaactttggattctacaagtttaggcataatattatatattctgtttatgcacatccaagtattagcttccaatatccaagtattagcttccatttggtctttatttgaaaatatttaccttttctttttttttttttccagatggggtctggttctgttgcccaagctggagtgcagtgggacaatctcagctcactgcaaactccacctcccaggctcaagcaaccctcccacctcagcctcctgagtagctgggactacaggcacgtaccatcatactagcgagttttttgtagaaaatatttatcttaactcattacaataaatcctattgccctcttcttcaggaattactattttctcttaagaactgcttaaacatagaggggatgccaatggtaattggatttgtcaaaaattcaattctgtttccatactgcttaccctataattaaacaattgaaaccattttgtaattaggactcttttgaatttattctgcatttttcctagcctaaataaaatgactgtgatttggaaagatgtcaccaagtgtcactattttcaaaaagttcaataagcacattactgcccacacacaattcctgattcttttaatttttccctgttattctctcagtggaagtaggatatacacttgctctactaaacaaatataaagacaacatcaatcactgcggccacttccagtttttgttgttctaatgtctgtcagatcactttgcaaaataatgtaaggagtaactagcaccactgagagaatagaacaaaaacacccaaattaaaactctcaaccaaagtcacttaagttagtaacattggttggaacacaaaacaagcacattaagttttataaattgtgcatgaagtcacttaatatttcagtatactaaaagctggccctgtattatcaaagctgtctttagaggagaagcctcagttagtggttctgtggttccagttgccagtattttctcttctgtgtttaagatacaggatgattgactgccctcaagaatacctgctggttagcgcttagtttaagataaaatgctgttcacggttgtaatttagatgaaagctctctatagctcatgaacttcaattaaatgcttctaaccttttgcataacacttaacatgttaggtcagctctagatttagggtgtatttgtgaacacagcactataaaaagacaggttttcgtgtgattcaagtgcttttgcttttataatataaaaccagcataggaacgaaatgtgcatagttttcaaccatcagaataaagatacaaggaggtatagtttttatccctcaacatactttaaagatgtggaaaataacaggttaagaaaaataatgacaaagtgagcaaaagtacagcgaagtggtagttattgaatgacctaattcttagtggaaacaatgctacaatagagcagaggcagactgacaagttccccaggcgagaccatgccaaatagattctcaacttacattcatttattttatttcaataatttaccttgcttttgctaatggaaaaaagatttctctctgctatttgtgactcagtttagtttttcatttattatggagatgatttaagagacttgagaccccccacaaaaaaacctgtattttttcacactttaaaatggaaaacatagagataaatgtaaggtaatcatccacatatgttaattacagtttttaaacagaatttgaaaagaagcgattacccatttgacattattatgcctgatctagtattggtaaaattttaataaatttaaataattgttttcagtgtggaaaaaggctaactcttgaacacttagtatctgtgggtgcctagaaaagggattatagtattttccaccatccaaagtaaatttattatgagaattttacaaaatatatctatgcaaaacaatgccatgttgaggtaaggagggccacaggtataggattgttcaaatgctgaaagatagtttttcttcccaaaaaaactggaaacaaatgtattaatggcctatggtgcctactgagaaagcttttaaacagtttcactttcaaataaattttggacgttgaggaagcaggtaggagatgtggtcagagttataaaataaagcggtggtcagcagagattttggaagcagaaaacagggacaggtactcgaacaactacagatgaacatctttcaactataaagtccttaaaataactgggtctgaagctactataatttatttgttttctaaaatatcttcaagaatgtaaacagtgaaccttcaagtatgaagaggccataaaactcttctgggcactaatgagggtgaacatggcatgtgccaagggtgacccaggttgactgttagaggcacagatttaagtggcctcctaaactattttctaaggactttccaatccaatgtgctcctgtagccagagtaactaatgaaatactgtgtgttgaagatgaacttctagttgttttaatatgccacacaaaagggatttatcattggaaaaatgatccgtcatgaatccttaatgaagctggatagagttgaggagcaaccctcatcttttaggaacaatcatgccctctggaacacactccttactgcaattctaagaggcagattaccaagcagtccacaaattagataaattagacatttccaacatacttaatttatattaaccaccacattatcaactttgaaattttagacagtccccagtggatatccagatttatttacaagcaaacaatcccctctccccttttaaaataaccatttagtttatgggcctcttctgacaatcacctgttcattcataacaaccaaaacccatcactaaaatgggcaacctcaattcgcttcccatataaaacatcaactacattatcaaatctttagggtaaaggcaagaaggtaatgagagatgcacttctgtcatatggtgtcagggatattgtggcctatgtataatttatttgtgtgagaaagaaaaagtaggaaaaagctatgtttgaatcttaattactttctttttttctttgagatggagtctcactctgttgcccaggctggggctggagtacagtgacacgatctcggctcactgcaactcccgcctcctgggttcaagtgattctcctgcctcagcgtcctgagtagctgggattacaggcgcccaccaccatgcccggctagtttttgtattctcagtagagatgggttttcagcatgttggccaggctggtctcgaactcctgacctcaggcgatccacccgcctcagcctcccaaagtgctgggattacaggcgtgagccaccatgcacagccatcttaattactttcagagatggttaataacctcactaaaacaatattctcatgcacatactcaaatccatgaaaataaaggtatcagtgatgtctgcatttccttaccttctatagctgataggagaacccgggaatgatcatatgcgattacattcgcgtatctattctttggtttgtttacttccaagtttgaatgttcccaagtgaactgctggccagggtcaattgactttaaaaggaaaacaacacatatacacaaaatcaatactgaaaaccaccagattataggcatttatcacatgtaataaacatgatttaaaaggaaaattctgaagccatacttcatcaagatgatcctaactgtgaagctgaacactaatgtaaccagcataacaaaaaatggttaatcactgcagaaacagtgatagtcaccaacattgattcaaatgaaaaaagaaatcaatacagatgttctgttaatattggaaaggcaggttcttaattttacttttccatttccctctctgctgctgtagtttacaagtcatcttggttcaatattccttccggttctgtaaaccttattttatattgattattcttccctattctttcctatctggacctaagctgagtctttaagttaactggtctttcactggcttcaatggacacaggctttactgttcattctttatctacatgttcacaacttaatggcaacttaaggttttgtctgtttctctgtaacacactaagaccaatattacaaggcaaattgtacaatttaaatagttaacacgaacagtaaagaagggaggtcagttaatttaatactcagatgaataagatacaacccaatgcatataaattgtttttctatttatcattatatattttctatttattattatgtgttattatgtttatagtttgctttttattcttgattttaacattagtttttttttctgattttatccctttctttgatggtacatttcaaccaaattattcaacaatctaaaataaacatcaaacaggtatataaagtatgtaatttaaaaatatttaagtagaatcatcatttcaagaccaaattcaggtttgatcataaaactctaggggacttcatttcctgaaacgttatggaaatcaaaatactttttctttcatcataggctactgataacatttaagatttataatttcattgttatatggaaacacaagttcattaatgacacaaacatgattttaaacgatcaaaatcaagttttcaagaatgataaaacaggtttatacccaggtaatttttttaaaatatactctattatgttaacataatttttagcagttatttttgatgccgggtatttttcatgcctttatgtgtatatgtagaagttgggagtaaaacatacccccaacagcatcaaaatactaaagatgtgcacactttctgtcaaaaggcacagaatttatcacaacagtaaaactcacaagtgtcaaaagtcaagtctgttagtagtcttgaatagcctccaagcattctaaaattctcagcagtacagattccagcctctaatttactaaggattattaaactgttttcctttcttagcctgtgttaatctatatacaaaatagtcaatcaatgagcagtattcaggaaaatattaataattatccataccttagagtctgaaaactaatataattaagggactttctagtttgctcttccagggaaatttttcatctcccttgcagaaattaattatctccaagcatgctatgagccgaaggtattgaagcattcagatgtcctggtggaagccttcaagtcaaccttgaaccatgtccacacagaacagctccactcagtgatgagggcctgccttaaaaatctctcaaatttgcaatctcattgctacttcctacatccggaacattggtatctgttgtctgattgaaatcccttctctaatctcttattccaatccactcttcatactgctgccaaagttgtctttctaaagcatagctctggacaggttggctgcctgtttaataacttccactggctctgtgtgacctacagcctaaattctaaattcctacctatgcagctttcgtcatctttgcatctacactacacctggctcagtaaatggtccaacagatgttatttaagcaaatgaacagaattgatgaataaatgtttttgagaaaagttcataaagagaaatcatagagtaattcctctatataacatgagagttagagaacaaattatggaaacttcattgtacagtataccacaattatcatacttaacacccattatcatatggcttagtgattaagtatgtgatcatggaattataactaccactgctattccactttatactgatgaacattattggatacataagcttcttacacatcatttaaacatcccaagaagctactaagctcactggtatacgtacagtgctccctctgatatccttgttttacttagactaagatcacccacagatgtataagatggcatgcatttacttatagcaatgaaattgcatctattaactgaaacaaactgttaactcatgtccatttccactcttgccacatgttttcagccttctgtaggacttacttgatacctacattgaagactttaaaaacgagtaacagaaacatgagttgtgtgccacctatgttagataatacgcttaggttcaaagtgtggcccatgagatgaagaccaacaaataacaggataattataaaaatacgtgctaggtcattatgctttatatgaagaattatgcttgattttcacaattgttacaaggtaggtattgtttttttccatttggcaggtgagaaaactgaagtaaagaaagattaatttaattattcttactgagggcctacttcgtgacaggctctgtgctacttggtacttaagtaatttggctaagctcacacagctagattcatacagttaccctcaaaccaggtctgtgtgattccaaagctcaactgataattaacagctggtaacgactaagccatgatactacttaactatccagaatgccactgcaaaaggaagaagcccaacttaagaaacacacctacacatcactatcctttatttcaccaatccaaatgatatttcttcccaacttatcagcctgtgtcattctggggcaattacataagaaatcaagttttaaaaatgaggttggcttcacatggatgataaaacagatgggatgcagcttacgtttatactcgttttacacggatcaaacaaacattgattaaataatgctgacttgtctttgtgcaacacagcactcatccatctgtatctatctgtctgactgaacgtttaacaaaacacaacacgggtcattatttttggagcttgtcagaatgctgacagcagtaaactcagtaaagaataacaactgaaagttggtgaggtatactaagatctttcatatttcaaaaaatacataaaactggttgaggaaaatcaaatttcagttatccatattactaagacaaagagatcatgaatgagtaagaccctaattgctggtgacagacacagttgctttgcctctctgttctcaggcttctcttgctgctgtcctcttaaggaagagtgagatggccaaaatgaagaaagagcaatgtagaccctgaggaatgtaaaagttgactttcacttcaaccctgtattttcggtcagtccaccctgaccatgcatcttttttactataaagctaagctgaggttacccaaatattaattattcaaaacaatttgaaataagcacctttgttcttaatggactcaattccttcttttgggtctgctgctgttagtgtttggttttcctgagcttgactcctagatatgtctactcaactctgtccacccaaataatcttccatgggatacccttgccttcccagcactcaatctgaagttttaccttcccaagctgaaatcctggccaggctttcttcagtctccgttgtggagaattttgcaagttagaaataaagcaagctagatttatttaagtaaaagttgattaatacacttttatacatgatacgaaatacataaattatcacagaattcacaaaaatgctacttcgtcgtattttttgtgtctccagccaatcaaaaagcctcttgaaagacagatattggatgaaccccatatagcgtctaaagttttaccaagatgccgcaccattttacattgcttccctgcctgcacactgggcacttgactcctcctccccaccgcagcttttgactaaacctttctaacgctaacaacagatcttcaactcaaaggctttgcttactcagaaaaaatgacccaatagaagaaaaaatcctattgtgagtgatttaaagaacaacgggaaagtctcaagcagatacttgctaatataaaacactttgcatttatttagtctttaacttgatggtctgaaagttctaatcctttttatttgatcaactagaagtttatctcaaactaggtaactgaaaaaataagctatagcagatggattagaggtttgcattgtattctcgacaaaaactcagaattaaaatataaatatatccaatagttgtaactaatacttagataacatttactatgttttctttgtgctttgtacatactaactcatttatcttcacaaagaccctagaagtagttgccattatgattacagttatgtagatgaggaaactgaggtatagataagacaaataactttctcagggtcaaacagctagcagggagagaggccaggctgggggtccacatattctggccctggaggctgagggcccagccaccataagatgctttctctctagttaagctggagaagattccttgaaggtttcacacttgcctttcaactattctcttgaaacacaacgcacagaaggttgggaacaatctgtgtagtactgctgaactctatttgtaattctaaactccaaacaagagagtgatcatcaatttgcacatcagattacagtcaccaagtaaaattatatcctgatatgggagtaacctttttcaataatgctgaagtcattatcttaaagcaaagtcctttaatcattctgcaaaattcaacctttttacccagaagaaaaatataattcaaatgtgcaaaacaccatacaatactagttgctctgtgtttcactttccctcatcccgccaagagaaaaacctcaaaatattccctttagaaactcatcaaagagaaaccacaaaaaaagatcatcctgtttttgtgtgtttttaaaacaactaacaaaaatttaattatatagaaggaatagaccagttacttcactcgtcaaaccatgggtcagactaaccattctttttacagggaattgaactttcaatgaccttaacttccaaagaaacagtatcttttcacatatctccccttcagtaggctcatttggttcttagtgtggttggctctgagatattctcaagtcctttctgaggtttagaagagcaatctaccattcactgtgtattctgcaattatgccttttaaaattctcattcattgtctctctcttctctgtttgaaaatggtaaattaatatatgcccatttggaaaagaccacgtttgcatagatgggaagggctatattttgcacaattagtaaaagcctgcaattggcataatgaatactttcttcaaagagaagagcatgagttcagttgaatcctatgatgttttagaaactgaaatgtgaggaaggagtggaaagtccagtggtgaacaaaatctggaagtcagagaacagggtgttagctttctggctgcccctggttagctctggccggtcaggtaacttgggtctgtttgctctgtgttcccttttcctcttaatgtcaacctagtgtcaggtgtgtgtcctcattttctcttatctctctttgtccaattagttatcaaatcttactgagtctctctctgtaagagcacctctgatccaggccaacattagagtgtgaaggattgaaataaagatttttcaagactctcagtattaacaaatgaatggatgtgggagtgccccacctttagtagtagaaaaggcatagaaaatgtataaatataccacactcattgaagtcatcaaaaagtgtttcagtcacatatttttgtacacagttaaaattctggcttcagataagtgataaaatgcatcagctttacctgttgtctaatggttgcatttgaaattttgactctaacatactatataacaaatacgtatagaaaattacttaaagtaataatatatattattagaactgacatgcagggaacaaaaaggataaactatgctcatagtaaatcattcatccatggcaagtgagtaaatatctgaggtaaacttttgataaacaatttattctaaattatatcatagtactaaagatgaattagtttatttcactgaggaaaccattgattcccagaagtatattagaattatcttaatctaacgtggattaaaaatgatgaaaaacaacaacaaaaccaaaaatacttaattcttttttttaactcagtaggccaacatgaggtactctctagaattcagataaagtgttttactattttagtgtgtgactgtagaaaagattatttttgagagatcgttccaaataagaatccaaaaaagaacatacaactttaagattaaagatttaaataactagattttttactatatacttttttaaaattttttatttatcttttatttttatttttattttttttgtggcagggtcatgcctgtccaggctgaagtgcaatggcgtgatcttggctcactgcaacctctgcctcccgggttcaagcaattctcctgcctcagcctcccaagtagctgggattacaggcatgtgtcaccatgcctggctaacttttgtatttttagtagaggcagggtttcgccatgttggccaggctagtctcgaactcatgaccttaagtgatccacctgccttggcttcccaaagtgttgaggttacaggcgtgagtcactacacccaacactatacatggctttttaatatgccaaacattttcctgaatattactaaatgcagaagaaagacatttctagtttccaaagacaatgtgctagaggaataagatcagcgatatgtgttaatcctaatgttttcatttttagctatttatctcctacatcagataaggtgaataataagaaagagatggacagatttataggtgatgttctttttttatttcttcacatctttgaattctatatagttgatgttcttaagaatagaatgtgtcattggaaatcactttacaaatacaattcacagattagaatttctgatgttatttgaaaaagcaaagagtattaaagaatttccaggcagtttggggcaagcaaatgtattagaaagttattaaactgctttgtttaaatagacaatgttgactgaattggtaaaatgtaattacgatgacttataagaagaagtcacttgatctgcaaatcacttataaagtatgatatttaataattaaagaggatcctggtgaggtggcatgtgcctgtaatcccacctactctactcaggatgctgaggcaggaagacttcttgagccctggagtttgagtccagcctgggcaacacagcaagacccaatctcattaaacaaaatattaaaataggttatgcacacctagaaacattaaagagtatggcaacattaaagagaatattattgagtataggtaacagacaaaattatctagcaaatacaatcaatgtgcagcattaaacactaatttacggtgttagtaaattagtgttttagtaaattaggaagaattaattcacagctgcatcctttcttttccatggataacaaggtcccagtttttgccaccaaattaactagatgaatgcattaattcctcactgctctttgaaaatgctgacacatctgtatagatcccaaagtattaagcgaaaagtacctgatgcacagttattactaaaagaatgctagatgttttgccttctcttgcctctaccctgtgacttgtataagaacatccctgatagaagactatcttagcctccaaggaatatctgcattctccttgatgctaacggtgccttttttgatactgaagtataaaactgaggcaactgctcaatttaacaaataaatctatttctgctctcctacttactatataacatgcccatctatgtaatttgcaaactgatttacttttccggcagagacaacaaaaaagagcacagctgcatatggttctcactttttgcatttcatataatagaaacttgaccactcagaaaactcagtacataagtagattcaaaagaaaaaacaaattatgaatgaatagcttggtttcacaattgttgtgcgactgatattacaacatcatttaagaaacactataaggaaaattgttaagataaatcatcttcatttttaaaagtcggattagttgagcttaagtgataacagtaattcttttaatcaaatatgaaaatgtctagcctaattttaaacatacgatttttcttcctattatttttactttgcatcctaaacatagatgtattttaggctttcatcattgctttgcttgtcatttaacagaaagtttctttattaagtctttgtttctttttccatatttagtttcagatgcaggtggagggaacagatgaatttctaaattgaaacataaattaacttttgttaatgttcagtcaatgcatttcaaatctcattttctgattcagaaagagataaaaattctacatccaaaatgaaataagaaagagtaatgttttctcccagtctttgtcggaactcagaaaatcccaaataatcacttaaaaaactcttgtaccccatttcataccaaatgtatttagtacaactatctcactaaaaaacatgactatccacatgtgccttttgggcacagtatatataccaacaaccccttgccattaataccattagtgcttgcaggtaaggtagcaatacaccatactaaatataggcttctaatcaaagaagtcacacaggatgatcattaatacttatatccatggtgctcaggtgtcttagaaagtatttacaatctaaagtgtcagtatatttgtctcttacatgtgataaaactagaaaggctagaacaaattaacacaatctagaattttagagtttagtatctttctaaactaaaagattactctcaaagattagtatttttaaatgtatattagttttacattgtaaaattagggactcttctaagttaaatattagaaaaaaaatcagtacattgatgatcttatgtattagacctctggaaaaaatggaatcacttgagaacactgctatggggttgtgatttatctgatgttgtatattttgtatttagcatacagtgaattttaaaatgtatttgtggaatgaatagctaagatacattacaggtaggatacacagcaacaattacttttaccctagtaccttagaactagttaaataaatttctcagccaaaggtgtgatgatgaaacaaatatatattggaatagaccagagatataaaaaaaaaaatttaaataaacagaatggctcccagctcacaagtggctacaacccaattcataaaagccatctttgactttttgtgcatctgaaattcattctaagctatcacctgtgacagccttttgtactgtgttttccaatttttacatatgtacttaatatttggaagtaacacataatggctacttgccaatgacagttctgtataaactgtattacccaattttctgcacagcagtatgggtttatacaattagttggctattttaatacaatagtttttttcatttttttggtttgtttgaacagttgtgctccccaaagatctcaaggccacttatgttgggagttatagggagaatggaaggaatgtgatcagatggaaggataaatattccagaatggagctctacaataggctgagtttgagttaggtagtccctacatcccagtttacacctactgtcccagcgtagttattaataggaccctttctcactctcaaagtatcccagtttaggcaagaaattacatggccaccccaaggtagagctggttctacctaacttcctcatattcacatctatatctaggcaagcttcatgacagtgtcataaccatcagtcaggcatgtacatgtacggggagggaaggcgtgcaggggagcaggagagagggagggagggagggagagagggatggggagggagggggagagagagggagggggagagagagagagagagagagagagagagagagagagagagagacagacagacagggggcagtctctgctaaaaagtaagtacacttacaaactatcacatggataggtgggtgggaaaaagtaaagagaaatttctgcagtgcaatacctatctccaattatctaacactattgatgcagcaatgagatactgaatccagaatgagagaaggtagctgaccttaccatgattcacccttgttcaccttaactatggtgctgcacacaagagagaaaaaggaagaaagcagagaatgtgtttctcagcacacatttactgtgctctctaacaaaccaacaatttagccctttctgataattgctttttcctccttctaagacagcattggagatggaaggaatgtgcagtacataagctggctggatatgtattcaattgtgattggatatgtattcaattatgatcaaagtaaacgaactaattttacaaactgataattcattctatagacatgatttttaatcttgtatatcacctataatattttataatatttaaggctgtgattggaatattaaatgtaattatgtcataatttcttttttaatttttaatgctttggaagtaaaaccatagacctattgtttgagtattacacaattcaaccatgatacgtgtctccaaatgtaatataatctaaacagtaaaacataaattaacatgtcctttaaaaatctgtgtattaacatatctaaaaaaatgctgtgtcagttagtaggagagaaagcaagccacagacatgcagacaatggagggccagggaggacgatgaccatgaaaatctggtcctctcagaatgacggtagcatttagacgtcacagcttcattacatggccaccaagaccacacaactaatgcaagtgaggtttccagaaaacagatctctctcaagttttagaactaagaagcaagttgtaaagtgaccatatcaaggtattctcaaggtctggaagcctgtcttgggatcactttgccttctctacctggctcaattcaccccactgtgaagtcagtctttgattcatccatttcctggtgttagacttcagatactaaactctgtcagaaagccttaaaagtgaaaaaaaatatttcccctgaacacatgtatacaatcatttaaaataactttgaaaagcttggaaatagccttaatataatagtagattatatgaaaaagtgtgaagctattaaaattgttatgcatctagtgacgtggaaagataaacttttactgttaaagaaaaaacatgaaacagtacttttgttaaaatatatacatatgtatacacatgcactgcatacatacatgaatacacacacatataaaaacctagaatgttatacaccaatgctatcagcagttatctctgagctgtgataaatgacaattattttatttccttatgtttactatccatgttctttaatttttccatttatgaacattgaactactttccaggaagagggaaaaaagagagttgcagaatacttttcacaactgcacatgtgacttcctcttgtcatgtcagaggcagaaggagcagactgtaggactcaacactctggaggggattttgtgaaatccatagaaaatttttcagctggcttttggggtccatgaaggtaacttcagtgtagatttatgaccaggaaagaatactgaagggccaacacaagactagactgtcttactctaaactcaccaaaggatggtagtgagaaataatcaggttaaattacttctgattttgaggattatgatgacaatgaggggtggattatcactacttacagaatctcatgtaattcttaaaacaaatttagaggtatcttagatattgttatctccatattacagataaagaaattgaggcatagaagggttaagatactttccatgagtcactcttggtggtccataaattaggagaactgggatgtaaatgcagagattcctgactttgaagacagagctcttaactactacactctaatagatacgtaaattataaatttattatcatggagcataattccttatttaaaaactgtggacagtaaggaaaatagattaaacaccagatacctctgccaattttggcttaatgatgcattcatcccacagttgttattgccaaaattttttgataatgaaagacaagccacagctttctataatatatcgttagattctaacatgactcctatcaaatccaaaagagtgggaagttaagtataatctttactttaataattgggaacaaaaagacacatctcaagttctccctggtttctacacacccaacagtgctgccccaaaaccctcacacaccataaattctgcgggaaaagagagaaagctgatgcacattcattccttagaactgaatagccataatgcagcaaagggtagagctgtattggcagaaactactaagaatggtgagagaccaataactcatgaaaaacaagtctacactaacagttttaatgactattctaatggtttaatggatagcactttaataggatttctagtagaatctgaaagcttctgaaagcttgtcttcaataaatctgtcattaacaaagaactgcattgcttaactacataaccatagtttactgagtctgaacacagaaaaagtatagcagttgtcatcctgtattaccatcaccttttcaagtattctattaactactgtgagagagacagctacaagatcaaaatgtaggctgccagtgaaagaggcatatttatactaaggggatgcagtagacattaaataaaatacaacagaaagctcacaattatagcttgtgtccaaagaaaaagctgaaacagtaactgtaatccaaatacacagatatactaacaatgaaatttcaaaaactagctttagttctctttgaaagagtattaaatgttttggggtgatttgtttttgaatgcctattgcactctgtgtctacatttgacttattttgtattatgttgcttcctgtactgatttaatgttctttaaagtcaggaattgccatgttgtggtgctcagggtacataccaactcaatataaatattggattggctataatcagtcctagtgaataattttaaattccagcctttggctctgttttcctctgtccatgtctgaggttctcatttctgacttttttgcactggaatatttcttgcttggagagcactttcttatccttttcttttttttttgcttctaaattctaccttcctttcaacaaggttcagcttaaatcccactctcccaattcattactgcctggagctttctcttacatgcttccatgtgtgccactatcatgtgttacagactggagcatccatttggcaactagctacgtttagccttgtagcatttcttcttgtaaagttgtttgaattcattaccataacttatcttttcatttgacaattctttatttccccaactctatagtaagtttctcaatggaaatactgtctggtatatatctgtgtagtctagaaaatggctagcccagtgcatgtaaaatgtatgtaaaatacatttttttttttttgtaattttaatcatttcttgtctcaatttctgtgaaagtctttcaaggttgggaaacttatttctttcggaattacacgtagtcttatatataccaggatcacaaacctgaggataacagactgatgcattcttcgagtatgttctatcaatgctgatagctgtaaattcatagactttacagcaattatactgattatcaaaattactgaaaataacccattggctaagctatgaaccattcaagttgtacaacttgaacaaggcctagagtatactggaagaataaaaataccttctcagatccaatagtaggcaaatttgagtaaatatacccatgctaggagatttatatatgtctgtctggtgataatgtccttgtaaaaatggctccttcattcaaaatcaaaagcattatcacttgaggcaggagttcgagactggcctcagcaacatagtgagacatcgtttctaaaaaattttaaaaactcatcacaaaagatggtaatgcacacctgtagtcccagctacttgggagcctgaggcaggagaatagtttgagcccaggagttcaatgtcgcagtgagctgagatgagatcatctcactgcactccagtctgggagacaaagcatgacccactctccaaaaaattaaaaaaaaaaaaaaaagaaaagaaaaacaatattattaatcaagctattcaataaaagtaaacagaattttattctgaaaaagacaatatgtttgaggtcatttaaaacacctattgtttattaagaaaacttattaagtgatagattcagtctttacacagagtgagtcttatttactccatttcaagggtatgctttgaaaaccaaacaatatagcgaacaaaaaacaaaaagcctaaacaatttcataaataacaatatgggtaaagtaacaaacataaatggcacgctctacaagatagagcctcttttaccaatataaatattaaaatataagcaggtcatcttaaccaatgatttacaataagggaagaaaagaaaaatatctatatgattctttggcatctcatatttctttctcgggggggcatatatttcatccagctaggggaattttggatgaaattataaaacaaaatactatgcctgttaactgctcccacagcttagagaaaccctaagaagttctgccagggaagcataatagagaacaaatgctgttccctaatcttatttcacatacattcaagtaacagaatatgagaaagagaaacatgagttttccctacagcgggtccaaaaatctgagagtctgaaggattgatttttctgtttaaaaaattaggaaatactttgaaacacacattttagacagttgctaagacactaactgccctgacctactgaatttccacatctttgtatgtattgagtgtcagaaaaagaagaaatcccatcacccctcacatggtacatgtaacaaacgtagacaaaaatgccagtcccattaaccatggagtaaaactcatagctgcataccaaaatcctgacaaattctagttattgtggctttggttaagtttggataaaaacactaaaggaacccttggactcagaattcaagggcaaaatttatgcatcatttatttttgtactgcagagtctagcaaagtacctggcacattgtaagagcttagtaaatatctgttttatgagatgagctgaatataaagctggaaaattatatagacttttaaagaaggagcattcatgatcttgaaaattgtttcttaggtagctaaaatttttatttttatttatttttaaattttttgtagctaaaatttttagaattggtcttcttgttctcaaggccatttgggagaaatgagcagctttgtttcaaagttcatctgtttattctccagcgaaaattataatccttggtctgtggcatcacaattggttgctgtgggaatgattatagatcaaaaacaaaacgattatatcccttttcaagagcaaatgagtaccaagagcagatgaagacttaaggaaacaaagatgttcttttcatgcaaatatttttacaatacaactgtggagagataaatactgaagctggtagtctttatgaaatttataggcagatttttagctttggggaaagacagctccctttgccctcagagttagctttgagacatgaatactacagatcatttttctttttttttttttttaaaaaaagaaaatataaagacactgagagcgtaggaaaagtgagttctgtgatcagtattcccctgttgttttatttcaggcagaagaatgtcttcctcatctgtgtacaggatcactgtcagggagcttgatgtcctgcactgtcctggcaatatgttgcccaagggaggtccaccaaggaaagccaaaggtgaattctccacctagaaagaggaccatgcccataaagttgctgttcctccgtctccaaaagacttctgctgcagcacagtagtagttaagagttataacctaatgaagcatgcttattcatgacttgataaatgatatctctctatatatcatgtgactatgcttggaaagtgggagatgcaaagagcaaactagactcctccttctttctctcttttgcaggagatgcagagaaaaccaacctcctccctctttctctcattccttccttctctccctctctcttctttctggcttttctcttccttctttctttccttttctttttcttttctttcttcttctctcttctcttctcttctctctctctctctctttctttctttctctcaacttatgcatgtattaattccagaaaattttaccatgctagtcacaggaatatcctgataaacgagacaccatgaagaagctttcataatagcagaagacacaaaagtaaaactgaagaccctgtaatcccttgcaatgccatggattcaacacagcaaacagcgaatcaaatctgccatatacacagtgacaggcacctgtatcaccctaatcttggccttgtactcaagcctcaagctggagtttggcccaaattgacaatggcattttcaaacaactcctcagtgcccttagtttccctccatcaaatgtttaaaagcaatacaaacaaaagaaacacaaatattcaccaaaggtagaaaaaaaagcccagtggtcttcttgattctttataatatacccacttaatatttaaatataaagtacattcactgaactttttttttttaaatggtgaatttgcccgggcgtgatggctcacacctgtaatcccagcactttgggagaccaaggcaggtggatagcctgagcccagtagttcgagaccaacctgtgcaacatggcgaaacctcatctctacaaaaaatgaaaagttagccagtggggtggtgtgtgtttgtaatctcagttacttgggaggctgagatgggaggatcatctgagcctgtggaggcagaggctgccgtgaaccctgatggtgccactgcacttcagcctgggtgaaagagagagaccctgtctccaaaaaaaaaaaaaaaaaaaaaaaaaaaaggtaaattttatatgtgaactatattgcaataataaaatgatgaagaaaaacatataaaatatatcacacaagtttatttctccctaaaactgccttatttcttcccataagtaaaattcctactttatcacaatccttgtaatgtttataatttgggttctcacatagaaaaacaaacatccttaacgtttcaagttaacatgactttaggaggtaatatgatggttgtttatttttcagaaaacatttttatgtgtttgtttttatctagggagtctacttagaaaatgtcatctattgcataatgttagatgtaaacttgcagagacttcagccacgtcacttaactgccctgaaaatgtcttctctacagtaaaataacagcagtgaacgaggttagaagattctagaaatcctcaaatataacttcacagtagaaactttgtgacactgaatttaaacttaaacctctaaaattttatgaaggattttttaaagataataggatgatttcttgagctgtgacaacaaggatcaatacagaaggaatagaaaaagaacaaaaatggaaatcaatgcccagttgcacggcaacatccaccaactctaacacttagactgaaaatttttattctccttgtgtctcaacagatgacaaggaggtcaattaattactggtagtgggtggtaaaatcttctaccttcccttatgcagcaccctaactgctcttaataaaaagggaggcagcatttcattgttcattaactatactaattatagcttctcaatcactgcagccacataggcactcctgagttgtagaacggcaatagaagagactcgacctaagcctgcagggatgggagtaggggaaacacagcattgagaaaacaaaaagggaaacctgacatcagaatctgaacgttattacatttacattaaatcatgtttcataataaccagagaaacagaatttcagcaagagagaaagaatctaaaaagatcgtccagtccaatcacctaaattatgtttgagcttctgcctcgtcaatccggctcaataagttatatgccacctgacatactgttcattttaacagaactaaaagctggagcaaaagcaaacaaaacaataataacaataaattcttaagctaatggaaataaatgtaggtaggcagtggttttgtatcctcctgccatcttgaaatacggcaagcatcttctgattgtacagtaacagctcctatcttttcaaatcatttagcagcttttgtatgaaattaagttgcagaaacatgaaaggattttgcatatatgaaaaggtgtttttagaatcttaaaggtgaatattactatgtatcatattaaaagacttataaatcataatttattgtggtgagcaagtttccccttcttcattggtcttatctaaatgaaactggaatctgactcgtgatatgtagtgagaagggcaccttgccagtataggtctcacttttttttaatcttcagggttagacaagtaggtagactctggtctataactgacaatgtcaaaacaagaaacaagtcaataccaactatcccctgtgagagttaaggctgagtctttacacctttaaatcccatcaaccatctgctttttttttccttgattttatttacctagatcaagatcagaagtcaaaggcagtcactataatataggtagttatagaatcaatctgatgaattatttctagcccaactaatcaaatatatttttctgtttgacaagcttaggatggaatgctatttgtttcagatataaactataatcctttcatcatcttcaaacttgctaatttttaataaaaattaaacaagagcatgaagcgggtggctgggtataaaggttcctatccaaatcatttaaaactaagtcgttttgttgttgttgatagactgtctctgatgttgaaaagcaaaaataaaatataattataacaaaaagaaatttgggacaataatccttccttggggtcacctgactactatgtgatcaccttaacagataagttaatgacaacaaattttccatggtgaaaactgtggtgaaaggaaatcaactctcagaggcaactatttatagtggtcagaacattacccagacctcagactacacgggttcatatcctagctttgccatttactagctgtgtgaccttgagtaagttacttaactttcatgtggttcaacataccttctgtaacatggggagactaacagtacctacctggaaggactgaatgagttaatgtttacagtaatgcattccgaagaatgtctggcacatggtaagtgctatacacatgtttgctatcaccatcatccttgtaaagcactatctagactctgaaactctatggaaagactattatgatattaaaatgtgcagtttaatactaaaaaaatgatataaaaatactctgttaaactggcagaaaataaagaaggggactgggaagaaaagggaaggaaagaggaagagaaggggaataaaagaatgagtgaagggaggagggatcatgagagaaagaacaaattaaatcaggggtgtctgtgagccactggttgaagtttagaggactgatgagtgcctgctgttaaggaaatttttttagcaagtgatatataataaagttctgattatgcttcatgcatgaacttttaagctaaagccaaatactctgattgctgcatctgtgacgatggaaagactaatgtttcccaaggcctagccaaaactgcaaattcatgtaatctcttaatgcttacatccttcactttcatctacactcccaaagcatggtggtgtgcccaacatttgttttttcaaaaagaatgacaaactgtttagccacagtagaaaaaccatgacaaataatactgccactaccattttataattttacaattaaatacataaataagtaaagtcatccctatgatgctgggttacatcaggctctaggcagccttgttccaatctcttcttgcagcattgttaaaattttccccgaaagctgttcccagcagtgacataaacatagacgtactcatttggtccctcaggtacttggagtttcaggaggaattgtaggaagtgatttccatgacttttctgaacatttttgaaatcacttggttgcagactccttcctatattgttatgacctttcaagggtgtaatcacctttcacacctcacctctcagcagcatgaccctgagctgcaatgacagtcacagaatatgttgggaacccctgagcaagccacgcttcttctcatctccatgcttttgcatgcacagatccctcagcctgggggcttgcatttctggcaaacttcagtgactctccaagtcatgggtactctgggaagactctcgtcaatattgtcccactcccaagattaacttaacaattattttttgttttgtttttttgttttttttctgtttctcctagaagactatggactcattcaggacagcttatttcttgattatttttggttctccagtaaatgttaaacagatgaaggcattcaagctactcctcttataaacaaagaaactgagatcaggagagttaaataatgtgtctaggggcattaaaactagcagagacatcaggacagtttccattcgtcagtgaaaatacctttttttgatattttaatgtggatataatttccagaaatgatattatgtacaaaatatgaaaagaactctgtagttcttcataattaccctccatccttgtcaccctttaccttcccctaattgctttcatagagctcctttttggaagaatgagaagagaatgttatagaagataaaaatcacttgagaaaaaaaagtcatgttaagtgactgacagataggtcatgcatattgaagttcacaataacaagagccacttctgttgaccaagcgcagagggcaatgggccaggtgcctaacatatattcatcttcataacagtctcatgggtagatactaatcttctcatcttaaataagagaaccaaggttctgagaggtaaagcaactggctcaggatcaagcagcgtagctactaattggcccagtcaaaatatgaaccttgttttccctgacttcaaggccctccccagcatccactatggcatccctctaagtacacacttagcattccggtgctaaaatcccaattttactttgaaataaaaatgcaactcaataaagagtgtcttttttcagtccttgctatggtctcttggaagttgaaagcttgctttggaagcagagacagagttgtttcctgagagccttgggctccacatgggagcaggtgaaaagacattttggagaatgtccagtgatggtcaagggccaattagttatagagaacttgtatgagaacaacgactgagaaaaaatgaaagttgaaattgtatgagaataaggactgggaaacagaaaacgagttatgtgagagtcccttaagacgggtaggactcccacaagaaaaaaacaaaaggctctactatgaaagatacgaagtttaatgttagtaaagaaaatgtctgaggttttttttttttttttaatgtgggtgaaagaacaaacattttaaaagtctaagtagaactaagctttggaacttgagaaattacttgcactttgagttttcacaactatagaagatcagtaagaaaaaaagactataagcgcatagacatacgccctgttttggatgcaatgtttcttctaaggtgagctgctgtgtctttgtgttctactagatttgtttataagatgccaaaagcagcccactgggaggggactctgtactttttcattttacttggtgagactggtccttaactgcagaacaaagacagcatgttctcagatggccgactggtaggccaatctttgctataaaagcggctcagggactttattcagtaggtacttttgagttaaatctgagaggtctgcattaaaatgtaatcacttctgcactgtctagagatagtaatagcctattttctgagagaaaagagcctgaaaataaggcttcactgctgatagatcaggtggggatgtcgactggaaaaagcagctctttacagcaggacactctttcttctgtttgctcctgttgttgatactagcaattttgatcacaacaaagagtttctatgaactgtaaatttagttagaaattgatccagacacacactttggttaatcacctgctgtgtgccgagcggtgagcttgttaccacgtggccaacagcataccgagaggccagacacctgaccaaaacacctgacccagagaggcttgatcacagcaaatgactggagagtaagaaagggcaacataacaagtgataattgcactggtttaaactagcaagtttccatttctttcagtcttttattcttcttcttcttattgttatgattattattattatttttttttactgacatcagcaaagccctaagggtttggcctgggataggaaatggtagggtttcattgattctaagacatacatttcctttccacattctaacatctctgaaattgatgtgcatcttaaaattgatggcatcgtgcagttataggggtgatatcttttattccttagtggtacatgcaatgatggagtatcttaaaattgatggcacctagatgagataaaataagtaatagttactaagactactgagtactggtgtcaggaaacctgataagcatgtatgtgtttgtttttaatgattgtatgaagtaagtactatgactgcttctttatatagagatgaacaaactaaaatacagagaggttcagtcatttgcttaaggtcacacagtttgagctaggggccaaactggtgacctgagccaagggcctgtatacttagcaactgtgtcataatatttattcccactgctggctcaacaagtagaaagcccggagtggcaggcagagaggtttggacccaatctgagaagcagaaaaactgccatgttcgtaaggaattgggcaaagactctcccacacccacctccaatcccagtgtattaggagattctgatctggaatagtaaatttagccattcatcttcctcaatttcatccatcccaggtacaaaaatgttgttactgctttttatttcacaaaatcgctcatttttctcattccattaccaaaccaccataatttgttctcaacttttttaaaaacaatcttttatctcttgtgactcatatgtcaaaaatacttagaaatggaggccttcccttagaaatggaagagtctattccactcttccactttgcataaaagatgaaaacagatctctgtcgtccaccacttccttccttcaagaaagtgggggaaccaccttcaagaaaaaatccagtgcattcgaagttggccaaaaaaaattgtgtgtgtgtgtatgtgtgtgtgtttggtttcttgtttttgtttgtatgattcttgaatacatgtcccccctcatgagcttacacataaattataaactaatagaaagcagatatgacagtagttttgcattataagtgctcagaggtttacaaaacctaataatgatgactgttttactaatgatggttctgcgcctgtgaatacactgtggcacatgtggtcaaatataccaagagtcttttccaagggaaaatagaaatgttttcttttgtggtcattgcttagatgacagacaatttttgtcccctctgcggagaaatacaatgtttactatcaggagtgaacaaattatctatggagaaaagcaatgcgtccttagcatgtcatagagaaccactgggttttcccaggaatagtcatgcaatggaaattggtaactatgacattttcacagaaattttaaatatcaatattttgatctagtttgatactaaggtttctgaactctatcatcagggcatagtaagaaataaagtgtgaaacatttaagtgtttatatcaggtaagttaaggtgcagtgaagaagaacaaaacaagatgaatttgtgacctggttttaccacacatagtaggtgtgtgaccttgggtaagtcacttctttctcagtcttatgctccttacctctatgatgggagagtgaaaccacatgatctctgtggtttagacagctctaaatattaaaaaacatgacctaagcaatgtttttaatgtctctatacgtctcaacactgtcttgatgtatttcattattcatcaaggaaatatatttttcctttatctgtcttactgagtgatgggaagattttaacttactctacaaaggtgtaatacatattgttataaaaacagaaggacagggctctgatatctgaaatatttcatataaaagggtcattatcatcatcacagacaggagatgtgagagtgctgccatgagaacaggaagaaactcagcacatgtgggtgctgaatggtgggagacatgtgagcactgagactggagacagtccacatccagagacggcagcaaatgtgttgggactgggctttgtgatgagaacaaaacagatcaaagaggccttcttcagggaacacttctgtgaaccacagagtttcttgtccctctccaatggcaacagaaagattgctccgagttaatacatagctttaaggtaatactactaacagagctagtgctgactaacttgaaactagatgtctgatgactgttcatctctgtgtaactaccatgacaggatggactgtggtccaaaatgtgacttgtaagtgagctgacaggaactcagaaaaaatgctgttgttgtaactacttaaaaaggggttattatctcaacccacaccacaaaatgtataacatctagaatgtacctgaagtagagtatgtgatttgggacagtatttctattagaaaactgtaccttgaggaccacattgggaactagttttacattttctctaactttatagcttttcttgatagtgaccactgggatgcccattaattttttttattttttttttactttttttcagacagggtctccctctgtcacccaggctgcagtgcagtgacatgatctcagctcactgcagactcaaccccttgggggtcaggtgatcctcccacctcagcctcctgagtagctgggactacaggtgcatgccaccacgacaggctaattttttttttttttgtagttttgcagagacagtttcaccatgttgcctaggctggtctcaaactcctggactcaagcgatctgcccgcagcgtcctcccaaagtgctgggattacaggtgtgagccactgtgcccagctgggatgacaatttattacacaaagacatcatcaatatcttttaaaatgtagattctgaatcagtagcagtggggtagtacctataattctacatttctaacaagttcccaggtgacgccaatgctgctggtctgtagtccacactgactatgagactaccagaacgttcatttctcatgtgcctttcccttgataaaatgcacttcactcctcttcctagttccactaagagtgccatcttctcttcaatacctttctcaattctccagatcattatgacctttactgaatcccaataacattccagcacttaagattacctccttggtgtaattctcgtttgattgtatatacttgtctttgacaactacaaactccagaagtacaggtttcttacaacttctatattttctcagcactgagcacaatgcttttctgtagtactgtagtggataattattagttcctcctcccagctcacaagcctccttacacagaaacttcgctctcccccatctaagatctgtatgagtggactgttagcagttacgtcccaatgtgtgtcaccacaacaaacagtcaattagatagagttcagagtttgctctctggcatttaaaacatgactggcaagtacaacttagtctctttatggggcctgtacgtaaatgaaaatatgattacagaccatgttttctgtgcgtgggtgagaaaaaaagaagacgctggcttgtataaggggaagaataaagccaccacagagaaagcacaaagatgaaagctccagagaagatatcaggaaattgccacagcccttcagttttagatgatagttcttaatgtgtacctttactgttagccttggccctataatacatcaaaaatgctcttctgtatttccttgagaatttctaggggctgcagttgcttacgatctatctagtctaaataagatttgtatatatatgactgtgatgatgcctactgattaaattttaaatatactagtctatatgctatctcagaaaatggtgaaatgaagactgggggtcatgttctgtaatacattaccctaaaccaatgacattcctcaaattgaagtctttggagcacctgcatcaaagtcacctgaagagctcttttaaaatgcagatttgtggataccacagctgacctattaaactagcatttctggggctgggaccaggaatttcaattttattgtgtctctgccaggttttggtatcaggatgatgctggcctcataaaatgagttagggaggagtccctctttttctattgtttgtaatagtttcagaaggaatggtatcagcttctctttgcacctctggtagaatttggctgtgaatctgtctggtcctgggctttttttggttggtacgctattaattactgcctcaatttcaaaacgtgttattggtctattcagggatttgacttcttccttggaatttcaattttaaataggcaaccaaatgatctgtaggcgccagcctaagattttgtttggcaaggtctacacaaattactctgatttaaagattcaccagcctaatatatggactttaacagccataccaactttaaggaggactttcttccctgcattccagatgccattctcaaattgagactacttaaattccagcaggacttttcagtttcatctcagaaaatggacatctaaagtgtttataaagacctgcagagatggggttacactaatttatcaagtccattcttccagctttcactaaattcactgttggagttcaacggcctttacagtacaggaagtgtctcataggatctaataatactgtgctacaatttaacctacttcctcgtattctgacctcaggatcagtgcaaacagctttcacgcctttaacctgttttagtcttagaatcagagtaaaaaaaaattagcttcgtgcatcttacaagttctgagtaaacatttactcacagtgattatgccaaaataatcaggtgtttgaaagcaatgtgagttttctttcctccattttctttgctgaaagccagtaaaaatctattcaaatttatgtagaagataataaacaatttttccccacaaaatgttgctctgagcctaaatttttatgttgaggtcttaatcctattatcacagttgaatacaacacttaaacatctccttcatgccggttaaggcacagtagagtcaattcatgcccagggagctttaatcatggatcatcatcatgaacatcagtgaagagtctatgtgggctatcaggtccacagctaagcctactggggaagctgtgcatagcagcattgccagcatgcagttcataactattttcaagaagcacttctgatctaatggctaaatgaggatcattaaagtatctttacatgtagcatttcttgaaaattccacatttaaaagaggccagttattgcattcaatagatgcaactgagattgcttgagtgatggttttatagccatgtgctgcataatgacatttcagtccacaacaaaccacaaataagagactgatccataaaactataacagatctgaagaaattcccatcacctagggatgtggtagctgtcgtaacgtcctagcacagtgcattactcctgtggttgcagagatgttggtgtaattaaacttattctgctaccagtcacataaaagtcaggcacatacaattaggtacagtacataatatttaataagtgaatatgttactagtttatgtgtttactacagtatacattttattgttattttaaaatgcactccttttattaaaataaaaagaactttaaaacagccttaggtaggtccttcaagagttatccagaagaaggcattatcatcataggagatgacagctccaggctgtcaccctgaagacattccagtggacaaaacgtgaaggcagaagacagtgatattgatgattctgactctgtgtaggcctagattaatgcatgtctttgcaacttagtttttaatcaaaaattctaaaaagttaatataatttaaatagaaaaacgcttataaaataaggatataaagaaaaaatgtttttgtatagctgtacagtgtgcttgtgttttaagctaagtgatatcaaaagagagtcaaaaagtttaaaaattttataaagtagttacagtaagctaaggttaatctactattgaaataaacttttaaaataaatttggtatagcttaagtttatagtgtttataaagtctacagtagtatacagtaacgtcctaggcctccacattcactcactactctcactgacacccagagcaactaaaagtcttgcaagctccattcatgctaagtgtcctacataggggcaccatttgtttgtttgcttgtttgtttgtttgtttgtttcactcttgtcacccaggctggagtgcaatggtgcgacccttggctcactgcaacctctgcctcccaggttcaagcgattttcctgcctcagcctcccaagtggctgggattacaggcacacgccaccacgcctggctaattttgtatttttagtagagacggggtttcaccatgttgaccaggctgatcccgaactcctgaactcaggtgatccacctgctttggcctccaaaatgctgggattacacaagtgagccactgcgcccagcctaaaaatcttttttacagtattttttaccttaccttttctttgtttaaacacacaaatagttgggtatagtaacttgctgtaaaggattgtagcctagaagcaatgggctataccatatagcttaagtgtataatagactatactatctaggtttgctatactccacgatgtttacacagtgacaaaatcacccaagaacacatttctccaaaggtatccctgtcatcaagtggtgcatgactatattattgcccatggtttaaagttatattggtggagagtgaattaacggcttactaacaggtcgagctatcatatttccgtaatttgtaacccattacataacttataatcaaaaataaataattaaagcagggctatgaaaaaatatcacatggcaaaataataagaatcatataacaataaaaagtaggttggagtgatgaaagatttctggttcataaaaattgacataactaagagttttttatggtgccccaggtgctatttatgatttgccttattttctctaaactcactatggagccctaagccctaaattagaaactatagaaagtgttttaaaggatactgcataattttaaaggagctattctgatcaagaggaagagcaggaaagaaataagctgcgaccatttgagaaaagaagacaacgtgcaatccggtgtgaattttcctagcattgaaaatgttctcctgaatgcttggagcagaataaaggaagatataacttcaccaagaggcaaggaaacaaacaaaatctttgcatcctatcaaatatgtgacaaagatgctgcagtatgcaaactgaatgaaacgtggtctggctcttgagggtggaggtgaatgagactacagatatgttttggttttccagcacagtaacttaaaataatgaacatttgaatatttgaagattttgggaaggccatgccacaggcctcactgctctatgttctcttacatggagcttcttcttatttttgtgacccctctaagccacttgaggttgggggtcctcttagaggttactacagaatgtgacagggtagaatgttagcgctggtaggtccagtgcaactgccccaattaaggctgatacaacagataccaagaggtaacaggatgtgttaacgactcccagtaagtaaatcaatagaaaccccgatggtgaaatttgggctgcccaggtacccaataaccttttattatttggtatatctacaagattttagttgtacattttaatcttatgttaaaactggtctagaaaaaacaattatcgtccagttatcaacaatgcattaattggcttcattaagggtccttgttgctggagaataccagaaatacccagttttataactttttgattgatatataccacaatatccaaatacacacacacacacacacacacacacacacgcacgcacgtgcatacacacaggcttttaatttacctccatcaagaattcacaaagaatctttaaggattctggaattttaagatagcattcagcgcaccattccttcaaaaacaagcaactctctgaaaatacatttctatcttaatattagctctagcattaatttagattgaaggataagataatatacacatactcaataattacagagttttcatggcttataaaaccaagagtcttgagaaatgtacttaatcttcgtaatctttctttctagatgaggattcttatcacaaatcagtgtatttggcacctatttggtatgctggaaagcttatcaatttagtatattctaggaactgaaaaatcagaagacaaatactgcatgatctcatttatatgtgaaatccaaagaagtcaaactcatagcagtagataatagagtggtgattaccaatggagggctggcaaaaggggagatgttgatcagttttagctagatggcaggaataagctttagcgatctattgcacagaatggtgactataattaataataatgcataatatgtaaatatatacaattattgccaattaaaaataaaataaaaataaaaaacagaaaattcataatctcagcaagtaatattgaacaaacataaaattaactttttcaaactgtaattactatattgcttgtgcagacacttttaagttgacggttcattatacatttttatatcatatttgagtcatatttaaagggaaaagcactgatgaagttaattttcaagaatatggtcaaaaaaagagaagagtaactcttgaaattactgtaaagaataaacacagtgaattacctcatattcctgggaaaacttcaagttgtcatttgctttcaatctttcaatgtggtctgcaagttccaagatgggtattggaggatggctagccatacctattgaaaaaagcaaagaagaaacacatttgaaaacaaatgaaaatgatgctaactattccaaaatatagagaatactatagttagaaatggcctgaaaatatgtgagtagtaaagatgttttaggtgaggaagcaggcaaatagtttggttactcaaagcaggacatgctctgggaagatgaattttgtagccaaatgaaaagtcaccaagcataatctccaaactaacactcctagtgtaaaagaaagcgttattgtgctatgaatcaataaggttagctagtggaaaaaactgacagtcaggcttgatgtcaacttctgctttgagtaatgacttttatgccatttcaaactccttctcctgcactgtgtgaaatggaaattgtgtggaattaaatggtgtaaagtgaaataagaaaacagacactgagaaaggcctaaaagggaaagagtagtagcttgatagtaaacataaaatgacttatgcataatcaaggaaaactaacttgaagaatgaaggttaccagggtaaccggaatcatctgaacctgcaaaggaaatgatggtgtaaataaaataaaatagaacaaattcttcaaaaaaaaatgaaatggaaagcctgatatattttttaaaaggactaattaaaatgctgcaagtttttacagaattcactatacattgtggctagtacaatgtgactactacattaagatcgctaatatttcacaaacctgtaggtgactgacattcacatgcaaacacagacacaaagaatgacatgcaccacgactcactgacgataatcactgacggcacaatcagacaccaaactgagcttcaaaaatgtttccactagtagcagattgtagaggttggggttgcagccttctcctggacatttataaatggccacactaacaactctgtgatattttgccccaggtccccattattcaacccccagcaaacctacaatctacttcaggtgtaaacatctttgtccactaatgagaaatggattcagggaagtgagcaaatggtgaaaagacaggagggaaagagggtgaagaaagaaggaaagcagagatggggtgacacattctagttcattcagccagcggaagatatagtaatttcatagattccatgaaaaataatccactattaattttggtgactcctgtgtctttctgatgttttctcacttttcatatgatttgtcttttatttctttcctattaattttacagaagtatcatgaaagagcattgctgactcttatcttacagatataaattccagctggctacaaaaacctgaactagcatgtccccagggaagccactgaagcaggaaaagaatgagggaggagctcaaactggaagccatgtgttgacattctgctgtcactgtggctctttggaggaaggctacagaatgatggccattgagtcaacatgacatgtgactactttaagagcattttaggaattataccattgttaaaagtcacccagtaagttcctttatctcaaatgccaaattattaatggttctggtaagttaagtaaaaagctaccctgctttttgaagacaaccactttagcaagtgttgtgaattgtggtggtttagtttttatggctatgaaggtctgcttccagtcagctaaaattttagtggagagccaataaaactgaattgcttgcaagtagaaactctttgttggtgatataataatgcctttggaacaaaattttggaaccctttctgaaacttttctgtattaatgatagaactgaaataatttacattctatggaggaagtgtgagggtgacagtgatctgataattacgtgatcttatccagatgaggcacccccaacgaaaagaatggaaatgcaaaggcataggtgactttaggcttatctggaaatggaaatggactgatgtggacatcattacagtgctttcacagagaaaataatagagacaaagatgtttagaccttttcgagcggatcgtgggagagagttattatcatatatggactgagtggtggtttggctagagagggaggacacagagccaatcagggaggcgtaggggactgaattactgctcaaagctgcaaaaagtaaagccagttggagacgggaaaagtattagtataacagcagtagaagaccataataataaccaaagatgtgatcaacatatttacttgtggcatgcactggcacatggtctggaagtattatattggaagtttattaaagaaaaattcaagcagacctacattgagtcattatattccacatcagaatatatatacatatatgtatcacatgcaagatatcacagcattaaagaatcgctacataaaacttatcattggataccatattgcactccatttctaagacaagtaaaaatggcagatggatgtttcacagaaaagggaggagaatctgtgtgaatccaatggtacaggagaaagaaccctggcttagaatactggacatgggttctacttctggttttggcatctactaatagggacaaatcaccttttgtgaagcgccttgatttctttaactgttaaaataagagtatagaactagataaattcaagagccattctcttcttcataactttcattcttcccacatatagacagaacttctgaacagagaagggtctattggtgcatatgtaagggttctaaaagttatcgtaccttttctttgaagggagagagtacttactttttacaaaatggaaaactagtatgcagttgaattgtttattttttgaactatttaagtttgttgctattttctttcattagccaaaatgtatacacagtctattatgatgttatatcatatatcagaaaagaccgaatgtcggcataaaaataatcatcaagagtaaaactcctctaagttgaaactgtttagctcatatcagaaaacaatgaccaaggatctacttcaaaatattgttacacaattctgcagaaacatctccgctgcccaatattgaaaaaaaatgttatatgatataaacaaatatgttagattttgaatgaaaaggtagacactaagaaaactatgaatttgacctcactgtggtaccttttcaatgttttgtctggcaacctgaccactgctcagtctataaaccaaagtctttactacatcagattttacacatttaaattacttgatgtgctttaatttttttttttttttttttttttttttttttgcaggctgtacaccagaccaattaattcaggtctgtggatgtgggagctatatattgatatttttaaagttcctcagcactggctcttagtcctataggattcatgatggggggcctataactccatttattcctttttttcccatttagaaatcatatcaggatttatgagaatgagatgagctttctcttggtgatattcttgaatcctctctaacaccccattagcaagctttagtactcagctattattggcagcaaagaacttgaagcacagctaacaaacagggagggcttgccagtgtcatgacctcatcagttagaagctacaaatgtacaatagaaatgtattattttttttttttttgagatgtagtctcactctgttgcccaggctggagtgcagtggtgcaatctcggctcactgtaagctctacctcccgggttcaagtggttcccctgcctcagcctcctgagcagcgggattacagggacgcgccaccacacccggctaatttttatatttttagtagagatggggtttcaccatgttggtcaggctggtctcaaactcctgacctcatgatccgcctgcctcgggctcccaaagtgctgggattacaggcgtgggccgctgcgcccgacccataaatgcattttaaaggcacgcatcaaatctgttaagactttttattttgaagctatgatctccacaatatagagtcaacatgaaaaatgacagatgcggtcactgaaatctgccttaggttggaggaaaaaacaagatggctccctttaatagggtacatattggtgagactgatgtcacggtgacttccttataagaagtaaactttaaaatcatggcattttaacctgagaggcaccttagagatgacttagtccagcactttcactttatacaagaggactcaaatccagaaaagttagatgacttctctacataagcccagacagtaaataacaacatctcaacatgcagcttgggcatctttctactgtactattccgagaacggcatttgcgatcttctaaatgaagtggggggcaaagtctccacagatggaatgggctaggctggtaagataaatgactgaagagggctaagtatcatatagtcaacattttcacacacagaaaatacgctcattcccatttcctcacaatgagcaggtttccagggctggcttttgtgtctctactttgaacagagactccagaaagaacagtaattctttactatgtgaaaaacagccataagcgtgacataaatggcaactaacgctcagtctcaatgtcactcatctttagggctagtgtacacattggggggcttctgaaaagggtgaaattattcagctccaggacttgctctgccaagtgggaatgcaaggccaatcggttcagactgttcaggttttcaacagccactcaaaatccagagtatcgtgtggcatttcctcagttttcaatgttgactcaaaattttgttgaaactcagtccatgtcaaacgataagctcttttgcagaccacatacggctaactagattatggcctttgttttaaaagaacaaaaccttctttaatctgtgtgtatgtgaattagaatcaaggagtgttgggagtgacagactgcatgcttgtatccacaaggcaatggactagatactgctttgtgctggggatataaagaagtatgcttcttgcatggttcatcccctatgggttcatctacctccccttctctctaacctgatcccccattatctctaccaattagaaaaatgaagcccagaggagttaaagaactcgatcaaagtcatcattatcagcagaactgtagctacatgaggaatctgatcccataccccgtacactctcatttagcacatttcacatgacgccatgctgtctttccaaccatttaacacccctggacaagtggtgacatgtacataaagctgggtctttaagactgtttgggctctctatgcagcaagacagagatcataaaccatcctcagtttgtgaaaaagtgtcaatacagggccttaacctaggtcatctgtttcagtggtggggaagaggaaaaggggatgcaaaaacacgtctgtattttccagttatttcttgccaaaatatcctaagtttccaagaaaacatgaactaaaggtattaatttaaaatgttaaaaactggaatgctatttggcagaatatttcttagaagctaatttatggtatttttgcttttcaaaagtcctgctctgttttactaagtcagtaaggctactgaatgcttcaaatgattttattatccatagaaaaatatttatcaaacacttgctctattttcatatttttaaaccttgcattaaatgccaataggcactatataactattctgctaagtagagtttttgaagtcattaataacggtggtacatcttttacatgatttttttctgtcactatatacgtgtgtttgtaatgactcagtaacagtctcttcatgattttccttactgataaattgtgataaaggctggagaacagtttgtgcttatggaccaaagagaagctaattttttcatcaaatcaattaccacagtcttaacaaaagtagacttctatgagttaacagccagaaagagaaaattcattcattaaatatttgtcatatttttgacataatgtatgcactatttagaattccctgaatcaaatacaaatactctgctatatttgttatttgtatcacaaactaatgataaattaaagataaagagaatattgatttgtaagcttcctgatacaaccataatgacaattagatttaatttgtgactggggatcatcattaaatgaaagagtcaccaacagtgcttttctgggtaagcaatgaatggcataattaaaattcaaaatttttacttcattccaggagtttctgtccagcctgggcaacagaggaagaccccgtttctgcaacaaaaatttttttaaatgaaccgggcattgtggcacatgcctgtggtcccagctacttgggaggttgaggtgggtggattacttaagcgtggaatgttgaggctacagtaagctatgattgtgccactgcactcgagcctggacaacagagcaagatcctgcctcaaaacattttaaaaaatttttgtaaaattcaattctaatggagagtttctcaaaatacagaatttgaacaagctgtttctttatatcagaaatttcagaaaataaaacagaaaggacacatccggtattcttaacctaggtcatatgcctaaattccttactgtataaaataaaatatgaatgtatgaagaaagtatatataaaaatggatcttgttagcattgatccaattaatagtattaatagatcagaagagacagctcaagagctttttaaagcttattcagttgctgtgcagacatttctgctgctgataccactatttctgatccgttaactttttatgagtttgtttctgttttcacagcccatcaatcacctaccatccatgtatgctttagggcaaaacatattaaggtcatccactgaatgaaaatgaggtctttgtgttgtaacatctgatcatcgagttttaaatctcttttcctaaaaggtgcaagcataaacactatagttttggttttgtttgcaggtatttttgggccagggaggaggtatgaacagggacagcagacactttaatattgaatatgcaggcagaggggaaggtaatgattggtgcaccaccaatgctaccagtagcatcttctcttacaactttctttgtactgaaaagaaagtgaatttctctaagatcctcaacctctaaattttctttgctgggaaaaagaagaaaaatgaacacatattagtaatttgtttggttttcttatatatcaccatcttttaataatattatgtttattttcatcattttgcccaattctaaaggccatgggccagagggtgtcaaaccttcagtaaaggatttttacagtattttgaaaagtctgtaattgggtctctctatcaaaatggtaaatgtgcctaccctaggaccctgctatcatatttccaggtgtctgacatgcagaaatagcaatgatggtgtcaaaatatatgggctcagtaatgctcattacagtagtatctgtaatagcaaaacatgagtaataacctagcctccattaatagggaatgagttaatacattttgatatctatagaactgactaccatcattgtcattatctgttaaaaagaagacataatacactcacttgaaaaaagtccatttttatatagttaaatgtcacaacagcaaattgtgtgtgtatacatacatgacatacacacagacatccctacctactctatattatatcatttaaataactacatacacaaattaattctggaaaggtatatatgaaactctatatggcagatatttctggagacttaattggagtaatgacacaaaatattttaattttaattttaaatatgtcaaataaaaaagaaaaaaaagtggtggaatgaagagtaatttttcttctctaaaagtgcttttgttggaccgtttcccaccatataattataaaaattttcaaacgtacacaaaattaaagagtaacataatgaacacctaaatggtcacaatctatatgcaatgattgttaacaagcttattttctattttccaaaatttccccaataaacatgttgcttttgaaattaaaaagatgttctgggacggagagactaaagtaatttggaaattgtttataaaagaaagaaagagaaaactttccttgcaaatggggctaacacagttcatctttgtttaacaagcaacatatctattcacccatcctagtgcgcacccagttactgctgtctacagagatgtatggagcttaatggacatttcctttaaatgcatcttttataagtgaatattttcttcccttcttccatagatcttaaagacttgtaaaacttgatcagcagttaataattccagtaaactcctctactacgtcacctctctcttttacttattttgcccatcttattccactatctgttagaattaataagtcaaatcttagctaaatgataccttcctatatacttaagtccccattttaacttggtagttattggtgatacaactgatgttacttaaattgcctttttcacactaattctggctgaccttgtacactaataatgatttattgtttaaatcattattctcttaaatgattaggtagctcatgttgtctcaaatataacttggctatacactgccatctgaaccacaataagacagacacttacaatcaatcatgcaaaatacttacaagctgaggtgcctgctttcaattgtgaaagcatgggcttccccgacctgttcaggtgtttacatacagtgtttcacagactgacaggatattttttttcattttaaagtatactttaataatgaaagtgtacaagcacaaaaaatgataaatgttcccgtatatttgtccagacttaccatgtgaacacatcacttaagtaatagattggtcctaacactatgcagcatcctgggatcctatcagactgtttatcctgaatctagtcctattcctagaaaaactaccatttagggggagaaaaaaaatttattcaacaattccatattgtctctgatgcagcaatcggttaagtcacaattacattatgctcaataagagaaaaataaaatagtttttcagaaggggctgggttggtgattcttttttcactcatcttaatgctaaaaaagaccaagaactttgttgccactaacgaactagtgggcttcagccctgaagtacctctagctgccagcaccatcagtgacttcagaatgagaagatacagcaactccttaaggtgctctgtacagattcaagtccaagctacttctttggaaggctctcagcagtgtcagagagtgacttgattcttgtctaaaagtttgaaaatgtgctaaagcaatgttcctctccacactctccaacctcacaaggatggttatactgacaaaaaagcaggtttctctgtcttttctttgtgccttagctgagcaacggtggatggaaatctaactttttctgatccaactatgtttgtggtactgcatttaagggtacagttctttgacgtacttagattgttggaatgctatatttatatgaaatggggaatatcgggcagaattaaggaaaaaagatctgacttcttaaatctcgattctccaaaagaataaataacttagaatgtaaatcaatctttcattcacaagatgacttttttgagaaagtagaatttatagaatcactgaactaagcaatgtgctttctttaccttctgaaaggcctactgaatttcaaatcgtaatgtttgtttgctattttatcattcataacagacccatcagaagcagaaatcaatttgcctttgggaacaaattctgtactaggtactggttatataaatcacaggcatcttatttcattgaaagacattttttgaacagaaggtgtggattactaattctctacttatgtatattattaataaatattctcaagcgttataatgtttggggataagcaattatacattcatagtagatatattaaaaagccacatttcagagagtgaaatgtaaataatttaaaaacctaaaaattagcgtcatagcacctgtcatgcaacacctaatgaaggattattttatttcattatccaagaaaacccttgattcttcgtgaaaaagaggagaagaacaaccacaaaagggttactgggttaacaaccccacattctgctctcatcctattggcaagtaattatggtaattaacagccgctggctaaaatctatgcaggctgaagcaaatggtcacatctctatgaatttcatattaacagcggagtctatttcctttgtaaaatggtaaaaatgttccagacagcaggccacaacatagagcttggatggcaaataaacaatttcagcaaatcaagcttaagtgaattgcttacctgagctaaagggcataatgtactgcttcctgagtgaacagatgtgctaggaccttaggacaatttctccttttctagtctcctcctctactacagctcctctcttatctcattttgtctactacagctcctctcttatctcattttgtctactttattcccttattcatttgaggtgataagtctaactttagttaaatgacaccttcctttatactcaggtccccattttaattttgtaaagtcattggtgatacaagagatgttacaattgtaacattcattcttctttctggtatcttacctaaaatttaacagattctctctataaatggatataatattcccaaatacattgggaaaattaaattgctaatagaattcttgagtttggccatatttgcaaaattacatctgaaagtgagaagtacttgcagacagaagtctcctggttgaagacattcctattctcttacctgcagtcaccagcacctcttaatcattctctctacacagttcccattcttgctttgtgtttattcccggaaacattttctgttggtgcgagaggaggtgaggtgtagcagcactctcactggctcccttcttttgggggtacccttgcctttctgctcaaccttatactgtgtttctgcctccggtggaagaccaaggttggttccagcacaaatgacatttatgtgaaaaacagaggaaggaggggcagtggagagctagcagcaaggtactgagaaatctgatccgtttttctatttccacaacatgttgctcttttacagggtgatgaggtaagaaatgcaaggaatcatgtagcagatcatttcttcagcttttgggtcctctatacattgagtttgctaaattgaaaggaatataaattcctgggtccattattaagaagttgcctgtaggccaggagtggtggctaatgcctgtaatcccagccctttgggaggctgaggcaggtgagttgctggagcccaggagttggagcccagcttgtgcaacacggccaaactccacctccacaaaaataaaaaaaaaaattgtctggatgtggtggcgtgccccagtagtcccagctacttgggaagctgaggtagggggatcacctgatcccgggaggttgaggctgcagtgagccgtcattgtgctactgcactccagcctggacaatcgagtgagactctgtctcaaaaaacccatcaatcaaacaaacaaccaaaaacaaaaagaagttgcctataggctgaagtagttagtatccacctatttcaaaaagcgctgacccaatgaaatttactacagtaacttaattcatatcaagttgccttaataaagtactgagtaggtgactcaacaagatgcatccagagggctacgacctatcctggaagatgacacaagtttgttcaatcatcatgtacacgttcccggtgcatgatgaaataattttttttaaagtctaacctcatatgagttagaattttttttaaataccgacattatgatgcttgtatagccacactgaaaatgctaaacatttctttcaattgaagagttactagttactatgttacatctacatgtaaaagagaaaatatgctgaacataataaaccatgttcaaaataattcactgtaaaatgtgtactgtaatatatctgcagtgtatcatactgtgaatcagaacatccatatggcacaaagaaacttgtctacaatttgtgggacaacactgcaaccacattttaatcccaaagacttcttagattagcttttcactttgttcattatcataacatattaagatagggtcactcggttttatattttcagctccctctgccattcataatttgccattcatttggtataaacatgctttagttgaaaaagtcaaatagatctaggcatgaataaacaatattgtgcagaaggcccctcagtaggaatagtagtgttcctctgttgaagcacttaatgttctttattttaagaaacaagtatattttttgttatcctcagtcactttatgtttctctctagtaagaagcctgaagtgatcagtgaaatttagtataggtaatatttaaaaatatttacctcattttcctccctccctccctccctttcttccttcctctttcagagtaccataaacacaaacaaaaaggaaaatatagaacaaatctatgctttcccatgggatgaaagatgtgtacagtcatccatttactcattcattcacttgatgagaaactgaattctttccagagtggtgtcattggaaataataaaaacaataatcaaagcccataaaaatggtagatattattataaagactatagttcttccaaaatttgaaggatacccatatttctttttcttccctacccaatttccggtttgcagaaagaacttaatttcctttcagacttttgcttgggcaagtctccataatagtaaaataaaagagcaggatgaacaaaatggctcaaaataaagtgataccttcaactcttaatatcaattgagctgtacaacttctgggaaagactgtgtgtggattagatgtgtgatgcttcttacccggtgtttgaaagttaaggcgcctcagttctacagggtctgttgggtggtgtgaagggatctccttattgttcggtatgctgctttttctagagtcggactctgccctcttcctatagggggaaaatagaaatttaagaagaaaagaaaaatcaattgaaacagatagaaaagcagagaattgcacctgcactccccccacctcccaagttttcagttttacaacttttcaacccagctgacttgtgacccagttcgggttgcttttcccccctggcctaattgttctctcaggtctaaaatttttgtttaagtcaatgatctcgaagtcctcctccaactgcaggattaaataattcagcaactctgccttttggtttcaaagggatcttggtgagatacgcatggacccttattgagcaattctctcttatctactagttctatttgtgaggaacaggataggatacccctaagttgccaatactaagactgttgttaccatagagaaactacctgaccttaagctgaacagctaaatctgtcccccttagccctaagtatatataagtggtgactacagagagtagatgccgtagattttcccataaggcaggtaaacacaagtgcatttttaagatgccaagttatcctaatgcctaggataatcgggaccaggtaaaacagaactcccctttctctttcaaatgtgaaggaaaaaaaacagtgttagctcttaacagtgttaagctaactgtgattaatattttgttaatgaaaggttcacagaaagatcagagaaaaagtaatttcacctggtgggtagatcagcgctcctgataatcattcaaggtgccattgacagtgccttgttataaatgtgattcttcacacaatacattttaactttgttctaaaagctatctactagctttattagatatccccatttaagctctcattatgtaattttaacaaatttctaagcaagaaatgtcagatctgtatataagatttctttatccaataaaaaattaatcacagagtcctaactatcttcttccagtttgaattagattaaaaacccattgaatcaatagaagccattttcaaacagtgctttttttccaaatactaacgcctgcaatctctacaccacagtcacaatcctagtatctcacccctgctcaaagcaaaggcgtttttactgtgggggggaaaaggtgctgcacagtgtttaggaactttccttttctctgttcgatgtgactgtggtacagctcattagtgttgctgtggcaatggggtctcattcaatgccacccaggtcgttctatggttagccagagggctcctgttaaatagcctttcttcccatttctgctcatctgtataaaataaaactaaccagggggtgaagagaagattgatacaaaggggacgtgcacatgatttgctcaagtgcagtgcctttggcaaaacatccttaatggaatacattttcatggctaagtcctattagacatgttgctttctcggtaccttagattaacctgtctgaggatttcttctttctacctaaaggtgtcagatacagccttgggacaaaatgtgctgccaacccattccaccaatcagaggtgagcagtattctgcgacctgccaaggtactggcagctccagttctatggagtagaaaggaagaagaaaagaaaaagaaaagacaaagggctggtgaaaaagatatgaggacgaagaaaaagacaggctcataagaccatgcgaaaggaggacatgatggccagtttcagagtaggcaatgtcactgtgtctgtgctatgggtcttcgcctcaccacactaagagattccttttaccactgaagatgcaaaatcgaaatgggttaatgaaacgtcactgggtgcagccagccagtcaattccacgtgaaacatatggttggtcttctcacttcaaataataccaatggcccttctcatgttttgatcattttgcataagttggcaaggatgcatttctttactaatgtgtcaggcccaacgactaaaatttggatttttctcccttcccattgtggctctgccattcttgcaagattatggaaaccagaattagaaatatctatctgggcaagaaaactactttactcttacaggtattgtagggtaacctccttatcttctttttccctgtggctggggtgagtgacactgagctggagggtagaaaagaaaactctctaaagtaatttagcccatttctctggtgcaaggaaagttaggaattacatcttgttgcaaagatgtgagtctcagaaaactcaagacatgggactaaaattacaattcacaatttgaatgaacagggagggatgtagtgacatttaataactaacttctctttcactgtttattcaaatgaaattatttccaagacctcagactcctgaaatcctagtcaaatagaaaaccagctgcttaaatgtattttgcttagttttctttcgatgatcacaacatggataattctggctgtccacattcttatcacattatttttaaacacttattatgtgatgtgctagaatgattgttttctaacacagaaaccatttctaggaaagatgtggaagatgaagagtttggtcatcattggtaataatactaaagagttttaaaacgttgtcataaaatattaaaagacatataatggtctaaattaggcccaacatgaatgtaactagtaaccttttttcctgataaatttcagaggtctcatcattctcattttcgatttgaaaaatggaaagaataatgaatagaaacagattttaaattttgccttgctctattttttttctattaagattataaaatgttagtgcgagtttatttcttgcagtgagaactatctactatgtggaggagttatgtaggtgaaaaggaaatggaagatcacttgacattttggatctgtcagaaactgctaatactataaaagcatgtggttgtttgggatgtgggtaatacacaatacaaatgctactctggtctacggggtattttgctttcaccaggctctcatctggggggaagaaaaaaacaaagagaagttgagtgaaagatcaattcatggtcttgaaacaaagatatacagacatgtgagaagaggcttttgaaagaaacatatacttattagaaatatctaccatcaatattcaagtaaatcaatcaaaatatttgtttctgttaacattaagaatgtaatcccaactctgccactactggtatgtgtcaactacaaattttcttttcagtttatttgtgtataaaatagagggagattagaagaggatgtctaagttttggttcaactctctcattttaatagaaaaagaaagcattaagttgtaaaatatgaaaagtgttatgatgaaaggtacggagtcccactctgtcgcccaggctggagtgcagtggtgcgatctcggctcactgcaagctctgcctcccgggttcatgccattctcctgcctcagcctcccgagtagctgggattacaggcgcccgccaccatgcctggctaattttttgtattttttagtagagatgtggtttcgccgtgttagtcaggatggtctcgatctcctgaccttgtgatccacccgcctcagcctcccagagtgctgggattacaggcgtgagccaccatgcctggccgatgaaaggtagtattttaagtgagtttaaagtgttttgtcttttggctgaaaaaacaaaaacaaactattttgcacgtgtttttctgctggacaaatggatactagagatgtccacacaaagaagacaccctcatagaggtttaaagattcttatcattgaacatgaggcttgctgaccaacataaagtgattttagtgtaaataatgcagcaatagttctcaaactttagtatgcatcagcatcacctgggaaggcttgttaaaatacagcctggtgggccaatgcctagactttctgatttagtaggtctgaggcggggtccaagggtgtgtatttccgtcaagttccctggtggtgctgacgctatggctgctggtccagaggccactcaatggaaaccactggaatatggcattgggagaaaggtaggtgatcttcaagatgttttttgtagtttaattttaatcgggaatttatatatatgttacatgtgtatatttatacataagtgtatatgaatatatagatatgagttagaaagctagagggttagtttggattaatcattcaataatcacatagtgtattttagctattattattgctcttattattcaagactgggagacatggataataattttgaattggggaagagttctcactaaggcactgtcatcaatatttgcaggatgtgaaaatgctaatatcattaggtgatctgtactcaaacttgaaaactaatctttggtaaaaacaaacaaaacaaaacaaaacagtttatgagacacctcacatgtctgctctgtaaacacatcaacacacacaaatgcccattttaatcttgaccacaaacaaaactcagatattggtttgtgtactatcttttaaacttcgcctttaatctgtttttttctaatgtaaacaaaatatttattttccccagaatcatcttaatgaagttactgtgtatatgtaggctttgcccatcttccacgtgccaggtattatcttttgtgtgcagccccgccctcccctcttcaacaactctgaagtctaccagtttatttttttcttactgaacattaaaggggtttgttctctattcctcacctgtcgggtttactgctccattttaatgcagcaaaaaaaggaaaaagaaaggctaaatgttagttggccaatggtaacaaggataaccatgacaaccaagatttaagaaatagtgttcacaagcaaggacacataactgacatacattcagaagcgacagcgaatcaaaatatttatagacctctgattatgaactaaacagaggacatgaagttacatcactgaatacatagtgtgtgtgtgtgtgtgtgtgtgtgtgtgtgtgtgtgaatgccacgtgcacttttatccatcacctataaaatactgccacaattaattatatcccaggaagtgttcgacagtggagagataatttgatttttaaaaaacatgctatgagaaaactaatgtactcaatgggaatacagcatcattccataaaagaaattcgttcatttaaaataaaaagccttcaattaagaggtatgtcattcctttcatgatataaaatatctgcaaattgtattgaactatacagaaatttgcacaattgaataatacaccaaaaggtaataaggtggcagaaatgatttcttcaaacacctcttgccacatcttttttcccatgaaggattaagtgcatcttcagtttaggaaaatataatacccatcattataaatctacagagcatggcccatttatacagttgggctaatccagaaaaacattttattaccagccattgacagaacatgtattttcctagtctgtggtgctgtctgtgaacacaactagttcatgcttatagatcctttcacctgtgataatatgttgattgtgtaaataaccatattatttctgcagagtataaccttttcctgaaaacaattaatctaaaaatcttcactttgaggcaaattgcaaagttttcagtgagttcccagttgcaaaataaaggtactaagtttttcttaatgccaatgaaatatatacccaagtggctggaatatctggccctgtgagataattcaatccatctcttttcaaaaataaaaaaatccacatttaaatggtacaaacacacacatacaaagtaaatgatgaaaatgatatcaaacacattggttaattcttcttattcttaattttatagtgatttacgtagtgtgccaggttaaaaagaattctatataaatgtttccaatttgctcactttttaaaatcagtgactttatcagggaatcagttgtagaaaaatctatgcctcaggatggaaaaccatctagtgaattatcagttctatgtattaaaaggctgttttgagtattcatatgcacaaattcatagttccagataaaggtcagcctcaccatacacctgggtacatatgtggtacaaatatctaagtttgaaagctttcacaactggtaaatttaaattataggccgaggattttattgcaactcttgccagccaaaataaagttgatattgagtgatggagtcaacatgtagaaggaattgagtttgtttaatactgtttgacttgtatacatttaattattcaatatttttgtgtgccaggcactctactaggcagtagcaacacaataatgaataagacagagtccttgacctgcagtttagtggaggcaaagtgccaagaaaaggggcattgacagtaacgcagtaggttctacaacagacaagtagaaagtactttaagagctcaggaaaagtgatcctaaagcagcccgaactgctagagaggggaggagaagagaggacagaaaatgaggcaggcacccagaaaggcttgatttagtaggtagcatcctagcttacttccaaaggatgagttggagttatccaagccaaaaggagtggcaggggagtgacaggaaaggcattcctaacctagggagggcctactcagaagccagaaagcagagtcaaccagcagcttccagtatggttgggtgtggccacatatttcttcatagcatctcaaaatattctggactgcatttccttgatgagggcttggaactgtatggagggttgatacagaaagagaagactaaagacacaaagcttgcagagagccagtgttggagcaggaaaaggctggaaaaactgaagcctacatttcagtctcatctagctcatggtttccacatcctgggatggggatggaaaaatagtgtgcatgcaggctagattattaccattcaaggatgttaattttgcctgaagtgcatctcagacttctaggaccacctgatctacactttctttgattccatagtatgtaataaacactttttatccatcttgaaatgcttttccatagaggtaaggttaacagtttatttttaaatgtttattttttatataaataattcttggacagttctggaataaagtctgaaaagccttacatatgtaacagatatacagaataagaactttcaattgccttgtgaattttttgttggagtagatggacgtgcagtaccaatactattatctggtgtttaatgttttcagattatagcgcattatgattaaaaaggtctaattatctggtccacccactaactttgtaatgaagaaatgtaggctcagagtgttggcatgaatttctaccccatgcaaccagctagtcacagaactgggacttggattcgggtttcttggctcctcagtccagtacttggccgaacgttgctactatcttatctctggaatgtgtattttaagtcatgggccatataatattttttcaaaattatagtacaagaaaatttataacattaaagatataccaaatatattttaattttctgatgattcagagggtattttagggatcttaccaagccctggtgatttttttttgttactgattatcaatgtattataggtatacagattactagattaaaaacaaaagttaaatgaacagaatgccagatcaaagagtatgccatttccacatgaatagatctaataggaataagtctcaaagtctcctcagacagctgggtaaaatatacttctttatatgataaaactatctgtagctacagacctattgctaatgctagcatcttagaagcagagatatatgataaagtggattatcaatataatgtgagtcaacaacgttttattctcattctcttctcaaagcagtatttgcatatgggaagtaaaatattctgacaataataataataataatactttcaattctgagtcattaccaatgacctgtatataaactgaaaggcacctaaaaagagggaatggactatttattatgtaattaactttgctcagaatccaagctataaaagacactattcattgggtacagaagatttccttttgaactgcctcatgataatcaagaaggacattgttggttctacttgaatttcaagtcaggaatgttctttactgctgaagcaagcatttctatttcagaaatgcttcatgggccttcagatggttagctaaatatacttagcattcgaggatgtgtgcatttcccaacaattgcattagacgatgcttacataggcccacactaaaatgctactctattttaacagagtcataaaacctttaaatatgatacttctttttgtgggattaggaaaaattataagtgagttgattttttaagcacttgcagatgaaggaagaaaatagttatcttttaaaaattattagggctataatcatatttcttcaaatttacatgactgattcacaaataccatatacatctgttgcttggtatgatttaatgatagctatgtatatccaaataaaacataacttaaaaataaggcattaatttttcccatttcaaataatcacaaaatgtcatgtcatatggtctagaaatacacctgtcaacaatcccttgttttttgacctactcccatagtagtatgtgactacctaaatcaatatttcccagaaaacaattagaattataccactgctttttattattgaattctcttctggaaaaaagtgcagcgtacagacagcaaaggacaccagctcctgcttggactcaaacagggtctatgattactcacggggcaggtgtgtacctcatgcttcctgcccttatctcttacatggagagaggtaataaaatacaatgggttccttaagatacatgcttatagatacagattggaatggaagattcaaatcatcaaatgagaggagattttggctttccacacttactttttcagctattttacagcacggataattgaatgatggcagtgttcatgaaaaaaaataatgatggatatatctttcattctttataactctaaaataggataggcaatttaatgggttatggttatgaacttctttcatttgtcctttattttctcaaccctctcttaatgctggaataaaatgaaatggagccttttaaaaacaagtttttcaaaagagaagagttttgaaggagtttctttttttaagagtcaagataagaggttatgggggaaaaacgttattccagggacagaagagcaagggagtgagggtgaaaataattaatataaaccccccaaaagggagctagatgggtaggaaaaagagtgaatggaaatgagattattagattaagcatgtaagcaagaatcaaaatgaagatactctttttagattctgaaggccaaggttagggacagggagagaagctatcttgtagtagaaggatgagatcaacttcacagtagcatttcaaaatataacacaccacaaggaaaacgagaacatggattaaagttttgtgaaaatacaatttggattggaaaaaaataaaaatctatataaagggaagtaattttgaatttagtcattttaaatgtttaagaaagtatattatatgctactctttataagttcatatttatattataattatattcttaagacagaaagaatttataagaacaattactaatgtcctctatctaactgactggccagtgccctaggggaaaaaatcttattagagattagatgttagaggcagaaataaaattgaaaaagagtggcatatcagaaaaatgtgggtagacacagattatttgcatcctaactgtagtcaaagacactactcaaatcaacacatgggcataataagactgagattatattttttaaaaaaggaaaatagtaccttggcatccctttttggacacatacacgaattcaccagtgcagatgtggaataagagttagaagaaaattgggagacgattcattctccatccttctcttttttttccccttccttaatccttaatttttatctgcttttgctaaattttgagaaatagctacagggagctatctcaacacttgcgcaaattagaattatgatatgtatacaaattgcaaaatcgtgatagtgtttcaaaaaacacactgaaatcgagcaattaattatctaaaacaatcaaatgaaagcttgcatggaattatttgcttgtgaatgcactaatgcctcaattgttatgaaaagtgcttatctgcataaagcagctcagaagattggaggccagaatagatgcatgttggacaacagaagtctataccaaaactgaataagattccaaatagtacagtctttacattttgatcttactgtaatgtaaacacttttccaaaaataattgaaatggcactgaagtatttctactaaaatcaaccacctaaggacagcagaacaatgatcaagtcttcaaaaataaggcagcctccaaaattacaacagaaatattgggcaaacctaccttttataaagaagaatagcaatgacaatgcagatgataaagaccactgcaaggacaggacctacaacccagatcaagccttcttcttcatccgtgattggctgcggatccagatccattgacaccacggggtcggagtaagggctggttgcatacatcttctgaggaaaagcagagtctatttcagttataaaataatgactttctagataagtacctttaacattagaagaagcaaaaaatccaggaaatagtggatttaatgataagtgtgtgatgcaatattagcaaaacagaggggaggggagaggagaataaagaaaagaaaggatggaagatgttttgtaatacaaatttccttatagagtgaactattttataataaaatcattttgatagtacaaattacttcatagacactttttattgggctttctatatggtgtattaaatgatcctatgaagcgtaaagtaccagtaattaaccagttgcaaaatgtttaatgaacatttacattgtgccaaggcgttaggtgctgtgtgaaaatcaagagaaaaactagagttctagccctcaagccattatcatacagttaaggagaccaaagtacatatttacaatgcaaaataagtcagtatttaattaaatgtgaatatcggtagtcattagtactactgtgcttcttagtgcttggtactacttaatactactgcatattagttaggaaatggaggccaaagcatgaacaaataaagtctacaatttcaaaagagaattccacagttcaaattacagatgcgagatgtacagaattgatgatatggctttataaaatatagaatttttagaacttaaaagaattcagcagttctcacttagttttattacagttattgctcagagattggtatgtttgttctcaatagacaactgataatatactttttaagaatacagttacttggagaagaaatggactaaatatcgatgatttttatttctatgatatccgatcccatttagttctgtcctattttagcctatattaggaaaacatcttcttggctctacctgcccccttcaaggccctatcttccactttccaatccaacagaaactaatccatatccactaactgccctgcttctaccactcactcctcatctcttctcactccaaaccaccattggtcctatttttttttttttcatttgccaaatctaattgcctttatttactctttacctttctagacaatttttccagatttgccttctttaaaacttttatctctggctctctcaattttgaattaaaccagtcccatcctcatctttccaactgctcatgccctgctgagttaattatctctgactccatcctatagacaaacattctttttttaaaaaaattttttttatagagatggggtctcaccatgtttcccaggctggtctcgaactcctggtctcaaacaatcctccagccttggcctcccaaagttctgagattataggtatgagccactgtggctggccctgaacccgtattcttaagttctattctctactagcatctcttgtcctctcttatctggcaaggtcagcccaagctttaactatcaacctccatgcagaatctgtctcttcattaatgttcctaaactcagatactctatgaaatcccagatcttcatttccaatcatttctagagacccctacatatatgttcaaattagtatgagtttcttaatttttcccagatccttcttcccttcctcctcacttcccaaattctctcatcctctcagtatctaagaatggatactgattttaccttacagaaaaaaggaatagaatggaaacactgatattagctaatcagtgtcccccaggtccatctgctcttcttctagtctcatgagtgccacttttctttaggcccttacttatgtgctcctaactataccaagagcttcttccttcctctcatagtctccactgctgctagaggtatcatcctaaactgcaactataaagccttcaagaggctctctcttgattcccaaataaaacgtagataacttagcatggttctcaagggcatccacaattttactttaaacttgcttacgacacacaacacattccatcacagtgggcttcttgctactactccctaaaggctctattcttgttcctcaactccctcacaagttccacaacatttagctcctgaaattgaacaactctccaggcccccacttgaatactgcctccaatgaaaccacctctttttaattgactggcagtgatcggtcattcccctctactaaaaaaaccaaaaaagataaaaataacacagctaaatttttatttagtccttgtttttttaaatggtactcaccaaactgtattttggctttttatttgtatatatacttcattttctttggcgaaactacagactcctagaaggtagggatttatatattatttgtgtttatatgcttaaagcagctagcaatgaaccttgtacttagtgggttctcagcaaatcttggctgaataagacaaaaaatgttcatcttttcaaatggctgaaattgtcaagacatcagtatatatgctcacttttcatgattggtacatatatttaaatgttttaacctgcatctttaaaaaatttagtttatggcatctattctgaatttaagtacaatgagcttggccatcaagcaggagaacagatgttccactgaatgcttgtatactactcttctctctcattttcgtcattgtgcccaggaaagagactgactagatttgcagattttctaacgcattacaagaagataaaaactcagtatatatgtccaagcttctcagaggcagccaaaaaaaaaaaaaaaaaaaaaaaaaagatgtgtatggtatgaggattgacacaaaggacttggcaaagaactatatatctaagaaacatgattttttatataattgttttggtttatgctttacccactccattttgtaggtgatgttaaaacagtttcatagacagaactaggcaatactgtctcatttgaaattctttaccaagaacctttaagataataatcacggtccattgagatggaagtctaagcacaggttttcccaaagaacatagatttccaacccattcaagaaacagagacatatgaaaatgaaaagaaaacaaaatcataaaatgataccagcctaatgaaaaatataatttcttgtgcgtggcaataagagattaaattttggataattccaaaccagttatctgacattcttaatatgagacaaaggattaggggatagcttgtgtctttgagagggacggagaagtattttctctttgcaaattaccagtctacccttggaacattgttataaactgatatggaaatttgaggcttacacaaaggctttattactgcaaaatgactctagctggatacaagtctctcctaggcctgcaaatatttatgatatataaagaaaataaatatcatagatatttgaaagcaatgctgagaaagatgatagaataaaggggcaacttcattaacaaatttggaaaaaattcttgattctgtaattaataaacagatgacatactaaagaaaggggcagactctttatcagttgtgacacatttaaaacactagcggaagacatcagaaaccacagtgtgtagttcagtggttcagtctgcaggatcgaatgagatttctcttctttgctagattctctgatctacctcaatgctctaagtatgctttttgaaatgttcctagagctattaaaagaaatttcctctcaaatatttaaaagtcatttttgaataaaagaaaaagatgatttcttaacattccattcccttgatgttctgccttaaaaccttcaactagaaagagaaagcatatctgaacattaaaattccaggaaggccattactttgttttcaaatgacattctgagcacaaaggtaaaccaggcagagaggctgcctttgtgttttgattttccacgggggaattctttcagtcacttgaagagaggccccactgtacacactaacacctgatgtggagaaatctttgatacattgtgagctgcttctatatgggaaatgactggctcaactgggttgccacacctgtcatatttagacaccgattagaaaacgaagtttataatatgtatattaaatgttcatgtgtactgccacttcaaaattcaccccctgcctatctacaatatctctcccctttttttttttaaacattcaaagtaactgaagcataaaatgacatataagcaagatggattacataaaagaagaaaactcattatttagaataccttaggaattctctcttttattaaattattttctaactttcttggcttttcactgatacagtcactcataaatttctacaattaaagaggctgctgtatttgcctctttctagatagaccttcctcatgaatccgggtagaggcactgtggtctcacttggcagatataggagaataaatacaatcacccccaaagtcagtattttcagaaatatgccatgttgaatggccaagcttgtgagttcccattgcaatcacaggggctaatgtcaaccaggtattatgcaacagtctccttttttggacaacagtcattttgaaaggatgatggaaggagattgtaagcaatgatggttctaacaccatgatatttgtgttacatcagaaggtatcaagaaccatgtcctatcgatctggaacttcataaactagagggccacctaaatttccttcatcagagacatagtctcatttgtaatgcagtctcaaggagtatattgagcaatgttcaaagagtaggcagcctgttattacacttaataacagttcatgagaaataatgaggatggatatacccacaaatccccaaataaccacattccagtgaaaatgtataagcgtaccataggaaacagatgccatcataattaacttacagactctgcatgttccattactgctaacacaaagaagacatattcttgaccactttggagttgcttgtttgtaaatccaccataatgcttgtcatcccccagggtgaactcagtgggaaggacatcaaagtgagcggcaatatatggctttaattcaacttctctcccataacggatgcttctgcgcttcctagatatctccttaagcagcttaaggaaaaaagtgggaaacagaaaaagaactgtaaataataacccagcttattgataatttaatgagataaattaattcagaactgggaacaacccaaatgcaatttgttcacatttcatatagcacatcagcatcactaaatctcagttctctcaatatttcaaatgcttctcttcctgttaaggtagaggtaagatactggactgctctgacaaggtctaggctataaacacagggcaatgaggtcctttgctgtagctcatttcatttcctacactaatgaaattctctcaaagtgcatcataacttgtctaaggaaaaaagtcagcttgattcataaaagccttgccctgcaggagatttattaaataagtattaacctcagacaaagccatctaaatctttaaatatagccacattttagaagaggttagtgccactttagattgttttgagtaatgagataactcatatgatacaaattccctcaaatcagcagaagcagaatccaataaacaatttttaatatacacatattaaatagacattgttactcatttaccaatttctgacttgacttagctccctggttaggcaattagggtgcacttccttacactttatcatggagtcaactttttctagaattgacctctcttgggagtgtgtatatattgccagataatataggcaaggtagatgaaaattaattttagtactgccctgaagaaaacacacatgcacatgtatatacagatgcttcatgtatttctaaagaaaagagatagagtttatttctggataacctattatttttcattgactccttcattacgagaaaatcatactaacagtggttatgaacactgatttcaaagttacctttgacttctccaattaaaattggtatttcacagggtttaacaagggaaaggtctgtattagtctgggatgcctgttgatgtaagcagcagtcttttcgccattttcttgggaagaatttttattttatttattttaatatctatgtattaatagaaaagtctatgtatttgaggacaaactggaaaaaggaatgaaccttgtcttcaccttgataaacaaaattaagatacttatggaaacagtgcagcaaaactatttactagccctgtttttgtaaatagaaatgatctagtaagaaccaaagtgtgatctctacttagtagaatgagagcctggcatgatcaaggctaggcttctgtgataaaatggcttcagactgtatatatgataaacactgaattcttccattaggaatttgatcgtacgttacagtccctcctacactgggagtagtaaatgtgttcagctggttcaaaattgtatcctaaaaatgtaaaaaaccagtttttcagttacaggaaaattttggccgacattatttttcaataatatttaatttataacgtgctaaaattttctgtgaatttaagtttattgatgcaattaaaattacatgaaatgtaagctgttttaggaaaaccacggtagattgggcatcacttgtttagcaaaattggaccatcccataataaattcagttatgctgatcaattatgcaccaattggccagtaaaaacacaaggccagaaaggtagcactatcttttaatcttgttgtcaaatttagctttacttataatactgataattataacaataatagttttcatttattaagcaattactgagtgccagacactgttctagggatcctaaacatgcattagctccaatttactcctcgtaataaccctataaggatggctaatattatcctcattttataaatgaggaaactgaggcacaatagaagaaagtctcaatatataattagactcaattactgaaataaaatgaaattccatgttagagattttttcaactataatgtaatttacttaatgattacacaatatcataaggaaatataatgtttaagctctgatactctaaattgttctaactctgtgtatttatacatataatttttatgtatctgcttacatcaaggcagatgaatgtattatttcttttttcttgattcttttcatatgctaattaaaaaaaatccgataccaaatatttaatgaagtattataattgaagcatcattacacagcttattgttgatatgtagttaaggacagtagcctattacaccaagaaggaaaatgcactgcagaggtgctgaacagtttttgaagctgggtaatcaaaaacattcatcatgagttgtttatgtgactgtgtcccctcttctacttcactgatcaaaccctaccttggttttattcatactgcagatgtagttaatagtcgcaattcatccatatcattgtcattcccacaagcactttctgctagggtttctttagaagacttataggaagtaattcacaataaaatatttgagcttttgggtattcttagacccaatgcagtcattcattaaagtcaaacctggagcatcactctgcccctttaggttgctctaatctctgcaggatgcttcctgtgttacacgttaaatggttcaaatgggctcagatgacaccaaagtcagccagcatgttgcagttacaaccacaaatgaccacattattttacaacaagcctttgaagtacaatgcagtgaaaagctcatgatctattacatgacctgctctgaattaaatatcactaacattctgggagtcattctgccccaaattcattttgactatcaatgtctgctctacccagtttgaccttgacaataggagtttcagtttataaatgtatcatgtggagagcagcccggtaacaaaggataaatgaactcagaagataattttgagagtaatgctgtttggaaagcctctttcaatttcttatgggcctagatatgaggtatacgtgtggaaatccccttaggccaccattctattcaatgatatggttccaacaatttgaattataggcctttctgaaaaattacttgatcaaatacatttaagagaggaacactgctttgtcaaacctggcagtatcaagctatagataaaattactacagtgcttttattatccatggtagaaaaaaaaaaaaaaaaaaactctctgtagggatcaaaaactggatgagtaagcataaagtgaggccatagcctactttcatttgttcccctccacaatggttacaagatgtactggaggtaattccagaagatatatcaagggctttagttctttatcagaaataattttcattttccagtcaatgcatatcttatttcttccaccattaattctacaatgtggtctcaattatatcagtaagaaaagtgggaaacaacccatcccgacccaaaaattttgaattaataaaatgttctttatcaaaccattatacagattaatgcaccacaacttggatgattaaaatgaccctttgttatgggaatcagcagcggagacccacagaatttaattgcaagaaagttcaaagtcatatagccctatactttaatccattagtgttgctgtgcattttggaggttaaaacctggctacaaaagagaatcactttctattacttactaccaaacggctttacttctaaggaaagcttattagttaaaactatttgatgtcattctggcttggatctcagtgccttaaaaacttttttttaataggtagaacaattcatagattctacaagttgcctttgcattttaaattccatttcaacttaaacaggatgatgacacttctgtagttcagctgagaaccaattaaaatagtaaagaatatatcaagattaattgattagtcagttgcaagtaaaatcatgtttggcttcaaaatgcttagaaaagagcagctgatcattctgcattttcagttaaaggattactattttctgaatatcacagaataatgattttgttccttcaccatcaaaacaaaacaattaaattataacatatctaaattacttgatgacattattgaaataatgtctcattttacacagctccaatgatcatctaatcactagtgacacaaaagcataggcctaaccttgaactcatctcctcgtctgaacacgatcaaatttaattcagataaatgaagccagtgatcataaatcccgcttctagagatgacacacgtctgccaaagaaagctaacaacctttctggtcagatcacagtctcctttgtgcagacatagatatgaaataagcatcatctctctgtaatgtaggtagggaatttattcttttccttgctctgtttgtactaatttgaggtagaagaaatacctagaaataaaagattgtactacaagatgtggcctatgctataaataatcccaataaattaaaatctcatatttgccaaatgggggcgttacggttatttgccttatgaactgattgaaaacagcatcatgttaaaataacaaaggctcttctgtattttaaaatgtgaattctactcattaacttgctgtggtcctctggggatctagctcaacacttctggatcatattttcttgcctaaatagaagtatgtagtaattatgtcttgttcttcatgttatgcattacctttcaaaaatgtccttatacaagaagagtaccaattataatgcacctgctgttgcaagattttggaaatccacgttatatatttagtatttgttgtttcttattctatatattctgctttgctcacaattttgtcatttgttttctctatagttaaatgcatttttgactctgaaaacctacagaatatagaacaaggcaaacatctgataatcaacagaattctgtgagaaactggttaagaccatatcgtaggtcaaatgaactctgctgcaaattgcaacttggtgtttgtgacagcctcagcaactgttgcactaatgaaggggaccttgggatttataccaatggtgattaagtctttgctgacaattcacttcaccttccacacctctacatcatgttttacaaggagcaaggggcaaaatgttaaggccaacaaagattagacaggttgtaagctttattgcagcttaatgttttttaattaaagccaaaggatctttgttgggatccccaggggttagcatgcccatagcactgaaccatccaaccagctaggtatggagaagccagcacccagattagatcctgaaaggcctccaagggaggggggcggaaatgcagcagattaaataacgaataaaagacatggccaacaatgacacagttacctcatctaattccatttcatctggactctcccatggcttgataaatttcccgcgagatttcttcaaaggcacaattattatgtagtaacctctgcacaagaatgaatagataaaagttaggttagttgaaaggaggaaaacgtggatatacccttaaaccttccacagaccaatgaggttgaaggcaaattatggatatggggtgacttgtccatttcttacatcaatgacaaatatccacctgtttgttcaattttaaaaacaacacgggaagacatttatgtgtgattgcagtgatcttgtatggtaatatcatcatggtggactgctctttattaggtatcataaacagagcaggcatagtttgttagggccctggtgctggacacatacaaggctagaatactgcaatctaccaccacaagctgctgaaccaaatattttctatgacatgaatttataagaagatgtttttaaaaggaggatatagatgaaaaatttcactcttagcccacataaatacctagtagtgctgttgtttatacaaacctaaaatgctttttatttgaattaaaaatttttaagtaacaaaaattaggtataattgcacagagtaagatattaaaaattcccttctttttctacccatcaaattgcaaatctcgaggtaagtaccgcagaaaattggagaaaatcacgacttaagggccttcaaaacagctatcactataatgacatctatacgaaaagacaaaagtaactgaatacttacactgagaacagtcaactaaaatttaaggaatgtataaaggcacccatccacaaataggtatgggttatttgtaaagctgttttgtcacttcagtctagtatatactctgctttcatattcctgtttagggattctgctcatactgatctttagtagtaactatacaaggactttgaacatactgtttaataataacatattaatcacttcctacttctcaggtattatagtaaatgcataatctggttttgtcctcctacagagaaattctctgagcaaagcctaggtatagcctataaggctacaaggactggtcacaggcaaaaagacagatctgtagagattaaataattgccaaattaaaacagatagtaatgggacgcaaagctacatttatcttaatggtggcagtggtctgtctctttttcttatttactctatgtgtcataaagtattttctaaggactccatacacttcgtggagatttactgtgaaaatgaaaacacacacacacggacctaaacatacccccatacctttaaaagaggaggccaccacacaggacaaagaaacaagaggaaggacactcccaaccctgtgtcacactgaatcacagagaccaatcacagagaccacagaggccagcaaggcctctttctattcatctcaaagcaaaacctgtaataaactcagtaaactctctgtgattaagaactctgtttccattaagagtctagagcagagctgttcagcatggtatccactagcccctgggggccatcgggcactgccaatgtcactagcccaaactgggacgcactgtaaatgtaaaagacatattgcatttcaaagacttagcattaaaaagagtgtgaaatatctcagtaataatttttaaaataatgatacattataaaataatctggatgtattaggttaaataaaataaattattaaaattaatttcacctgctttttattttttcactgttgctactagaaaacttaaaatgtcacatgtgactttcattatatttgctggacggcactgctctagagcattctggtgaagaatatggcacttggagatatgtctggctgggagtttgggctgatctttggcttagaccccagaatctgttatatattctgaaatacgtgagtaaaaaataccaggctgtgatatggggggaaataaaccagaggtgctcagcacagtgtgtgtggcatgtagcagtaaacagataccagctgctactggctagtatgaacatcacaggccggagagacgcatctgaactatcttattcagtaagactgcatgaaattccgtgagctgcaggttaaagagcttgtcaaacttcttttcccctaatggagaattcaactcaaaccagacaactataccacaatgctttctccatggtgccctgagcaactaatcaacagatacacaggattacaccagctagccattcattttctttactacaaacaatcataatgatcaaggaggatgaggagaaggcagaggcttctctgcgtatgacagagaccaatatcttttatgttatgatccagagtaagcttccccctctcctgtcctcccaccatctgaaggatttaccgaacaagtccatcatgttaaatgagcatggaggagaatgacagaggctgcaactgagcgtacaaaatcacactgcagatgtgcttgataaacacacttgtcaaggaacctcttgcttttcactaccaacttctcaaagtcagaagagcgctacacataaagcaatgatactgcatattatcagagtgctaccattgtcctccttcagaatcttgtaaatcaaggttaagctgatgagtttcattaattttttcttctgctttcatactttgagttgccattcttgtacatgaaaaaaaaaatccattctttcttcggcagcactcccccactattcattttacttgtggctgggataagaattgaacagcctcccccacggcaattaattaacggtgcggcaagatatccacaaccttttttctccgctgatctctaaagcattcatctagggcagtcaaagtgaagcttgcttcaaagcagctcttgcacattgaaagaaatagggcagtggcaatttgaaattctgtatcatacaaagcctcacctcagtctaaatccacacatttcaactgtgctctctgcaactatagctttgtaaatatcaacttccttgccttacccgcaacctgtctctcccctgagggtactgcttcctttgcagccttctcatatggcagctgtggatctatccctcctcccctgcccatgaacctcagagtcagggtttggggtttctttcctggcttcccatcgcttcctgcaggtatttttcttccactctcttgcttttgtagtaacaaaccccttcttttttgaagttcatgcaatccagctacattatgatcttctctggctgatttttgccatctagtacctcccccagcatctcctttctctcagggaagattcttttgcggggttcatggccttcttttttctccaaactctgtcatcatcctgggtgatttcaaccttcataggtcgggcccacgtaccactgaagctctcagattcttcaattctccctttccaaagcccgtctcctccactctaccttagctgaaatctacgcttgccattctctgtgccagaatccagggagctgaacacagcttgagaaataaagcacagggcagaataatgccataaattcataatcagcaaccccagttaggccttcaacacggcctggcaatcttaccactatctagtttcctaataactgctccaattgcctagtccttccattttccacagtaacattttcactttctcctctagcctgaaaccctggacgttcaaaccaccccactagaagatggcctcatctcttatataaagagaaaatgcaaagattcagacaagaattccctcatcatctgtctaccaaagtacaagtctatctagatctgtaaacaaaccacacattttcttttggtaaagtagaagggctggccctacttttgaaggccattaactatttcttgaattgttttcaatcttctcactttcttaggaagtttaccatacattgtactccttctctctcatatatctcaacttctccttccccatttgatcccatcacttaggtttcaaccatgtacaaatatgtgtcatatagagaacaaaacaaaccacatcccactctagtcacctctctttctcccactcctgactgccaaaattctgcaaatagctgtgtgttcctgctgctcccactgcctccctttcccttcacttcccagctgactaggctttagcgcctgcctcctcactccacctcactgccattgccagggtgctcagtgatctccagggcattacatcaaaaggggagtttctggtactcttctgtccttcttgccctcttagcagaccttttaagatgttaacactctccatgaaacattctgagccctttctctgtgatattcttctgttatttctatgtatatctccttccacactaaccttatttccttagcagaatttatcatctgcggcccagctacaatggtgacactcctcaaggctctggccaagaacttctatccagaccctattttcatcctagatctcattccacctcagggcatcagttcttagctatatgcaaatgatttccagactcatatctttagccaagaatgttcttctgaattccactggtttatctgactttaagttacaaaagtacccccaatttactgtggttaaaataaaagaaataatatgcctttcaaaataaaccctccctaacattgcactacaatccatttcagtgcacaagccagaaacctaggtgttatcattgacaatctgcctttattctctccctctgtcatacttaatctattgctaagttctatcacttccaaaccctatctccagtgcacgtgcttttctccatctctactgccactcttctggcctcattccatgtcttatgcccagactgtgaccttactctctcaactctctctattgactttagccccgtctagtgcagtctctgaaattttcaattcacaatacaaaatttgttctgccatttccactttttaaaacatttcaatggatcctcatttctcttaggataaagactgaaaggtatcagaaggccagcaggatcttgcctgaatccctctgactgtgccctctcagctacagcttgataggctttcagtttcttgcatttaccctagtccagtggttccgagcctttttggcaccaaggactgattttatggaagaaaatttttccacggacagggtggggattggggggatggttttgagatgaaactgttccacctcagatcatcaggcattagattctcataaagagccggcaacctaaatccctcacatgtgcagttcacaatagggttcatgttcctgagagattctaatgccaccactgatctgacaggaggcggagctcgctccagtggtaatgctccctccccactgcttacctcctgctgtgtggtcgggttcctaacaaggttaggaattggcacccattcatggcccaggggttggagatctctgacagtccattctgtcattaaactatcgatcattctgttccacctgcctagaactttctgtcactcccacctagttaactattctctctccttaaatatctactaactgattattttctaagtgaaatcttctctgattttttttaaacctattacccccattatatggtctctatgaaccatttttaatctatacattttcttatacaacaaatttatatatttataaaaacattactaaagcagacatacatataatacccccaacatttgcttaactttgctattttatcatggaattattcttccactgtaaagaaagtgggtacaagaggtggctcttaggaattaatgcctctcctaagtcaggcagtcaaaaatatttggcggttcttctccatcagaattttcaactctcagtctcatcaagctttttctcctttcttcaaaccagcaatggcatgcccaaatagagtttctagaaaatataactccttattgcaaacgttcttttctttactggcctactcgtgacccttgttctaatctcacaggacattaagaaagataagatgattcatattggaggagtgaaatgggcagctaatatgtgccctacaaattcatatcaaccaaatcatatgagctgaaagaacttgcttgaaatgaaaaaaaaaaaaataaattgcttttggagctagctttatatatgggtaaaattaaactcaatattctgctttgcccgtctgcctcaagcctggagtttagactcaaaacagcttttcaacatagactttaactattaaagtaatagaaaaataaataacttcagaatcaatatatctggaaagcccttgactacttataaagtaagctgtgttttcccagtatattagatttaattagataagttaaatctaaccttcagagttttaattatattaagtaaagttttactgatttcatttaatatgttatcatcaaggggcccagttccccataattatatgagaaggcaagctctggtttttgtggcagtcccacttcaaattcagtcaggctttttgtgttagtgtgtattagcattctcaaacatgttatttaactgggaggtgaaaagtccgtctaggagtttaatgatgaatgtcattccttgcgtaagcctcctggctttaccgctccttaaattctcatggcaacccactgactttattgcttcatgacactaaacacacacttctgtgatctgtacccaagcacatatgcctggtcactcttagttctaaggtttgtctggggcagtcctgtttatgtctacttcttttggagttttaatcagttatcaattgacctaggaaaaaaaaaaattctattttgaccaataaacttatgggcacagaggcagggctgtggttcagaacataggctctggagccagactgcctggattcaagcctttcctctctggttttgtattgccagctggggcaagtcactgtatgttgtgtgttcctcagctataaaataaggagcaccattcctgtgaggattacatcagttaatgtgtgtaacatcctttgcaaagcacctagtatgccctctgttcgtattaaccattactagtattagctgtatgatcttggccaggacacttagtaccattggtcctcattttactcatatgtaaattagaggaagaatacctacctcacagggttattgtgagtcttaaatgaaacctaatatcctcagtaaattgcaaagtactatacaaatttaagcctttgtgagttaaagtaatttaactcacaaacacatgattaattactcttcattaggctgctaatagtggaacacaaatcttatgaagcaacactgtaagccatgcttccacaaaaatcttcttgtttaaaagaaaaagttgagaacaaattagtaagaccaaagaaattgaaaatttcatagaatacccttattctttatttcaattttttataaacataaaacggttgttataaaattaatttacattgagtaccttctggtagttttttctcctagtataatctgtgttgtgcattttttaaatacccagagtaaaattctgctctataaagtcacagaagttccctatgtcattacaacttgcttctgaacaacagtagcactgctagatctgactggcattctgctccccaaatctacttaaatagtaggtttaagcaccacagaattcctgataccagaacttgcagtatccttaaggctgttacaaaagaaatttagcctttctgtgagggaactctcctgatgtggcacacaaaaaatacaacaaccaagtatgaaagtaaagagatattaaattaattagaaatcattagacactttttcggtgttgaggagttaaggagtaggggccaagacctcctcattaacttggccagaaatgacagcatggtttctgttggtcaagaaaacaggtgtcaatcaccaaaactgcattttgcttgaaaacaaataggaagcatttttctggatagctttcatctaaataaaagttagcaacctgcccaccgttctggaatgagttctgtttcttcctcacattttttctaatagaatactgaataaaaagctacaacctttcctaatttctaaacttgccaaccacggcaagtgacacagcatggcacggagcttcttgtaatacctgaccgtgttacattaaccagtctagaaaacaggagtagtaaccttacactattatccctttaagaattccaataaatagaaatcatctaaggcttttcactacaagatttgcttttcattttccatttctttgatacttttctcactcaagtactttcctgatttagtctttcactcatttcttccccaaagtggctgtaatatatttctgagaatcttttattcattcctagaaaacaaaaaatgtccaaaatagtttgctttctttttctgctttgtaatggtctcatttctgtgatgtcaaagttttataccttttccctgactcccttttcaaatatagaagcggaaagtgcataaataaaacaaaaaaaattgaacaagctaaaaataaaaactgacaaaggtagaaaacattctgcaatattctcaactccttcagaaattggaaaatgaaactaaagtttaccaccaatggactaaaagtgccaatttccaataatagctaacacattctagcaacacaatttggtgaacagcctctaaaaggtcatttttatataaataaaagaaagtattgaaaactaaattaatagtaaatgctgaagaatatactatactattttcctctttcaactgctcttttcctgaagagacatgcatgtttttttaatggaatgaatttatagtctatcatttccctgttccttcattatttgtaactttttcacctttcttaaatctttctcacactatcagactcagattagatatgatctccttcaggaggcctcccctgacacccaaattgggctaaaacttgatatttatgttttcacaatacctggcagtactcaccccattatattcacattatctattttctgaatctattctcttactataaggtaggacttaatctcagtcatctttctattcccagaaatagtcctgacaaaacagtgtgtatagaatatatatttgttggatgccagcaggaaagtcttaagaggtagacaagtacaacgtggccaaacaacaattgctagtctttctcttgcctctacaccatcagagacgctctatcctctgagtgaacggctgtctctccactcccactcccatggcccagctaacttcctgtcactttttaagcctcagcttaaaaagcctcatttgtcactttctctaggactgctgaactaataagccggagttaggagcctcgtctacagcctcccttatctatctaattttctctactataggactctgcttcagtgaactctttgcttgtccaaattgcccaattaactatgctgtatgagaacaatgagaaaggacacactgtcgctactgaatccctgaaacattaacgttgactattagggtatgtgatcaagaaataactgatatgtctatggccttgatggttttataggtaaatacgtatccccaaactcattgagttgtatacattaaatctgcacagtttcttacatatcaattatatttcaataaagtggttttaaaaattcataaatatcctttatctgtcaagatcaattaataaacattcagaatgaatacacaaatcaaggaatataatcccgctgtcatactgaaattgcttgggataaaaattacacaaatactccattctcattttcagatttctagataatagaagaagggccgggcgccgtggctcacgcctgtaaccccagcactttgggaggctgaggggttggatcacgaggtcaggagatcgagaccaacctggctaacatggtgaaatcccatttctactaaaaatacaaaaagattagccaggcgtggtggtgggctcctgtagtcacagccgctcgagaggctgaggcaggagaatgacctgaacccagaaggcggagcttgcagtgagcagagatggcgccactgcacgccggcctgggcaacagagttagactccgtctcaaaaaaaaaaaaaaaaaaaaaaaaaaataagagtagacaaatgtgaagactttattttacactgaatttattttgggaataatgttttagaaattcttttcactgaatttattttagtaataatctttcagaaattcttttcactgattttagtaataatctttttgaaattctgtcacctagttgaaattcatcaattattttatcaaataaacaataattgaaagtgtacccaggaaaggttgttttaggatgtgtatcaggtctgaatttattaattatacctaaattacacaaattatactattttaaaacttcttatttctgattttgttttttaatacctgattttctcagccatctgctttaagttttctggagtttggggagtttttgaccactttttgaatttttctccttctagaaaatccctttgccatgctgctctggctcagttctcctgttagatttctaataatccctctctgtgtcctctactggctctcttcttcctattaacggagacctttattttagtcttttgcttcacattttcccctcattgcttcaatgattctgtcttcttccacgaaaccattgctattttgttaacaactcctaaatgcatatctataatctgttttgttttgttttgttttttgagacggagtatacctctgttgctcaggctgaagtgcagtggcacaatcttgactcactgtaatctccacctcccaggttcaagcgattctcccgcctcagtctcctgagtagctgggattacaggcatgcgccaccatgcccggctaattgttgtattttcagtagagacggggttttgccattttggtcagtctggtctcgaactcctgaccttgtgatctgcccgcctcggcctcccaaagtgctgggattacaggcatgagccaccatgcctggccatctttaatcttaataacttctctaagcccacacttctaactaggtatttcactgatatttcatattaatacacacaacgttaaactcatttacttctgaatttttttatcctttaggatgacaccatcattcattgtcatccaagctcagaactcagagccatattttactctcttgatctcatcattaaagcagctaccaataatgtatgctgtactactactctagtgtaactcatgtctacctctgcatcctacttccatcatcatcatcttcctttagaatcttgttatttgcctagagtcaactatgtgaccacctcccaataattttctctaccactatctctatggcgctcccatctatccaaattccaacaatgcatgaactatgaataaatgcctctctgcttgaccttcaaacctggcatagcaagtttcacctaaacttgagggtgtgagatagaagaaatgagaaaggatttattcttattccaaacaggtagcacaatagatgctcaacaaatatttcctaaaatggaattttattatgtattattgaaatgttatcatgccactctcctgtgtaaagagctgtaatgggttgccattgtctagaggatatagttttcacttctgggtatacccttggctcttgtatgcctccttcttccttctcttgccacttgtggccaggcgctctgggatccagccgtatggcaccactgggtgcctttagtaatgggcctatgcacttaccactccctttgcatatagtctctcttttattatttgtatgcctcctatttatcccttaagatttaagttcagaaactttattgacccattctgaattagctgctcttaagataaagcataattctatcattaacgcttactacatctgtctgtttctctgtatctctctcactctatggtaaggtctttgaagtcaggaatccatctttttttattccccggagtctaccacagtacttgtagttcatatattttggtgaaaatacttttttcttctattagttattcaaccaactagctatatgtccttggacaaacttatttaattgactggatttaattttccacttcaggcctgttggcctctatgctgtgctacattcaaaccagaaaacttgaattttctaatgtttatattttttccaatgtcatttttaactttaactttttggaatttttcctacttttaatacatcagtgtcatataccattatctaatttccccccctttttttcaaccttttagtactttgtaagacttcttcataattacaaaaatattttgccaaatattagagttaatcacctattcaccttattccataaactatgacataaaatgctttgtagtagccgggcgcggtggctcatgcctataatcctagcactttgggaggctgaggtaggtggatcacaaggtcaggagattgagaccatccaggctaacacggtgaaacccggtctctactaaaaatacaaaaaattagccagacatggcgacaggtgcctgtaatcccagctactcaggaggctgaggcaatcccagctacttgtgacgctgaggcaagggaatctcttgaacccgggaggtggaggttgcagtgagccgagatcgcgccactgcactccagcctgggtgacagggcgagactccgtctcaaaacaaaaacaaaaacaaaaacaaaaacaaacaaacaaacaaacaaacaaaaagctttgtagtaagaaccatgttctatatgtttttctgtttctcctaaataacactgtccctgcaatacagattaaaaactcactgttaaattaatgaaaatctgtgttacaatgaatactaggacacgttgtaaaagaactcggatagcaaaactgggagtctgagcagaagaatctttcactacattaagcagtatcttcttttacgacctctataattttgagatataatgttcctatttacctataattctttccttcagccctaagccttcaatcaacttactttatattctcatttgcaggtacttcaggcagttgcacagtaatcatgccatccaagttggtcttcccaatgaaggcaggcttggtacgtaatacatctggtgcagtctttgccgtgaccctgtgctgcagcccaccagcactgtttccacgatttgtcagcacaaatgaatatgatttctcaggcttcaggttgacaattaacttctgtgtggctcggccatccacttcttctaccattttcccatcatcataaagaatctaaagagataaaaccaataaaaaaaaaatctggttatcagagaggcaaaatatattttctaaaccaatgtgcactagcttttggaaaatgtatatatagtcaattctaattttaggtgatttctaagtccatgagtagtcataattctggagatcacatcaattttcctgtcatttcctactgtgtaatgataaaatgtttccaagtctatcaaaaatacacaaagatagatatatacatatatatatatagaaaataacttatcaatattagacctgtcagttgtatgtgatcttaatggaatatgtgcagaaaagctctacgtttcaacgtattatgaatattgcctattttctaaaggttttggttcctctttctaaatatacttttactttcaaaaatgtttctctatttcttatttcataaatatgtacttgctaacatctcttaatggcaagccagagtttaaaatgtgccaagaatacaggccaacaaacaaattcagaaactcccagggtattataatataaataggtagaaaccatgtaaatttcattctctggctgaaaaacaaaagcactagcttagatgtaaaaagttcaagttcaaagtagtaggtaacctacaagtgatgccagccctggatttaagctcctgctccttcttcagagtgtaaaggacacacttacaaagcaccaaactgtctcccatgtgaaagtcacaaatgaaaatagcaaggacacgtggccaaaacaaagtggtctgcttgctgtgcaaataacttacccagataaactgtcccctctacttttatctgtgatttcttacaaattagaaaacaacttactttgaaaggcatggcggagttataattctctggaatctcccaagacagcaacacggaagtcttcattactgctttgacatgaaaattttttgcaaacactgctggaaaaggaaaaacagtgtatttaaactattcttaaaacagatgacctgtcctttccaccatggaccataggggcttatgctagatgctgtctactttgatcagagagagaagtatgattttcctacctgtttagagcattcattttaataccccattctcacagagatctttcctttctctccaattcagccaactctattgtgttttccttacctgaggacattggggtgctgtcagccagacttgcttgacattctataactgaaatctaaggcatccaagacgtagtaagttttacatactttacctttttgtttttgctgaacctattaatatgaatgggctgatcagttattatagcttcaaaatactgatttccaaagactgacaatcctttaaaggaggaaggccgtaagcagacaaatcctaccttgatccacaggcagtgtcctgaactggacactgggactatatggcccgggccctttgctcgtatgagcacgtacttttacatcgtatgtggtatctggttttaagccagtgagtgtcatagtggtgtcagctggaacaataagctgctccatcgggagaagggggatgttgatatccctataaagaagggtatacttggtgataatgccatttctctctgccaggacaggtggttgccaagataactggacggaggttgaagtggtgccttctgagtgaaggttttgagggaatccagttggtacttcttctggaatggaaatctccttcaccatctcctccccaaagcccactttgtttctggctgagagcctgaagacgtatgatgctcccttgtggatgtctgtagctgtaaagtgatcttctttttcagagaactcaagagtagtaagtggctccatatccttgcggccaaattttagacggtagccctgaagaggtccaaatgtgtccaccggagggtgccactgaataagagcagtattcatctgagtgtggttaatcacaagccgaggtttccctggaactggagcacatgggatggagtggtaagaccaaccaatctgaacgttcacatttcagtcattgccaaatgagggagttccactctactggtattcccattttcttacttaccaaaacaaaacaaaacaggcaatgtttgacctacatacctttgtggaaatatgctccttgtcttactttattaaagtaggctgagatactagaatttgataatggacacaaaacagaaattatcattgaaacaacagcttaaggggatttttttgacacctgcacgttttaaaccttcacacataaaggttcatatcaaagataaattaatttgagcaaagatcagccaattagatatggctaataagaataactataatgattatttattcgttgaatatgtgcaatgtaccggcgtcacgctaagtgcattgcatatagtattcacaattggtttacattcctgactcctcactacattctcggattagttattattatctctatcttctataatgagaaaatgaggcccagagaggtagaaaactttccaaggctagcatgtaacaagtgagaaatctataaggcaaacccacctctgtctggagtcgactgcttaaatgcttaattgtgctgctatgttgcttaaaagtttaaaaaaaaaccaaactacaaaataatatcgtattgacttactatgaatttaatttgcactttctaactttactatccacatcattcatcaagttcttcatctgtaaaatgggaattatattaagagctattttatattgttcttatgaataataaatgaggaaattcatgtaaaagtcttagcatgaggttctgcattctatcaatattaaccataattattaataatctgaatattaaacttcttatggtgaaaggctagcttccaatgaatacataatttatttacctttaagttagatatgtgaaaaggtctaatctactcattcaatgtattattatgtctgtatttatttttaatggagagcaattattattggaatccacagtgaaagacattgagggatgatcatcagaataaaaactaaaccaagttaacagaaagaagaagaaaggccaagtatggtggctcatgtctataatcccagcactttgggagctgaggtgggaggactgcttgagcccaagagttcaaaaccagcggctgggtgtggtggctcacaccagtaatcccagcactttgggaagcagtggatcacctgaggttgggagtttgagaccagcctgaccaacatggagaaaccctgtctctacaaaaaacacaaaaatagccaggtgtggtggtgcatgcctgtaatcccagctactcgggaggctgaggcaggagcatcacttgaacccgggaggcagaggttgcagtgagccgagatcatgccactgcactccagcctgggcaacaagagcaaattccgtctcaaaaacaaacaaacaaacaaacaaacaaacagcttggcaacatagcaagaccttatctctacggggggaggggggaaggcatggtgtcacatgtctgtagtcttagccactcagggggctgaggtgggagaattgcttgagccaaagagtttgaggctgcagtgagctatgatcacaccattgctgtccagcctgagtgacagtgaaactgtgcctcaaaattatgaatgtgaagaaaaagaaagatggtaggaaaggaggaaagcttacagtaatgggaaacaggtgataaaaaatcataccatggggatatagatgaaggtaaaaaaatcactaaaaagattatgagacaatacatagaatattaacctcagagatggactgattagcctcttcattttgtatttcagaaagtgaaacccaagtggagatgtgctctgctctaagaaatatcattaagatatttatttccttaaccaatggagcaacagttttgtttcacatgctgggaagattcatcacatgctgatataactcagctaatctacaatgtatgaaaacaatagtttctaaagtttttagataaataattattcaacaacatgtgtgctgtgttatacatataaaacatgtgtgttgtgttgtatatataaaacatgtgtgttgtgttgtatatataaaacatgtgtgttgaaggtaggcccaggaaccacatcattgtgtactcattgtgttcctcaggaaaaatgcatccagagatcttaacgaccaacacacactctcagaacaccacccatccataagttggaaactgtgtgaactattccacttgcttttaatatatttacaattatcttaattttaaaatagtactttaatgtagggacattggcagacatctttaattcccctttatgtgtatagagcatttacatgatttgtccaaatgtcagtgatggtgtcaaggattaaacacctgagtctctgctgagaaaaatccatggtgaaatagagctttcaacagagaatacagccttcaatatatgaaactccgttgaaacgagtgggtggaaacacaactattaattctcaatattctccagaggcaacagattaaacatatttattaaaattttttgaaattctagttccaacgaactgcataataatatatacaccgtgtatcctgtttccgtgagatgcacgtaaagctaggataaataaaaataattttttgatctaaaccacaaatagagactgcattctaatatttgtcatttatgagcatgttcttagtaactgatgtttcactttataatattgctatggtacacatttggataaatctaatgggctggcaaagtctaggaaaaaacccactgactttgtagatgtatacatttactcttctgtgggagttaaagcttaggatggagtaatctcttttgtttttgatgttggcatgacctttcttatcctgggacagaaaggcttgttggctaggaatcacgagatcaaagtaatgatatagaaataagagcattagctctgacctactggcttcccctgctgtacaggaggatctcagtctgctctctattgccaaacccacaacagtcattccttccctgggcagaagttttactaagcctgaaaactatgagacaaccagcctggaagtgccacaaagcataaaggaaggactcagtaaagaaatgaatgcttatgcagcttggggaagaacacccaatatcacctcaggagaggctggccacatgaagggtcacacgaagcgatgcctaaaatttccataagcatgtgaataatagaaacagtaaatgcagtttaaacaggctggagtaagggtttgggacagttgtggtattttatccagggaatcaggataggataaaaaagggaaaaggaatgaggagagttctacatcattgaatacatagttaaaaagaattctcccaaactccacagattggcaatggaactcactgcattcctggcttccagaaacactataggtatcaaacatttaccaacaattcactttgtgcaaatacttgtacactggcacacaggtagttgagtgaggaaataaagacggatgcagcagggtccatgttctctaatacaggcatattctagttgggaaaataatcaggtggaatagattgtgcaatctgtggagtcaggtttctaatgccttagggttattctgtagactacttttataagtcatgccagctgttggttcaatggttctgctcactccagcactggagcttgagggttggtaagatgaaagggtcttaaataattactcaggggagttggaaggtcatttttcagcagggtcttaatgaacacattggaagaagcagagaaggtccagttacaaagtaaataactctaaaacttacgtcatgacatataaactcttctcccttttacattttcttattctcttacattcttttaaaaatttcctaggacttcagaattggtacgtatgtgtggttgccctttactttttagcaattggaatcattggagatcaaccgaggtactcagtcccagtggctctaaatttagccccaatttaaactagtaccaacgcaacaacaatcacaattgactagacttgggctaatatttccaaattctccctgtcacagtcatcttttgattatccttaaacatagctgttcaatatagtactgaaattcatgtaaaaatatacagaaaatgtcaaaccaatgaattttctgtttgcctttaacctcaagaactcagacagtaaactaattattacaatacagaataatgggaggattaacaaagaaaatacaaatatttcataagcattgaaacataagagccaacattttcttcagaagcatccttgaggttatatgaatcttacgtagattacttaaattatgatcagtactcgtttccaagatatgattctttacaggttgtagaaacaaggtataataaacaaatatcccacaatcaggaagtttactattaaaataaaatttcacaagaattcctgaattctttgtgggagctgtaactaaatacctttacaattatggttattaggagctcacatctgtgagataaactcagtaattcttcacagtcacataaatatacgaggatttttaatacagtagacaaaacaaattgatatattcactaattgcctagggataaaccatgagtagcggctgcttatgcaaaggaaaactagagcttcgctcttaaaggaattaaatttggattcttctgccttcttcccagatgcagtggggaggtcttacaaaagtaaacgtgtaggcatctaaattacaagcattttctatctcaataccgaagcctctattgattaagaaggatctaaaattgtgaatgaaaattccaaaggaattctatatgtgaataagttccaaaattctaaaatgtctactgcatggtaaataaaaagggatgagctagccttagtgacgttaaaatagacaaaatcattcctttctctaaaattcatattcctcggctataaatccactactttcttgtcatcataacatgaccccatttaatgggcaacaggggagtggtgcttcatataaaacatttcagagttattatgacatatttataagtgtaggtaaataaaatgtattttcttccatttgagattcaattctttgttgttgacgttctaacagagactggatccacagccagatagtcatcatgccatcatgcccctcactgaatacatgcctgctcttcagggcattaaattagcttgatacaatggtatttaaaaaaaaaaaaaaaaaaaagcccagaagactcagccttgaaggagttttgccatctgtaatcctgctgtttgaggcaattccaggtggcaggatgcgagcgaggcaaatcttatgacatttagacaaagctggcagtgagcatggcacgcaggagggcactcaacatcacagctgttctttactttatgcctttacatagaggtatgttcctaaaaagatatttgagaagtgattcgggcagagtaaatcaaatcatggtttacatgttcacgggagattgccatatatgaggattgaggagaatccttctgcaattatctcttaatttactcattctacaatgccagattttccttcatgctggcttttcctactgtggctgaccaaagtcatcctaaaaagcattgaagaaaccttattctttagaggggagtaattttatactatttagccttcttgcttttcttctttttcttttttgttttctatcttttgttcagtttggcttctttagaatccccacagcagggggtggggaagacaaaatgacaaaaggtagaactgtaagtcatgaacccagttcaagatggcagctcttctaaggggatttgttttccagggaagttgacattgttgcttgacttccctgcccagatcccttccctccagatcttcatgggacttgatccttcacgtcatttgagtctcgacttaaataatccttcctctaccagaacttctcagcccctagaggctgcctgatccttaattgcctatacgcttttacttttcaccttaccactttctgacattttattatatactcgttttgtcacttgttaattatctagtcctattcagaaagtgaatttcatgagtgtagattcttgttctgttttgttgattgcttcatccccagtgctggtaacagtgcctgacacacagaaggtgctcaaaaaaaaaaaaaaaaaaaatacttattgaatgactgattgaatagtttggacaaattatgcacttggactatttttttccctgatctatttttttttttttacccctgaactaaaaacacaaaagttgaccatagtccatttatttcctctgattttactataataaaagcctgctagaagctacctataccatttaaaaagttagtattactgttcaaggcacatacatgcacagacatgattacctgccccagtggtggacaccagtttgggcttgctgcgagcaccatctcctttggttgtgtaggctgtgacggtgagggagtaggaagtttcaggctggagcccagaaatgatcatgtcctgaaatgacaaaatagaatgtcactgattcaaaacatgctactaatgctctgggggaaaaacaaggccgtctgccttcattctgcaaatgctcgcacatcccttgcagccatgctaagccctggaaatttcatgcctgagctcatgctatggagatctgttttcatgctgatatcgaaggggcatcttcaggcatcttgggaggtagatcttagggtattagtcaaagacatgaaatctggagccagacttcctgaattcttaaacttaaacttgcatgtccttactagcttggacagaccaagtatgtttacctatctgtgcctccatttcccatctgaatgttggaattataataggaccccataggattatatgagttatatcaggtaaactcacagaactatgcctggcttataggaagcattccattaaagagtgattattttatgccaacagctctccacacatatccactgtaacccacagactacagatggggctgatgccagcatagtctgttttatcactatagacgaattttgccaaatggttgttgttggacctagataccctgagagagaattttcttaggactctcttattaatggattgtattatcatttttattggttatttgtataggctatgagcagaaatcattatccactgaggagaattttcacacacattaaaaagcagccataaaagcaaagaatacaacaggactttagttttaccacatcactagtatgtgctcaatttattttgactttctaaaaattgttaaatatcacatactatttacctaaattcttagttttctcttagtcagggcccaaagctgtggtggttataagaccagatgctctttgatatattcctttaaactgcaggttatgggattctttagagattctggctattagcttattctagtattttaagaacaaataccagagctgcatgtacacatgcgcgcgtacacagacacatgcgcacacacacagacacacacagacacacagacacacacacacacacacacacacacacacacagcaatataaaaaccctttcagatttttggcacagctgtgttttcaaattgaatatggataaatttaggaaaatgcacaatgtcattgtcttccaaatctaaagacaatgtgagtgacgagtacgaattatattgtgtgaaatacagtaggtttttttttagcaaggctgtaacagataccgtagagctcaattgttgaagctgatcccaaatatgacagtttctgggaacatgctttctcaaaagagtaggaatatctcactgtggaaattcaagaagttcagatatcatcctgaagagtcactggaaattttattctgccagataaatggactatttgggagaaatgttgtatttccaggaccttggaatggtttccctaacattccagaggatagaaaaaccaagtaaactacccaagagcagtattttaaatgacagcagacacactggctatcccaaaaactatcatgagtaaatgccaacattatggtttccaaggttcccctcacatgccactggagtactgctgaaaagcagtcatggctaactggaaaaagcagcaaggcttgcttccatcaccaaattttgtagcaagaaattatgcactctgagacttatatgtttcttatcatgaaattggagttaaccacacatatccattatcttgcccaggttgttagaggataacagacataacgcaatttgaaatgcgtcaagttccctgcagtggtataatctcggctggacacacctccaactgccacggtcatatcctttcttggattacattttctttctttaagtggtgggtgcacttccttccttggttgtttcagtatgctctgtgaggtgatgtgcctgatattatggccataattcctcattctctttgtttcctcctgtcctgtctccactttgcttcttgtccctgactgttaaaagttggcatacctgaggttctgtcacagtcactggtctactgtttctctaatcttaaaaaagaaactgcattcatttctaaaccttaaataattatttctgcccatattcctgatttatttccagctgtgacttccaatctgagctccagtggcatatacattgtaaatatctgctagatgttttcctgtgactacccagtgttacttcaagttcaaatgaactaaaacttaaaaatcattcctggaagtagactccccctccttacttccatattttaatgaacggtaacacatctgcaaaacttatgagctatctttgacctctttctcttcctcagttcttagcaagtttttgccaattcttccttttattgatcctaactatcactttttcatttctactgcctcaactctgttgcatttttatcacttcatgactaaattagcaaaataactctttttacctgctttcctatctgccacctttttactctctaatctatccactaagtcactggattttaaactgcaggtaatgacccatttagtaggttgtgaaatcaatttagtcagtcatgaccagaatttaaacaaagaaacaaacaaacagaaaatgaagtggaataaacttgaatacttaatgttagtgtttattatacatttaaagcatggttctataaaaattttattttagttaaacagaggtgtgcattgaatcatgacatacaataatgtatttcttactgtgagttatagtcaaagaagtttacggtcaaaaatgctgctgcactggcaatcccatgagaactgataccttgcacacagttacaagattcccaacaagagccatgtgcattggcagtaaatattcattcagtgaatggaagaataccgtcttgccagcctttaactcatttttctttttatttcttctatatcactctaatattgaagagttaaagactgaccggccagctttttagcttgactcttctggttttcccagtattatattatagtttacctcttagctctatttaccactgagttacttaacacgaagccttcatttatatcaaattgtcaggctcactgtcacgtgactataccacatgctcaactgtctcaatgactggttttgctgtgatcaactttaaaaaatatgtatgttccacctccaactctccaacacacacacacacacacacacacacacacacacacacaaacacacacacacacacacactttttcacttattcagtctttagtcatcccttaaattctcaactaagcttcaggacttcttttactatcttggaccactgtctctgaattcatagcttttattgacactgtccactaatttactaatgcatggtccactgctgtaggccatatattttgctgcgttctatgaaacttttcagaactttactcttccctagccacttagaatgtaaacactagaaaggcaggtgtcacatcatgtgtcccttgcagtggcatatacataacagtccctcaataaataacatagagttttcattcaaatattttaaaaacattcctccctcagcgacatactttctacttcttggcataatccattcaccattcaaatatgtatgggtaaagtgaagaacagccacttctagttagagttaatcagtgccagatctatatcttgttatctactggatatgcgatcctggagtcagatttatgagcattatgagcagcctacaccaaacaatctgacatctccagtctgcaatgccttcatttaaagcaggcttatccaacatgcagcccaacacaaacttgtaaactttcttaaaacattatgagatttttttctgttttagctcatcagctgtagttaatgttagtgtattttatgtgtggtccaagaccattcttcttccaatgtggcccagagaagccaaaagattagacaacacccctgtgttttaaagcatgcctcctctgactgtcacaaggcagagttagtagcagccatcaaaacaaatatcacaagcccatgacatttcttacgcagtcaatagcaccatgctgatttcacaaaacaaaaaccaaaataaaaagtgcaccacacagtgaagataacttaaaaataatttgttagttcatgcatccaagcaaactgtgatgacagatcacaaataagtgaaaggatgtcagagaaaacaagcatatatagtctgcttttgacaaaacagtcaaaaattactcacatgttcagtagtatcatcaaattcccactgattgagaataagaaggttgggaggaaaacaaaataaaaagaaaaagaatttaaagccttatacaggcagtgttgcccttgttagattaaaaaaatcaaaaaaataaagcagtgtgtacaataaaattccaaagaatgtgtgatttgctgccacctccacctctgattgggaagtcaaattaaatatcctttgttactgttatcactaaaaccagctaacattctttaaatgtatggttcactgaaacatagcaatgaggcacagaaaaagttaatgtttctaatcatatcctactcgtatttattttgacttctatcttaagttacacaattaaaagtcactatttagattaatatctttcattatatttgacacttataacttcaatgaagtcctgtgagatgtaatgaaatttcagtgaagagtcaaggaaagtaaatgagatgggaaagaaagaaaatacacaaggaaaaacagcaattaataaagaaaagccaaagaagaagagaaaaaaagacagagttcacatttaatgcatttggtattatataatttcgttaactaccatattttgcaatggaactagggagagaattacagttctgtaatgtaaaatatctaagaaccaaaggagaacaccaaagcacactggtcatattgttttcttttccataattgtagacttacaagataaaacgtagcaatgatggctttaattttatactacgataactttctttttataggcactacataataattatttatacaaatcaagtcaatggcccctttccagtgttgaaggggtattacgaagcactactgcatttacagaagtggcctcggggtagataagtgagcaatgaatccagatccctttacttagaatgtttcaaaactgaagaaaacataaagacttctgagagttgacttgtattaagactttgggggtaagtactttccttagaggcacagggatatttattgctgtcttatttttttatttttttaattttattttttgagatgcaatcttcctctgttgccaggctggagtgcagtggtgcgatcttggctcactgcaaactccacctcctgggttcaagtaattctcctgcctcagcctccctagtagctgggaccacacaggcgtgtgccgccacgcctggctaatttttgtatttttagtagagatggggtttcaccatgttgagcaggatggtctcgatctcttgaccaggggatccgtccgcctttacagacgagaacgtagaactgggcaacctggtgccgcagttttcaacttgcttcataacctttccaactttcacacaaagaaacgcattttcatttgaaataaatttcaaatgtttttacaaactccatccttttccctgccaagtcaccaatttcttggataatgaaagtattccaatgatcataatatcctatccccatgacatctcatcaccatttgacacagcaaaggtaagccagtacatgagtcatgtacaattttcagcatggtggttacaagatgaaatcttcatcttcctttcaggaaaatatgtaaaactcaagcgaatttattatgggactatctttgaatcacctctaatttatgaaaaattttggaaattttcaatgctctgttttaaacaactaattataaaaccgggttgtgataccatagttgcaaaccactgccctaagatcaatacaatttctcacatactcaactactcatttttagtaccttttttttaaaccttggttcaacgtaaggatcccacttatttgctaggaaattctgatttaatttttaatatcattgtaacgatcttcatttgctgggacatgaaacaatgagtttcatcaaatatgtaatttgatgaagaagtactaaatataatactgagtacctgtccctgaataaaaatgtctattcttcagtggaagaagacacacatttagaaattagaacaactaagttgcaagttgttttagcacagaagaaagtagactccatcagcaaaattgcagtttagaaatcttccctttgactcaactaagtcaatcattttttgaagtcagaaaggcaaactcaaatatggttgtaaagggttgaatatctgtattttaaggaaaaagtaacatgtttttaatcagacttgagtgtcatttcattacaattcccttcctcacttgatagtaactctgattgaaaagatcaatatacatcaatgtgaaatgaaaactagaattttgtataggattttttaaatgtcgaaaaactaaaataagagcaatttcaggatatgaactaagataaacttattatataaaaacagaggtacataatttcagaggcttacctgtgcatcagccagcatgacatctttcagcatgggctggcccttgggctcaccattttccatcctcacataatgcacctgatatcctcttatctggccatgctgtttattgggcacgggtgagcgccatgagactttaacagatgttgagttgacagcctctacctcgactttgcgaggaggaccactaggaactggaacaacatcattggataaaagaaattataggcacttgtcccaccctatcagagcattttctgcattttctttacttaggtttctctttcaaaaaatgggtaaacccactatgttttctttgaagaatacaaacattttcaaccaatgaaaatgcttaaccaatctgctctaccttttaagaaaagatcaaaaaacatgaccgatgcaaaaaaaaaaaaaaaaaatggaagaaaaaaagagtatcagagaaatagaaaaacatgtaaaaaatgtacaaaagccaaggaagatgctttgaggttcaaagcattaaagcacaaagaggtatagcattgaaataataacaaaaactggctgttgattgttgtgtgttttttaaaggtttctttttaaacggcagaataaaaagattcttgattatatgtattatcttctctttttttctcatatcaaagttattccatacaaaagatgccaaaaattcaatgttgagcatcaatgtctctgaaatatgtaagacaaaaaggcaacaaaaaggtaagaaggtagttttgaaaagttaacttcaaaatgtaaaagaagtgactacaaaaagccaagaaaaacacagaagactttagatggaggcacagagacgggctggactgcaagaccataggagccaacagttcttttaaagagaagcaaattactgcattgagattgaaaaaaatgaaaaaaaaaaaaaaaaaaaaaaaaaaaaaaaaggccaggctgtagcaaagacaagtctttggcaaaaatactaaagtaacagcaatgctgggtaaaaagatgagcagagaaaaaagattactgtgagcctattgaaagacagcagatcaagactgtgtcagaagggtgcaaactgacgtagcggaggcaacataccatcttcattggttcgaatcaacacggacaagctctcagggccagggccgacatctgtatgggctgtcacagtgatccggtattcagtccatttttccagctgttccaaaaggtatttggtagtgtccgaaggaattcccaaaatctcgtgaggcttgtcatcttccccatccactgcagtgtacttgatggagtattcagtgataatgccattctgtttttccactggtggaggttgccaacttaccaaaatactagtggaacttgggctggtgcaactaatgtcttgaggaggagctgacggctcttattttggtagtgagttaaaggaggatttaagtgaaaggacaggagtggttgaaaaaaaaaatgataaaacaaaagaaaaggcaaaaataaataaacgaacaataaggacaaaatgaaaataaggctttgaaacttaaattctaatgacaaattatgtaccttggcttagtaatatgaataaaccaaaaagagaattaatgaccaaaaataattgttaaataatgggtagggggaatatgtgaaaatgagacctcgagataatggagcctcaaataaaattacctacctgcgataaaaattcttctaaaccaatccctcagtatctcccacccccactatactgactacccagcttcaaaaaagctgcaaatagtgctagtatttacttgagggtctgatgatgcctcacagatgtttccaagctttcacttctatattctagaatgaggatggtttacatacagtactcatttgtgaaaggcttcttaagtgtgaaaagttgcaataactgctaatgcccttctaccagttccaattaaaaataaataaacaacaaacataagagggttcactctatctgaaaaactgagtttgcctgaccagttttaataataaaaaaaatgttaacattgatcatagcccatatacagtgagcatgcagaatcaataaaggatgaaaatgcagagtccaagatttacctacccgagggtaatgtcaggattgttgattctgactgtaacttgtacttaccctacgtcagctttcagctttttaattataactcttcttgagacaccattgctagtgaagaattagaccccaccagcaaaatttggtaaaatcaataataatcatttatcccttacaaaatgtcaataacacagccattaaaaagaactgtttttttaaaaacccaagtatcaactggaaaagatataatttctgtgcaaaatttctttcattttgtacataattattcatacaatgtagggtttatattagaattagaagacatactttcttactgcccattctaaattaaactagtcactttctgagcaatcattttccatcaaattaaccaagcattatgattttaaaaaattaaaaatcaataaaagacagcacaattactatcattatttaaaacttaataatattatgttcctaaagaaaaacaaacaagtgggcaaagataacacaagtccatacacacacgcatatatttttaaagcaatgtatatggtagactgaataaagcaatcctatatttcatatttgaatgtgtagtctggggatttccctagactttgtgactcttaacattacggagtgccaggtgtatccaattgttcaggggattatcagtctttcttaatgtacgtgccttgtgttcattattacagtccatcaaaataaaagctctctgtactgacaaaaaagaaatcctcataggacagccttgtaaatttggaataagatttgcaaaaccactagaatctcatttttattgattctgactaggggttcttatatctcaaattataaaactattttacatgcattatcattattcataataaattgagttgttcatgtaacagcaaggactcatctgtaattctttttaaaaagctgatttggttttcactagggctatcttcagacctcctattttgtgagaatatattcaacaccatttgaaaattttactttaataaaataaggaatagataagtgtttgatgtgcttataaaaagtctattcaatatgtatgtgtgtgtgtatatatatatatatacacacacacacatatgttaaaaactgaggtttgtaaaccatgggaaatataatattgaagcatgtaacatttctcttaattaaaggcttggtttttagaaattatcttctacaatactatttattagcctgcctggaattcaaagcagacatacagagaacgcattaatttacatgcttacgcctttaaatgaaagaaaattttatgggaataaacgataatcactaatagattaaacatgatcctaatcattttcatgtgaataatcatgctttaaagagggaaaaacataaattttattatcaaaaaaccctgaaagttttcaagtttctatagaaaatgaaatggtggaaaacttgcttatttgtatggaaggaaatgaatcttttaaatcacaaatttcatgtttgctgataggtctaaatatgaggttaacagagcatcttcttgacaaaattcaatgtatttctactacagatatctattgtataattcactatgtcaaaaagtaaagacaaaatatcacacaaagaaatctaagaaaataactcaacaaaactcttcaattcaaggtaaatagtattttttatgaatgaactgtaaacacatactaataaaaagcaattaataataataagccaccaaactttccaccaaaaacaaaatcctgtataatactttatgcaaaacaatctgccctgggaacaattaacccccattgtgataaacacagctatgcttaagggtaacagctccaaaaagaaattgaaccccaggaaacaaaatacaatttagaattgcaaatatgtttgcgattattccattgtttcttaatttgtccacatacagattttctgtcaatgttccaaatttccacaggtactacacacagagttaataagaaacaagtcatcagagctgagcttttcttagtagaaacaaatacatgaaataaggacttgtttgattgcaaagctaaagcctgtgtgcttaaaaaaataaagtttttttttgtcttttgcagcctctttcatttgcgaagccctcctatgattattttacagggttctcaatgtgaattttgctttaaagacttgtaattcattaaacagggcttgatctaactcctttaacccacatttcacccatggacgtctactaccttctttaaaagtctttcagtgtaggaagtgggaaggtgggatctgttatttggatcaagtgatgagaccaaaagaagtcacagttacactttcacctgtgaagtgtgatgcatactaacctagagactaactattaagcatattagcaggtttgcttattggtgaaggtgaaagctagcaacatctccccgaggaaataaaaaggcagaaagtaagcaaagagagacacctacttgactgcatggttctagctgatatttctgcagtagaagcacccaggccttgaggggagcgtgcagccagacggaaatagtataagctgtttggtttcagtccttgcagcctatatgatgtccctggctcaatggtaattcgttgctggaagcaataagagaatgtggtcatcttcattaaggttcatgcaaatactttttaatcatactgtctggaccatcagatttctatcatcaggattataatctcatcaaaatatcaccaaaagagtcaatagtgagtatccagggctatactaaggaaattatataatgaaaatatcagtttaaaaggcaagtttctacaaaggtaactggaataagggaagtcagagatctttttaatgttgacacagtcagccaaatacatcagataagacgaagattgagaggccaacacccatgagtatgttctgccgttaaatgtgtgtatgttgctgtgacacagatcacaatagaaaatgacacctgcccctggtagtggaatctgcccaacatgtgcaattttaattgaacagatgtctactcatctcccatgaccttctgaaatctcaattggaggcaaagaaaacatgaccagaagtagcaacagtaaccagtatacaatttacaggaggttgctataaaagagatttgaaattgccaagttttaatgggtaaaatatcacgttagtcactaaagaaagttgaataatttatctgaaaccacattactaccctaggttgatctaaaataactgaaaaccttactttctttgtgaataaagaacccacagccagaaaaaaaatagattcacaaatgtttgtggacttttgatatacgatttcgttaatcaaatgctataactctcaccttccgtgcttaaaatttgtcatttagcaaaaatataagtgtctatgggtaatcaatcttgaacatcagcctgcagtaaaccttaaaatgcaagtgaatacataatctagtaatggtgtgtgtaatcttaacactttatcaaatagtgtttgctattcacacaaacaaatcagttaagaagaattcaaggccgggcacggtggctcacgcctgtaatcccaccactttgggaggccaaggcgggcggaacatgaggtcaggagatcgagaccatcctggctaacatggtgaaatcccatctctcctaaaaatacaaaaaattagccgggtgtggtggtgggcgcctgtggtcccagctacttgggaggctgaggcaggaggatggcgtgaacccaggaggcagagcttgcagtgagcagagatcgcgccactgcactccagtctaggcgacagagtgaggagactctgtctcaaaaaaaaaaaaaaaaaaaaagaagaagaagaagaagaaaaattcaaatataaaactagagaaaccatccctagggtgttctgacttacaaatacaaaagttttcaggaattttagatccaccaagtaagaaataaagaaattccctaaataagcaattgtggagcacagtagctatgccaacatttaagcatcacaattctcctttactctttgtatatatgtatgtttgtgtctatgtatgcctgtattttagtttggtggtcgtgatgaaggtttaaacaattcagtgctgatttacaccttacagaaaacaccaatagctcaagttgtaccatgaaaactttaagtcatatctgcatttcaactatataactttttgagtgcttgatttatattggctttgttagctaaatctaaaaccactgcatttaaaacctattcttttgagattctgctcaattcaaacagatggaataaaacagaagtttacaagaacatattaatttattataacatccaaaattatgtactacaagttaattgagagtagttcatttagcatgtgagttttttaaaagatattctttattagaacacagggactgtttcactttgtgaagatttttttttcagataaaaaatgctaagaggcataataaaatgaatatatgtgtgaagttctcaaacacagtgccattaactccttttgtcctaatgttccccattggatttaacaataataaaagaaacatacttactactattatgtattctcattctgaaaatgttagatgtatcttaatatcgatttctatcatgtattcaaactgcactcaagaagcagtagaccctaaccgttaacaacacagactctggaactcgactgcctagactcaaatcccagctctgccatccactagtgcgagactttgagcaaattatttaactttttttccatgcctccattttattatacgtcaaatcgattaataagaaaggctagctccagtgctactataaaaattacatgcattattgatggtgaaacccttagaacagtgcccattaatgagttaattatattgattttcatttctcttttcagtgacgatcaacaattgccatgccttctacaatctgttatttcatttgcacagcatactcaaatgttatacacactcaccttcataccaaatactttttagcaaacaaacatttgctattggggaatctttgaaaccagggtggaaaaattcatctagccaaggactttcattaacatatagagctaatttagtcacctgtccccacagtgacttaaatactttcatgaagaagagaaagtcctcaagtctcattgagtatttattcttccataacctgatacatctatggaacttggaactctgtcagaagcacattccaacaggaacaagagttattttgttttgtttttccccaaagcctccaaataaccactgttttttgtcattgttgttgttttggggtttttcttgggggggagggggagtcaagttcctcttttaattagtaaatcttttccatcaaggtcctcaatagctctctgaccaagaatgtggataaatacacaaaaataaaaaagtggccccacgtaatgaataattcccaaggtgagaagcactatagtcttacctcctctccatgctccccatctttgtagaccagttcatagttggcaatggtatctgaacgtggaggtgtccaagagagcaaaatacttgtttcagactcaggttctgctttgaagtttagtggctgccctggtactaaaaacagggaggcaatggattgaactcacaatcaccaggagtattcacaaagttcttccattagcgtaacctgcttaaacctttcgaaatctgtacacatgtaccagcttagtggaaaacaagctcctttaccttgtccaagttaacctctttgtgtacagggcaagtacaatgttataaatcctgctctggagtagtagaacatctacacaagatatagtagaactaataagtataaagtatatcggcctctgaattcaattttaaggaaaaaattctttacttcatgatatggttgttagtaataaataatataatttacataaagcacttgaaatattgccaaaagcataataagtacaaaatacctaaaagtattgttatttacaactgagtaggaacttactctctagcactacatgtaacattcaaaattatttccaattaaatttatgaaatcctacctttacgccaataacaaaacctaacaggcaaacagaatcactcagcattttttcttaccagcccacattttgaagaagaggtgtaagaaaggaaaaacaaaacaaaacaaaactctatcacttacaaataatgacttctaatctctaaactatgttaaattatttaaagaactacacctaatacaaacaaaatatcctctctagtgccacaaagctaaactactacaaaaattaagaagtttataggatacacttatcagaaatatggtaacttaaagagatcatctataattctcatgttagccatgtcatctattcaacagacaatttggaagagctgtttatcagctgtaacaaagaatggaaagtctattcagtttaaaacaccttactcaaatgaactagaataattagtaacctaaactttctagtccacacctaagcctatcagttcccctctatccattatacacaaggctgagtcagggtgtcgctggcacatctaatcgtacattgttcttggccactgtctgctctgattggtgagtgcctatgctttcccaattgtaaaacattttgatcattacccttgatattatggcatgtctcaatgtgctgtggctgaacatatgttcatattccctcaagtttaaataagaattccatttatatttaaagaaaaaaagagaacaataatacttcatagcagaggagtaaaaaaacatctaaagtgtgctttaaaacatctaaagtggcaacctcagcaaaaatatttaaaaatacatataatacagtataatttgtagttcaaaagaagcctttggagaaaatgtattgctttccttttcttttatagttatgtctgtgtactatggctttaaaaaatgccctttgttaaagcagtctgcaagaatgatttgtagaattcctaatgataattttattcctctggtaagtcagcctgtgtatatatatgtgtgtgtgtgtgtctgtgtgtgtgtgtgtgtgtgtgtgtgtgtgtgtgtaaaggaatatatgtttggactgatgcttaaggtcacaaataatcagtgcttcatatttctagttgccttcatcatcttttctctctctctttttaaaaatcacaggccttgagagtctcattgatttgatgcctctgggagcttaccttctgaacagagtatcacatttttttccccagtacctgcccagtgggtgacctaacacaatcatttagattgaaaggtggaagcgaaagaagataaaagattgagaagcaagaggcagagggacagaggggaacaaaacacaaataggcaaactgcaaagcaaatggaaaatgcattatttctaaaagggaaataccaaaagcactggcaggagcaataatggaaacaagagtgaccagatagatgggaaaattatgataggacctaacctaatattcacatgataaaagggtttctcaggctaaaaatgcacacatatgcctatgtatgcagtcactgatttttttcctagttttatttgcttctttctttctcccaatttcctgggaaacaagaaagtttgtgttaactcctgactcaaaccaaaccggactacagtatggtcaagaattagaaacacagacaacactgaagggctgctctcgggataataattgcttgttacgcatttcttccctgcctaatgctaataataaattgacattgattgaaaacatcttggaaacctaattaactttttcttacttaaactgtttactttttgcttttaatttgtcttgagtaaattcccggttggtctcaatatttcattcttgtttagtgacacaagctttgtctgatcatctaattctgcttgtttctattaagagccccttccttctaaataatgacttaagtaggcacatccaagtctcagagagtacactgtcctttttattcttgcacaaagctaaaggttggctagacgacttgatgcaaagtgtcttcatctaatgtacagggggttctctcctgttctttccttatccttcttttgaaatggttcggaggttaacttcatttattagattttaaacttgtggttcaggcttaggcatggtaactcacatctgtaaccccagcactttgggaggccaagttgggaggatggcttgaagtcaggggttcgagaccagcccaggcaacatagcaaaaccctgtctctacaaaataataaaacttaaaaaaatcagctgggcatggtggagcatgcctgtagtcccagctgcttgggaggctgaggtgagaggatcacttgagtccaggagcgtgaggctacagtgaacgatgactgagccactgcacaccaccctggatgacagagtgagaccctgtctctaaaaataaataaataaataataatatataaaataaacatgtggtgcgaatacaaatgctcagaggtgtcaggtaatttagatgagtgagaaggccatatggggcctggggcccggtggagagtgcccaccacctgaagagggaccgcaggccatgctcagtgacagcaggttgctgccttgtgaaatgtgggcgcactcttgtcccagcttccgatttccttcacagaagttgatcatgaaccttccaggtaaaacctttccattcttaattactaaaaattaattgaattttaaaagcactgtatggggcaaaatgtgtctacaggctagattcagcatatgggccatgaaataaactttcatgatctcaggctccaggctcatcaatggcttaagagtgcactacccacacttcctcgggaactgagggtgtacctaacgatatcacttcctcagggcattttgtcatatttgaatccacaaccatgaagctgaggacacaaaggaatttttttaaataaggtataaaatgaatgtatttttaaattcccaacatattggtcctaatgagcataatatatgtatataagaaaacactttgttttctctggaacacttgagacatgggactactttcattatctgtctattgaatttttataccaaatattgggtctacagaggttccatttcacatttctattaatgttttctctctatatatgtatttatacatataaatgtataaacgtaaatatttacctacattttatttatatatttatttagttttgagacaaggtcttactctatcacccaggctggagtgcaatggcacaatcatggttcactacagctttgacctccaggtctcaagtgctccttccacctcagccccctgagtagctgagagtacaggtgtgtgccataacacccggctaattttttaatgttttttgtacagacagggtctcaatatgttgcaccaggttgtctgaacttcctgggctcaagaaatccttccacctcgaccactcaaagcactgagagtatgggtgtgagccactgtgcctcgccttcttacacacagatattttatgctcttgtaatcactacacatcacggtttctcactggtatttttttttttaaccttcacttaccagtcctttgtctatgtatatcttattttatttttattttattcaagagtttttctgtgttgtaacatttccttcactgattaactgaacataaattttataagaaaatgtgagattctgggaaaatcatgggcaaataaaaacaacatatccagacctttaagcagttacttcatattcaaaggagagatatgatattgaccataaaccagatttacaataggacatggaaagcaaaaataaaagaagcaaaaatttttctttaatattatatttaagaagtcattatatactgtaaaagtatgtccgccctcttgattacttacttaatgtccacaaggaaatagaaatgtgagctatcgagtccctaaaatgagatcataatcctactgatacatgttaagtacttgagtattactataattacactctatataaatatgtgaaagcaactccaagacaagggatgaaaaagactaacaagagaaaccttcacattatcagatgctgatatattagaagagattaatatttgaataaaatgtagagattatctctaaagaaaggttgacacatattgcactgctaaacaacagtttcatcttgctatagtataaatatgaaatatgaccaaagatactagaaaacccatgattgctaaaatatccagtattttattaaggtacatgttttaaaatgtgtgtatctagcatattgataaatgataatgacaataaaaccgacagccagaattataacggtagtaaaacaaagcaaaattcaaaacaaagagtctgatgtgtaaatgccacaaatatatcattgacaaaataagtacttaatacacaagcatcagcacaaatcttattctcaacagtcattaaatataaatgagaaaaagttaaattttattatagttgtatttatatccagtgctcctttactcattgctaaatctattcagaaaaagcatttaaattggactcataactttggttattagaaagcagtctttttctagtttgcttgtataggcctgttgacatacactaatgaaatgatttataaacttctggaaacctaacagactttgtctctcaatgtcatagcttatattttaacacttttgcaatgcccagaatttgtaatagcattaacatccctaaaatgtttaaagttgatactagtcattagtatttgataaatatatataattctttatcttttgaaggcatatactgttaaaggtatatccatataagtcagatgattttcaagaatctattaaatgaatagatgtaattagaggtcagacatgctttctaaatacagttcagaaaaaagacacatattaggatttaagatttataatgcctctaattagcatgaacatcaagcaacatttaatgcattaggtttgagatttaacttactacttctttgtcagagttttatttctacttcttctataaaatatagttaccctatgcttttggtacaattacctttacaagaaaactataggaggtccttttttccttcctgaatgtgttttctaataatgaaaatatttttctagcttaatataaatactttccttgtcaatggccatatattccccatattttcaaggtaaactagttgcaagtgactttgtaatgccagaagttagagctatggagaactgagaagattgacccatatttcagaaaataatcatctcaatgaaagtcttttcatatttaaaaccatttaaagattactcaacacggtcaactgtactaatgttcacaatcaaggagaaaaactctctgactgtaaaacagacagatcatattctcattttctgtattaccagaaatacacaaatttacatcaatccttcacttatgtccatctgtgtgactcatattagatcaaatcaaaagtgagacttctctcttaaactcactttgatcctaaatactgttcttttggaatccggtttcaaacaaaaacaggaatgtgaatgtcacagaatgaaagataataaaattaaatgagtaccttttagacacagaagacatcaaaatgtacatttctgtgtatttgtatttaaaatgtacttcaattcctacatattattgatcagtaaatttttatagggttagaggagaaaaattgcagtgaaaataatcatatccttaaattttatatctcataatggttatcgtcctagcaatcatcctaagaattctttagtcagtaactttcttgttactcctttttcttaaggagcagctcggcattaattacatcagaacaaacatcattgtttttggtaggtgtccactaatatccactggcctttttaattaagcctatagaacagatcaaatcattgtgctattttggaaggttttcttagcttattgagcttggcaggcagtcattacatcactatatatcttctcaatcaacatgtattaaaagtaaaactattatggaagattcttggaaacatcttcatgcaaaaaagtcagttaaacagagtgggaataactattctaatatatccatgtcccattcatctagattttctgagttctgtcattaaattaaatcagagcttttgaaagtagagtccccagctcacagtaactcagttgcccctctgataatgctaccttcactgagttatgattcaatgtcatattctgtccactggtcatataaaaaaataaagatatggtctgtctacttcaacattacttctatatttttcaatagattacgactgaaggcatcagggtttttcatttagcattctaaatacaaggattctcacaattgtctaagattcacattttggttggattaggtttaggaaaaattttgtttctcagataatcttcctaccatcagaaaataaaaatatgaaacactatagatttctatgtttaaactggtgcttataaaacttagagccaaatttatttaaatttagttaaatttcagccagatttactgcttgagtgtaacgatctttcataaaaatgttcttccttccacttcttttagataaacttagtttttttttttttttccatttctaaatgttttcatgtacttctgcactggaataatctaatagctacctcagtgtttcagaagtaagttatgtataattcttagataaatatatgaataaatgaaacaattgcgtttttctctcttgcctcttttcattattgaatacctacactggcataaaaacacaaaaactatcacattaagcaaattattaatttaaaaggtaatggtagttgataatgattaggctctgcgtccccacccaaatctcttctcaaactgtaatccccatgtgtcaaagaagggacctggtgggaggtgattgaacaatgggggtggtttctcctatgccgttgtcgtgatagtgagtgaattctcacgagatctaatggttttataaggggctcttccccctttgctcttctctctcctgccaccatgtggagaaggtccttgcttccccttcaccttctgccatgactctaagtttcctgaactctccctagccatgtgaaattgtgagtcgattaaacctctttcctttgtaaattactcagtcatgggtatctctttatagcagtgtgaaaatggactaacacagcagttaaaagtatccagaatccctggatttaaattctgcttttgcacttagtaaccttacgacctacggcaagtttctgaatcacgttttatcctctttgatcttcaatttactcattggcaagtgggataattccacatctgcctaattggtttgtgagaataaatacatgcaaagttcatagtatagtgtcctccatatgttagctactattatgatgattacatattaataatttaatgttttacatattaagttacaaaatgtttccctccattatctaatctataccctgttatgaattttattgcatcccacaaaaatccatatgttgacatcctcatccccagtacctcagagcataaccttatttcaatataggatctttgcaatggaattagttaagatgaggccataagagtgaccccaagtccgttatgactgtgtactagtgaaaagggaaatttgggcataggcatgcttttgggaagaacataatgtaaagatgaaggtagtgatcagatgatgcttctacatgtcatggtacagcaaagattgccagcaaaccaaccaacagaagttagggcagcagcattaagtatatttccctcacagccttcaaaaggaaccaatcctgccaacaccttgatctcagactccctaggccccagaactgtgagacaatagattcccgttgtttaagccacctagtatgtggttcttttttacaggagcactagaaaacaaatagaaccactacactctataaggtggttattattatagactagaaaactgaagttcagagagagatgacataaatcacctaaggtgacagctaataaacgaaagcttgggcttcaaaccctggttatgttactccaagaccagggattgaaaaaataatcacagctgagaaatttaaaaagctcaaagtggaatgtaagttcccatataatttcttagaattttttaattgttatgtagctgctaaaacagtataataaaaagcaatctcataatagttaaccacttttagtcaagaaaaagcaaaacaagatttacggatgtctacatttcccaatgagaagcttttttggtaagaacagcctacagtattttttttctgcatattactacagcaaataaatacagaagtactgcaaatggcacacagagaagatatatggatagtttttaatacaactgtggtgagacatatttttatagctggctttcctacaatgtcatagagaaaagagtaaatccatgaacaagccaataagaaccaaataatggtatgaaaataaaggcaggcgaactattaatataaatgtgctctgagattcctagaagcaaggacaaatagttaaacatacttcatataaagaccatgccatgaaaacaagtcagtgattcacaggtatcagtgaaatagatgataggtacattatctagtactggcatctgagaaaatttattaattcattgccaggattagcaatgagttatgtctacagattatactgtctccaataatatgattattatgtagatttcaaaacaagccaacagcatgatgccaaaacattcgtagattaatgcaggtttaaaagatgccaacacaataaggagtcaaagaagtagctctcagatgctcaagaataaactttttttttttttttttttttttttgagatggagtcttgctgtcacccaggctggagtgtagtggtacaatcttagctcactgcaaacttgcaaactccatctcccaggttcaagtgattctcctgcctcagcctcctgagtagcaggaattacaggtgcctgctaccatgcccagctaatttttgtatttttaatagagatgaggttttgccattggccaggctggtctcaaagtcctgaccctcaagtgatccacctacctcccaaaagtgttgggattacaggcgtgagccactgtgcgtggctcaagaataaactttagaagaggcctgttattttatattagcccaaagccaaactgatcaccttgactcaaagaccaaagaggtttgataacctcttagaaaaataaaaccactgggagggccaagttttccttcataaaatagtctaatgtctgctgtagctcttagcaaagttaatcaatcaggcccaatgttctatctgagatctcggtaactgtctctctttatccactgaggccatacagagaaaaacagaaattaaagccactcagagaatacttattttcaagccagtagcttctggcaaatataagccatttaaatacccaaggccctgtaacagttttattttttagctttgtcttgaaccatccaatcttacacaaattaaatactcttttgagaccactctaccatactagctattacaaagaagtgtcgtttttctattctcaaaactgggcatgggggagacattgttctatctcacatagagaagtcttcaagtcattcccatacaaattaaaaagaaggggtgttaatgcattgttctgctcaaaatgattagtttttcagatgtccatgcttgttccttttcagatatctatcatctgttgctttgaagccctaaatctcaaaaattaaaattcataccatctttgttccttctttgtttttgtccttctcacctctttgcaccagcccttccctcctgccctatttccctcctcaaccaaacttacctcctgtctgagtgatgacttgtatgtcacttgaaaggggaccatctccaattgaggtaaaagccaggactttgacagaatatgttttctggggcactaagttgccaatagtagtgatttggctgtcagctacattgtgtttcatccagttgttgacatgttgagtgggatccattgtataataaactctatatccttggatctgtccatttggctcttcaggttccttccactgtaccaaaatggtggtcgaactcaacattcgtgcctggacatccctcggggcactggatggtgcttgctctgaggtttgtgttagcacaggttcgctgggaggcccccgcccaatgttattgacagcaacaaccctgaattcataatccgagtagggacttagtccagcgacactgtagcgtgtggtcgccaccccatcaatttctttgtaaagttcctcagagtttttaggtttatgctgaattatgtaataagaaacaggctcagggttcccagagtcccacgtcagtgtgatgcttgtagctgtgctctcggtcactacaggagttcctggaggtttgggtaaggcttggatgggggaagataaaagacaatgactacccatcatccctataatatttcaaaaatctataaactctactatgaaaatgacaggattatgtatctactgaagatttaattaaatgaaattatagcaaagagtagttttctgaatggccaagaaggacaggaaaacattcataggtgacacaaatcctgctttcctagaagggcttgatagcatatttttaggcttgtatccaaatcctctacttattagctaagtgatcctgcacgcatttcttaacctctctttgctttagtttcctcatgtggaaatgggaaaaatattattatttaagtcatattatacagctgtatgtaactgtatttcatgggtttgctgtgaagactaatgagccaatccactaagattcttagaatgtaactggaacccacaaaaaaaccttagtattagctgcagttattactattattataccaaaagcttggccaattagccccttgccccaataaataaatggtataactgaaataccgataaacattgaaaagaacaaaatgtggaatacattgaaatgaaattaaattgcgatgaaacaataacatctatattctggtaagacacaataccattactaaaaattttcttgtaaatgaaaaaccaaaaattttaaggtgcaaaagaatagaaatttcaaatcaatgctttattcttaatatttaaaaattgctgaaggaagtaaattaaggcacattcaccaatcactttttaaggtatgttatggtcatattaatatgcattctatattccacatcagaaatatccaatgtagctacatgacaaatatttgcaataaaatccatctttttagaggtctaattctttctttttagcagaagaatacaaatcaaaatactactaattaaaaatataaactgtctgctttgctgacctcatattcaagtgccttattctaaacaatgattctgaaacgcagtgctattagggtaggaaggggcattctaatagttgactctttagagaaatctcaaagggtaacattcatataatcagcccattagtgtccctgtttccttgccaacataaaggcaagaagtataacaccccctagaatggcagcttttcaagagcagcaaacttgtacttctgacttactgtaaaattgtgaatgcctagaatgctgcctggcactcggtaggtttttaatgagaatcgttaaacagttaactgaataaatgagtcagcacccattcacctcattctcttcaacctgttcttttgttttgatttattttaatttgccattaagattcactcttatgttttatttgtttatttttgaggtggaaaagacagggaagtggcaagagtcaggaaaacaaagatgagaaggtgaacaaaatattagtttaaagtggcccctgcttttgaattcttaaaggtcttcagcaagccttcaaatatttaaagctgaaatggtaattataaaaaaggtgattcaatatttacacactactcaaagaactacagaatgatagtattttgtcaagggaatttactgaaaataataataaaatgaaatttgtttaaatattctgacctggcatttttcaaggctgtgtgtgctccagatttcccctacatgtctttctgaactttcaaagcaaatacaaatattgctaattaaagctgtgctcactgatatttagctgacattattagtttcactaagtcacatttattgtacagtacaggttttatgtctgtaatgtacggataaatacatgtgtgcttattatattaaggttacacaatataacattatttcacgattgtaaatgttgacaatgtgtacctttgttctcatgtcattagttttatatagcatatatttgatatatacgcttggttagagatgcgataccaattataacgtgtattgcattttctaagatcaccccctagaatggcagcttttcaagagtagcaaacttgtacttcttacttgctgctgaattccaaatgcctacaacattgcctaggaaaagaagataatttgtgttcattttgcaatagttctagccatctgcagaaaacttaagttgccctatgtctgactcaatttgcaaacactttctagaattctataaacactaggggaaaaaaaaacggtacccttacatgcttgtactctttctctttagttcaaaaatattcatgtaatatagtactttggttatatttagtctgttttttaaaggaaagaatattccttgagcactcatctatgcaaggtgaaagataaaactacaacagaatatactcttacttgccttttgatttttaatagtagggctcaccaaaaagttaaatcatctattactagactatgttgatttcaactttttttttcttctttttcctttgtatttagaaattttaagcatttattaatgctcatattgacttttcttggggttcttatcaaggttctggtctagtatgtagactgtacacatcagtcccaccataatggtcgaccatgtgtaaaattcctagttctgtctggttagtgcctgggcctccatggactgtcttttaatattctgatgattatctctacataggctgccagatacttccaagaaaaaatccgcctatctaggcttatgcatgttatataataccacagatatgattaggttatacacacatttaaaatgctgaataatgaattattttagattttcaaggatgggctttctagaggcattagtcacttggcttgagtgtacccagatcctcaaagcataatccattgagcatacctttgacagtgatctgtgctattgcttcaatgacacccagtgttgacatagcaacacaggtgtaatttgctgactgtcttacatcattcagttctagcacatttcttcctattggcatatcatcttcaggtgtcagatcttctgcccccaacatccactttacataaggcattggtgaccccacggccacacaggtgatattaacgcttccgcctggcatgatttcatgattagtgggtgggatagagaatcttggtgggacacggcgaactggaacaaaacacaagggaaatgataacatatacaaggcaagaaaaagtggattattaaacacatgacatgcaccgtacagacacgattcaacaattgaaacattgtggattgtccaaaaacaaaacataaagaaaaactgtggataatacagaccatacaagtatggtgtgtgtatacacagaattatttatttagtttagtcattgatatcttagacacactaatacaaaagttgattcagacctacaagggccccacaaaaaactatctacaaactaacaatacacaaacatcatgcataagataaacacaaaaacatatacatgcaggcatataacaatgattctatgcaggcatgtatatgcagaaaagggggctggaaggtcaccagcatgtttaagttgagtatcaaaaccaacttcagtgctgtgcacttccagttgatgtgaatgtaggtgtgggaccacactgtcacatcccagccctggaaaacatcacctagagtacactgaaagtgcactttatgttttcagattcatagtggatgcagcctcaagacctcacactaacactggaacaaacacagaaatgtatatacatattgatttacagtcacagaagaagaaacaggctaacaccagtagagatactggattgggtcatgcaaggcatgcacaagatggaatctcaaggcccgtgctaaggatattgaaagaatggctggaatccaagacagcaatgaccgcagaagaaataagggggcaatagaaataaacgtgaaagggggaggtaaagtataacgattgaaacacagggacttaggggatgacagggttgaaagacagaagattaagctcaagttgttaaaggtaaggattgcaaattcagaaagggagctgggtgtttcacatacaggattccattcaattcatatcaaaggtaaaacaacataaatgacaacaaaatcttttaaaaggctttttatgcccacattcaaattgagggacactggatctaaaacatacagcaggacatgacattaagagaagagatcatattaaagcaacataacacagaaaaattaccaagcaatttcagttcagtgttcctgcttcagataatctgcaggtttatgtgtgtttaagtaaatgtgttttggatgtgatacaaggagaaagtgaaagataaattggtttcatctggggcttttactggcaaaatgtcataccataagaatttgagatctagagggtaatctttagggagcacaccttaaatacatttaataaagattttttaaaaattataaataaactgataagtaacctcataaccccaagaagaagataagtaattctgtctgaaaactttttggctgctcttaaggtcgagataaacctccgcttatttgagatggctcactgcaatggcctcatgggtgaatgacagtcataggagaagaagagaaagctaagcatgcctcctgcagccaattcacagaggttacacaaagcaagcaggagccagtgtagactctgaggtatcaaagaacatatcaagaaaaatggaggagagtttagtcttcatgcttgggattaggggagaaactagaaaaagtcattctatgggcagcaggcatccttataagacagaaattaaaggcagggtgggagatggggacagtggagcaggaaggaaagcaggaacactgaccaagttcactggaccttacagagttaagtgttaccagttaccatgcacccaggtacattctctcccaccatgcaccacagttagataccaccagcaagcaccagaagccatggccagggcattctctgctaaaacataccattaaccaaaagaagaacacaatgcagctacattcatttcatttgtattctttgttattggtttaattaatagttttgtaaggtgggtaaaaagtaaaaaacacaccaaccttctcgcagctctgagggatgtagggggtttgatgcagaacacaatgaaatgaggaaaggagaaaaacaagggaaacacagagagagtaaaaaggccatatcaaggctttcaactgctacttgaacatctttattcgctctagttcatccttcctatctcagctggaaaagttagcaatatctcacagactaacatggtattagaaacaatagctagcatcattttgaaattttccatggaagaaggtacacatgcctcatgcagcaagggaggtcactattgtggaaaaaggatcaagggactttcgaagaatttagagaagaaatgactttcttcatatttccccaccccagactccataaaaaaagaaaggagagaaaaacatccccagggaaacaaaattacctctaacaaaaatttcaaaatcaagctaggtattttcttaagggaacccatcctattgtaacttaaagccctctcagtcttttctttaatcccacccccacccatgcctttgtggttattcacagatatgtagaccaggaataagaacacttccactggataaaaaaaactacaggaactggctttgagaactctcgggaagaggaagtacttctttctagttgaatggaaaggcatagccattcataagctcacagtttaatcatttctattacttcatgagaacatatgaatgtatcctcataattcattcttgtctcaaggacaactcacattactatttaaaatacagttttccattgcaatcaaaaaactaaatgtttcggtaagtcttaataattcaaacaaaaaggtgtacatatgtgcacatatatgaatacacatgtatatataatactatgtgtttataattaagaaagtatacgaagacagaaatgcaactgtgctatttgcatgtagcacttgttttatagagttagcagctttatccttacagtttcagcagcaggggtcatgaagacataaacacctttatgcttggaattgcacagagaactgattagtagcacaccaagcaattatttcaggggtttaataaggaaacagaagagaaacaacagaaaaaaagagaaagaaaaagaagaaaacctcaaacaaatgcaaagcacagttcaatcaatacagtaaaaatagaaaccaagatgtaaaaatgcaaatatacttacaaactccaagcctcaggacagattatactcaagagttgtcttttggagttaaacaacacattttaaatttttaacttttctatttactaacatgtttcagctacggtcactattaccaaaccagcttgttaactactaatataacaacacggaccctgcggcgtctcaactccccctgagcctgaatgaagaagcgatgccagggttatgtcattcctacctctgacatataaattggcaggagcggaatagcgagtgcccgcgctgttggtggcaacacactcatattttccttggtcagactcttcactctgctcaatctgaagggctcctgtatggatataaaatatattgccaaagagatgatcagagaaggctttctcagttcagaaagctaaacctcttaacaatatgaaaagccctgcaaagcgaaggtccactcaacgtcgattcaatctcttgctaagttgcacagacagaaaatgatgcgatgagaaaaacatatagagattattttttttttttacatcatcaatgctagcattagaaatcaatatctcttttcccaagcaagacttctagtcataattaacactcttatttcctagactaataaaatgaagatgggtgagactgcttcaaggaagtatggcttttaaataaaacaaaagattaatttttggttttgttttgtttcatttgggtaccaaaagtggcgcaaaagataggtacgctcaaaaaaaaccaggctgggttttcaagaaagtcttctgctgaagagagccaaaaatacgcagcgagcacaaaaaggctgcacaaagcaaaaaattaaaattagtcattataaattatcaaaatatcacttaaagaaacaaaactcccttaagacatgcagatttttaagaaaagaaagacagttttccacgacttacaatcatttattacgtttgctgaaaaacaaagagcagttgaattagaagatttttaaaaagttaaaaggcatggcctgtgccacaaggaagagccaaccaaccactgcttgaggaccctgagatggatcccctaagacacccatcaaaatccaccagtgggattagcagtgtggtgtcacaaaaccccaagaaaaatacaaaacaagaattacaaaagaaatgcacactgagtcgaagtatgaaaaaccagcaataccacataccaccaagaatactgagcaccttttgtttccatagcctgaaggacagaagatccaaaaatccggagacgagtaatccaagaaaaaaagaagtggggaaaaaagcattgctgtcagattgtagacgagtgggatcaggtggaaaggggagtcattctttgacttttaagacattaagagaaaaaagaattgaagaacaaaagcaaaaaccttttgaaagataaagacaaaaagcagatgctccagggtgtcttctgcatgtctgccactgttctccagaccaccttggctttggtccagaacaagaacagctaaggaagaaaaaaaatgatctttttttttctccggttggacaaaaaaaaaggaaaaagaagaaaaaaaaaaagaaaaaggaaaaaggaagaagaagaaaaggaaaaaaaaagagggacagatggtacgctgtgactggtctgtggtctaaagacctggatatgctttctttgaagcatatcacaacttaaataatcattttcataaagaaagaaatgaacaaaacaaagagagaaagaaaaaggaaaggaaagttcacaatatgagagtcactgatcataaccaaacagtacaaagaaaaaaaaaaagttgatggacattattggaatgacgctgaaaacaggacaaagatgagagggatgaaaggacagaaagaatgagtaagatcattctgtgaacgttagttcagcactcttacctcttattggtgtaccacctgggtggataatatgaatgcaaataagattagaaagaagaagcattagtacgagaagaaggaggctagggctggggagaagaattaaattagatttacagaattaaataaggtcttaaaagaaacttgaattactatattggtaaaacaggaatatattagatagtattattagatcataaaaaacaagttgcattataccacagagggtaaagaccgcaataggcagcattgcctttctcagagaagcaactgagttttcaggtctggggtcatatagggttagaattatatcttatatgcctcatatctcttaaaaaaaaactatacaatatttttaaagacatagtttaggaaaatactggctaatctatttaagtatatatatagatatgcatatatatatatactgtgataggaaacactaaagactaactggaaacaaacattgttgattggatatcttatactacttgctatgctacattggtgtgccataacttgtgtactatttaatttttctgcacagtgttcttacgataacagttctgtggaggtgtgtgtgggagccactacagagatctggtgtctacactgacagttagtaaaatgcatgccatgcattttattaataataataataatattctggatatggaaattagtggggttgaagtgcgcttcagaactaagcacttaccaatagattctggagatttaaatacggagagaagaaagacagcataaaaatattattatattccttataatttggtacaaatttttcagagttaaagctttatatactaaatcatctatgttacatgtgaataattaattcttcatttacaataacagaatgctaatctacacaattctgctgacaacaagcaaaagaggcagttaacaagacgctttaacatcacaggacaggtcaaaagctgagaattctgggaagacaggcagttaaacaacttagaattctataccaatattactaccaatgtcaaagtaaacagcttattattatatatccctgtgaaattacctagggacaggctctaaaacttaagaaatttagaattatctctacttttaatctaagagagcaaaggcataaacttgggatgggaatgggaaaaggagaaaagggtaaagagagagagaaaacagcaaaagctggagtctacaccaaaagcagacttctgtagatccagtcactggagggttcaaaaaccttgacgggcgcacactactgtggctaatgtgtagaaaatgttcactcacaatgttattatcatagtattaataaaaatcccctccttttactggtattttctaaagacttttaaaaacatacatctggttactcatgagataacgtttctgtgtttttatgtattagtgaaaagaaagcagatgtgcccagacttactaaactttggtactttgatgagttcaaatgtagaaaagatagcagaaaacatactttaataaaattgaaacattttagggtttaatatgaacattttattttttaatggatacaaccattggatctccttgcaagttctgaatgaagtccaatgttgaaataaatttgtttcaaaagaaaacagagaaagaagaaagaaagaggagaaaatggatccatcaaatactgcgaaaaagcagtaaattaaaaaattaccaaaaatacagtcacagcagtgagcaatgtggattaaacagaagctgcaaaacacacagagaaaaggagaaagacagactctgaaacaggctatgacatcacaaacatggaccacccattaagtaacagagaaagagaagagggagaaaaatcagtacctagaaataaaaaataaattaaaattaaaaataaggagagagaaaaattaaaaaaaaaaattctctaggagttagtagaaacagtaacaagaccctacctgatcgtaactgcttaatacgaccattgttgttgcttgtgtccacaggtaagaaatctttaaaccaagtgatttctggatccggattaccactggctgcacaaagcatggtggccgtgcgagtacgctcaaccaccttcaactgtgggcccatgtcaatggtagggaagcccctgggaatttgatcttctgcaagacaaaaggtgatagaaacattcagttaataagtcagatgctccaaattcaagagattccccagaaatctctctttaccttactcagtgcttgttgagaacctaacacaaaccaggcactaataaattagaacacagtcacaatgctgctactgatcagaagagtaaacactctatgtaagaggccaacagactaacacagagctcagacggggccgactatgatgaggggatgcagtgagttttccaagagcaaagagggagaaataattatagggtttgtgcttgagatcagtgagtacccagaggaagctctgatttaaagtaggcatttaggaaagaacacaatcggccaagtcacaaaaaggggagaaggagattttagaaagattcgggaatgtcacaagtgtaggcattgaggtaggaaaggttttgccgagagagaagcatggaagccaacagtgccagcttggagagtacttggggaacaagcagaagctaggtcacgctatctgtttcaaagctggtatgtttttcttataactctgttttccctcacaagtataaggttcaacccaaatcgattactttgtaagagcttcaattaaccagaaaattgtctgaggatgctttgaaaaagaagagcaaaagcaactccttattaatggcacaaaaacacatgttccttacagggataagagaatgctttcctccatcccaaagatctgcatcattttcagtaattaaaaagttgaaattcctaaattttgaatctccaactcatgcaaaattcactttttgctacccacatcgaaactgttccagatcccagctcttgagaaattaaaatcacttaaatcccacaatcatgctccacactgataactgacattgccagctcttctagccaggattagaaaggtgtgttctatctaagcatcgaaagaattttagttagatgggtggcaattatccaaattagaacatggccatttgtttgaagatcatgaatttttgttattatactttaagttctagggtacatatgcacaacgtgcaggtttgttacatatgtacacatgtgccatgttgatttgctgtacccattaactcgtgatcatgaaatatttttacttccaattgagtctggcattgatttaatcaataccccctcacggccactgataaattttcataagccaccaattctaaaattactcgaaagcataaacagcagcgagcagaacattagatatcatcagatctggcatatcgcttctccttgggtgcctcctacaagctccagtataatccatgaattcacagttgatggtgaatcatactgaggttatgttagaatttctaatgaagaagctccattttgatgcctccaccgtgttgccagtcaacagcatgtgttctccaactctctccctctagagccgaggggtaaactcagtctcctaaacctcactagcaaagtccttttcaatcaggtctcatttttctcagcctcttagggatcaactctctcataggaaatttttcttctgcccacattgaaattctcaccacttcccagacaaatcatgtttgctgggtactccgtgcttctaggaagccacgcagccaaagtcaccttctttgtaaatcttttccaaattctctcaaacatatttcattctttcctcctcagagctaccatagcagcggctactcaaatccactgtcttgtacttattaactcatgagtttatccctccacaccaggagttcttccatgttttatctgtattctgctcccttgcaatcatgctagcctgggtttccagattttaagagaaactccactgattcctaagcctaagtatgaatatatatcagtgactgtttaaaaaatatatatatcctactatgcagaacttctggtagagaggcaaccagttaaatagttagggaccagagagattctgaatgtgaatggcgaaagaatgtaagatgctaccaaagattaaagctcccaagaaagagaaatttcactgaacagatgcagttattgtaagataaaattgatggactattaaggaaaagcgtagactctggctctcccgctgggcaggatagaaagtttctatcttttactaacacagtctgtgaaggaccaaaagaagctgaggcaagtttgatttgacacctgattcatgacataataccttcctatcagaccaggtagttagggccgggtactaaacacacttataaaaataattaactgcaatgagctgaacttcacttaagttgaaagatgtggctcatttgtggaagcagtaatacattgtttttgtgaatgtttacacatcgtcagccaagcagaggtctacagtagacaagtgtcagaaacagtagttaaaaattgaatttcaagatgatttttcaaggctccaagagaaagttaaaaattaaaagtgggatgcaaattaggctatgctggttttaataatctattccacatgaatttcatcaggctgttctttatggctttaaaggttttgccaatatatttacatctacaacatagttctgatgttgctggggggaaaaaggagcagaaagatcaatagctgctataccacacacgttatgttattaaatatctcacttggcagctattgacacaaagtgcttcaaaggataaaagtaatttacctcaagtgctccaacaccaactataccgccttcataaaaatgagtttctgaaaaagctcttagattttgttgttgttatgttccatttttaaagcaaccaacttaggttaatcaaaaatcaccttgcgattcctgagtggtttctgtatgtcctaggacactgtatctctcccatggtgtttaagtactagttacatttgcctgcataaatactgctctgctagtcattacttttcttctacaagttcatctctcggaagaactgagccaatattcagtgctgatcagtggcaagtgccaaaggcttaagattgttaagccacttactaaaggctcttaccaaagaaatctagatttaataaccgtttataagaaatatagtcctcaccttggggatagccgacaaaattgacttgtaccttcctgaaaagcagtctaatacattttcatgacctttctcttccttcctggctcataaagaacactccagagcccccttttcatatacacgagtgcacaacaaagataatctttcttgcatactaatgggacagaaaatgtaaagagcgttcctttcttatttttaataagggtaattaaattctatccatccccctttgcacagaatctctttgaatgcactttcttcgttaaattttcatgagaaacatcacaatgtaacagattcaaatagccagagctgttacacgttgacagttgtggcttgtttccaatttgactgtcaggtatttggcaataaaactcagtattcaacataaaacaaactgtagaaataatgaaatttctaattggaatgcttatctccgtgggtgtagtttagaagacgttaattgcttttttcttcaccttccacatttattagtgatttatataaaactgccttggccatttgataacatcaattttgacggctcctcaaatgtgtggtaccaggaacttgggaatcaaatcaatatccttaataacttaaccacacaaactttcacaggaaaaagcagctagcaaaaattaacaaattgtcaatatgctagtagctttaaacttttacatgaggtgaaaagaaaaacattttgtcctattcattaatgtgctcattaagctttaaagtgccttacttatcactgttccatattaatattcaatcatgcagaattagctactaattcatcaaccatttaaatcagacttgaccttcacaaagccatttgttctgtcattttgagaggccattaaagggcagattactacatacttgtgcttagtgaatcatagagtcatacatattttgtttggaatggcagctataatagacctggaaatatagcaccctctttgaatctgttggtatcttaatgaaatatgctgatacaaaactttcagttccattaaggaaagagaaaaatgaatgtaagcatcttccagagttaacttcccattgtggtagaacttattaacaaccctgacctacccaggacttgaaaggaatgaatccatgaggaaaatagtctgacactgttttgtaggtagtcatgccttacatatctgtgaatgatcaagtaacaggttttacatgatttgttcacttaaactgttttcactgttcatgcataaacaatattaacgatgctcttactttcactccactttcacaaacactgaatctcttctttgtaaggaagccaggaaaatctgaattgcctgctaaggctacaggctccttccaaggtggtcctaagtagctcttcttgcctaatcttgctagggctcttgctgcgtgaattcaaccagactagtcctttgactctgaccccaactgatttaacgaagtcttcaataaagaactgtttgccatggtattgggaaaaatcccaatttttaagattaatacaaatatgtttataaagaaaaagcgtgtcaattacatcaattacatcaatgcttcttcaagtgcagtatttaaaaatttggcaagtatacctgaacacttagatattattgacaatacagaggttttggcagtaatggcagtacaataaaacaaaaacacaatatggatgaagagacaagcagctgttatcatgaagcattcatcccctggaattacttttctaagtttcaaacagttcagagtggctcctctttaaaagtccccaaatagtgttatcaataaaccgtaataatagttagtatgtaagtgtgaactcttacaagctcacaggagggcaggagctatttgttactttcttcgtaaccttcccaatgttcaacaaatactcacaattagacatttttatgatgctttgacaattactttttcagcactcactcatgaggtatctctcaattcctcctggaatgtcattcattgaaataccattcctcaatgccactcactgaaacagtcattcttcaactgtttgtgactacacatttggcctccttgagtatcagtctattaagaggcaaagctatctcatagtctcattattttagtgtcataaggagtattagaattagagacttaaaaaatggctgtttgtgactttattttcacaatctttagtttcgtcagcaagtgattttccttccattgagaatatgcaatttatgcttttaatttatcacggttgctatgtgagaagcacacaatttagtccttgcttccttcattttacaggaggctttccctcatatattggttttcagttcctacgtgtcagaagcatgaccacatgacaaaaccacatgtataaacacaatgacactgcaaagaacacaatagaacacgtatctatattctactgttattctatctatagaataacaatggaattcttggtgttgaaactaatggctaaaaaagcccaggagtgaaccactcagtttttttgttgaggcaaacactgtgggtcttccttcactgacaggaatacagatttctaagtcactggatatcttacggtttgagtcattcatatactctcacagaacaagagtgatttcttttctttgacgggtggaaagactgagtgagaaaagttttcattaacataagaaaacaagaaaaatgatagacgagtaatatgcagcgtatttttaaaatgacattcctagagtatatatatatacacacacacacacacactaggactgtcattttaatatatataatacatatatggactttttcacgtgtcagagaatcagtagtgttctatgcagcagaaagtcagtggatttttatacttaagaaaaagtacgaactttctcggaaaatttaaatacacattggtcttaaggtggtcaaataaggtggccaaatagatactttaaaacaagatatttatgaaaattacaccatatattgaaacaagaagataatttgaactattagttctaaaaacctaccggatagtcaacagatggcatcattcattctacaaatatttattgaaggcctcctttgtgctggactgggccaggcactgggtatgaagtaatctagataatctctatattgttgtgatttaattgtatctgcaggataattagcttctttgaaagtaataatagtaccaagcacatacacaggaagattgaattagatgatgcattaaatgtgcctagtgctgcctggcactagtgtctggcatctagtaaaatactagcatatatgtacttgctttattccaagctccatcaatagatctaaagggatcagaggcatgtgactctaaggcttgatcaaacaagtagtgcagcaataaactgcaaatgagaaattattctatgcaaatcataaaaaacaggggttatctagacacgcaactaaatttaaagcatagtgtttgtgccaagtaacctctgcaaagccaataaataccctcttttccctttgaacaagattttaggctctttgattaatcaacagtacaaataaataaaatccatattgtcagatgatttgttcctaaaaatgaattttaaaaatagctctaaatatttgggatgtcaaaggttgttgtgaacaactgaaaacactggaaccaactgtttttccctatatcatggcaggcatttttcttttagttattcagggaaggggcattaagtattcctcatcttggggagtaggtcatgttaagaaggctatatggctttcttaaagaaaatagtttttaaaaagatgatgccaagaagtcagagttttgttttttcatctcaaaagtttcttaacattctgaaaataactgtttggggaaaatgatataaatcaagaaacacctctgtacaaagtctccataaactagttctaatagctccattaattgttcagctctggagaggggaaatctctcgatgagatttgtctaatatgatgctcttactaaatcccacctttaacagaatggaatttagtcagaagatcatattagacaaatttaaaattttacctaatgcaaagcactataatgcccagtatctctaaaatacaaatatttgaaccttattagagttccttgaggtaaataaggatggtatcattatcatttttttgtggctataaaacaaaaactcagtaatattgttatttgtttcatatcctacatgtagtaaaaaattaaagaaagtctttcagctctagatttggtgtctttttattgtgtcatgtttcctctatgcaaattgctattcttcaaataaatcttcatcatgtagtgatgaaactcttaatcacagtcaactcatgaatgggacaacaaaagagtttgaatacttggtcatcctttacttttattttttaaatggcatggactagatacgcaagttccatgagatgtaataatactttaaaaatagatctacattttaaaaatccacatatatatacatacatacacacacacatatacacacacatatatacgtatataaatgtatatatgtgtgtgtgtatatacatatgttataggcttctcattccctcaggattggttctagaagagacagaattctgccatgtctgttagccagtacaaggtagatgagaaatggaagagtgtgaaaaggctgataaatgtcaagtaattttcctagagagctgagatttagtactgtgcctatacctttagcccttctgtaatttctacttaattacctaggaagggctgagaatggcgggccttctgccatgagcaggcaccaaaagtcagtacagagaccagaaaagcagatataagtagacctaacatatctaccctatgactttgggccacaaggtccctcttcggtttatgggactaataatgactactccaaagctttatctggacagggagacagatcagtgtctcagaggctggaaggcagaggattatcatagtgtatttgctactttgtcgaacaatgagttttcaagtcattacatttcaaaatgaatcacagtatcaggctacaaacaaggaccaccattttctttccagaatacagtccttgaagaagaggaaaaaacattcttttcttaaaggaaacagtgtaaataaagcttttattttcaccattccagatggcagcagggtataatttgtactgtgttgacatcatgaccattattattcaaagtcaattttcctgtaagtgaattgaataagggactgaaaacagaaaaataaagagcaaagaaataaaagctaaatcaccgttttctagcaaagttgggctcttgggccattatcgaaatgttacgcatatgaataaaattgaaaaaatcatatagtttctaattacaaatcaaatgctagtccagtcagcaagaaactatataaagcagaaaaaaaaactgacagttaatacatgacattccaaatggaacatacgataaatataagatctgttcccaaaaaagtaattatgaacaagatacaaaaatttttttcccaaggtcctctttgcaagttattacatacagatagtatgcttgtcttaatatggctataaatcaatcagctaagcttttatttcagagtagatttaggtatctcttaaaggcagtcactggatacaagagtctcgaaagatttctcatagaattatgccatgcaggaatagaaaattggacattgttaagctaagagcctcattagcagctactaaatattcagcataccaaccagctacccacagagcattccagagcaaagctccattttatgaaatattcctcacattttgaggagtttgcaaggtactccgggcagagaataaaacaaactgtttagaagcaatgcatgcaatcatcctacaaattacaaagtaatgtctacatagcagaacataaaccccagttagatttaattatcatttgtctaaatgtggtagctccaagtttacattgcattaagttaaggcatactgttattagtgctcggcctgagcaaatgattaccctttttgtgattcataatcaaataaacgcattgagaaaaaaaagaagtaccttctcctcctacctagtaacactattaatacctgaacgtttaactaaatacttaggcatcagggaaacacatttattcccttctttgggattcatttagataaaatccaatatccatccactttcacaaatctcattattccctatcaatttatatttatcaacaagcaggtgtcattatactcaccctttacatccatccaaatgtttaccttactttgaatattcaaataattaaccactttaccgaaatgtatatttaaatcataaaatgaattttattatttttagaaaataattttttattcttgttttttagaaaaagaggcacaaagacaaaaatagtaaacaaggaaagagacttggatttggatcctgcatccattatttgttagctttgtaaaaagttacaaaccaacaagctcaatcaaatgggactacagaaaacattcaatgtggtttcttcaccatattttggtaaatataagtatatatgaataaattttctaagccatcaaatgttataaaaaaaagaaaatcagaatcaattgtgtagtgttggattggaactaatagtgttggtgtgaacacctagttttaaatatatatgtacacacatatatatatacatttgtatacatatactatacatattttaaatatatatgtatacatatatatatgacttgtaaatgagtatgcatgcacaaacatacattctttatataaacttagcaaagacatcttccctagctgaaccaagagaggctgggagcagtaatacccagtagcaatggtcacaccttgtattcagatcttggtttctaaataccattctccagttgaaaggaaacactttcctttcagaaagcttcccttcagaaaactccttagagaaatcactgattccaattaggactggaacaagcaaagaatgagactggaacaagcaaggaatgagaacaagcaaagaagacacaacttatcctgttgtataagaaaatactcaaagaatgaaaggtatatactaaatgtacacagaagccagcttaaaggggctcttattgaccaaatattggacaacttgaacacgaaaattaaaaaagacagtattaacaagttataacacactgaataaaataaagacatgcatccatactgatataaataactgagtaaattaaaagtttcaggagaaatagtatctttacatagtatcaaagggactccctacataaatttattaaatataaagaaagcagtctgtgagagattaaatgatagggaaagtcttaagcatctcctagatttgcagtatgcaattagaaaccaaaaatgatgctccttatgctgctgctgatgccaatgatattaatttagaaaataatgctcccatttacatgattttgctgtattctaagcacggtagtagtcctaaaaataccattaaagacaaataattttgaagttttaaattttaaaaattttaactatttttaaaataataataaaatatgtaaagaaaaattagtaactttacattggagaaggcttacagaaacaaccttgattaaaaaatcaaagttaataacaccagtaaagggataattcaaattcttgtgctgagaaaaatataacatcacttccacaatattcctggaaaagagtcacaacctaaatatgaccaccagtaaacatcagcaaaaccccaaacaagaacattttgttaaataacaggctcgttatcttcaaaactatcatggtcagaaatgtcaaagaaagactgaggaactcttccaggttgacaagtacaaaatacaattctgaactggagcctctgtggaaaattataaaaacttgaatggcgataactggtgaaacacaagtaagaacaactggaaaaatgtgatcaaaagtgaatgcggatctaagaattagatggttatgatgcatcagtgtttacttcctgatttcgatagtcccattgtagttaggtaggagaatgccttgtttgtataaatctgagtatttgggaatgacaggcaaggcatcatgtcggcaattaactctctaacagttcaggaataataagttctttgtactgtagtttctacttttctataagattgggatcatttcaaaattttaaattatatagaagtaaactgttataattaattcatattatcagaaatatatagacttattcccaaagcatctgggtagctagatatactcaagcattgctttcccaattgtgacaaacattcttaaatatatactttatttgaggccctcttgaataccatgactatttaaatgacactccaactgttattaccaatttcacacaaatgatgacaatatctgaaaaaagttaactctaaaaatacatgaattcctataaaattaaggcataagtatttaattacaaacaatgaacaaaattgagtgataactcaagagcaaggtgcaagctcatgaaaagaaaatgtgagaaatcaatattctaataacataatgcacgtttattatttttatttagagaaatgataaagtctgataaaaatttaagatagaagacaaactttttgaggatcttccttccaattaaaacataattaacttagaatagcttcagaaatccaaatgttatttttttaagccaaactttcaaaaattttagaaacaatccaccttcccctcagctcatcacagttctctcttcctgaaacaagaacacattacagaaaatggttgttaccctctagtctttaataatgtaaggcaatgggagcaagaggaacaaaataaagtgactcagatatgtctaaataatttttctaaaaagagcatttcactattttaccacattcagtaacagtttttatagttttaaaggcaaactgtggtaggtatttgttttatctgacaggagaaaattgattctgaaaacagaggtaatggcagttttctttagagggtgtcttgaaagatgaaaagatcaaaatcttaaaacatcaaacatcacatataaaatgtttcactgaaaaaatgaaaactacaggagtacatgaataagcagttaaagataacttatatgtctcagaatgtattacagatctatggggaaacatttcccataaatgcaaatagttttctatttatatggcaaaattcagcctgaatttaacaccagagaataaccaaatggaactaggttttttgttttgctttttatagatagggtcttgctctgtcacccaggctggactgcaatggtgcaatcatagttcactgcagcatcaacctcccaggctgaagggatccttccacctcagcctccagggtagctgggactacaggcatgtgtcacaatacctggctcaattatttttatttttcatagagatgggtctcactaagttgcccaggctagtctgaaactcctgagttcaagtgacactcctgcctccactctggagcagctaggaccacaagcacataccaccatacccgtcttttcttttattctttttgtggagatgggtttttgctatgttcccagggctgctctcaaactcctcctgggttcaagtaatccttccaccctggccttccagtgctgggattaccagcatgcgtcactgcgcccagcctttgtgtttgtttgtgtttgtgtgtgtgtatgtcaatgtatgtttttcttcaaaatctttgaaatcacaggactatcaatttatgaaactgcccaaagaagtttacaactatgatttatttcttttcgaaatgtttgaactttcctctctatcaaaagaatatcatatataaaagcaaacacaggatagaaatttattcactatgctttcaaatatcaaaaatattaagaagctattcaacaggagttcagacatctggaaaataacccaatcaaagtaaaactgccaaacaatggccaaaaccactaccaaaagttacatgaatgaaatcccttatcttttgcaactagatggaagagttgtcaagcatccacataaattctaaaaccttgaccttcttcttcaatagattaaacacagcaaattagaaaaagggtttcaggcaaaacctgagggcatacataaaggattgcgatctttttccaaaagcaaatgaaaggaaagaagggttttgaaggtaaatacaagtgtgtgggcacttcggtgcttgcgggcatgtgtactgggagtgtatgtcgcttatcacaaaattggcattaaaaaatggctttttaactgcattatgaaaaatgcattggggaaaagcaaaaaataagaataaagtgatgtaggcatgttatttaggatagtaccgagatagccctgtggcaagataaacttacattaggaagatgtaaggagatagggagaagtggaaaaagttcagaataatttgaatgtcaattttacaagggttggtaatattttgaagatgaggaatgaaggagaattatcagggatggctttctgaaatgttatgattgtttgcatatgttttcagtcatgtcttcccttgggaagcaatgtcatgtatttgaggcactcatgaaacagtatgcctctatgaaggactctcaccaatagagctgcccctggatggagcacagcactaagtacaaagcaagtgtctgtcagttgaacactgatccagcttttccttcaggaattggcaaaaggggctcgtagagcaagccgtttgcctccttatctgctttgtctcaggatgaaggcaagaaatgtctgcttcagcctacacacgtgagctcagcatcctcactacagacgcaccagaagttccctgggagccagtctagaatgggttgtaaatacccatggatttgcatcagttttctccactaatagctcaattcctgcaatttgaagacagttgagcatgcaagggtagtttctccctagccagaaaaggaattcacaaaatattagagtatgacagccaatggtctcctgaataagaggaagaataatttgagttgtgttcctatgaagacatgaaattaagaatctccttatagataactcacggctgtcacattttaatatacaacatgccaattaaatagatataagtttccaatgataagatgatactcagaagcgatgtaataaaacctttttcttacatattgaaaacaacccagagctgctcattttcgtttagttgtaatagactgacacattgttataaatttgggaaacatacaatctctaattcttaacaaagtgacagcaaattgacaacaaaaaaagttttctcagccttgaattcactggcatagcaacatgacataatccaccaatcccccaacagccacgagtggatggttttgatgtttaccacaagattaatgccccttcaattgctcagtgatgatggctatgaggctgctgaataaataatgtatgtgcattcactaaaggaaggaagaatgtgtatttcagccactgatccctaatataaccaatgctatttaagtgtttgttgttaataaagataaaatactatgcaatacagctttgtatattatacacgacaggttttgtgagcaaattatagttacatgggcacatgttgtcatttttccggaattaactcagaagataaaatataatcaagaatgtttccccagtgggaaaaagacattttcttttcctttttttctttttgagacagagtcttgctctgttgtccaggctggagtgcaatggcatggtctaggctcactgcaacctctgcctcctgggttcaagtgattcttctgcctcagcctcccgagtagctggactacagctgcgtgccacaacacccggctaatttttctatttttagtagagacggggtttcaccatattggccaggctggtctcaaacccctgacttcatgacctgcccacctcagcctcccaaaatgttgaggttacaggcatgagccaccatgcctggccaaaacattttaaatttagttttattttcatggatatcatagcccaccatagtactggtttttgggggttgaaggttcatagacttccatttgctgggaacctattgggtatatcacatgcattaggctggtgcaaaagtaaggttttgccattactttttttttttttttttttttgagacagagtcctgctttttgcccagtctggagggcagtggtgccatcttggctcactgcaacttccacctcccaggttcaagcaatttgcctgcctcagcctcccgagtgatctcgaactcccaaccctcagtaatccgcctgtatcggcctcccaaagtgctgggattacaggcatgagccaacgcacccggtcgccattacttttcaatggtaaaacagcagttgcttttgccattgatatgagcaggaattaccttgcaggaaaataaaaaaaataactttttttttttttttttttttgagacagagtctcatctgttgtccaggctgaagtgcagggacgtgatctcggttcactgcaacctccacctcctgggttccagtgatcctcttgcctcagcctcccgaatagctgggattacaggcgccagccactgtgcccagctaatttttgtatttttagtagagacagggtttcaccatgctggacaggctgatctggaactcccgaaccttcagtgacccaccattgtcggcctcccaaagtgctgggattacaggcatgagccaccatgcctggtcgccattactttcaatggtaaaacagcggttgcttttgtaccaacttatacataagttgcatgatttctcacagacttaatcctttgacaataacagctgggtcatactaaagacagtccttttttttttttttttttttttaattgtcaggaggcacttttgtatcaaagtgccttcttcaaagcttaattcactttcctaaaacatgatgaccagggtttcagaacaaaactttctgggatattcactttcctggtgcttcttaatatgacagagacttaaacatattctagcacacacaatcgtagtttttaaatgtttatcttggttgtgaggaaaaaatgcagctagtggtagatttaacaaacagcacattgctccactctcacctctcttttactctccagaaataatttttgttgattttcaaattcatttcccaacatcatggatattattcgttttcatacttatattttgtccttgacaaagataatattgtttgttcagacatacagggacccatttctgataattcagtttttcgtgattccaaatggaacctgtaacagagttaatcgggggtacctggactccaggatccctaagttcatgagacaagctgttttctggattattcttctaaaaagcagatcaaatggaaaacttctcaacaaaattatttatgaattgcaggacatgaggtagttccgaggaaaaccatgtatcttgataaaacgtataacatttcctagaacagagtcaactatcactgatttcatcacagtgattttcagaaggcaaggactatacagatcaactgttttacagtcaaagtcatgctctttggtaaatattctgaagtgtttgactattttcaataactgagtctacagagacattacctcattcagtttattaaagtacattatttctactgattgatcaccattgaaagttcaaatggtgtttaaaagggccttttagctttaagttgaatgaatgacatggatacttgtttataatttcataatagtttttcaagtttgaattattatagacatactttatggtataaattggtcattccttaatttcccattaagcctgttcaagaagaaatccaacaaactttatacaaactctagctaaacgtagaagtgctcactttgtccacctcaatttatcaggtggctagcctatccaagcacataatatcaccaacctctttagttttcataagaagatgtacctatttagccttaacacagatcagtggtaacatctgagatgcttcacttaaccgaccacatagtgttgctttcatctgtacttatcagggatctcaatcttaaaatgacagtcaaaacaacttggccagaggagtaatatttatggagaattagctgaagttatgcaatttcatccactcctccatataatataaaaactgattttggttagctaaaggatgagagagctagaaaccaggactgttttctctcatctgctggagaacagattaaactgacatgtgttttgttataattcgacagattaacctgagggactttagcaagcaactgccctataatgttgtgaaattaaacatgcatatgatgcagagaatagcatttactatttgactatatcctcgttctcaagaactatgggagagaacttttcccctggtttcaggggaatattatggtttttctttcttttttctttttcttttttttttgtgagacagagtctcactctgtagtccaggctggagtgcagtggcataatcctggttcactgcaacctctgcctcccagtttcaagagattctcctgccttggtctccccagtagatgggattacaggcgtgcgccaccatgcctcgctacttttttgtatttttagtagagatggggtttcaccacgttggccaggctggtcttgaactcctgacctcaagtgatctgcctgcctggagcctcccaaagtcctgggattccaggcgtgagccaccgcacctggccatactatcatttttctaaagaactgatttgttatttatgttatggacatgatgcatctgtgtcacagtttccctctttctcacgtctagagatgttagtagatttggagctaaaattgtggtttatttagcaaaggcacagaagtccatggcatggaccgtatgcacgttccaactatactcctaacattaacctgtcttactacaaaattttcctgctccactgtcataccattttatcttgctatgtgaaacattcctccataaactcttctatctctttgaaataaagttatcatagacacaggcataaatattgtagatacaaccttttaaaaatatataatgtacaaaagtgatgatctgaaagatgtcagtacatgtccaaatgaatccacatttcccataacagtctgagaaatgttaaagtcacccaaagttatgctaaaccaaaaacaataaacttattaaagtgagcttaccagaaaggatataaaaaacttaatttagtaaacactaacttaaaggaaaaaataaaggaagaaagaaataaagatagggttaaataggcatagtgggccaggcatggtcccagcactttgggaggccaaggtgggcagattgcctgatctcaggagtttgagaccagcctgggtaacatggtgaaaaccagtctgtacaaaatatacaaaaattagcctggtgtggtggcatgtgcctgtagtaccagctactctcggggctgaggcaagaaaattgcttgggcccaggaggttgaggctacagtgagccgtgttcacaccaccgcactccagcctgcgtgatgaggtggaatcctatttaaaaaaaaaaaaaaaaaaaagagagtgactattatttctattttagaaaagtcacaggcattggatttaattccaatatcagcccatgataaaaatgataaatatcacaaagatatatacccacacaaaaatacatatataattatgtgtggatatgtatgtttgtacaaagcacatgtttacattacttgcagaaaattataatcacatttaacaaacattaaatagcagtgtattatttgttcaatttaacaaatatttattgaacacctctcagactctctgtgtaaaacattgctcagcacctgacagctgcaaaaacagtcccttaaaagttgtaccatgtaaggtgaaaacgtgcatgtgaacacagaaaatgtgtcaactaatcaaaccctaagggagcacaggggtgaataacgattttgctggagaccagagaaggtagatctaagagcatgaatataattttgatagaaatgtagtaaagggccttcaaggcacagggaaaagtataatctaaggtccaggaaagattaaataagtgcgaggtggattcaaggtgaaatgcggtcactgcttgaatgcttttgtttgcggacaggggtaggaagacagtgtgcaaggtctgttgaaggatgatgcaaagatggctggccaggtccaactgtgacaagctggaaggaatctggggttcatgtgttaggttgtatatgcatgcagctggaattttgttttttttttgagagaggtgttcactctgtcacccaggctgtactgccgtggcacaatctcatctcactgcaacctcaccctcccaggttcaagcgattcttgtgcttcagcctcccaagtatatgggactacaggcacgcaccaccaaacctggctaattttggtatttttagtagagatggggtttcgccatgttggctaggctgttctcgaactcctgacctcaagtgatccacttgcctcgtcctcccaaagtgctgggattagaggtgtaagccattgcacccagctggagctggatttttttttttttttttttttttttttttttttttgagacggagtttctctcttgttgcccaggctagagtgcaatggtgcaatctcggctcacggcaacctccgcctcccaggttcaagcaattctcctgcctcagcctcccgagtagctgggattacaggcatgcaccaccatgcccagctaattttgtatttttagtagagacggggtttctccatgttgaggctggtcttggactcctgacctcaggtgatccgcctgcctcggcctcacaaagtgatgggattacagatgtgagccaccgtgcccgggccacagctggatattttgaaccaaggaagtaaaagaaaaatcttcacattctaaaaagcaatctctgtcaagggagtgcagtgaagggggacaaagagaaagcccagttaggtagttactatattagtttaaatgtgagatgataaagtctatgtgcggatataacatagaattataattatgatcgttggaagagaaaggaagagatgagttagacgcatactggagaaacattccaccagttttagggagtattcattttacttaaggaaaaatggggtaagagtcagtgtcaagtttctagcctcttagttccttcgtgaatgatggtaggtcagcaggcagggatgatgtcactaatataaaagacacaagaagagacagagaaaggtcaagatttgtgtttctctcatatgaaaatgacagctggaatcatgcagatggatgagatgacccagcaaagaatttacagtgagaagagtatgggaaacaggggttttgcaatgttccaagtatgttttccacacagtaacatttttgcatattcctattaaataactaaaagggataagaacaattatattattttgcattgtagattttaaacatagagaaaaatatgtgtgaatatttgccttgtgaggaggggcatatgagaaagtaatgcaactttgagaggggagatgaagtaaaataaacacaagatataaaccccaagggaaattatttaaataggaaatataaaattattcaaattgtaaattatctaggaaaaacacccaataattctaatggtagcttaggatattgagccaattttttaaaaattattacaaaagaaagatactattcttaactcttgcttcaagccatgcaatcagacaaaaagggtaccatttcaagctctttcatttagcgtatctatattcagatctccattcatatagttcctggcatgaagcatctgaaagaagattaaaattaatgtaggagtgcaacattaagacaaacatcactgattaacttgaactgaaccaagctcaaagcaaaagccataacagggaatcagtcagaattgaaaagaacaaatagaagacttgtttagtttttactgtattccccaagaatttgaaaaatttagggtccaatttatattattaggaaaacaaaaagttgtttttcatgttctattggcttatgattgctctggccttttaaataggcctacattccaatataaatattgtcatgttcctaagattagtatagataccttacatgtatatggtacctcccaaatttgaagtgtcatgagtattaaatgatttaatgcatgtatggcactcaaaagtagatttgtcatatagtaaatactttaaaaatttactattaccactactgctgccactactgctactactagattgtatgagattaacagtaaaatcaaaactatattctgcattatttattataattagttgccctgaaatattttaaggccatcaaaatcttagttggttaaatgacctactggataatgtatctaccatacacacaaacagatacgtatgtgcttatgtgcacacacattctccaacataatttgtggaaagagtagcaacaaattaaagaagagatcatgattttcaatcacctaaataaatctaaatccatatgcaagagaaacctagaaatatggtataatgtaactgatagtataaaagctcagccctaagatttcttaatagatccattggccctatagtctacagctttaactatgagaactcctgacaagaacacccaaggcagatccagtgttcaatctttcttttgtacaggcctgggtcaggctctttagagaaataagaacgcaacagcaccaaggctgggtatgaaaagaatattctctccacgggcctgtcttcgacagtgagcttatgctatagctctcataacaattactcatcaccaacaatagcatcccagttctgcagtgacagtgtggttgaatagatttcactcctggcactcccatgataccataatggcaaatccctatgaaaacatatgataagactatcacttgggggtggtttttgctcaatagctattttattcccttggagtattttatctttcttcataattatatcaaagggtacatttctaataactggtaatcccttccttaagtgactttaacctccgtaggcattgggccccatgacccatagcacaaacatattttgtaattaaattttttttcaatttcagaagccattgaggaaatgttctgctttatataattgttctccattaacagacatttaatatgaaagttttcataatttaaacccatttaatctcatccttatatgcttcatatctcattttatttttgctgttttcaacaatcaaaacccttattattatagataagagagtatatggcagatcttttttctttctcttttcctttctcttttccttttcttcctctttgttttttaacgaaggctaatagttcttaactttagaagactaacaaggatgcaagagtgatacaatttttcaggagcctgaagtaccagtcattttaagtagcttcagattacaacctgtgtgggaaatagcatgatcattttcaattacttcatcatgaaggagaaccattaattagttttaactggaaattgctaacaacatttctacaaagtttataggtgtaataattcaattttccaaacataatgaagaaagtccacaaaatgttgactatgaggaccaaatcaacctctttttgcctagaataaacctgcacagactttatcaacatataatcagcagaatcaagcctggaatagatcaaaccagaaatgtgatccagtcatcctgttccaattaaagaatggaccatgtgttgaactaagcaaataagtgtagataaaataatctatgttgggatttgagtacaacttttctggctgtacttcaattgtagctaagatccaagttgaaaagttctggcaatactgcccccatacccaccatatattttaaaggaagctatcaatgacctggaccagaggcctgtgaccatcaccttgcttttttcaggcgatggtcacaggcacctccttgcacggtttctaacagaagacagaactgacctattaccaataaccacaaccctagcaaaacccaaatccaaaccccatttatatacaaaactgagaaaaggaaaagtcacagatctttggaaagtacagggttctttctctctgggaaaaatcattgtatggtttggcggtgcctgtcaaaaagggaaagtattagcaggtttctcttcttgctgtgtcagaacggaccagcgtgagagagtttttgacagagtatgacatgtgtttttggatttggtatccacttttctcccagagcactgtataaagaagcctcagtgaggtgcatggaaagaggacagaggcattcacaccaaaccaccttcattgcactcttcagaggatgaagaagcagccctgggagacttctcgcagcttcaggagaagattcatgatgaacggaggccaagcaaataggaaatccaaccagcgaccagatcaggtaggcagcataatggctgggactgaatatggatgatgacccttctctggggtgttcatgagcaatgctggaggaaagaagaagccaaatgcaaccccaagaatacctactctcgctttgccctctgtggtggattgataatgaccataaatttaattctgagttggctatatgacttgcttttgacaatggggcattagtaaatgtgtcacaagtagatacttggcaagtcactagcactggggctgcttgtgagccccacgactgccgctgtgtgacaaacacttctggagaacaattgcctctgttgctagagccaatagcatgccacatcccagacacattctgcattacccagccatcagctaccctgccacatgaccacagacccaagagagagacagtataaatcacttgagctggcccagactagaataactgcccagctgaaccacagaatatgaagaatcgttagaatggctgctgggttaaacttgttataaccaaaagttgagcaaaacactagtgacctgctttacaaagtatattatggcaccctatagattacaactaaactcggatcccaaatcaacttaaaaatgctatgatacagtttttgttaaactgtgcctttatagaaatattagtgaaagaaaaaaaggaaaacacagagtagaaaccctctacggaagcagaaaatagtcaatgtggagttgctctgacctcaagcagcttgaaagagctcaaacagtgggcctgagtcccctggcgtggcgtgaaaacaaggagcaatttggtttgctttcatgtatcttctgataagttgaagtagtggaatgcattaattccactctaaaataattaaatcaatcctttatttatcagtcgtttactggacacttaccctatgcaatcaactacactatctaccaggagatagtaataataaatacgaaagctatagaaaagaaatgagagaggggaactggagtatacctttatgacaggtacatgactcagcattctaaaatgtatgctctcatcgcttctcagccttttggctaagatcaagcgtctaaaatgtatgttctctttttctaaccataaagccctataagaaccttcttcttatgctcagagaacctatataaccctattttaataagctatgaccttgttgtttgcctgtaaattctatcctaacttaaggagatggagcacctacagtatggtacaaaaaagaaggcggccagtctcttacgaaattcagagagaaaaagaccacagattagccgggcgcggtggctcacgcctgtaatcctagcactttgggaggctgaggtgggcagatcacgaggtcaggagttcgagactagcctggccaacatggtgaaaccctctctctactaaagatacaaaaaattagccgggcgtggtattgcacgcctgtaatcccagctacttggaaggctgaggcagtagaatcacttgaacccaggaggcgaaggttgcagtgagccaagatcatgccattgcattccagcctaaacgacagggcaagactctgtctcaaacaaaacaaaacaaaacaaaacccacagattatagttggggaaggaaggatttaaaaaataaataaaagctttgttaacaaggaggattctgagttatgaggaagagaaataaatctgatattgctagaaatagaaaaaaatgattattctcatgttttgatatcacagaaattgattttaatatagaaatattttaaatatgggaaagtaaaaagtagggaaaaagtccttgttttcctctaaatgagctataaataaatatcctttgggtcaaggaacttaaacttggagtgtagcatgtgctgggaacacagagaggtatatgatcaccccataaaaagaagaaaagtggtttgactgacacagaggccatactaagtccaattgtgacacattaataggctaagaaatggactttgagtgccaggctattgaagcaaatttagatggctaggtataaacagaaatacaattttataatggttctgctaaaaaacagaaagctaatcctgggataagaattcattcactgtccaacacgtttgtttattttgacctgttggtccaagcactgtagagctgtcagagaaatatatgaagcagcacacagaagcctgcaaaccccacaaaacactaacatatttgtgtttttatacgctttctatcatttttacgggctttggtgttggaagagtaaggtgatccaggatcagagtccatcaagttgaaacttaagtctctttgtacttatgagtatatatgacttagctattgaaaatccaattatgtatatatacactatatatataaaaaattgttcctccagatacttgcttctaatttgctaaatgttactatatcaagagaataacatttcttctattataatttactaacttcccagaataagtcagatgcctcctcaaatatttaagactcaaaggggccaggtgtggtggctcatgcctgtaatcacaccaatttgggaggatcacttgagcctaggagtttgagaccagcctgggcaacatggcaagaccctgtctgtataaaaagacttttaaaaattagccaagcatgacagtgtgttcctgtggtcccagctactcaggagactgaggtgggaggatcctgcgagcacaggaggacaaagctgcagtaagctgtgactgcgccactgcactccagcctgggcaacagagaaaaaaccaaaaagactaaaagggagtaaaagcaaacaaactcttacttggtaatcaaccacatgttagctttgggaagctgagagttaatgcagaaggtttttatatgagtccatgtgtatttccccatgggtaatttgatgttaaacactaaatccaagtttctcagaggaacacagtctttaaatggcagcagtatcatcagccttgctgccttctggctttctatcatcttcctttggacatctctccaaaatgggatctggtttttattttagacacaacttagaatgcagtttcctatagtcaggcagggacaatgaggatgtcaatgaaatctgaagtaacaggaaggatgctttgtctacatctagaaagagagtctacacgtgtaggggaagcactggagcacagattgcagatggactgaaagtgggcaacaaataagaagactgataaacattccactggaccacgggtcaaggtccatcttggactttatattgcacccttggggaagcatgggagtacagaaatgggtcagagcagatgcagatctgtgaagacatcttcatttctctgatgtggaacaaggacagatggatgtaaaaaatgtgtcttggcggatctggaaagagcatgctaccctttgggaaaacatctgggctgttacattgttttacagcacagaaggcaagaatttcaagctctctcgccctgcttaagacttctgtcattcttacactactctgtcactgagaaagctaaaaatttattcaaaggtctcttcaatgaaatgcagattaaaggcattttgtgcatataagtctggtctcttaggcagcatttaactttactatgtccagagcatatgtcataactaatttgggtcatgtttgattactcactatgggtcaaagttgaaattctgttgcaaaacaccagagtaaacttaaccatgaatgtttttctaacagtctgtgactaaatgtgtaatatacactaacaacaacaaaaatctgtggccaatcatggactttctaatgcttggaaatggctgaaagtatatagaggatattcaaggccaccaaaatatactgtgctaaaagcacttaattagcaaaggctaactatacatctgcatgtacacatacttgtgtattttatatttctttatatatctgttagaataaatatgcatttaattaatataaccacacatttctttcctatccaaggagtccacttgcatatatacaagggtttgctatattataagaggtcactttcactatgcacttagttacatatgcttattctgtcttagaatgtacaaatttatcattttgacaggtaaaaaaagtgtaagaatccaagcagaaaatatttgaagttacagcatctggattggtaaggaggctaaaagagatagcataggtgacagaatcgaacccatgtctttcattgatggtacaaggtgagtaacctaatgaattagaaagacaagccaataaaaggtcccgagttgacctttatagtccttatatgcacatacatctttaaattctcccattatataaattaatacaatattggcaatattggttgtttcatatcagcacaatttgtagctgaaattgattattaggaagtggtttgtggtatacagtaaaggaggaccagtgagaggaaggagtgcccattcagagagcagggccacagtggaagggaggcagacagagtgatgcagtttgcttctgttagccgaggtacaggggaacctactccttgatgaagatgaaccactctggcgccatgaatacattgaagattactcagtggtcttgacaacggtcattactaatgagagcgaacttcctgaaatcaacagcttgcctaagactagcacagtgtctgatatgcagcaagaactcaatacatgtcatgctctgttattggaagcaaaatgatacctattctagtccattccaattttgaaacttattttagaaacaaaactctttatttttcatttgtaaatacatatatatatatatatatatatttgggccgggcgcggtggctcatccccgtaatcccagcactttcggaggccaatgtgggcggatcacctgaggtcaggagttcgagactagcctgaccaacatggcgaaaccatgtctctattaaaaatacaaaaattagccaggcatggtggtgggcacctgtaatcccaactactggggaggctgaggcaggggaatcgcttgaacatgggaagcggaggttgcagtgagccgagatcacgctactgcattccagcctgggtgacagagcgagactgtctctcaataaaaaaaaaaaaaaaaaaaaaagaaaaacaaaatacacacacacacacacacacacacacacatatatacacacacacatatgcatatatgtgtatatatataaatttataaatttgtaggtatacatatcaagaaacaaggaaataaacatagaagtaaagatcattttctacttacttaagtttactctaatttttttgtctcctttaagccaccactataaatttagagaacgctttattaactgtgaagcctgaaaaaaaattatgtaactaattaatctattatttctgctacaataagtgagcctttgattcttttcccgatatagaaataatgatgtgtgtcagacaatttttaaaaatgagaggtacagagagacggacaaagcaggccttgcctccctacctaggtttgactgttttaaactttaaatgaatactcaaggatttcctccaggatcattaattagctatttccttatgcaaacggagacaactaaagatgttttattttcttcctctatatcttctctcctttatgtttttcattcagccttgccaggaagaataaacatgagctgagtcacctgtactatttcctaatagtgattcatcaccaagaagcagtaacagactctccctcctttcttccctctcaggatgtggtaccaacaaggcaagtctcacagagccatgccacgtgccacatcctaaccttggattccccatatagcacctcccagagagctgaaatagcctggacatctttcaggcctgctctgatggagagagctcagaaacagccttttcacatgtgtcagattttcatctctctgaaacgtattaacagtttacatggcaggccagatgaagcctagaacccagacagtcaacgggcttgggctattgtacaaaccgttatctaataaaaaatgtctattattttaggtcagttgtcatcactatccatttagtttatggtgagtgttcatattaatgttaccaaaatagggtgaacatcctttatgacaccttatcttacgtgtaatcatgacttgacttacatgcaatggcgaactgaaataaaatggtaattgccacaaaatggtgcttggcattctaaaaaaattaaaatttacttcaaaattcctttagaggtaatatatattcatcagaacttatcaattaattgagtaaatacaaaaacactcaaaataataatattcacaagaagtacaactgcgtttaaaatctgaatgcctggcctacatttacatagtctaatagctaactgaagttttacttgtttctatctcttttatgccaaattgtttttattctgactgagatgacataatattttaattttcccagaaaagaaaaaattaatgcagaaaaaatcaacaaaaattcagttagaagaaataagttctagcattcaatagtacagtagaaaaattatacttagcagtaattcgttgtttatttcaaaagcgctagaggaaatgaactataatggtcccaacacaaagagaaatgtttgcagtgataaatatcccagttatcctaattttattgtacattatatacagatatcgaaatatcacatatacctctcaaatatgaactatatcaatttaaaaattcaaatgttcatattgtatcatgtgcaatcaaattttacttaatgcaattcactatcactttgaaacctgctcttgggctaggtttatgcttatttcatctgaatagagaaaccagaagttatcatccttaaataccatcctttgtggatgttcccatcatgaggacaaagtaataaatttcagttctcaaggatgagaagcccaacagattcactccttttctgcacacagaaccatgctggcaacagtcccaatgcctaagcttcagtcacaactttcagaaaggtgctatcaagtggggctgcaaaagaatccctctatcacctttcaaactgacacctgtgttgattgcttgagcccatcacagtttagctctcacagctttaatttactagcccatgagaagtcagcttcaaagaacaccatttcgactctcaaagaacattatcaatgtacatggatagcttccaacttcataaggtgtttctctctacctagagcaattaacattaatttgcagaatagtgtttattgaaaacctttgtgtatctccaacaaagtaatagtgtattgatttcattcctactatcttcaactgtatcattaagaggaatttcttaggaaagtctatatgcagtaagcaagtaagatcgcagaacatcaagggagaagtaaatccaaaactgattttacttcttttcttagtgaggaaagaattatgttttaagcttgcctctattcatataaccttaaaagtaatcattctgctttttgtgggtttattataatttgaacaatgtttataatctctcaattcaaaaaatcataatctgtacatgttgatcaaccaagttataaaaatgagatgaatttttaaactccatgcaaatctttaagagataacatgatctatctgtccataaccaagtttaaaactttgttgataacaaggccaaatgcaaaatggggggagtggaagaaaacaatacaggtaatttagacagaggcaagtcaaatgatcagtaccaacttaaaaaaaaatacatacacacacacacacacacacacacacacacacatatatacactgtttcattgtcaaggctctttcatattaagagtaatcaacatataattaaatttaaaaaaatgtatgtatagatgagtatccagctatataaccctgcagaggagctgaacaaagtcattcaatgaattgcagatgacatagcaatggaaagaatgaattacctttgtagttatcttcccacacccaaccattaaacaaacaggaccctttaaagactttaaggtaaacagtggtttctcaaagtgatgcaatgatcatgctgtgcctgtataaggagcataaaatgttcttcacaacagggttatccagtgtttagaaggaaatctctactggcaaatggatctgtctttttgaggttacagtttataggctggattcaaacgacaaattcctcaggactctttagcctaagtgtaaataaagatgcagaaaggcattcctttaaaaaaaaaaaaaacactccgtagacatggtgatgacagtgaaaggaggcagtcaaatgcctagtcagatggggcaggatccccttttaaactccacctccaaactgaagacagtttaaagcctgaaagccaagctaaaaattaaatccttggaccagactgagaacctgtcttcccatttgttgcactttgttctgattgatccccacccttcatgtattttacttatccctaccctttcctaattggttttctacactgtcctgcccacctttgagtggtgtcttcgctttaatcttttttgaatattcacataccaatcagcacatactcctcattctgagtccataaaaagccccagacccagccacactgagaaaaaaaccacccgactgaaggggtgaggaatcctcccaccccaccgctgcccctgactgtgagctgttccattgttcaataaaattcttctctgcccatcctcacccttcaactgtcagcctaccctcatttttcttggacgcaggataagagctcaggaacccccaaatgtgagtacaaactataacacaggtgggctagggtgcacccagctcagccatgggccaagccggtgtacaagcgagactcagcgggctgactgcctccagcagcaggcccagggctgagcaaggtgggggtgagggggggtggagagtggagggcacatcaccagctggaaccctgcaaattgtcagaaaattcctgcgtcagtgattcagtgatatataaattcaaatttcaagaattcattatttttataaagtctttaggaaaggatccttggattttttttttttttccattcaggagcagtgttggcaccattgtaaagggtaagggtaacggttgagatgtccaaatatacatatatatttatatatatttagtgatctaaatgtttccagtgccaaagttagatgctttgcaaaactataactcctttaaatgccatccatcttgaaaaaatgcatgtcacatcactagaatgttacttatagtcctactagagtttaaaaagatgtttcctaaagacctaccatttaaccacaaactgggaataacctaatatcaattggaaatgctgttaaacggaaacaaatgtaactgatacatttgaagcaagaggagattgaagatgaaggtatatatccaaaatggtgacagtgacagattctgattttcccattttgattaacagaatttcctataggcatcaataagctataaggtggataagatagttctgttgtaaaagtactgaggactcattatctggactctcaattctcattattcagtttacttagtttcataaaactttaagctaaatctatattctataaagtacatatgacaatattaattatattgtcacctttctaagattaaaaaattaagtattttttgaaaacttctcagttcctggcttggtttttccttctcataataatttatttatttatttattttattttattttatttttttgagacaaggtctcattttgtcatgcaggctggtgtgcagtggtgcaatctcagctccctgcaacctcgaactcccaggttcaagtgatcttcccacctcagccttccaagtaggtgggactacagacatgtgctgccacgcctggctaatttttacattttttgtagatacggggtttcaccatgttgcccaggctggtttcaaactcctgagctcaagtgatccacccgcctcggcctcctaaagtgccaggattacaggcctgagccactgtgcctggccaataatatgttttgaggagaaaattttaatgcaatgtaggttatcattaagattcatgtttttggtgttgtagctgaaaaacatttcctaatccaatctgcaaagattttctttttttttttttttgcagaggttttatggtattatgatttacatttagatctgtgagttaatttttgtatttggtgcaaggaatgagtcaaacttagtgttttttgcatatgggcacccactttttccagcaccaattgttgaaaaggcagatgagtagataaataaactgatatatccatgtaatggaataccatttggcaataaataataataaactactgatatgttgaacaacatgagtgaatatagaaataataagcctgagtgtcagcttggcacaagagtatacacattgtaggatcccatttatataaaagtctacaataaaaattaatatatagtgacagggtgatgactgtttgcctgggaagcgtattggtgaggctacagtacagacagccaagatggaggaattacaagtgtggtgaagtttcgcaggtctatgcatatgtcaaaactatcagactgtatgttttagatatgtgcagttgatcacatatcaattgtatctcaataagtatctatacatatatacacacatatgcatatacagatggtctcctacttacaaagttttgatgtagactttttttttttttttttttgagacagagtcttgcactgtcacccaggctggagtgcagtggcgcaatcttggtacactgcaacctctgctcatgggttcaagcaattctcctgcctcagcctcctgagtagttgggactatagacatctgccgccacacctggctaatttttgtatttttagtagagatggggtttcaccatgttggccaggctggtcttgaactcctgaccttgtgttccacccgccttggcctccctctgtcacccaggctggaacgcagtggcacaatctcagctcattgcaacctccaccctccaggttcaagtgattcttgtgcctcagcctccagagtagctgggactacaggcatgtgccatcacactcagttctaagtttttgtatttttagtagagaccaggtttcaccatgtcagacaggccagtcttgaactcctgacctcaagtgaatctgcctgacttggcctcccaaagtgctgggattgcaggcgtgaggcattgcaaccggcctcggcatacaattttcaaactttagacggtgcgaaagcaatacatattgagtagaaactacactttgaattatgaattttgatgtcccaggctagagatatgtggtacgatactctctggtgatgctggacagcagatccaagctgtaactgccagtcagccacatgatctggaggataagcaaccaatacactatatgtactgtgtttcctgattattttttctaactgttagctaatgtaagtattctaagcatgtttaaaattgggtaggctaagctatgatgttcagtgggtttgacatattaaacgcatttttgatttacaatattttaaattatgatgggtttatcaagatgtaacctcatcaaaaatcatgatgcatctgtatacatacacacatactatcaggcgtgtttcaacaatctttttaaaataaaagttgatattcaggccgggcacggtagctcacacatataatctcagcactttgagaagctggaggcgggcggatcacttgaggagtttgagtttgagaccagccaggccaacatggtgaaaccctatctctactaaaaatacaaaaaattagccagatgtggtagtgcgtgcctgtaatcccgctactcaggggctgaggcaggagaattgtttgaacttaggaggcggaagttgtagtgagccaagatcgtgccactgtactccagcctgggcgacagaatgaagactctgtctcaaaaaaattaaaagttgacattcacaatcaagtcatgttacattgatcttgattggacaagaatctccggaaatttttatttatccaaatgcatatgtaggtatggtgggttggtgtgcattcacttattggagggaagagtctaagaaagttttttttaaagggcctaaataatctaagcaaaataaatattaatccatgctagccacattgtaagtgttaaaatggaaagaaatcatgagattctcaaaatgtagccactggttggataaaaatcctcagcaaaatttgtctctagaaatacaaaagctccttcattgaaaaatgccctcaaatgaaagtaattatgaagctactcacaaaattagaagtaaaaactcaatgacggggagagacgaacatgtggccatgtaatctgctccctgctcgtggagtttcaagctaaccgcagtggttttgagtataagaaatcatggtcacaggaacagggaggaagtgtggaaaggggtgggctggaggaccggggagtttacactgccagatatgacaactcttcgcacaatgaagtttgaaatgtaatcaactgctattttaaatttgacctttttttccctagaatagtaatttcctatagactgctttcatgtgagaaccatatttggttgcttaagaaataaactattaattcactacccacagaaaggataacattcatttgttatcaaatactaaatgctgcacattgcattagactcgaatttgaaatgtaattcctatgcatgagtagtgtttcaggaaacatttgcctcccatgttttctccccttgacacttcacgttttagatctttgttgctaccatacagaaataggtgcatttggtttttaaatactggaaataccatacttgacataaaaattatatgaaaaagagcacatctaaaatggacatcaagaggaaggaaaaaagaaaaaatacaacaaaagattcagtttcttccattaattataaatttaaactgctaaagatcctaaaatatttcacctttctggctaattgttctgcatagtttatgagacgcttatcaaaaagaactggggtaagttattcatcaaagttttatcattaatagcattaatagcaaaagcataccttttggaaccatggaatattacagaaatagaaagttgcagttcaaatgctgtttgtatatagagagaaaacaagaagacaaattttatgagatttcaggtacctcaggactggttttgaagtattatagatcaaatatgtgaaggttataaaccagggctcccaggtaagctggtatagaacaaaatcaccagtggaacagaaactgaaaatacttccgctgaaaagatatatactgaatgcaaaatatgtgtgtgtgtgtgtgtgtgtgtgtgtgtgtgtgtgtgtgtatagcaagtttcatttatagaccaatgcattctctttggcaggggtagttttttaagctactgttagaaacatatgaagaggggtgtatgtaggagaactgcttgctctagggttaggtgtatttctacttcaagaagaaagccacccaaagaattgctgtttcgaaatctgtacgaatagctgagcctctcttgttttcttcactcatgttcctaagtaacagacagcagactaggatacttgggagttacatcccttatttggctgtttgaactataagactaacagcatatcaaaagctgatcattaaaccctcctattttgataatatcctcagtatgaaacagcttagtgaaagacagaggttggccctaacagcaatgttcattatagccataacttcacctctgagtagggcaagagttgaaggaacagatctgagtagatcaccagtagctctcactaactgaagcttcttgagggcaggattatccaattcatatttgatcctcagcgcctagcaatgagactgaaatacgttagacactcatgattatttgccaaataagaatggagtcaaattcatatccattgtgaattacccagaaactatacattttaagataaaaagtgattgtaaacatagttccagcccattcctcttaaaaattctagacaaggtatattgatggtcaaatgttgcagttctcaaaaagtctccagcctggacactgccttgggtagatctggtcatcagtcctggttgctgctccaagtaaaaacttcattcttgatttggggttttcttatcacctgaaatacccttttgcaaggtatgtttcttacatctctcctcacataaactccgtaaaaccacccctctcgaatgctaccttctccaacgaatctctcctatttatcttatttgtaagtaatttctccctttcctaaatgacacaatattttatcagtacgttataaacaatgtttcacattgatgcaatgaataactaccagaaatgcaaaaaacacaaacaatgcagatgggttccatgatgaatttggcggtacctgccttttccaggcttcaaggctgctcttatttttcattcactctattgcttctgcctcaaatatcacaacctgcctgtaatcctgttccctcctctcagacaaatgttctttaaggcatagctcaggagtcactttctccaaaataatcttccctgacctcttctccaatttcagatgagtaaggtgttgttaacgtgtcctactcacctgcttccatagtaccatgggcacatgtccttcttcactaaggataccacattgcagtgatctgggaaagcacgtcttctcactgacctgagttctttgaggaatggaatggcacagtcatcatggtatttccagcattttgctaggcctcagtgccacagtggctgctcaatattttatgaataaatgaattcagttatatttgcgtgtaatctcctattctagactgtgtgctctttgagctcagtaaattcagtatttttggtacacagtagatatttttaaatgcctcaatgaatgaatgaatcatacaacctttaggctggaagtaattatagatatttttagtcttatttctctctcttacaaataacatatgatgaccaagctaggttctatacatttattcatggaatcaggatcaaggcataggtcttcagattccaagccacacaatttattcttgtatactgtgacatttttgaattaattaattctatatgaagactaaaatattaaagtcatcactatgaatatatatttagaaatgagaccttattttcacggaaatttaacaaaactggctgtcaaccatttttaatggattctcctagtatgtatcagaggctgacagttacaggcaatccattataatagaaagagaaacatgttatattctaaatactgcaaattaatcattaataataatttaaaaatccaatagattttggtttagtcagcaaaatgttttaaatacaagtgttctatacattgcagagatgctaagttacatttaataccatttatcaaaaccttagggagttattctttgggtctccaaatctcaaagacattaaaccaggaccaagaatttcatgaatactgtggcagattcctccctccctccctctctactaacagtgatttcaaggcaatgtgacagcaacttacacattacctgtcaatagcaatgacttagccatcatctccctggaacctttcattcctattactcctaaatcacctataaagaaattggtaattaagctgctagagacatctgggctaaatggattttgagccaagaagttttgaaaggctgattattaaccttcggtaaaacacaattaagagaacacaccagactcattctcagcttcagtaggagagaaaggtcagggctatatgtgtctggtagatttaattttctatatcactattagacagcctagattatttttaatctggttacaacaacaaattctactgatttttgaatcaaaagtcaaataaaaacctccagtataaacctgagttttctgcaagtattttctttcagaggcataacagtctccattttctacagaattcataaatatgaatattttagaaaatgtctataagtgttggtcttctaagttctcggtgctgcctaaagtaaatatggtaatactcagttgcccacctatgagcttttgtgtgtcattagcacaaatctaatgcttcatatgcagcaatacaaacactaacatcatttcttttatatagaaatatgcttcccaagtttaagttcaaaaacacatctgactttaaacaaaatcatgtttgttgtcaatgttttattctctctcccaaaaaccttccttcctacctccagaggcttcctctcccaaactaacacatctttcttcagcctagggagttcattttaacccacgtaggtgaaactctctttagataccctctaacaaggagggtacaactcctcccaccccaagaaccgctatctcttccagccttaaaacttccagaggaaaaggttatgctagtggttacagaaagcaagaccaatattttgcagaaggaagcccattctatccaatgttacccaaatcatatcaggcaggcaatcatcctccaaactgcttgaaattatgaatgcagaaattaatgttaaaatgaaaatgcctatagtcctctgctacagacaggcagagaggggaagaactttactaacctctacctcagaagaactctttctctttgaggaggaacatcttccataaaaactggagaaaaaattgggccttccaattatcacacatctccgttcccctcaacaattggtgtgtctacagtcccctccatctggtagtgatttattttcaaaggatgaaaattaaaaagaatcacaccttgcaatttggcttatcgattccttttcatttatctaaactgagcagtcatataacatccttaagaaaagagactttaaaacttccactgcttaaaaacatccctaaaagaaaggacttaagaatcacctctatcaaagaaagtttgtttattattttaaggaagatataaattggaaaaaaccatactaattagaaacttgtaaaacttccatttgaattataaattcatgatgaaaactaatacaacacaatatttggatattttgttatacataatgaaagtttcagatttgggaaactgaaaaatacagagcagatatcaacaacatttgggtacataatgcggtgaactgttagaaaaaccacagtttccgtaatgaagttgtagtggaagtacaatcaccatcgcataagtagatatcagccaccatactatgcatcctcttacaacagcaagaatgactgttcctatagcagagatcgagtccattagaatttcaaccactgaaaaatgggttgagaccacataatttgctagtatatgtgacttcattatattaaatagggagatttttatatgtaaattgagattattaacagtaatggtcataataaatacactcctcataatttattgcacttcagtaacatactatttgccacaatacaaatactttcaaaatcctaacaagatgtgctcaaaactaaattgcaaaacaaataagccaccacctactgttaaaggttagtttaagtatttcaaaagcaacaatttaataaagattaaggaatttaataagcttcccttttcctttaacaaaaaagctttcaagagtcaatgagcaacaacaagaaagggaaaacactagcacattaaaatgtggtgtgtaaagtatggtaataaatacacttaagagaggtaggttttaataataacaaatacatttttttttacaccaatgactgcccgttaggcacattcttaagtcaacttgcatggttgtggctatttgtcaaaacttacttcatcatttacagtctcagagttcttttccttttagctcaatgttgtgatggaatcaatacagatctgctcttaaaatatctgtctctgacctgtgtttgttttaagctgtatcattcataatggtgatggattggtaatgctattcctctttgtctgcacaaagcaccatggcataaaaagcacatatattttatgcccaaggtcaggagaaaattaatggataaagagctagataaaatggagttcaagctgaatgggctgagagcgctctacaaggtacagaccaggcaggcagtacaaagtccattatacttaaacactcttgaagcatttcagaagtgaaattgtttccacaggctaacacataaaagcaccaagctctcacatggcttccactgagtgcccacaggtatgggcaaagtactcctgctcacgagcttccacggcatattccatttatcaatttttaccttgagcaataagcccatttggtgtttatcaccagagttgaacaagttatgctttgttgtcattagcaaacttctcttttaacactttcctactaattctatttctattgttcactctcttactgtgccttgtgaatacttaagagtttagggtctcccttaagaggcagggccagctgattccaacaaaaacaaagcttcatagctaacaattacacgctattttccataacatgcactctcagacatctaaatggcagcaaactaagtagaaatttaaaataataacaaaaacaaagaccagtaactgagaattctaaagtttggcatgcagaacaccatcaaaatcatccatgacaatttggctgataatatctatgcataaacataaggaaataagcattttgcctagttaagcagtccaaaaatcaatggttttcttcacaaaccttgctgagaaaagcaatattactattttgttgaatataaaacaactgagcaaagccatattagaatttatcctaaatacctcactttcagatttagaaaaacaatatttaataaatagatagtgtaagtgggttcttccatttgttcattttaaggggaatgcatagtaacagttgtgatttgtccttatagttgagccttcaaccctgtgacactataaataaactgctcctggagctgcggaaattgcccattatctccaagagcatgttctgataagagtccatcaacatgaagccaaaactcattcagagcatcaagagaggaaagtttctagtgatggtttggtcatggtctctttcaggatgattgcatggcagaggaaggaataaaactgtgaaagaattaaagttggtggatgcggaagtaatgtgtacagtgatgatatagatattaaagccaaaatgtggcaactctgtttgacaccgcaaagcaaaatgcattttttcacgtaatttagaaatatattcaggtagcactcaaagagctcatttaatattaaatataataggcaagttctgagtgtcagttaaactggactgaatgtttgagtttgtcataaattaggtgtggctcacccaaaagcataatctttccattttagtttctttatttgtaaaattaagagtcagaatatagcctccaaggactcttctacctaactaaaaagcaaaaccaaacccttccaaatatcttccatgatattctcttaacataaaaagtcccaggtttatgatccaaagatagagatcttggcattttaacatgagtgcagtgacaagactttctgacctgagtccacagggcagttacacacataaaatgacttcagggaaactcttcacttagggaaaaaagcaattatgaggaatttgtaagtattataaaactatttttaaaatagtaatagaaagctgaaatgaagagtaatggtctaaagctaaaaaaaggaagaaattaacattagacaacacaaaaattcttcaaggggaattaggcactagaataactgcttagagaggtacttgagtcaacctcattggaggcattcagaaatagattatatcaaaacctagcaggaagtctagtgttactccttaacttgaaaaaaataaaaaacaacgtagcacatttccactacctaacttaccatattttgcatattattttccatatatttcatattactgtgtatacttggtgctctgattatattggtttgcatgattctattttcacatatatcctaaatatttccaaagtttcaacacactgttattataagcttaacatttcaaaagctggttaaatattcaacgttgttgatatattttaacttcttattctggtaaagtacatttagattataatttattgccatcatagcaactcctatgctacatatttttgttcatgatctgttggtttctatcaaattgaatcctcaatttaaactcctatgactagaaataccaaatcaaatgagtatttcacacctctggctatgtattgctacttctaaagccctaggtatgaatgaatgcatgacaactcagtgctgccattttaacatgtgctgataatacgttccaaaaattctaaaaaatgatgtgcaaattttgttattctcttacataactaaagaaaggtattggtgctactaaagatatacatatttatttccagtatgtatttaatatatttattcctgaaatgaaaagataggcaaagtagttttaaaataatctataatagaacactgctttaacagaatgaagacagacttaaatttcttgagtgttaggaaattggggagaccctggatcatctcaaacaatactgaagatactcttcacaagtcagttcactctgggtcaatggcaatcagccagataaatcttgttaatattaaaactggcttaaagccagacagaattcatttttttctcaattaaaatagatggagccatctttcttgactattaagcatatctctaatgttcacaagcctgcctttgtttcatttcctctccctataacataaaaatgataaaaaatattctctttatccaaaaaagttgcataatttttatcacattagaaaaaaagcatcagtaggagtatttatggaacattactcttaattctgcatttttacctatgcagaacattttgtaaccagtgttcaatattatgattaaaacataaatgaggttaatatttacaatttgtttatatttcaattagaacaattttagaattcatgtgtgcataagcttggcagaaaataatttctctaatgcatattttaacttcatttagggctgactatggtaatactaattattcatccttgtattttcagatagttggaagaaatggcagttccagggactttctggttcctcctcagtacaaaaccatttatatcatattctattattgctccatctcaactcctgtgcaaacctattaatacctacagatactgcacggaacatgctatgccattcacaatttagtctttcagattgaaacatgtcttaattcatctcaagaaaagactagaagaaaatggtagttgcttcttaaaattaccaaaatcatgatcatcactattaacaactgataatacgccataatgaacactctttggcactgtctatcaataaatattattttaatttaaactattcattttggacatcatctactattgtagttattataatattgtcctctgataaaaacatctgaacattttaattcatgatgatgatagttgggaggccctaaaaattggtccaacactttaaaataatgtataataaattaaacaccaaaaggcattaagcaataaaatgtccattaaagcactgtatctcagcagctggaaaacacctaggtggtatatatagcaaaatataagtatcaaatatttggtggtacatatagcaaaataaaggctaaccactaagaagaaaaatatttttcttgcactttccacatactttgttattacttttaaagttcaaggcatagtttcctgtgggttcttttcatttttcttcattcagtaaaataaatatccatcttcagccagacattcattcctccccctgagctattaaaactcaattaattgcttagttaattgccaatcccatttaaacaactcactgctgaactccaaacaaacttataaaatgaagtgatatgctgagattcataagcagtcacaaatgtaaaaataaatttaaaaaggaagaatatgcatgcccaagaagaaatggcttcattaattaaaaaatcaatatcatataaataaagacaaataaaagcaaattaattcaaccttggcaataaaggcacaagataatttggtcatctatttcattaacgcgtttgcaaatagatcacacttcatcagagggtttacagaactgtcctcgtactctacgaatagctgttcaagtagttcaggctgcaaacaagtacaagacttctgaccttctacttaaacagaagtttttaaagttggtgattatatatcatttaccaagagtaagctaaattgttcctgaaattaactcaaatcacttgtgttcatgagaaaaggaaaaaggcgattatatatttatatatttcaagcagggtctgagtgaattgagtatccagtaccaacacactcaagtattctttttagtccctaaccgcttacttcaaattttcatagaaaaagcagcaatttaattctaagagtatatcaaatgcattaaatagccctgtacggagtggccaatgtactaattcatatgtgctggtgaactctttgcctgttgctgtcttaattcttgaaaataaattacaggctagtaagtatccttcgttactgtgacctccctcaccctatggattttaccagacgataatctagaccagtgtctctgcaaaaacgtggctgcagaagagatatattcgtttatttggtaagcaacaatgaagtacttaagtccataaattttccattacaatgtcagaaaaacaagaaggctcactttttgctcaagaataattcagaaaggaaaaaagcaactgctcagtttttcaaaatgagtttaagttgcaaaaacaaatgggaaattgtgcaacaaatgtagtgactctaagtcataaatgcattaacttaaatttattaactacagtacctaccatgtgctaaacactgcacagggtaccaaagatgcaaagactagctagggatgcttcctcagagggctgaactccataatcgactctgctatacaggagatgtactacaaagatttcagcagagaaataacttaggtcagtttacatttacaaatgagatagtcctaacagcctttaaatccccacatgttgtaatggatgatacttagtatgcatgaaagcttgggagcaaataatgtttgcacaaactgtttatctatccttataacaccaaaccttgaagtgttggaagattattgaaggcttttttttccttttaaatattaatgtgcacacttttcaaccaattgttggcatagaatacctgcagcaattcttgattctatcatatttataaaaaataatgtcaatacctataataactataaacacataatactaagttttgttttatggccattttgaacttcctgaaataattctgcatttaaggcagacttccaaatacaatgaaagactcttactgatatttgtggggagaaataatggttcttttatggtcatgatttgcatttttacagattatctattatactttatgtcttttccaatgtttcctaaagcttcacattttggttgtattgtaaaaccaaagtaaacaaaatttctacaggttaaggtcataataattagagttatgtgtagttctctttttgtgtgcatatatacacccacatacatgtatatagatatttaatcttgtctttgatctacagcaaggctaatgcagcaaaaaaaaaaaaaaaaaaatccatatttgcatatccgtgtctctttcctaagtatctctagttgcatgtttcctgaaaagagcaaaattcaacagagccaaagtaaattattccctaccaccaaaccttcacagatatgttccctgcaatcctaatctcagtgtatgccacctataccaaaccaatgccaacccagaaagcatctttggtgactctcttccttagtggcaatattcaactgctattgatgctaccttttgagttactgtgtatctcttcttgccaatcccactgtcagcagagccatctggacctttatcacctgttgtctattttaacttcagtactaaaaccctccaatccattctccttccacaatgcagctagagccaagcttcaaaacagcaaatatattactaaggttttcctgattcaagtctttttgcttcaaagactacccaaactctccagcttccttttttccactctccccaccatgacctgtactccagaatctgagctaaattagagttctgtgaatacacatcacttgagcatatgccattcttgctgcctgaaagaacttgaactcttttattttttatttgtttgtttgtttgtttatttatttatttattttgagatggagtttcgctcttgttgcccaggctggagtacaattggcgtgatcttggctcactgcaacctccgcctcctgggttcaagcaattctcctgcctcagcctcccgagtagctgggattataggcatgtgccaccacacccagaaaaaattgtatttttagtacagacagggtttctccatgttggtcaggctggtctggaactcccgacctcaggtgatccgcctgccttggcctcccaaagtgctgggattatagacgtgagccactgtgcccagcctacctttaactcttgttaaggatctctctcaccaagagatccttcaagacttcaatcaaatcctacctccttttgaaagcctcccctgacttctctaacatactgagcattgcctgtctctattctggaaacgactttaatacatctttgttattctacttatactcaactgcagtagctataaatgatggttccagagcagcagcctctgcatcacctgggaactcattaaaaatgcaaaatctcgggccctactcaagacccgctgaatcagaaactctagggatgtgggactcagaaatttgtagttcaacaagcctttcaggtgattctgatgcgtactgatgtttaaggaccccttttctattgaaatcctgtgtgtccatcagtctctacacataattgagaaggactttgatggttttcatcttcctttcattcttctgaatatgcaatacacatttgttgaatacagagcaaataaactggtaattaaaattagaattttacagttaatttcattgcgctttatacagatacagattcttagcatgctatcggtctgtacataggatacacacttgaaatgtgaagatgatcatgtcaagacgatagcagatatgatgcattgccaatagttttcttatgataatattcaccatgaaaaatgaataagatcatatgaagttattttcatgttagacaatagggaaacttaaaagatgctactaagagtcaagggccatttacaactttttaagtaatcaactaggtatactgttgatcgaacagagcccccaccctccaacccctatatatagtctatttattaaacagagtttaatgtttgcccttcataaaacatttcgtatataactgatattaaaagctgtaatactattatttgattcataatttaattcggtgtttgcaaacacgtgaaacaaaaactcagaaaaattctctaggctgtcaatacaacaaaatgctctacctatatgttaagagagtgcagaggcttggttatcagccagctatgacatagatggggctgagaagtggaaaggcaacaggatccgcccacactagcttcaagtatttagacacatatatctaaatggcaaagtgtttgaaatcaggactgggcttaacatgttgtactttattccccatcctcaagtgtcaattacaggatgtctgcatataatagttatttaacatattgacttaaacagaatttccatgtaattcttctttgcttaccattttgattaaaaagtacaggagttaaacttcaaattacatgaaattagtaatttaagttatttaaaagtcaattcatctcaggcattgtattctgttcctactattgtgtactacttctgtcactgatctcaatttataaatgtattaagctggatttataaatatttcagaggtgctctaggacagagatgatatatttttacctctgtatatgcaacacttacaagtccaaatctgtagtcgattttaaaacttaataataatttgattaataaatcatagcaaagaaacagggagaataaggatattgctatagcatggtatcatctaaaatcagttgatagaaacaacacaacattttctttgtaaatgtgaaagcactgcttaaagttccaaccaactgtccatctaatcttttccatagcttattcttcataatacaaaagcttcttttctcttggatctaatgctaatgctctcctggtatataatcctcagtaagaaataattttaaaagaaaagatataataaaagtactatccatgaagttttaaaactggaactttgctaaatatattatccttattagttttaaataccttgggtcaaaatatgcccaagaaaaactggtgactgttcattcattccacgttcatttgttcacactgacatttattgatcacctgctcatgccaagcattttaataagtcctgggcaataaaagtataaaaaacccacagtgcctgtcataaaagaagtcacattctaggggaacaaaagatacatatatagttgcaaaccaaagtattttaatggaataagagacatttacataaaggtattatcaaatcaaagtagggtattgaccagatctgggaaaggcttcatagagtaaggttgcagtggatgggaaagatttatcaggtgttgtaaacagagaccaggaaattaagctgaaggagtatcatgcagacgtaccttggaaggaatgtagtatgttagatggaaacggaaccaaaagtgttcatgatgggaagaaaagctggtgaggcaagtggaagcctggtgaccaggctaaacagttccctctttttgccacaggcaaaagtgaatcatcagaggtgtgaaacaggatagtggcatgatcagatttcactcctgggtggtagctatgaacattcatcagggtttgcagggattacaagtttccagtcattccacaaattattgaccaaaaaaattatattaaagggaaaatatatttctattaataacaaatgtgtcatgataatgtcaggtattaagacagaatatacgaaacaaatgtttatggaaagtgttatcagtagcagtagacatgtgaaaaaagactagtttgcctttggaaagataaaggaacaaggtaatatgcaaagaaagcaataagcattagagggagataactgacaaaccaagacagatccgaaatgatacatgactctaaaacattgaagcagtaataagaaaatagtttagaacaaacagcctaatcacctgaagtaatagacctaaaaagtggagtgacgatagcaattaagtttctcttgtagaatatagacccaaggtatgagaattttctttctttggttttaaatatatgctatatatgctgccgtctgcagaccctgatggactttttatttttgaaagtgaatacagcacctgaatgtaaagataccaaagtacgtgatagtctgaactatcagggaagtctttgacaggttaattaaaaagacttaaacttgaggtgttgtattccttatgacaccatttttagcactaagtagtgagtgatgagtgagaaaattgtgtaattattggaatagctaattggtggtaggaccatttgtaagtacaacaaaataggtattatggtcagccagacaaaagcagctatttgtatgtactcacgcacacatacacacacacacgcttatataaacagcaaatagcaaatgtggatacaatttttcgcaatgatagaaatactgttttgcagtgatcctgtggaagtaggaagccaaacagtagatcacatatcactgacatcctatttcccaataggtttgctgaaaaatgaaaagcagatttgttgttggtaattgcaaatgccctaattttcaataatgtaaaaattagaacttgtatatattcatatttatcgtgacaaacacactctgcagaaaagaatgttgtttagttcaattaattggtttggtactgggaatggccctaagaataaactccagggtgagttctacctggaagctggaacagagagtcaagttaaagtaactgtaagtaagatgctgtagatgccttaggaatatattataaaaaaaaaatcaaaccaaaaattaaagagttaatatttccagtcattaaaatggaaaaagagactcagtaattctaaagaaagcagaaattagcaataggtaaaaatagaaattggtgaaatacaaaaacaaagaaaagggaggactgacagaactaaattctcattgtttgaacacagtaattaaaatcctaaacttccagtgagtctgatcacaaaaaagagggaaaagggacacataaacatcataaagaaagaaaagggtggccggggccgggcgcagtggctcacgcctgtaatcccagcactttgggaggccgaggtgggcggatcacgaggtcaggatattgagaccattctggctaacacagtgaaaccccatctctactaaaaatacaaaaaattagctgggcatggtggcagatgcctgtagtcccagctacttgggaggctgaggcaggagaatggcgtgaacccagaggcaaagcttgcagtgagccgagatcccgctactgcactctagcccggacgacagagcgagactccatctctaaataaataaataaaagaaagggaagggaagggaaggggaggggaggagaggtgaggggagggaagggcccggtggctcacgcctgtaatcccagcatttggggaggtggaggcgagttcctgtcactgcactccagcctggatgacagagcatgactcaatctccaaaaaaaaaaaaaaaaaaaaaaaaaaaaagagggaaaaaaaggaggacagagctatagataatttacaaatttttaaatactaaaagaataaaagtttatgtctataaatttcaaaaatgagagggcactgataactttctagaaaatataaactattggaagtgacaaagatttgaaaatggtaatgacaaatcagaaaaaagctcggacataagtagggaaatctgctatgagacagaggcagtatttcacatcaggagagaaaggttgggactagccaataaacagtgttgggacaactatgcatccatgtagaataacaagattagatcgccactttacaacaaacagaaaaatccatttcagatgagttaaagacgtaaatgtgaaaaagtaaatctgttagatatatttattaccttgagtcagaatattttttgaacatgacacaaaaaagcaataatcataaaggaaatctaatactgtatatttgactacactaaaattaggcttttgttcagtcaaaaaacaaacatcataatgaggtagataggctagtcccagactgtgaaactatttttttcaatgcatttaactgacaaggaattagtaaacaaatgtgcataccttattgagaacaatgatataatagggaaaaaaggaaattaactggcaatttatagaagatgaaacatatggagaataaggataagaaagatgttcagccctactaggcaccagtggggggaaaaacaaatttaacaataagatactattttataacccttcagattgtccaaatgtaagcctctgaaaatacaaatattggcaaggatatgtagaagaggtaaatcttagttatgctggtagaaatataaactgggacaatcactggagacaaatggtgatatgtggcaaagttggtgggctttgttttgttttttgctatttaattcagcaattggatgttaaggcaaatttctggagaatttctatcttaggtaaataaagaggtatgtatgagttggagcactgcttgaaattggaaataattaaaaaccactcagaagctcattaacttaaaaatggattaataaattgggggttattgattcaatggaatatttaagacagtggtccccaaccgttttggccaagatgaaactgttccacctcagatcataaggcattagattctcataaagagtgcaccacctagatccctcacatacacagtttacgataggttttgcactcctatgagaatctaacgcctccactgatctgacaggaggcagagctcaggccataatgatctcttgtccgctgctcacctcctgctgtgcagcccagttcttaacaggccagagaccagtaatgatctgtggcccagggttggggacccctgatttagacaacatgtttcaacacggattatttgtttttagagacagcatgttagcatgttgccatgttgccaggctggacttgaactcctgggctcaagaaactctcctgcttcagcctcctgagtagctaggacaacaggcacaagccaccacgcatggctggataatttatttaaaaaaaaagaaacataatcttgaacaaaagaaaaaatcatgttgaagaatgataccagttatgtagattatgataccaatttatgtaaagtttgaaaacatgaaaacctatgccataaactatttaacatatatgcacatgtaggtgtaaaacctttcatggagataatatatacctaaattacgttgcttttgtcatctgttatgggaggtgggaggatggaaatggggaagaagatagagtagacttcaactgcaatgtttcatgtccttattctgaagtatgcatgacagaagagtagaatttaacagatgtttgttcattgttgtttttctgtactttcttcatttcatatctaaaaagcaaagttcagctgggtgcagtggctcatgcctgtaatctcagcattttgggaagccaaggcgggcagatcacttgagcttaggcgtttgagatcagcctgggcaacatcacaaaaccccatctctacaaaaaatatacaaattagccatcggtgtggtggtgtgtacttgtagtctctgctacttgggaagctgacacaggaggatcacctgagcctggtagttcgaggctgtagtgagccatgattgtgccactgcattccagcctgcacaacagagtgagatcctgtctcaaaatttttaaaaaattttaaaaagtaaaataaaaataaataagaagcaaagtttactagtacctccatagcaaatatattttccatacccaatcataaaaagcatttaaccatttctgcagtcatcaatgagaaaagaaatccctatctataaatacgatgtcttttctggtcacatcttgcaaccaaaccccagaccattaggttgggtagaaaaatgcacagatgctagcctcccttagattgccaatatgtgtgtgtagtacatattggtattggtactaactgattagttactgaaaaaaaaaaaaatttacattcttctctattatgtttttacttattatgccattccctcaaaatgtggcattctggtattcagcaaaaatactattggttttgattaatgccaagaggaaatctatcattcatgcactcatgctttcatacacatttaattatgtattatttttccaatgttctagagactctggttaagaaatctaccccagcatttcctaataagttgggtgtaaatataacaaacagcagaaaataatccagtactgtattagtccattctcatgctgcaaatggagacatacctgagaatgggtaatttataaaggaaagaggtttaactgactaacagttcagaatggctggggaggccccaggaaacttacaatcacgttggaagcggaagcaaacatgtccttcttcgcatggcagtgtcgaggagaagaatgagcaaagggcgggaaaagtcccttataaaaccatcagatctcatgagacctcattcactatcatgagaacagcacggaggtaatctcctctatgattcaattatctcccactggttccctctcataacacgtggggattaggggaactacaattcaagatgagatttggaaggggacacagccaaaccactgttaaagtactttaaagtactttaaggctcaaatgaatacaatgcttgccacgtgaaattttcaacgtagatcttcaaatatgaaatatgaaattcagttagtcaactctactaaattttttttaactgcagagttacaaagggagaaaaaggggaagagtagacagatgcttgaagatagatggaaacaaatttattatatatttaactttataaaaagaacaggaaattgtgaggctctgcagtctcctgggtcagtttcctgatgccctggttctgtcaaggtttaatcactaaactacaccaactatagtcactactttgtttttaagccactttgagattttcgctatggactggaaagtctgggatatgaatgcctaagcatgaagaaaggctggacaccataaaaatgtgtaagaattggtgggatttaatttcatttgggtcacattaatggccatgaacatgacaactctgtaccataccaaccaccatacattgcaaagtagtcctaactctatatgtaggtaagtcagatttcttagtatcctttacttgctcagatgaaatgtatttatttatatattctggtaaaactatatgaatgtctgccatgtgtgaaagttatttttctgagtgaaatttacaattgcattgaaaaaatgcttgcattttgccaggcacttctgatttctctgcctgtactatttcattacaccttttaaaagctctatgaggtagactatgttcttatgttagagatcaaaacattgttatggagtcagtcatctcataaatccacttgtcctctctctgccatgattgtgccatcagtcaaagattaaaattttattataaccaattaaactcataaacaatttgtggatttaacaataggcattacttttaaaaaataatttataggccaggagcagtggctcacacctgtaatcccaggactttgggtaactgaggtgggcagataacaaggtcaggagatagagaccagcctggccaacatggtgaaaccccatctctattaaaaatacaaaaattagctaggcgtggcggcgtgtgcctgtaatcccagctacttcggaggttgaggcaggagaattgctagaacccgggaggtggaagttgcggtgagctgagattgcaccaatgcactccagcctggtgacagagctagattctgtctcaaaaaataataataatttataatatcttgtgtattataaatagactctataaccagcattgattcttctgtattaagtcttcaccagctcatatttcttcccttcttcaccatagcagtgtcagcctctaccactcattccacattggaatctttcattgttctttgtgttgtccttatttcatccacttctgctaggctgggatcaaaggcaattatcaaaaaaagggaacctaacaggctgacttggttaaatcattccattttaaatattcaaaagttgaggcccccacaacacagtatgacttttcatatgggtaaatcaagatgagaatccatacctctagctctgcctcactacaacaagctgcctaccctcctacccccagtcactgtctatgcctttggttttctattgctacccacacatttgccaacggcattgctagaccaagtatgttcttaaatattttatattaatactagattttaaaatataaagtggtaaataataaagtcagcgaggttatcttgctctaactcctcacttaataaagaaactgaagccggctgggcgccgtggctcaggcctgtaatcccagcactttgggagactgaggtgggcggaccatgaggtcggaagattgagaccatcctgactaacacggtgaaacccagtctctactaaaaatacaaaaaattatgcgggcatggtggtggcgggtgcctgtagtcccagctactcgggaggctgaggcaggagaatggtgtgagtccaggaggcagagcttgcagtgagccgagatcacaccactgcactccagcctgggcgacagagcgagactccatctaaaaaaacaaacaaacgaacacaaaaagaacggaagcctagaaatattaagagaccagggttacactttttatttttatttattcaactacttacaaataataaaaatctgcagaggcactagtgacatgttatgacaactggtttgatcattatttagattttggatttatttagattttatattttaataattttgttcacctctgtaacagtacaaaaatcagcagcttttacagtaatgcaaggtttcttctaatttcactgaccttttcctaatacttcaaaagaaaagaataaatacatattggcttctgccaccgttgtagttaaacaaacttgtagaattcgaaaatatttaatcaaaatgttttgagtaaaatgagtaaaatataaccttctatataatattccttaaagtttcctaatcacataaaatggaaagctgaatttggaaaaaaatcaaattaagttcaacagactaaaagttctcttatatcccaaaaggaaaataaagatatgcttaggtatgaaatatctgacctcaacggccttggaaagctgtacatggtccttacagccaagtaacaaagaaatttgaaacatgtgttacaagaaaggaaagaggaaaacacttagtaggaaaggacaaaacttaaagatccataaatataaatcccgactgtggcaaataattttctgaatgtctgtttccactgaccagatgaaaatcgtaaatcctcaaagatgccaacaagtacttgaaataatcaagtcacgagaattaaggagtaaataatagctctgtgcatctcaggctaagaagccaagagccttcaacaatctaccagccaatgggcaattctcctcagaacacatgcagctcccccgtgacaattttaggtaaacctgatctttgcctatatggtgtaattggttttaatttaaggattttgttttactctgtgacttctacccatgagagcgaaagccagcaaagctaggctaatctgcattctgaaatttcattctgtgtttttattttcctttggagggttcttgttacagaagagcttcattaacttaattaggcatgatccagtgggcccatacaaattaggctagccacagtatctttagaatggacaaaaataagaagccagctgtagtctttatattttgaagaaaatcttaccagctgacatttctttgtgtcacagtcatattaagcttatgacaactgcaataaccaaaatgtgttttggaagttcaagtctccaacactatgaaatataaaagacacaacagtggatagggaatgaactgttttttttaaaccacaattctttttgtaggcatctagctctttgctttattatagaaagaataatcctttggtaaaagtgtgcttataaatcaatttataactactagcaatgtgataactgtatcagaaaacatttaggagaaaagatattttcattttcttcctagaactcacaggcatgtgtacacctgtgcatacacgtaccaagataatataatacaagataatacatgtatcagataatgcaaagaaaaccagacactacttgacctgcaatcttaggaagttattgattttgcctcaatttcttcatcaaccagcagaaataagaataaccctcattcttcttcagagaaatctttaggcaacttccctgtttcaaaaggataatctggataattgttaaaatagagattcttggaccatatttcagacatcctgaatcaggctttccaccgaagagccaaggaatttgtatttaataaaagttattcttagtgggtcactataaactaaaatataaataatgtgaaatccctatagattcttactgggttattataaactaaaaataaataggaaagctctatagaaaattttgagtgatatataagtatataccatcaacattattcagaatttctagcgcaaaggaaaatgttgcaaagaaagtattcttacaggaatttattctggctaacctttacactatgaagagttgctgtgctgatcaaatcaatcaacccaccaaccaaacaagcatcttcaggaagctcaacatatacccttctgcttctcagataagtacaaattttaaccgataaacactaaaagtcacatctcatacaataacatttaatgtagcaaaatactctagatatggttctcgtaagtcctggaattctggaactaaatcataaacaattaagcataatcacagcgactttctgacttgtcgcttgattctttataaatgtattctcaagaaatacaataagaaaacatggaagaaaaaatatgaaaaccttccaacctaattctaattatctgaattaaccatgttgaaaacaagatactacttggagtaggaattcactgtcaccataagctatttgtgacttaaaaactagaacatggagttcagaacacaatccaatttctgtagatgacagtgagttcccagcaggggttgttcctctccagaaacctgtcttggatagtatcctggtacttggttgcgttggcacgtctgccacctcagaaatcaacaaagtcatgcttccgtttgaatgagaaacttgacacattcctctgattcctgaactgtgcctacacaacctgttataatgttttgtagattgcagtgaatactgctgaagtctcacagtggctacgttcaatttcaaacgtatatttgcaaatttggaaaatgtaaattaggaaattttctggaagaaaattatgctggaaataacagaaattgcttgcgttcacttggtcaactaataatgactgaacctcggtaacaaagatttctggggttatgaacgtcggtttttgcaatgttcacgaggttccaaggattatgacctaggccatacttaagggtacatagatattatatctatacaatctgtatagatatagtacagtcataatatgagctggaattgattttattaaagctgataatagaaaccagatggtccaagtatctgaatcaaatatagacttccttaagctagggttgaaaatagctcaagaaaaaatgaatgaagttctaaatatgacataagagctctgcggaggtaatataagtgtggatatccaagaataataatgacttgttctgaactaagttaattacgtcttccaaggtattttatttggagaacgctgcatggttgtgtgctatatcctaaaattcaagtgtgcagaagacttatcagagggtgggtagaaagttgcaaccaatcaagttttacatgccttagtctctttcacttatgggtgataggattatcaagtttcctgtccttctcttcctagagattatatttttacatttgaagcctgtagctactttcccatcttgcaacccaaaaaccaaaaagacactgtgttcactaactggcactaggtatgaacagaatggatgttttcaaacaaatgaatgactcaaaggaattcttaaaatgtttctttggtgtgaagagcaggggtcacaaaggcatatggatagtaaatatagaaatactagggatttgcatgcaagtttaaccagctacaaaccaaacagaatagttctgtctaaaattaaggtaggtaattagtttcctactgctgttataattagctgtcacaaactcgatggcttaaaacaaaaacatttattatttttcagttctggaggtcagaagtcccatatgagtttcactgggttagactgaggtgtcagcaggactgatgttagcagtcctttatggaggctataggggagaatcttccttcttgcattttccagtttctagaggctgcccacattccttggcttgtgatcctttttcatcttcagagccagcaaaggccagctgagtctttctcattttgcataattctgacactgactcctctgcctccaatttaaagacccttattattacattaggctcacctggataacccagaataatctccctcacttaaggacaaatgaatagtaacatcaactgcatctgcaaccttaatttccctttgccttgtagggtaacatagtcatcacaaggttccaaagaataggaactagtcgtgatttggagtgggatggtcagggccattatttggtctacccacaaccaagaataatgaaaatcatattttgctcctgcctgtgaatggtgaaaacttcaaaggaagacacatctgacactcttctgttgggagagtttattcaacttcattttgacttcactgacttctatacactgatccaaggtgtttttttattggcaggttggatttaattttcaaaagataaactgcttgattgcaatcaaaatcaaacagaataatttatgaaaaatggaagcaagaggagaaagaatgtaggaggaggtggacattttccaagtgatttaattgaatattatcttaagaatttctgaagctcaaattcagaaggacacgtctagttggctaaattaccaagtctgagagtaatgaaagagttgccattccatgagcctagagagcaaaccaaactagaaatagcaatctcacttatatatcacagaatttcagtttaagcataggatacaagactaaatcaagctttaaatgtgaactctgtattcactatgtaaaccttctaacggaatagccttcagtgtaaagagctagttggccataaataagtttaattcccttcctttaaatttagatttgactcaagctgcatgaatttctggacagagaaaaaataaatttggggcagctagctgttggttttacagaattaattccagtccagccttgtaatcgcatatatttattaaaataactttgaaataaaatgtacggggtcaaaaagtatcaaaatatggtgactttaacatggaaatttaaattttaaaagaactatgtggaaaaattaaaaataagacatattgacaatacacttaatcagacagatttgtcttgatactaaaccctttcagctaaactcaatgccctccttctagctcttcttaaagtttcactcttcaaacaactactcagactcaaagtacacccccaaattcaacccactcacacaaacctgacttgatcatgtaaaatatcctttccgctttagctgactaaactttaaaaccaatctaagcacctggtgtgtcagtgataatgaacaatagtgcatatggcctatagggagttagagttgactcctaagtgagtaactgcttgccactgacatacaaggacttgaatagctctgggaacgtgcacagctctttacttgcagagtagaaattccaaggattctacatctttcattttgattacagtcgacaccaaaggcattcacacttgagatactgactgtcctgattctacagttctttaaagtgtctcaccaaaataataagcaggcttcctgatgtcttttctttattcacatgacaaaggttgaatatcgtggttactgagtggcagatattgagataattggtgtctcgaagcacataagggttgctgtgcttgaagattttcactaaattagtgcttaaaagataacaaataattgtaatataacatgctgcgtgttaatgcagctattacataatatagactcaacgagaagataactaactttactgaacgaagtcaaagacaggtggtagcacctaagttgaatcgtgaaggataggtagaggtttgacagaaagaatcaagaaggacaatataaacaaatatgaaagcaatttccaacagacataaataagggcagtacatttgggaagctcaggatgtttttatgtggctggtatgaaaggaagaaataggggaacagcaaaagacaaggctggaaaggatggctgaggagaaactaggaagagcttacttactgtcactgatgaggacttctttggaaagtcatattctcagaagtgttaggaaatcataaaagaaacaaaattttcaactgaaagcatttgattgaaaaaagaccttgcttgagggcgtttatctttatctttgtgaggtcaaattttgctaaggatggttaagatggtaaagtcagcacctgatacagaagatgcttgactacaaattcataatatatctatggtctccctggaccattcagttttaatgcctacagaaccagtgtggaacaaaaggtacgtagacctggtgaaaggtcacacttgtttattgtaagcttgcctttgttgttgctatttctaatttcaagtaagaaacaagtttccagacctcaaataaggagatataactggtagatataactagtagatcttctcaaaatgacattaacttctttttgtaaactcctacttcctcatagtatagctggagaaacatcttaccaatgtggagtagacagtgatatcttaatagcagaaatgtctcacaatttgattctttattggtgtgaaacactgtatcataaaaggtttcgaggccatatccttaagaggagtggtagattttcaatgaaagagctgtttagtattttggaaaatgcaacttctaaaaccagcaaacaagtatcacaaatggtgatgatgatcatagcacccttggcaaatggcctccagagaaccatcatagctggtgaaatggatacaacatgattaaagagaacttccatcttttctttctgagcatttcattataccactgattctcaaagagctggccctgggaacctagtgaggtctttcccagtaggatacatatatatgcatatctcatatattcacatatagtagttatgcatatactactgatatgagtgatagggacttctctagatcccaagttaacttcctaatagtagaaaaggcactacattgatgtaatatataatgcccagtaatttccactaattctagtgtttgctttttttgctggattggtttgacatgtgaaatcacacagaataaatctaatctccaatctccactttacaatccccactccatgacactcaattactttaaatgttttatcctctactccaaagtctgctgttttttaaagacaaaaatcaaaccaaataaacataaatcctaattatctcacttttctataatagaaaacttacaaagaaatttcaaacaaatggaaaagtttactttatcaaagatctcctaagaatctgtaatcattctctaatattaaaatgtttggcacaaacatcagaactcaaatatataatataaatcctggcaaacaactccacaatatattgaaaaatccacctaatcatttgatacggtttggctgtgtccccatccaaatctcatcttgaattgtaatccccacatgtcgagggagggacctggtgggaggtgattggatcatgggggcagtttcccccatgctattctcatgatagtgagtcctcacaagatcatggttttatatgtgtttgactgttcctccttccgacgctctcgctctgtcttgcctgcggccatgtaaaacgtgcctgcttccctttctgccatgattctaagtttcctgggacctccccagccatgaagaactgtgagttgattaagcctcttttcttataaattacccagtcttgagtatttctttatagcagtatgagaatgaaatcatatatgtttaaccccttttttttttttttttttttgggacagagtctcactctgtcacccaggctggagtgcagtggcgcaaacttggctcactgtaagctccgcctcccaggttcactccattctcctgcctcagactcctgagtagctggaactacaggcccccaccatcatgcccagctaatttttttgtatttttagtagagacgtggtttctccgtgttagccaaaatggtctagatctcctgacctcatgatctgcccgcctcggcctcccaaagtgctgggattacaggtgtgagccaccacacccagcccctaaacctgttttttttttttttttatggcaaattaaataaaaaactttaagtcaaaatgtgtgaaaagattgcagacaaccaaactatggcagaagagtttgatcacatgataagcttactctgaaaaatagttttttaaaaaacaagaaggatcagccaggtgttgacatacaaaaccatatagccaatcaaagcttatttgaaccatatacctatgttgagagagacagtttagaatttaaatgccatacaggggcattcagtgcttagagggaaaaaaattagtactgcttttatctggatataagccatgagtggagaaaaacaatgtacacacatgtagactttatatatgtatgtatagtcacataatctttcatatatatgtaatataacaaaccaatgtctgggaaagttaatggcaacagtttaagagcatcaagataaactctttgtgcttagaaagtttagttttgtcttaatgctattcatgaagtgcatcgaaaagttagtttaattcaataaacactcttctttagaattatttactaagtttactgtattggaggtcataataatgaatcagaaggtgctcttgttttcactgagcttatagcctaattaataagaaaaagtaatgatgcgtaatccatgtgtgttgacttttaaaaattcctgctctatgtgtctctctttaaaggtgtaagttagtatgtcttcagtaggctagacacttatcttagttacccacaacagatgcaattctatgttgtgcctatgccattgtatatcgctacaaatcataggttaagttcctggaaggaaataacaggctgatcaaggattttcttaaaagcttcaatatgtcttaaaggcacaggtatcagagattctaaacatatttatctttttcacaaaagtaatatatcctatttgataaaactatagaattcatagtaatgcagggtaatgtgaggttcaccaatcattgtaagatataaaatacaagaaaaaataatatagtattttgcatatcatgaattatcttaatatgaaaataatactccatcacataaaatatatggattttatggattatatggattatatggatatatggattatatggataaatatacgcatttataatacagtctcaaaaataaattagcaagtggacaaatacaataattacttttaaagcactctggggaagatctgaaaaaaataaaaaagatgcttaatatactacattatttaaacaaatgtaaattacattgagttcatggttctatttatgaacttagaataagcatcgttaacacataaagaaaaaaacagacgacaagaggcctgcagaggagcagaaacaatgcggaaagtgagaaagaaaagtccagttattttgaaaaacaagactggtttcaatattatcatttggccatcttaaggaactgcaggttaatcaatacattataattgattaaaaggaagtatttacaatatatacaatagtactaatatatttagacacataaactacatttaataaaatctgtgttaagagtcctaaacaatgctataatatttaatccttatctaagctaggcaacacaaagcaacaatattgttgataaacagctttgctacataaggtattgggaaactaagtaaacttgtgatagctttggtttttaaggtgctatggttggactccatttgacacatttaataaatggtgcatacaatttttagctaaatatctaacaggatgtcatcctaaaacctcatgttcctatattactgtgctgttaacagaaacagcttgcagagatttatggcttctattaattacactaaaaaatatggtagatttgctcaaataaatcaattgtaacagaaaaaaagcgcatttttaaaattacaatcatgcgttacaaatgactgccattatcaattctgccttttcatttattcccaaagtgaagggttaaagggggaatctttctgttttcctagatttaaccctggaagagcagtctttgagttagtactttaaatagcttacagggattctagttaatagcctcaaaaattggaaagaaatgagacaaaatatcaagacaagaataagattgaaatatataaatttctgcctatccctgtttttataaagtaagtttcctccccttaccaattatgtttcagttctatatttccattcagtgctactttggctttttttaaaattattcatatacctgttaatacaccctccttgttccacaaagaatttaccaatctttgcatttatacaaacaataaaagcaaaaatatcaaaataaaacaaaaaaaaggagaaaatatttttacaacagtgaaaataaaaggaagaaggaaagatcaaataaaaaacagaatgcattcaagtttacatttagaactacatttcagatttctgaacactttttgttgggctctaaatcaatatcaatttcatgctcactgatgttcccaaggagttgtgtttctttattcaatatggccctgaacactgtgagccctagatgtaacttatattctcaaatacttatgtggcttggcattcatacagaatctgtctgaattggtaaaaatactcagatttgttttttcactcttcattaacctcctatgacaagtataatccactatcccaaatatttattattatttaaaagaaaaatgtactcatttttcttggaccaacttgtttaaagacacaaaggactcatcatcctgaagaaaattacaaatgtattaataactttttatgccatctataaacatctctcattttggtactaaagaagataggggtctttttatccccttactagttagagaagagccaaacatataaatatgcatggagaaaagcctgagagaacatctaccaacatgtttacagtatttatctgagtcactggatcatgattagactttcatacattctccaaattttctacaatgagattattgttcaaaaatagccagtgcactctgggaggccgaggagggcagatcacctgaggtcaggagtttgagaccagcctggccaacatggtgaaaccctgtctctattaaaaatatgaaaattagcccagtatggtggcatgctcctttggtcccaggtatcccagttactcgggaggctgaggcaggagaattgcttaaacccaggaggcagaggctgcagtgagccgagatcatgccactgcactccagcctaggcaacagaacaagactgtctcaaaaaaataaaataaataaataaataaataaacaaataaacccagcatctgaaaagtatcaaagtactgaaacaataaaggacatataatcagtcaatatgaaagcataatatttttgacccttagaaaacaggctaggaaaatggtctttctatcagatcatgccttttaacacaagcaattatttccaaaaaccaatcaaatgtacaatgctgcttatacttcatagcactaaaaagtatccttcatcatgaatgggagaggatctttcattggaagagccatttgtaaaggaaaccactgtctgaccttctcagagaaatgctgtcttccaacgagttaaaatgcttgggttatcaatctatgagccaagttggaatcattaatcccaagtctagacatttcaagacgtagaagcaaaatagcaaaagatacagagtgtatagagttctgctcctttgctggaaaaggagacaaaggttgaactttaactgaaaaatgatacggtttgtctgtgtccccatccaaatctcaccttgaattgtagctcccataattataacgtgtcctgggaaggacccggtgggagataactgaatcaagtgggcaggtctttcccaagctgttctcatgagacttaatacgtctcatgagatgtgatggttttatgaaggggagttctcctgcatacattctcttgcattccaccatgtaaaacatgactttacttctcatttgccttctaccatgattgtgagacctacccaaccatgtggaactgtgagtcagttaaacctctttcctttataaattactcagtctcaggtatgtctttattagcagcgtgggaacagactaaaacaaaaagtaaaaactgtctatggccatatctgtctatatcaccctgaatgcaccccatctcttctgaaaagtaaaaacaaaacaaaagtcattgaagcatcagttacctatggaacatcttgtgtttgcaaaactgatgcaaacaataactctggagtaatgaatttttttgatacttttttttcttaattcaaaagtagaaagttacaaaacacaaaattcacagaaaacaaaagggggaacgcaagatggatgagggctctactgatggccctttcccccacccgcccaccctttttttttttttttttttttttttttgaaacggagtttcactcttgttgcccaggctggagtgcaacggcgcgatcactgcaacctccgcctcctgggttgaagcgattctcctgcttcagcctccttgagtagctgggattacaggcgtgcgccaccacgcctggataattttgtacttttagtagagacggggcttctccatgttggtcaggctggtctcaaattccctacctcagatgatccaccagcctcggccccccaaattgctggaatttacaggcatgagccacggcgcctggccggcccctcccctttggtagaaaccaaaaatcaagtgagcactcgcagtgcctaattttgatttcatattgttgaaagaggcactgaagaaggtagaaaagacagtggtgaattgcccacgctgcccctcccccatcccctggctgcagcctggtagtgtaaggaatctatgtgcttgggatgggtggagcacagtgaatgggaggctttcatccaactcagtgctgccctctcacagtggaaagcagaaccaggctgtattcagccgacacctgcccatggagggggcatttggactggcctagccagacggaggggattgcccatcccagcagtcagagcttgagttcccacaagcctcaccatcacaggctgaagcactctgaggccgtatgtgaactccaggggcagtctaggccacaaatactgaaattcctaggcaagtcctagtgctgcactgggctcacggccagtggactggaggggcatgtaacctactaacactccagcctgggtagttaagggagtgcttggatcacccctccatcaacaccaggcagcaaagctcacagctctaaaagacaccctttccttctgcttgagaatagaagaggaaagagtaaagaggactctgtcttgcatcttggatgcccacacagccacagtaggatggggcactggtcaggtcatgaggtccccattataggccccaggtccctgatatttctagacacatctttggccagaagggaacctgctgccttgtagcaaaggacccagtccaggcagaatccagaccctactgactaaagagcccttagtccctaaagaaccagcagtaatacccaggtaatataccacaggccttgggtaagtctcaaacacatgctggtttcaggtgagaaccatcatattaccaactgtggtggctatggggagaaactgcttctgcttgagaaaagcagagggaaaaataaaaaagaaactttgtcttgcacctgaggtaccagctcagccatagtggggtaaagcaccaggcaggctctccgggtccccagcatcctggatggcatttctagacctgccctgggccaaagagctgatcgccttgaagggtgagtcccagtcctggcagccacaagctgactgaagagcttttaggccttaagtgaacactggcaggagcttggcagtactccctatgggcccgtggtggtggccatggtgtgatgttcctctatctgtggaaaggggaccgaagagtgagaagcactatgtcatatggctttattgccagcccagccacagcagactagaacaccaagtagacttctaaagtttttgactccagtccctggctcccagatggcatctctgaatctgccacaagcctggcagaactcaccacccttaaaagaaggcctggatggctttgccacctgcagactgtagagccctatggccttgagcaaacatagatagtagccaggtaatggttacagcaggccttgggcaagactcagtgctattcttgcttcagctatgacacagcatagtcccagtggtgatggccacagggttttttctatgacctcacccttggctccaggcagctcagcacacagagacagactccatttgtttgggagaaagtaaggcaagagaacaacagtttctgcctggtaatgcacagaacttttctggagcctatccaagaccaaaatggcaaaacatctacaagtctccaagaaccactgtgctattggggttgggatgctactgatggcagtattgtttttcctactgattgacagtgttgtcacagagtaaattcttaaacgaatagcatagaattcaaatgatcaaaagcacatattatcagggttggaaaaggaaaattagaaaaccatacatttattaatttagtcagttaagaaatatgtatcaagcacctagtcattgtgccagattggggaatctaggtacaaaaggtacacaaccagcctggaatggacctccagtatggagatgaaaataattataggtagtgacaatggtgacccaatgtagtgcactgcaaggacagaaaagggtagaagatatcagatctccatctctacactcagtcacttacacttagcaatgtgctaccaaacagaagatgaaaaggagggaaaaatggaacatgacaggaactccctctgcatatatttacaggcacaatgtccaataaactggtgaaagaaaagtgtttctataaacgaccttagcattctatctttcacctgagccaatagttctaaatagaaaactgtgaacatgttttcacaattaaggtgtttacaattacatctatctgtaaagacccctagatattgctggcatacaccttcctcattgcccagggcttctgagacttcacactaccttgtctgtataagcctttggtggtgcttcttctctccacttataaataggatgacaacagcaactgtgactcttgccacatgatataaacttactatgagccttatcaggaatgagaataccagagaccattgtttcatgagatgatgaattccctaaacgtgtaaaaagacaatatacaaacaaatatttaatttttaaaattgtttttcaaaactgcagcaggaatcagcatgtttttatctgacataaaaccaaaacggccttcaacatctctttgtaatagtctcatgtgctcagacactacagacaatcgtcaatagaaaagactgtcaacttgaatgaactcaacctgcatcaatatttttccagagtcagcaccatgcccaaactaagagaaacatgcagttacataaataaatgaatatggatgcatgtgcatatatatgcatttgtatatacacaaaatgaatgtgaatatctttctatatctgtatcctagctttaattccatctccatctctatgcacctgcatatactcattcaactaattcattcatctgcataaactcattcgatataatcccctttagtcaaacccaccactgaattagtcttccttagactgctgccactggaagatgaagagattccaacaacactgcaaaaaaatatagcaactaaacctgtcttaatcaatttttaggtttcaaacagaggttcttaatcataagtagtattctattacctgcaagatgatttgtattcatggaagtatactataatccttaccagaaactaataatgattttaataaacttgcattgacttcagaggtttcaccatttataagttgcttaattcagtctttgtaaaatcattcattactctttacagacatcagctggggaactacaaggcaattattagattaaactggatttaaaggttgcttttattgtaattgcaaaagaaaaaaatctaagttttcttaaatattatattgtacttagacaacagtttaaactcttggtgtgagtagaaaggctgggtctttggccctatagacagctttctccagtcagtggtttcaaaagtatttactttgtaacactggagctacatctccttaacggtttgctttctcacttatttgagaacttttttcctataacgtgaataaaaagaagaaccttagcaccccaagcaccattttttaagttaaatacttcctttatatgagaagcagatgctgtcaatagaagtcacccgaattcagcaagcagttagacgattaatcaacttagaatataaatccaactatagttgttacttataagggaagttgatgaaaagtacatgtcctaactctcctatccattgatataatcaatctatcaataataaagtattaattagaaatattttcaggactttggaggaaacaaacaattatacattgcttccacatgcaaatatttcacaatttagttatagtgaaatcccttaatggaaaagcccaactaattagaagaaaggctacaatgaaaacatgtactttgtattaaaaagcattagacactataatgtgtttcctatcaaccatgcctcaaagtttctcctacctgtcctggaaacacaatatagctattctcacaactacatatatccaaaattaaacaattatgctgagagtgtttaattcttcacttcagcttccagcatatcatactgtcaatgaattaacattcattgacaatctactatgtgcccagtactgttgttgtaaagtaaggaactcaaaaacaagacatagtctctaacctcaagatcctcccaggagaggaggggagacccatgcatgaagtaaaacacaatgctttaaggtatagtcgaggaaagagcaaagtgccacagtggcacacaagagaggaccattagatctcagaaaatagccagggaagtaatatatgagctagatctttttcagaggaatagatttcccagtaaacattaactggatgaatcacagatagggtgggaaaggaagaagacttactaaggcagagaaatacaagcacagcatgatattttttgagtggaaagttcagcctgacaagagcatgaagtacattacatcagataagggtaagtccaagatgaggccagcaagggaccctggccatactgcctcagggttttctcctatagccactggggaatgataccaaagtggacagtcaaggaacagatgccaaaacccttgcaaaaatccccaaagcaataagggggactcaagctaaatcagataaatatagcatgaaaagaggaggtcaaatttaagatgcatttctgaagtaatcaattatctcctaagctattgcctactgagtttggtggaataaggaggaaaagagaaatcaagtaagtctgtgagttttcaggctttcataaacgggtatgatgatgccattaactgagatggaaaatatagaaaatgggagagaaaataaggtcatcccttaacatgtatagcctgagattactgcaatacatttaggtgcaaatatccagtgaggaggtatgggaaagtaagcaagttattttccatgcaacttatttaggaacaatagcaatttgatttctgggttttccatttatttaagtaacaaaacaaaaataaactgccatcttttaatctattagttgaatcactcttggtaacctctggcctatcaaactgtgcaactgcccatgctcccaacccaactgccacaaataaactcttcttctatcaacctcttcagcaagaaagcattttgccaacataatatgcctcagcagaccttaaaataatgaagttggaaaaatgtgggtgagcaaattttgaagtatattaaacctgacaatttaatatttatgtaagctgcaagtgctaagcataattggacttaactattggcttaggtttaatgggttgtgaatttaacttcattatcatagttttgcctgctctttgagctcattcaaccgaactagagaaaaaaaactgagagccattttctacctcaccaaaaccatttttgagatgacctgaaaccattgggtcaaagaaggcggattctttcatttcacaaaagagaagagcttcagtgaagactcctcagtggttacagtcagaaaacaaacatgggtttactctagatgggctagttactgtgagtctttaggcaagttactaagcctctggaagcctccatctctacataaatagggataatataaaactttcaagatactgtgaggatgaaaggagaatgtacctaaatcacctggcagaatgcttttgcacatgatgtgacatcagtgcacgttggttcccttcagcactcatgccattaccttgtgcttcaacagacttacaccacttccaggcctttctgctcatctctatggaagttggcaacataagcatactctacttactagggattgatcatcctaccagctattacagccacctctctgatacgatttgtagcatgtaaatcagaagcacaggtgtgccacagcatggatgagtcctttgggtttttttgtttttgtttttatttttcggggagcgggggtgtcgaggggtggggatgtacatcgtatactatatcatcctaaagaacctaaactaaaaggatccttatttcattccattttatgctttataagcacaaaacaatgaatggatctacatacaattgtggacaaaatctctctgaaggcatgtctccaggaattcctttgtggaatgtagtgatgaggaaaggaggaaggaggttccaagggaaggaaaagaaaggagggaaaagtgtccaaataactgtctttacatgcattcacaaacacacacacacaccccctcacagtagccaataggcatgattctacaattagagaatgctaatgtaatgccagtatgccttgaggaagatcacagtctagtcctttcatgtggggaagaaaagccaagagaaggaaaatcaattacctgtgaatagcatcttacaggggcctctcaacctaacaaatgaagagacatgaagcatatgcagagacatacgtttcctatgtgcaagcatcaagaatccagaccatatgatgtataaaagagatgaaataagttttcaatttatttccagggagtaaataagtaactgttgaaggagggaaaccaaccccagatgctatttagggcaccaagctttacttcactacatgatgcttgatattctgaaatccattctgcctttctccctttctcctaaacacctccaccccttctgcacatgaaaacaatgctaaacagtcttttcatattttgtttatattttatgctagaggaaggtcatttttatatctatacaataatctctctcacctccttagttgccacattttaagttacagaaactttattcaaaatgttcacaaagcacattgcttaaattataaatgaatccaggatctgtcacagttttttttgtgtgaccaaatttgggcatctctctctgtagaagcaggacaatagtcttaggtaaagaaaaccttacttgaatgcttaacttcaacagaagcccaatgggggctggagcagacacataaatcaatggtagaatgctgactacctggggctgcagggtttggaatagttgggaagacattggacaaaggatacaaaattttggttaggagaaacaagttcaagagatctattgtagaacatggtgagtatagttaatattatattcttgaaaaatgctaagagggcggatataaagaattctcaccacaaaaaatataactaggtgagttaatgcatatgtaaattagctaggtttagtcattccacagtgtatatatacttaaaaacatcatgtacatggtaagtatctacaattttgtctattaaaatctgtaagcatataaacagcaaattaaaaaattcataaaataagtaggaatagggccgggtgcggtgccgcatgcctgtaatcccaacactttgggaggctgaggtgggtggatcacaaggtcaggagtttgagatcagtctggtcaacatggtgaaaccccgtctctacaaaaaatacaaaaattagctgatcgtggtgacacgcgcctgtaataccagctgctcaggaggctgaggcaggagaattgcttgagcccgggagggagaagttgcactgagccaagactgcgccactgcactccagcctgggagactgagcgagattctgtctcggaaaaaaaattaaaaaataaattaattaattaaaaacgaatgggagtggcccctggttataatgccatttgcaatggagaatgaccatctcctactagagctgccatgccaaacctcgtggagattcatagaatagtcacttaataaataaacacaaatatttattttattacagtttattgcaaatctaggatatataattttaaggcaacctagcaataagtttaagggatgtttttacattatggtggactttataggaaacaaatattattcttgtgtcacatgtttacatgtcaaatataactctattcaagttaacatggaggctgcctgccacacttgggctgcaaacatctgtgattacaggatgtcagcttttacgacgcactgcattctaatccgataacccagtacactgtttttccattattcaattccgcatatagctgagaataggacacagtatttctaaacctttttttttttaatctagacttctgtataggatatatctatacattacatattgaattgaagatattactgttaccctattaacccggataatacaaatagttgaactaattcaagttccaaagtaaaatttcatgacttggatgatccagttcagctgtcatgaaatagggatgaaaaacggcacattataaaattttagtaaagtattttgcttatactacaaaagggccagcatatggtattcctaataaagagattagataggaagaacgagaggtatttccaaactctagaatgccacttagcaaagcatcactgtggtatattttagcgctccctgttcacccagcagagcgctcaaatctaaagcaactggtatattccaagagagtcacttagaaccactcagagactctcagtgtctctcccatatcttcttatggcttgacccatcccctgctccagggcagcagggaatctgaatctgaattaactgtccacatatatcaaatcagccagaatactggaaaatcacggcgtttagtacatgaatagcagttgccattagagtactgacggcaaatggatgatgtaaacagaactttgaaaatgcaccgaaaaaaataaaaaaggaagaatagaagtactcctttaattttcttaattctggaggggtttatggaaatttctcttcagggatcttcatgaatcgggccatatgtactttatctctacaattgggaaaggataagtggcccaaagagagtgaatcagcacaagtcaagtggttgaggcattttgcagagtgatgagactcagacaggacttcgcaaagaagcaaccaggtgaaaaacaggcttctcagtgtttcccacatatcacctctataattcagaggaccagagtcatctgtgggcaaagtgcagcacaaccatcaacaaaaacaaaattctcacatcttgtctcatcttaaaagtgaatgagaattttacgtttgtctcctcaatgaatgtaattttaatattaaataatccttgttttccttcaatctctgagaaaagctgatattccgggaagatgagacatattaactttatcatttcacatatgcttggctgcatcccaggacttgagtgtgttcacgtggcagcactggacagggtgtttaggaggtaactccataaagggcagcagcacagagcataggaaggatatgggatgtgaagtcagtttcttcaaggtcaggctctgtttcatgttttgtggttttgtcatcttttcttacctttattttagattgatgagttgtgaaaagcattgcccttatgatagaagtatcatgaaaataaactaaattaatatgtgacaagtatgtaactggatgcctgaatcaggtggatgtgcattccacggaagcttgtgttaccatgtgaagatctctgctcatccatacacaaaaaccacagaacaggagcaatttagcaccactcataaaacagggcacttaaagagtaaaattaaataaaaattataaatcaacacaaaatccacatttgaacatcactatttaactcaagtttatttttactaatagctggttataggtactaaattaccctgcaataaatgatttgctcataattcataaaaatggaagggatacttgagtattttgaggttttcccttaatcatttgactttttccttccttttaaccgtattttttccttatacaaataatataaaggagaaaaaattcagtatatttcctacattaaaaactccaacataaatgttgaataagacaagattagattcatattaagttctgattacgagctgagctactaaggctcactgtagctcaggctccctattagtaaagtgggagaactaattttctacctatccctcaggactgatatcgagattaaatgggctaacctgtagactaaagtggtttaagagtagcacacattttaagtattttggcatagcagcacactttttgttaagtgatctttatcatcatcattattatttgttgttgtgcaaacactgctctttctgaactgcagtgcacccatctatttcaaagagataatacttcacaggattgctgtgaaaagtaaaacacatatatatattttttgtaaagcacttagcatactgttcggcacatattaaatactcaataaatggtggctattatcaatttcagtattcagaggaaaaaatctgaggcactggaaagcctagggtttttgttcaacattacattgctagttagtgtcgattctgggatgggatcctagtttttctggtgcccagcccagtgtcccagccacaccacatggtctcctatagatacctgaatccaaactaaaaaccaagggctgatgcttctttcctctctgttagacaaatgaaaacttaaaccattctatttgaacagcaaaaaagctgcgaaagtcaaggagtgggcatgctaagcaccacagactgacctttaaagtatttactcataaatattcagttcaatagccaaatgccagtcttggtgcaccactgtggtttcattcactgtttgaagttacagggacattatttcatccagtctagttctgctgtgttattctacttagtttttagaagagctttaatttcctggcactttttattttccatataatcatttcattaaaccatacaacaggacgtgatctggtttagatgaaagggcaacaacaagccccagaaaaataactttactagccagctgctaacatgctgaaagtaagtttttctaagcctagctaattacattaacattttccacatcaacaaccattatggttttatattttcatgttgaaatattatatggtcctccatctaaatttatggtttattcttttcataaatactaggatactcaaaacacgtgatgaaaaaataacatatccaaaagattacatttcttataatcactaaaatagatgtaattccttacttttcacaactgagaatgtttttcttaatggtatcccctgtaaagtaagaaaataaccaaaaagctgattgttcatttgttaaacaagaatatcaaagttaaatgagcctgactctgttctaatcagaggatatatatttttttaactatcacaaatattggtaggacttgccagttgggcaaagctatccttatgatgacgtcactaaaagatgaggaaaatggaagtgaccaaccagaacatggggtaaaggatggaaagaaaggggaataaaaaccagagcagggccaggcgtagtggctcacacctgtaatcccagcactttggaagcctgaggaaggtgaattgcttgagcccaggagttcgagaccagcctgggcaacatgacaaaaccctgtctctacaaaaaatacaaaaattagcagggcatggtggtgtgcacctgtattcccagctactggcaggggtcaggtgggaggaccacctgagcctggaaggtctgggctgcaatgacctgtgtgtgatccagccactgcactccagcctgagtgacagggcaagaccctgtcaaaagaaaaaaagaaaagacaaaagaaaaaagaaaagaaaagaaaagagaaaagaaaagaaaggaggggaggggaggggaggggagagaaaagaaaaaagaggagaggagaagagaggaggagaaggaaagagagcaggaatagcattcattatcacttccagaaagatgatgtttcaatgttaactactcctttttgtacctaaatatcaagaccttgtgaaaagaaaagaaaagaaaagagaaaacaaaagaaaacaaaagaggggaggggaggggaggggagggtttgggaggggagggaaagagagcaggaatagcattcattataacttccagaaagacgatgtttcaatgttaactactcctttttgtacctaaatatcaagaccttgtgaaaagaaaagaaaacaaaacaaaacaaaacaaaacaaaaggaaaggaagcaggaatagcattcattataacttccagaaagatgatatttcaatgttaactactcctttttatacctaaatatcctacaaaacatatctcctttacacgattcatccagtaagtatatttatatttcatattccattgtttgcttttgtatgtttggccatatcaattcaaaagcactgaaaaatgttcatttcatttaaaggccaagattaaatgtatgaatttgagtctataggcaaaggatacaactggcagctgtacctgaattaagtggaggtgtttgagtgaaactgtagatagatcatttgagaggctgtacaatggagaaaggaagctgttcaattaaggtgttagaagcaaatcggaaggtaaggaaaaacacaagggtcacttgtcagttattacatgggaatgcattggtcagaagaagcaagacagaagaataagttaatgaaaatccacatgcttcgaacttggacacagggagaaggatggcggtactattgactgaaataagaatgcagtgttttggagggatgttcactgaggtgagaagaggatgacaacttctgggggaccctgaggctggtgggaccacccacatacaagtggtacctgcctcaacttttctccagtagagaacaatgaagacatttcacattcttttttatgcaagactattagcatgttttaaacaattgcctctagagtgattatttaaaattataatcgattagtttaaatcatgatgtgttctgtgattgggtatggcattgttatgaactactaccgtgccttcagactgattaggtattaaaacttacaaaaaggaaaggattattaataacaccagtagttagtactttcatgtgtttatattcaacattctgtcaataacaaaaccctaacatttattcattagtaaaaaaagacttatattttacttatatttggtgtgcgtgctgggcaaagggtaggatgtcttagctctccattacttccaacacataacaggtattcaaagaatgttacttttgaatagactgaataacaaatataaaaaagcacatgtagattaagacaaagttactctgcaaatgttttaaaagagaaatggcattctttcatctcagtggcctcttccatttctagaagagagagcaggaaggggaagggaaaggtactatccctgacattaatgctaagggtgtaaacattataatatcttactttgccttccttctgggaaacagagcacttcaaccatatctagaaatacttgagagactattctgctactgacttattttttttaaaactaaaaataaatccaagtgggaataaagggcagattaaaatatcatagcatcacagactctctgacatcatcatgctgtgttttttacccaaagtttgaatctcctgcctctctagcacccccagaaaatgatcactcacctctacctcctaaaattgccctggtaattttcaggaagctgagatcattccagagttcttcctgggaccaatccaaaaatctgccactcgctgagcctgatttggctgtctgcatgaacacaaaatgagtctaatccctcttctacatgacagtccacagaggcaaccaccagtttcataactggtttagttgtttttcttacaccctgagggaccaggagaattacattttcacattctcagcccaactgtcttttctgcaagaactttcctaaatgaataaatagtctgtcattttagaactagctcttatcaaagaagagtatcgctattcttgcagttttttttttttctataaaatagtaaagttgtgtccttcacattatggtaagtctgggaggctattagtgagaatatgagtttctctagttttgttctgttatttgatatagtgttatttttaatatactgtcattcagatgtgaatatgacatgattaatacattattggtaaatgtcatttaagatatgcttccaggagaagcaatggtattacactgagctttttgaccctcattcttcatatttgtgaattcacctatttgctaaagtttatttgtaacctccaagtcaatacttatggtgatttcagccatttcatacagtggcaaaatatttgagttgcccaacacatgcagtcacagctaaggtcaaacaaggcaaccagtttatgcatttgtggcaaatgagactaatgagttcagaggtttgatcatcccatgaccaggtataggtttattcatagtaaaagacctccctgcctgtattcagtttgataagatgccacacagattaatgctgaatgttgtaaggaaggccaggataaatgagggtagactgaaatagagaagataatcacttaagtactctttaggactgagtcaatttcattttccttttatgtagagccctacaatgtagaatcctacagcttctcatatctttgcaaagataactactacaaaggagtttatgcaagaaataagagggcatataagggatctggcacattgggatcttggacctttagacatgagacaaaatgacaaaatgagacaaaagacatgagacacaagacaaaatgacagacatccggtcactttcaggaacaagtatctgttagccaaagtctacgacagagttggacaattacttagccctgactagtcctcatatttcacaaaaagtaatctacatatggcaagtaactccaccaaggaagagggcttcctattttcccactttctgaactaaatcagctcaagctacttttaaagaaaggagagcccactcttgagacttctttgctccttcttttgtttggcctgctaattctttctccatctgaggggtgagaaagacttctttttagctgtctctttcactgccaacctgctttgataatgttctgggggctttaccagaatgacattttagaccactctaactcagcttagccactgaagctgagcacagctgaagaaagcactcaattagcaactccaacttcaaaggctatattattctctcctcaatacacatgtgtaactcccattagcgttaatgggagctgtgggagcccacggctcagagaatatacctccaagtctgtttgcttgatgagcatgcaattaaaccttatggcccaaatttttcaaggagggcatagtaagtacaccaagcactcatgcaaaatcaagtgtgcttactttgagaaaaagtaagctatcgccactatttaaacatgaagaaagagcagtctaaattaggtctattttaatttcatttgtcctcttaggtgtggacaatggcctttcatggtgttttgaggaaagtcactcctcttttttaaaaggtgaattatatgtttttagaagcattagttcacattgcttaaaagactagctagcctcaagggtaaaaatgtctaataagaacaaaaccattctaagtgaatttcgtacacataaaatccagcatggcacctatatacactcagtggcttttcctgtctttatttaatagctgtattctaacttaaaattaggaaaaaaattgatttgacattaaaaagaaaaaaaaattttgagaggaaaatgcatgccccaataataaatttgtccttatcaggaagtaataatttccgtccctttcttgcattctaaagagatttgtccatatattttcaacatgaaatcaatatatatttcagcttcaatgaaatatcaatatatgtcagctagtctgtgctacagccacagtcttgaacaacatcttcatggggaaaataatcttgataatttagtaccatttaaaacaattccttttctattattcagacattttccccaaaatttaaaaagaaatttatgaatgaaagtttttacattttataaaggagagttagctaatcacttttaaagtcatacaagtgaattgttgatctactattgacacataattcactctaccaccaaacctcatatcctgactttctaaccacatgaggcttttttaggtactggaccatcagtacaaatcaattgaagtgcaacgggccaatgaacttatcagaaagacaaaagcgtccacactaagcttatgggaatgtcgagatgtcaggagacttttcaagttgtaacatggcagatgagctagaggaaaactcctttaaaatttcatctagtacatggtcttcataacttcattttgcactaaatatttaacaccttgctttacaagtttgataactaccatgtcttcataaaatttcaaagcccatgtgttaaaggaaagaagtatttcaaaactgaacacagggatcccttacttcagactctaggcagactgaataaagaatgataaccatagattagataataaaccgtggtctgtggttaacagaatttttaatgatgacaaatgtgagaaacattcactatttcttatcaaaaaaagattgtggtttttctctcatatctgcaatcttattcataaagttgaaagctactacaatagataccctactttcagagcatatctcacatacaaaactacctttcaagtgagagataaagactgccgatgttattacagaggggctagacagttttattcttagatgttttggatgtgatttactctggctaaaaatactaataatttaactatgctattaatcctgctgaagtgattatgccctccatgagaggctaagctgaaactcatccagaccttcagttggcacagaacacactgatttcctcatatagaagttcagttggtagtggtttaatcggggattatcagtgtataaaatggcatttattcgaacacccctgtgagtacaaccgtactctactttctataactgttgtccaaaatacttatttacaaatcctttttttcccaatctggctcttctataagagataaaaatatattttcatttgatataaaccaaaatacactgagagttcatgaaccttggatgggtcaagggatgtgaagtaaatcaatgagtaataacagcaattacctaaaatacttgcagaaagaaggaagagagagaagaaagatgggaaagaaggctgggagaatgaagatgtctactcagtgtctctgatgagggttggtcgatgaagcacccatattatgatctgagaggcagctgagatttgtgcacttctcaggagagagaactgctgtctcattttggagaaatgcttataactcttatcaagtggatgtgcaaaacctgatgtacataagtaatttattcctattcctgattactaggctacaatcaacatcagatatgtcacttagatgtcccaacttttaaaatttactgacatgtattatttcagcaacatatttgagtcccttctctgtagcacctcttgtctaagtactgggataagcaatactgatttcattcctacttaaaagaacaaacaaaactactttgtttttaagtcttacagtcttgattttaaaaatccaaaaggcttgaatttaaagagtctaaaaatccttaaaatgaaactcttgagtagataaactttcttaaaaataagtatttctataagtgtatttatatatgtacataaaagggtgaattcaacttctctttatctttagactcttgtaaaagttgccattgaaaggcacatctgatacggcaatttcagcacagaacatactcaataggaaacaactaactagagaactaaagatgtaccgtctttgagtcttgctcattttttaaaaaaatcactaactttgaaactggtaggttgtcccacttaaagctcttgatttttaattgccatttctttttacacccaattaaattgtcagagtagtgaagaattgcccaactgagtagaactgtgaggatcttctcactgctgctttccgcagtcttaatttgcagatgcttttgcctaaaataaaaatttaaagtcacttcctcaacaataagacctgtaaagcttccaccaactgctgtttaagacagacgcaaaaagaaaatttgctgcacgagtttggggccatagaaaaaggaatattttcctatatttgtaagatatttgggttctgaataacagattaccatgtcccttaatctgatacatattaaatgaagaccacataggtaaagggcttggtacctttcaattagctcagcaagtctatcaactggtaatattcaaaaagaacaaacaaaactcatgctggactgttcattttcatgaaaacatattgtgtataaagccatgaatggtgatcaaagattcctgtgaataattttcttaatgaaagaggactaattacttgctagattctcagaccaatggtatggtatcttgacaatctccatctaccagaggtttcaaagagaaagccatggagtcataaaacaccaagacaactcagttccaacatatctgaaatgacttgccctcaccttttaacttcctgtggttgcctcaaacatttaagaaatatctttattaatttacttatttattcttgtttttagacagagtattgctctgttgcccaggctagaatgcagtggtgcgatcttgactcactgtaacttccacctcctgggttcaagtgattttcctgcctcagcctcctgaggggttgagactacaggtgcatgccaccacacccagctaattttgtgtgtgtgtgtgtgtgtgtgtgtgtgtgtttgtctgtgtttttttgtttttttttttttttttttttttttaccggaaacagggtttcaccatgttggtcaggctagtctcaaactcgtgacctcaagtgatctgccaacctcagcctcccaaaatgctgggattacaggattgagccactgcacccagccatacatttattttttaattgagacataaaagtgtatttaccacatacaaaatgatgttttgaactattatgtatacattgtgaaatagttaaatcttgctcagtaacatacgcattatcttacatagttaccacttttgtgtttgagaatactttgtacccattctcttagcatctttcaagaatacaaaacattatgaactatagtcaccatgttctacaacagttctcttaaacttactcctcctaactgaaatgttctatcctttgaccaccatctccccaacccccacccctcaacctgctcagcctctggtaaccaacattctactctctactactgatatcaatttttttagattccacaaatcagtgagatcccatagcatttgtctttctgtgaatggcttatttcaattaccataatattttacaagatataaagaggtataacaaccaaatgcattaaaaaaagaagtaccctcttaactagcctttcagtgataactatgtcttctttaatgcctttttaatgcattttatttttcacaaccattcagctcttacatcccactccaccccatctttttgtgttctcagagctctctttctacccaggttacacagaaactcaaggacgatgactaaataaatctccattacacaaccaactcagcagcccctcttggtggagttaaggtatcttttacacatcttcatccttttcctagagacccccaaaacaaaaaaaatcaacccttacacttttctatgtcacattacactcgattgtatcctttgcaagatagcattaaagggcaatatatgaagtagtaaatacagaataaactttagagtcagaaaatctggtaatcaccacatttaccagcatgtttggtcaagccacctctgaatctcagctgctctgaacttgtagcctctccagacactgcacacagaccccctttagtagtcagtaaagcacttagcagacctctcctttagggctaagaatctatcagaacctcagatggaacacctatatattaaaattcacacattccaaaactgcattgaacgcttggtaattactaattctctaggatttttttcctttgtttgatctttgcttttctaattgccaataaaacctgagcaagcaaatagaggttctgtatcatttgctcattgagaaaagaaatctgaagatcttctaatatttatcttacagacaaacgctttaaagaagaagcctaaaccattcctgccttctacctgtctcttctcctttaataaacaagacagcatgccgctcatggagaatcagttcagaaattcatttgttgaattttagtaaataatgccactagactttagagctagtttacataaaaataaaaattaagaatttatagtgtctaatgtcttgatgaaaaggttattttgcatcagtgatggtggtggtggtactgttcaaatgcaatgagaggagatagaaaccttgacctttcagaatggagaaattttaaccaggtacagtccagttaatggcggggggcagggggtggcagggaatcctgtgtaatgtgcaaaaccatcctgttacaggagagagcagtggatgtgtactgcctgtgtagtattgtatgttaaacagtaaaggaaaaaaatagtaccaagatgttctccataaatttagaaacagaattataaacattgggcaaagtcctttcaagtctatattaagccatggaggattgtgattcaggaaagacattcacccctctacgtgagactcacattcaagtgctgatgtacacaagtaatttttcttcaatcatatgtaaagtacaatgcagttcttagatcccttggccccatcccagcagcggacctagatattattaagtctaaagcttacgaaactttaaaggactactttatgaaaacaaatgcaaaaatcttatttttacaaattttagaaaaatatataatcaaccggagatactagtaagtcttcccgggtctttggaaggcatcgtacaagggagggccctaattccaaagattcctcaactgcagggtaagcctgtctctgcttcaactccacaccaattacttcccctccaccattctgagagagattttctggcacccgagtatggcaagagtttggtgggggtcttcgaacaagaattcatctcactggaggacacaggaagcgtggtccctgagcttaatcaatgctgttagcatatagttaaccaggcttgtgtaaaagacatcacatcagcatttcaccattatgcggtaaagtaattttaatttttaaaaaaaatttgtttgtttttaaataatcacaatcatatcttaaaaatgttgatagggaattaagaaaagattggctcaaaccccagtcgtactgggcaaaaccccagtcctactgggcagcatttagtgtcctccttggttctttgtactaggtttatggcaaatccttgagaataatcatttaagtcagagtgaattcttcctcccagatgatgatttatctgtttgtaagctgagatgagggaattccatttgctattgagccagtgagtgttaactttattaacgcatctttgcaactaagattaatgggacccatagtaagtcagctgtagcacttgatgtcagtttataacaagcttggcaatacctggaaattcagatctatcatcataagttataatgacatgcataaaaatttgagtgtaaataaaaggctctttaggatacagggctctaatccaagttgttcaagccttaaaaagtaacttatataacagtgttcctgttttggagtacagtatatgctaatggcctttcctcaagggttaaaatgcctaaactaccatcttctaataaataaatattttattacaaaaatcaattttgcttaatgaagtcctctgagggagaagatgttttaagacattttaccagtacactttaaaatcattttgtatttaggtatgctctgtcatctccacctagagcaaaaaagaatcataaaaaatgataagtgcagcaataaaaaactcctcttactattagttgggagagaaacaaatgggtatattactctgaaggtaattacttaagtttttttattgcaccatattttctcaaaaccgaaccaaagtatatcccaaatcttcctacaaatgaaatacaatttttctctcagaacatttttactcatcaggacaaaaaggtgagcttaattcttctgtcagctgaggcttcatgtgtcaaacacatcttacatttcaacaaaccttactgtcatattgatggaatattcaaggagacattagttcttacggcaagtactagcttgaaaaggtgtaagctgaattactgtgagagcacttttcttctaaaaatagactttattatctccaaccacagtatatatgtataactgccttgtcattttaaccaaatttatggcttcccatcagagattgtagcttccttgaaggcaagtgggggtagtttctttccatctttttattcccaacacttagcacacttcctggactagagagagctagattatcaaatgaataaattcatgaattaatacaaattgcttctcatatattgtatgcctatccgagatgtggaagcaacatctcctgacatttctaatttttaaaaataaaccttaaatccagcagtctgcaagaaaataatatttagaaactttttcctaaaacttgtcattcattcattccatcaagaaattttggctggtagcagcggcttatgcctgtaatcccatgactttgggaaaacgaggtgggaggatcgcttaagccaagagttcaagaccagcctgggcaatatagcaagacctattttctaaagaaaatttacaaaatacaaaaaaaaaaattagctgggcaagatgactcatactatagtcccagcaactcagggactcaggtgggaagatcccttgaacataggagtgacaggttacagtgagctatgatctcaccactgcattccagcctggatgacaaagtggtaccctgtctctaaaaaaacaaaaaacacaaatgtttatggaaaatgtcaggcactgtgcttactgccatgtgtacagtctagagcaaaacaaagccatgcccttatggaacttctagtctaagcatgcaactaactctgttttttaggataaaaggaaaatttcatctaattttctcttaagtatactcccctatcacttatgacagaatgatgttcaaatttcaaatattttgtggatcctacaacagccaaatggtggcatctggaccacatgattatttagtggacaaggtagcttgacttaaggattaaaaaatttgtgtattcccagccttagcaagataattctgcctgtgccaaaaagttctgcttcacaaatggggcagttccctttaatcaaataatttgaaattaactcttaataataatcctactgatcatagtaatactagtgatgataatgataatcacaacaacaactcacatttcctgagtgcctagaactttgctaacagctttacatggattatctcctgtaatcatcctcttaagtttactcaataggtcttcttatctcgacttgatagacagatgctgaagcttagagaggttaggaaatgtgcacatttgccgcaaaacaaatagtgaagttaggatttgaactcgggtctgtctgtttgctgaacctacacccataactacaccttctatcacttcctacaccaaggttggtaacagaaataatcaaaaaaacaaaacaaacgaataaacgaaaaagcaagaaaatgtttcctattatctctttcaaagtttcaaggatatttgaaattcttctgcttcttctaaaatatatctaatgttacattttcacagaaatcataaaacagttatagatttttatctagtctgtgacctagatgtcatagaacagaaataatattctagtacgacagtgtgactctagtttgagttaggcagttgaagcaattgactacctggacctacctaatgtataagcattctgaagaatatggaaatgtgtgttaacgtaacaataagcacaaatgtaacagggggaaaaaaaggaactaaaattcttgggattgtgtactagcatagcaccaataaatgattttcagtctttcaaaataacttggtaatactgtatgttttcagattgttgtatcatcctatttccttgtgaaaagctgtttttcagtcctttggattaaggactatttgagaagacacaaaaacttatttttcagagttcttcaccctcccttcccttcaccatagccacgtatacatataacacttactgaattactatgtgcctagcactattctagatgctggggattcagtagtgatgggagagccaaaccagctagctcagcttcaaagggataataaagggagaaggaaggaaattaacattctttggcaactttattgttagttactctgccagatgatttaatatgtcattaacttcccccaaaacagccctaaaagatagccaggatcacccccaaccctacagataggaatttaacattcagacttgagtaatgtgtctaaacctatacagttaggaagcactggaaggttgatacaaattcatgcttatgtagctagaaagagcatctctcttcattccctctgtttcactctgtctttgtagttctctttccctttgcctcgacttcttgactctcaatcacgctcttcatcttgcagaggccactgaaataatgactattttgttcattatatgtaaagtaagactcattcttacccaaatggtctcttaatgcattgtatctacataaccatatctatagatccctctacatatgtacctgttcatgccacaaatatctcttgggtgcccaataaatgccaggaacatttctaggccatagaaaactgtaatggagcttatacacaaaggaagaggtatacaggataaaagtctcaagacataaagagtataatttcacatagtaaaaagtgctatgaagcaaattaaacaggtcatatacaaacacactatatatatatatactacatgtacaaaacatacatatatgcaaatataccttctcaagtttttgtataaatattgatagttaataactagctttattaaaagccatcacgtttttatgagcacatacttttctactatacttaattttctagttgaccagtaaatgacagatctgcagttacccacgtaattaaacaaatacataaacaaacagaaagaactatgtatgccgatacttagaaaggtagaaaatatctaaaaactgttaatattgattttctggtctcacttatgatttatagcttcatttttttaatagctcttttggtatttatgctccaagaaatataggatctcttctgggaaaatacaaactatgatcaaattttcaacctgaatacagacatcatcagacatgtgagaaaaatctcaatagtgctacacttatgaccaaaaatctatcaattaaaaaaaaatctactgtgttaaagggtgaaaataacatttatgtaatgcatggataaagtttaataatcaaaggtaaagttctaagaaacaaaaaagaaaggcatggaaagtttttagatataaattaaaacacagctcattttggaagatgacagataagagagtcttgaaatgatatgactattccccgattgcccagtagttaaaaaaaaaaaaaaaatcttgctatctttaacaaaacatattaagaatatgggatgtgtgtcatcatagttgtgtttaatgtggcattaattcacaagtcattgtttttttaataagatataataagttacttgctcttctaaggagatacgtaattagggctttgataattaaaccctagatgaggcatttggcatatctgtgccctaaataccaataaattatgcatgtacaacttttaaaactacatcttaattagtagcttaaaataaaactaatttggaaaaccaggatactgaatttttaaaaactgctcaaattttatcaatgaaagccaaccaactacctagttttaaatataaacctcaattatgtatgaatgactgtttgatagattactttaagtgaagtattttagtaaactcctttgtaattttcagctcacataaagatggcctaggttaacttaatcacaccttttctcacttattaggtttatctccttagccaatgagtcacgtcccaacctcattttcttttactactactattttacttctgctcaattctgacctaccattgtttatacccacctgtaatggttaattgtacgtgtcacttgattaggcgaaatatctggggtgctcaaatatttggtcaaatgttatcttgagcattactgtcagggtgtttttggatgcgattaacatttaatttagtcaccaagcaaagcagattgccctccctaatgtgggcaacccttatccaatcaggtaaaacactaaagagaacaataaagctgagcctcacctaaggaaggaagaactcctcctaccttcaaactgggacatcagctttttcatgcctttggacccaatctgaaacatcagctcttcctaggtcttcagcttgccagcctgtggactagaactgcacatcaactctcctgggcctccagctgccaactttggcagatcttgaaacttcttggcctcattaataatgtcagctaatttgttaaaataaggctcttcctatatatgtatatattctgttggggttctctttctccagagaaccctaatacactgcacacacctaccatcaatactcagtgatttcctccctaagccactttgctcaagaagcttctagtttctactcctctctcaagttagctctgtctcacagactcctaaatattcttcatgccccaacccagcagtctcctcactctcacagtgtatcatccatgtagcattttacacattttgcacccatggcacttgagcactttttatttcccatcatgctcatctgtcgacatgtcagctggaagaacattgttcttccaggacaatatcttgtatataaagtaaaaatctgaagggctgaaactcactgtcacacgtactgcagcagggatcacttcagacttggccaaacccgatgaaaatcttagctgtacgaccaagaacaaatcatgtcaaactctctggaccttggctccttacatcaaaaataagtagtgaggctaggtaaacaccaaattcccttctagctcaacatttctatggttcggttaacaagttaagcagcagtaaacactcgcatgagttgatgttcatttcaaaattattaaaaataatattttaatatgaagtcaaaagaagaaaattgttctcacttcaatgcaatgatttacaagtgtgctcattttttctgagccctttttagacatgatctcagtgtggcaaaacaagtaatagttccaaggaaggagcatgcatcaccaacataacagtcctcaaaagatagatcagaaggaaaatgaatagcgtctcctcacaggtacactttctcccccagattttcagttttaatgtctccccttactagggtctctcatagactatccacatgggcttctgtctttgtgaccactgatacccaaagaatcactgtttttaaattctaaagattacaccaacgaaagtcaggagcgtctgttcacttaaagtggctctgcccactaccaccttttcccagcatggaaatgaggtacacacgaaagctttatcgtgttggtatcaatgtattccaagtactcaactattttataagccttttcaagtaatcttcagtcagtaccataattgtcagcacgtttgttctgtgttggccacccttccttttgtttcagtctttcataaaaatccttttgtgtgacagtcaagcagctgtgctttgttctttaatgttcctagcctggatctccagccgagaccactttataacataaacggcaaagtaccattttcacagcggggacaactgtgttcatcttcaaaaagaggcattaataaaatgagactgtaatcaacatgctaattctgatcacagggtactgcacaatggcagagatagttgactgccttctccctgaaagattgtaaaagttgtatgttttttttcctaacaactgccataatggcttacattttttgaaacagacatattatgcaaacatttctatttcccattgcagtgccttctctgtctcatccaactgctcactgtgtgttttactatctcagtaacagtcaccttcagggagcaaattttttccatcttgcaagaactgacttgctgaaataggcatgtcaatgaatcacggaaagctggagaggggtgatctgagtgatttcatcgctaatccaaggccttcccaatgcatatcaggccaaaaaaaaaaaaaagaaacagaacagaacagggaagttaacgtatttgcttaagaatccagttattttgtgacagagctaaagctggaattcaatttcccaagacctagacttgggtacttcacgtattatcttttgtcctaatggtgatcattcacaaataatatatttatatgtaagagtaggtacacataagtatcacttgatgaaatatatttgctaaactaggtaactaaaatgcctcatatctggtaaactagcatgtttagacaataattgtactgtagatatgttctatgaacaaagccagttccctataaatagataagagcagcagtgttgtatatcataccctgttctgttgtgctagtggtggtggtggtttggggcagtgctatttgagaacagcccagtctaaaaataatctactaagattttttaaatgacccattacatgctgtttgagataagagcaaaataatgtattttctgattactcccctaaaaaaaattctaagttcaagaaacatgatgacatttagtaagatgcttagattcaaagttgattaaatggttccagaactttgtcttagagaagggaggttatgtaagtaagaataattattgatgtctttcctcttgcccaaaagaagcaagtacccttggactcttactagaaagaaaagtctatggatggtgatatctcattttccctgcctagtgattgataacatctatcagagagaatattttcatcctcagttatcactgcataaatttgtattacatggtttcctgctgatatctttagtcaggaagaaattgtgaccagcaaactaacgaaacagacagaaccaattccatttagatgacaatccctgttcttacaacactctctctggtcctatgcttgctcttcactgaaagcctgatagttaattcactgtccttagtagcattccacaattagttaaggcacagtccttagtagcctcagtacatcctaaggccttcacttaaagttctgcttaggatgggaaaacacaagtaaaacagatatactcagcctcctaaagtgttgtatcattagggagtcagtattttcttgtgtttccatagccaagacaactaaaaaattaaaatgacttggaagacataagccctacattcacctcccccctctcctacttctttcgtgaaccacactctatggtatagttaattgcccaaatatcttatttcggggcacattcagcctgagcttgtggttatccctccttattgaaacacagtttttgagagtaagggtaatttgaaacaagctacgaagggaaacttgttcctgaaatgctcccttcgaggcacatgggtggtcagagtattatttcaatgtcttcttcattaaccatacaggtcagatatttgaatctccaattaattagtttctctagtagcttgtgtgagataaatcaatgatcttcatccagttcacttagataaagcccatcatgagagctggcacatttttggcatttgtcagtaaagcagggagaaagtaaatgatccacgtggacgaaatgggaatctaatgaggccactggacgaaaagtgtaaaatggtctccatctactgcagaacagagtgcctgagtgtccgccaacatgatttgcaagagaaagtgaacctaaaatctcctcaactgtggtataaacctcttcacactcatttatttagctattcatgatgttcaaagtctatgaatgtcagtttacactggaatattattaaacactactattaatagaaataacaatatttagaagttttaagcaaacagtgactccaggaaacaaaaataatttccatccatatttattttatcctaaaaggatatataaaagtattctattttaagattatgtttagactacctttctgtcatctaaaatacttttgaatttttctcatgaaagttctaaaactgctcaacatagtctttaaaaaaatggaaagggttaactactcaaatcataaattttcatacaagtatacttacatatgacagatgttcacatagaaagttgagaccatattaaacatttttgatgcatttgttttatatggggactagctgtataaaagcagaggagatgatgaaactccagccaactgagagacaggaaaacattaatccatgtaaatttctaagtaaagtgatattttgctccaattttttgttaatgtcttcattggatgcataaagataagtcaagcacatgactgccattaattccttttaaggagttcaagggatttggaaagtgagaaaactcaaaaacgtttctgataagttttattttattgtacctttttaatataccttctatatgatggcactgattctaaactaggtaaataaatggagattaaaatttttaaagcagatgaacaaatgagccagatttggcttcaaatatgaacacctgaaaaatgacaattttcagacaagctgaagtgaactatgtatgtatattcagaaatatgtatactttccatagtgcatattacagcacatataaacatagtctctaagattcctgccagttctaaaatctaatttctaactcctattcttttttttccctaatgtcttattcttgcctattagaccattccttcctttcccttttcaaatattttaaatatattttgaaacccattcatacagttcagttacctgtggatcagagactatgatttccacccttgatggttgggcttactgtcgcttgctggtggtagctgacttgattgctttagaactggtgttcattagcccatctgggtatgaacaaccttctctagggttgtgtatctggattatcggaatgtctctgtggggtgagtgctattatgggtgtctgttgcacactctatgggactcactgtttctgaccagcttttatgttaaactatttggtcctgagtattgcacagtaggaatagtgctggaaatctcacttgtatgcagaaagctgatctagtctctgttactctcaacttattttatatacgtatgtatcttgctggagtgttaaaactccagcactaaagcataaggtccattttgttattatcttgggttattacaattgtcttttctctaggaaatccctcccttgtttttagcaactggaaatttcaatttcttgtttgtaagcctaattatgcttttaattttattttcagatactttgtcaacatttctatgtgttggtcagggaatggggaacttcctgcaccaacctagcttgtcataacagccagaaatgtagctcaaatctcacttgtctgttttaaagcagcatctgttacatgcatttaaaagatatacatccaattgtcaatactttccctgcaacttaataaggtgtttatactatttcaaacgtaattaaggatatatatgtaaataatctcattttctcagcctcttgaattgcttctttgtgtgtgtgtgtgtgtgtgtgtgtgtctgtgtgtgtgtgtgtttagtttcaaaaccaccaggtaaatttgacctacattactaattactgctggcctccaaataaataagttcttgacaatatcaatagggcttacctccttgaaagaaaccaagatgtttatcaaatcaaacttttttattttataaaagatataaagtaaaaccatccctccatgggggtaaaaaaaatgaaatagtagagaaatgtacttaatctacataagttcctctatgattctgattgtttcctttccaatttctttcatgttaggaaagtctattctcctaaattttggaacagaggaaaatacaacaaaacaaaacaaatgagttgtgtgagggagagaaagagataaaggcacagaatagttaatctggaaatgtcaactgtgaggtgcctaattgggaatgttcgtatctctatacagaagcctgaattagagacatacaacacagtcttcatcatagctttattctccagcactctcattgtaaaggaagtctacaaactgaacacactgtactggagatctggcaactcaccctgtgcctttgtcaaattgtgtaagcaacattgttggagacaaagaaagggatttgtcagcccagttatttagatcaatacatattggtttaagaaagataacagacaaataaaaaatgtattttttttcacataagacaggtgcatttcttatacttggttctgaccaattgcttaaggaaagttcatctttaggctaaggttctttctttaattctgcaaatatcaatgtcagctgtggtagttgtaaaaaacgtagctgctgaatacagtatgaaaaatccatgcacgagtaatgccaacatataaaagagtaccatatcctgtttcctttctagatgctctgccaaaaatcaaaatggtatctggcatttgaagtcaatgcttttttcagcttttttacctctgatattccccctgaactctagttctgtaaagacccaaaactagagaaggtatccactgtctaattaaagttcaagtcttacaaacatttaactgagtttcccatttaagcaccatcacaatgctagtcttttcaatgatgctacaaaagagatacagaattgtaacaatgacacaaacgacaaccttcacttgagcacttaccccgcaaaactgtgagtctggtggatacacttatttctcccacattatttgaggccacacattcataaatggcctcatccctcggagtccgtaagggttgtattctgagaactgatccagacccatcgtcaaactctattacctattagaggaaacaatagctgtcacaggtgttgttacaattgtctacctctcagctaaagctctcaatacagtggtggatccgccattaggctcataataaactaggcatcattctgaaactgaattttgatatagtggtgaaaaaatatttggtctaatttagtgaatcttctactgaacaaggagaaagatatgcaactacatatgcaaaacatggagatttctagtccctactaaaaactaccagggtttattcattaaaatatttcagtatgttcatctagggcaatttgactctattaattttgcaagaggcttgcagctataatggataaacttcttaaattattctttctctcacagcacatatacgaatgtggattcattcaataatgggactgtaaggtgaagaattaatgcatgccaccacagatagctctgctagtttaaactgtctcatcctgaacagtatagataggcaaaccacgaaaagaaattgcataaatctagtacttaggcagccaacgagacagctttcacaacccaaaagcctgatggtgtgcattaattttgccataaatcattccagtatttgttctagcttagcattttctgcatttttagagcattcttgctgtaaaatggaggcttgcttcaccaggcagaaaattaatgtcctaaacactaagcctgaattcaccatcattaggaactcttcttggaaacagtttagtgacactgataatcctgggtacttgttagctaattcaagtaccacttaaaaaaaaaaaagatgatgatattaacaaatatgtatacaatattatggagtcctctgtcttttctgtaactatgctgcattccttcagctgttcactgagaagttgtgccttttttctcttgtatttcactgtgaatattcccatgtgcctaaattatgaataaattgagattgcctcatatatatatttatggggtgcttaattccagattttgtgtgtgcatgtgtatattaacacagagaggaaggacattcatattttcaaaatatgtccacttcaatctttgtgcattccatttttgttcaaaattcacaaaaatattcaaaatggcccatttctcaatgcactacagtttattttcaactctataaagcatacactttaaaataaatctactatgcatcttaggaaagaaaagtttcatagtttcatattggaagctttgttaagcattccataattttaaaaaagttatttatgatcattttatgatttaggtaggaaaaggttaaagcaactataaacccaatttaaatgttgactaatttattaataaatgtcattgtatgtttacatttgtgaactatttcctagatttagatctatcctcttacaacatacaatataccacacattacacgccagtgatgtaatttccagtttgaaaatatccagtattgatttcatgcctgccatggaccagacaccatacttagcactggggatagaagagggagcaaaaacagtcaacatgtactgctctcagggaccatacagactagtaataccatatatattgtttaataatatatatttaataatatatattaaatatatattatatatatattagtgttaaatatagtaaagattttcaaccaaggacttgatacagtttgatgaagctgctttgggtaaaaataattcatttaccccaaaggtgtttatatgactctcatggggaattaggcattgagcagagatcatgctgtgaaatatttagtagtataatttcacttttgttacatgattttgtcaggagccattgtcattagaaagcgtgatgtcaaacttctctttgacaaaaaattaacttcatttaaatttttttaatgtgcagcaaagatgcatacatacatcattttctacatgacacaggaaacattttccaaatattaaagatatttttgtatttaaataaattatatttcaataataatcaagtatttgattttcagacataattttaaacttctcacttgtaaactacaacccaatttccaatggcaaatttctaatttcaccattgtaattaattaggttctctatacatttgaacccctgatcaccctgtgagttcctatgaaaataagtaaaataaaattgttctgaatttgtagttgctatatttcttttaactagaaattgcctttaatctgccaaactgtaaattaggtcatgaaggagattagaaactcaggtaaaagggaggtgagtttcacaatttcaggcagtttgggggtattggtagcccctaaaattaaagctatccttctcatgtcttaaattatgggcatgctattgtgtgcccataatctgtgtagctttctatatatcttattgcctatatttctcctccagaatgagcaaatttctaaaccatcagccttctcacaaacactcaaaaaaagaatctttgatttatgtttcaccatcttcgctgcactgagctctcctgaataaagaaaaccaacttcttcgataggtttctctgcaatatcaacctgtttgcatgtgtttctttcagaatagtactttaaaacactggaacaaatttctcattctagttcacactacttgtaaaacacaggtgcgaggggcagtggaccacttcatttgctgcttagcatccattcccattcttcttgataacgaggatttaaatttcctttgggaaaattctgctctttcattctaagccatgcaattggatgggactgtcctcattcccagaacagaggtagattctgattggcttaaattaagtaggctacactgtccacctatccacacaaattgtctcagggatgcacaagtaacgtaataggagccaatgggatgagaggcttctggaagagacaagctttcatacatcctacagacgtggtcctgtgaggttgcagagctccatcttgcaacctggggatgaaactgacagactaatcctaggaatactattgagccctggcacaagtagaaacaaaaatcagcccttgaacccccaaatttccttttttaaaaagccatttagagttacattttccatcacttgcaatgtaaggaataccatatatcagtgacaccttttatcagagtaaagcaagcaagtaacgtagaaaccaaagacagagcagatacattcttcccccagagaaacagaacaatggacctaatacctcaaatctctgattgctgactttctttccttttttgttccagacaattttaggtcttgggtctcccgtagcttggcagatgaaagaggcaactccgccagagacccctgtctgatcaacgggtgttcgtgtaaaccttggaggtgctgaaataaaaaataaacatcacagttaaattgaaaactgaaatacagactattatcctactaccgctgctctccccaccatcctcaaccacaccgccatcaagacatacatttttacaatgcactatgggattacaaaattagaaaagcatcttttacttttgagggtagtttaaaggggaaggacataactttctggttaagttatctattagtgcttttattgctgaaatctgtattaaggtagagatccaataacatccgaaaagcaacatcacacattaatttttattaccagtatataaaaaaatccaatttgtcctctaacaaaatgagctcatcaatcaaagtgggtaaaattttagcgcttgctttgatgccactatcaggacactgccagaaagcagcattgccactgctgagctattaaaattagtgacatttaagagaaatgctaggaaattttaaagagacaagaaatatcgccctgaattagaaggtttcgcaagaaatagaaataggggaaaatggtaaagtgactctctaacccagatattgtaagctgtcttacttgaaacttagctccacaatttgcataaaagaagatgagtcaagaagcctccaaagtcatagtaaagcaaagaatattttttatacaaagatgtagacttaaagattactaaggctagcaagatagacattggaagcttgttcaacatcctccatctcctttaaatgttcctaacattcttcctccttctttaaaaaacttacttatttttcatcttgtatttcaagatctagatagctatcatacaagaatgatataaaatgtaaatgaatacttatgcacaaagatattcatcatatcatttgtttggcaaaagagtataagtagttgaaacattaaacagtatgggatttctgtcacagtgaaataaaatatggcatgaagatggaacatcatacaagtagttaagtgttataaaatctgtatcataccacatgagaaatgcttatgatgcaataataagccacaaaagcatactacagagttatatgtggggatagcagataatgaaaaatgcacacacacacaaagattgaacaaagtaaataaaacactaataatggtgttcaggaggaggcattttaattatttctccgactgctttccatcttttacacttccttgagtttttacaattatgttctggctgaaaatgttttaaagccccaaaacattttgctgttccttcttttttttttttttttttaatttctaatccctgttacagattttctcttctctcctactgtgttctacttacatgtcattgaaaagtggttttaaataaccatagctaaaattgattttgaaaacaatccttggattataaaaaagaaaaaagtcataacaaagtttgttcttcttggttcatcaccagtatcttctctgtattgatttcatgtttcccacatggtgttcccattaacttgatggtgtgttctgactctgtttggttttcttggagtcaaggaagccggattcctatctaagctccaccaatacatatatggataatcttggaggaaaaaaaatcatgtaactttaccatttcttggtatgacatatgaaatacattaatttacaaaaattgcaaaactatgacatatgaaataaattaatttgcagaaattgcttccagtttcaaggtttcctagctttatatattatttccaaaggagggaagttcagaagaggcatatttgcaatgctggtcctggagaatgaattaccacctcatcagcaaattcaacttgttggtgatcctggaactgcgggcctgcttatgttcaaaaatattaagaaagcaaaacagcctctaacaaccctgctagagatcataacctgtagcatctcagtgtagcaatacagactagatgattactaggagctgtgggaagtacttaaaataattttattttttatttatttttatttatttatttattttagatggagtctcactctgtcgccagggtggagtgcagtggcacaatctcgactcactgcaacctccactacccaggttcaagcgattctcctgcctcagcctcccaaatagctaggactacaggtgcgtaccaccacgctcagctaatttttgtatttttagtagagacagagtttgaccatgtgggccagaatggtctcgatctcgtcacctcgtgatccacctgccttggcctcccaaagtgctgggattacaggcgtgagccaccacgcccggcctcaaaataatttaaaattgactaacagtgagaggattacaaaacactgtacattgatgtcacttttctggaaacaaatgaaaaatatattacaagtttttatatttatctttctgctgtttcaaacaatgcaaattgataataactacttgcttgtcagtaaccaatggaaaaattataattatgcaattaaaatttctagggaatttccctagaaacacaaaatagattgctgtattaaatggtacaatactgtcatttttagctaccttccttttcttgtccatagcctaaaaactgtcaaccgggaaggaaaatacattgtaagagcccagcttcccatttaagttctgttctgaaatttcttgcaagaacatgtgaatacattgaagggctgttgcataaaatgagtgtgcactatattagaaattaaagaaaactagaagtaggatacccttttccctgcatctggatattttttaagggataccgttgcatttcttaacccaaagaatgaagaagagttggcaattctgacaatctgcaactaggcaatggatgcttgggtaagtgcttcatctgtcctgttgccatgtaaggacctaaattagaaagctcatctggaaataactggtgggtgaggacaagtcaaattaaacatagaaatcttatttctaaatggagtgcagagagacaaaattcccatacacttggagaataggtatgagtgccatttcgatgttttccaggtatgtgtctcatttatctttattttctggtcaggcattgaagttttttgtttgttttttgagacagggtcttggtctgtcattcaggcttcagtgcagtggcacgatcaaagctaactgcagcctcaacctcccaggctcagtcagtcctcccaccttagcatccagagtggctgggagcacaaccacacaccaccatgcctgggtaatgtttttattatttgtagacatggggtctccctatgttgttcagcatgtcttgaactccagggctcaaggatcctcccgcctcagccttacaaagtgctggaattacaagtgtgagccatcacgacacgcagagaagtttttgtgtaatattgacaagtataaaaatatgccacccaggaggcagaggttgcagtgagccgagatcacgccactgcactacaacctgggtgacaagagtgaaactccatctcaaaaataaaaaatttaaagaaaagaaaaagaaatgaccattggatgctactgtaggattttatttctggagaccaagtcatggaatgaaattaacctattgaactgtggtaaacttattaaaataaccagttagaatctattttaggacctggaactatttttctaaatcctaccactgtattgatgtgatattcttaaaaaacaaaaaaacaaaaaaaaaaaaaacaaaaaaacctaaaagggctcttaaatttattctttgaaaacaagaaaataaaattgatcacactacagttaaataatttcaggggcttttacagagaaattctgtaaaaaaaaaaaaaaaatacatatatatatatgaaagacatcggcctcactgacaagaaaatcatgactttcctatgggacccaatgtcaatttttctagattcgcccacaagatccgaactacaaaaaggatatatgtcatcatcctatgatacaaagtaagactcaagataatatagtaaaatcctttcactaagcatgggtggtgcatatataatcatttttgctggtcaaactctcagatggtgtctgtcaatgctaggcagccagccaaaggaaagatatgaggtagagagaagactaaacttaataaccccaacaaatgcttgaggcaagtaaaaatctttattctcagagggatataacaacacacatcacccacttcccttctccatatctcagtttaataaaaggaacatgatgaatcgtctgccttattttgtcatagatattgtccaaatttaagccatgctctgaagatgggaagaaagggaagagaattcaagtaaagcataaaacaagggtatctactaaaaagtcacaacataggacagactaagatttgaatcgtgaaaatctccgtttttatcccatgagatacaaccatcagtattatagttagtgtacaaaaaaaagaaatatcaaggtataaagatggggagaaaggcattagaactttccagtcaccattatttagagaggcatccttccattactgctgtagctaatcaccattgccatctacctgaagctgccaatgctgtactttgcaaaatgcatttgtgctcaagttggttttgacaagtgaggagtatgatcttttattaaactaatgccaggtactgcacaggtcaaattactggtcaacccagaaagtctattttctaaatggaaagtagagaagctacgcatgcatatgcgtcacaacagagacatggccgatattctagaatgtgtctgccaggctcgcttgccattttcaaagactgtacattctcaggatgcattcacaacacaggccatagctcctggaatttagtagattattatttgctacacagctcaagagaagccacaaactgcgcactgatttttgcttttaagaagttagattgtttcttaaagtctaaccaatgcacagtatctttgaacctaatgggtctaatatttggatgccatatcatgtttcaagttgctaggcactctgaagacaaggtgatgagctcaatgtgcacttatagctattaaatgtaggtgagagaaccaaccaagaccagcaaactgcttttgtctgtccttaacaaactgccgtactgaggacaaaatcctccctttcgtacactatactaagtagtgctagacataaatcggggagagccattgaagtccaccagtaacatccacagatgaatgcaatttatgagaaattcctaaaggttaagtagataacttagagttgaggtatatgattggccaactgacttaaaacagattcatagaaaggatcacatgctacaaaagtgaagagacaaaatgagggtgccatttatctaatttaattctaattaataagctgtttcttgtggacatcaagaaaatatgtggcatggggaacaaaactaacagcatgtaacgaattggctttgtttcttttaactgattaacatttccttaaatacagagttttgtttttaaagggctgtttgtcataacaatgtacttaaaatttttaaaggggaaggtgaatattgctgttaaatgagacagggagagaatgttcagtgggaacatgcaggtacccctgtctttagcaatctgcttcctccttaaaaagtgcctgtagaatttatgagaagatcagctgaagtcatctctgatctttctttctctgtaagcgtcaggatgagagctctgaaggagagctcaggaacagggcctttggggtctggtgggaaatgcagtgcatagcagaagagtgaggggtggttccaagggtagtagcctggtctgaaggtttgaggggaatgagttaccatgggactttacattcccttccagccacagcacatcctattgacactttcgcaaacatggggcatccagagtttgtgtggatgataggtttttgttataattagcttcattttcactgggacaagggtagtgacagacaacctgcccaagtcaacagcacaactataccaacacatgacgaaagggagggaggtcccaaagttgatgtatcattgcttaggagggcaaaagcatggcacagataccacctggggtagcttccatagcagaggttctacatgaaccagggcctgtggggacagtgaatctgtcacatgaaatttgaacagggtcacctgttgacatctgtggtcaggatagatcttcaaaatcaaacagactttcaaaaaaattgtttatggtatttctttttaaatacagctcccaaaaccacctgttagttttaaaatttgatttaagaagcattatactttagaatggaataaagaaataactgctccttgagttccatgcactagactaaatgtttaatatatcttatatacggtgttttcaaagagtcttgcaagatgttatcattactcctattttatagatttatagaaagctttttagtaatataggtattaggaagggagggagggaaggaaggaaggaaggcaggaagaaagaaaggaaggaaggaaaatatatgaaaagacagtaaggaggagtcactgaggttatgagtgagagaacttctgatctaattgtgaacccctcatgatggcagcagcagcaggccatgtggagcggccactgccctcacactggctgcagatgggctgcctcagggacgcagggcataggggaagcggggaataggggacccaccaccaccactgctgcctctgcagccactcctgccaccactgctcgcagctctgatctcagagcagagttgaggccgagcctaggtgctgtcagcctgactgagtgtgcacatgttggggcagcactgagacaccagccccttgctgcctcagcacccccagactttaggtactgaccagggtggaagggaagccaagtggggagctgagggcaactcagggcctgcagatgccccttggcgtgagcagcctgggtgccacagttggtggcaggaggcagacaggctcctgggcagaaggggatggatccggtgaggtcccaccttcaggccagggagggcctgaagtctgagtgctgggctgtcagccccacagaccatagtgggaactggtggtgccttttctgggaccgcccatggctgtccatggaccagctggcatgcacttcatcccctctgaggcccataaaagttccaggctcagccaaagcaaagcagatgggacaaccagctgcaaaaaggcacgactctctctgttgttagctgaacacctgctgggatgaccagctgcagagaggagctaccctctctgatgagaactgaggacttgcttaacagagaggagctaccctctctgctgggaggtgaacactccggacgacctgcctaacagagaggagctaccctctctgacaggagctgaacattcatcaggacaccctgagacggagagaagatgcccactatgggtctcctctgagctttcctattgctcaataaagctcttcttcgtcttgctcatcctccacttgtctgcatacctcattcttcctggtcacaggacaagaactcaggaccagccaactggcaaggctaaaagagctgtaacacaaacagggctgaaacatgccccttgctcaccacgttgcagatgaagagaaggagagaagggctgtggccctttgaggaccccagacctgggagctccccaagccagggctgtgactcactctttggggcctagtggttcctgttgtttccaagtttccaggtgccactgcattcaccagtgccagccagggaagctgctgtggtgctcctggtccaaccgctgcctcacggagaactggcagccatactagcacccggaaccgcccaccccgtggcagcggccaacatgtctgactgtgcagtgaccaaaccccacgttcactcacacaccccttgccattccatgcctgactcgcagtctcccttgaagacatgggatccaggccggtagtgtgagctgagtgcagcctgccaggccaggtgggcagaacaagaccaacgggcctgagcaaaacttggataaaggtgccactggccacagaggtttctggccaggaaaataacaccccaaagatcttgtaacactaatattttcactgtgccaaattacaagctagaaaattataaagattgcacagataatatatcgcaatttattaaatattttgaaatatcttttatgtaactataaaatgtatactgattgtcttctcaagggattggcacgtactttgtgccatactacagcaattatttttcactagctaagtgagaaacttcacccagaatatgctgtatttaaaagttctcttaaagtgtaacatcatcccaggatccaattgaaatcagagattacgatgtctgaccaagagacaaaaatcaatgtcagaaaattcataaacaaatcacccaaattccaagtttagcatggtaggctactttggtattattttacttatacattccatttgctcatgatttaaaaagacaaatacctcaatacagttcttgacactgattaactctcttccatttcaagacacttcaatgacatatttctatgcatgtctataccattaattttatttaggcctcaactctcaattcctttagaatgagtattaaagcatttcccatttggtagatagatatctatgcctctgtatgactaccaatatctaatttttcaaagggctgataggcacactgacagacaggaacagaaaaggagagagaagaagaaagggaaggaagaaatgaagagaggaagaaaagatttaatttagtgaaaagattatctcccacttgcactttctatcaatgttaggttattatttctaactgcttgaaagattaccttccagcatctcaaaattgttgtgttgaaaacataccatgtcatttgccttcccagtccttctcctcttactgagtgttcatttctgtttttggcatattcactctcccatataccccacctaacagcctcagcctcctcttctgccttctcctttgcccacaataccaattattaagttctactgatttatcactaatatgtcttatccctcttttttgtacccaaaaacaatggccatggttcactcctaaactggacattagaatcacctgggagtcctaaaagaaaaaaaaaaaaaatgaaagctacaggtgcctgaaccccaccctaaatcaattaaaacagaaaacagtgcatgggactgggtaattaatttacagaaaattccaacatgcaaccaggattgagaattactgaatgatgccatgatatccatagcttcccatctggtcactctcacttcaggtgcttcatctcgacaatcaatattacactttactatggatccttcttttgttttcccttttcgttctttgagttttgttttctaacgcatctgtgactacagctcttttccgctcaaaaaataataaaccaactttaatagcttactcctgcaaactaacaccagaaatactgtttggcctttaagatatttcagagctgctgtcaatctattttcccaaatacatttccaccattgcccacggagaacctaaaattctctcatctcgatgcctcagtacaggctgttccctcatgtaaaatgccttctttcccacttttgaatttacagaatttacccacatttttcaattctaaattaagtccttggaagccttctttgatcttccccatctagatgaaatgtaccatcctttcgactcccctatcacgctttctgtatcttttatgaatcacaatagtctatatttcattatagttattttaagcacatgtgttttctcccctttcacattcatagaaccttgagaaaattatacatgcccctggtcatctatgaagtcttataactcccaaccatacccagcacatagtttcaatgcatacatgagcttggtaaaggctgtcccagatactatcccctaatcctggactatacacttttgagtatttaggacggataataatatcgtaaatgtgatctttgcacctctattacacgtatatttgtttatagtttggcgaattagctatggaatacaaagtctatgtgacataccttgccactgcaatacattgatatgacatagtgagagacgaatagatccatgcgaagccctaagctggcaaatgtagcacagccagattacagattcatgtgtatcatcataggactgaagtttagatgaagcataatataacgtgatgagtcttttctcttttatgaatatcattccacctcattgtcatcacagagctctcttcccctctaccaccttttgtgtttttaatttttaagtaaaatgactttactcttctaattgtacgtatttattataaattagaaaatgtacatgagttgaaaggagatattctaatggtgatcaccttgatgaataacttttaagaattttccatgcttattttacatattttttaacaagaaagaggttatatcgtaccattattttgtaaccaacgtttcatttagaatatactgtgaatatcttttatgaccacaaataaattcatcatgtttatattataaagagtaaagattacatttaaatttattgttaaacatttaggttgtttctgctatttcaatcagaaaaagacttcaaaacttttttgtaatcatatctttgcacatatatgtaattcctatatgtgaattactcctacatgtaaaattactgaattcaaaaaagtatatttttaaggcttttgatatatttaacaaattatacttttaaaataattcatatattcatagcagcaatgtgtcagaatgtccaattacctagaccactgctaaagctataacttaatactttatcattggccatatttttatccactgtccaaaataatgaattgcaaacatttggcacaatgtctacatacaaactaagcaaccagtaaatgttcgtagaccattagcacagctgaccaaccttctagctctcgcatcatacccattcctccattccagttgccaccatgggacttccctgccagttgccttcaacatctctgatctcacctgggattatttcacattccagaacagcatgcaatcccagcttctgctattcacaacacaagcacacgcattacaacaggacaatacacatgcatgaagaccataacgtgggtcagagcagaaaagtggaaatggtatgttccaatgtttgagggaaatttgtcataattcaaggtataataatacctggatcataaacacgtgttttacagcaacgaaaactgtatgatctcaccatcataactttttatttaataaacagtcatgggatattatgacaaaaacaatcacctacattctgtgtgcccgggcaataaaacttcctgaactattgatgtgcttagtaaggctggccattctgttttggtgtaagacactcaaaataaccactggtttagtgacataaatttcaagaagatggcctaagtggttttgaatcactcatagacaaaatctgtgaagtcattcttaccattccttatgccatagtcatgcattcttaatgaaaacatgttatcagcaacaccatttagacattcacttaacatcttccacattaagcctctagatttgcttactacctatttatgcattcaaaatactcagactgtgcatccgttttgttcaatagagtgataaaaggcccttatactgaaacagatgagaaagttatgcattacatacaatctcccaggctcattcagcagagatgtaggcaaatgacacaatgcttatcagcttttttcatatttcctttaagtggtaacatactcaggaagccatttaatatagacacactatttgaccaaaaagaacctctaccaatgctttagcatctttttgtagagttagttttcaaagcagattcatttacatcatccactgctaatttactcattaatcataatttatcacattagatgtgctgatcatcattaaaaataatcatttattctctattctaacctgctgcttatcatgtacctgcaaattgggtcacacaggaaaggtaactggcttatttgaaaaggaacatgagagcggataaaactgaagtgggaaagaaagagaaaaataaagaacaatgccatctttcccaattttatgttgccaaactccagaatatcctgccacttcttctatacaatatttccagtgtatcaactacatgaatttttaagaggaactagtgtgatgaactgtactagcttcactttagaaacagtagtaaaccagttccacaaagagaagatctgctggtgtcactgtatgagctgaaaggctttgagccaatatgaatttttgtaacgcttgccttccaaccaaagtgagttattaccacaacttacaaaaacatagaccatttcttttaagatagatccatcttacaggataagctgaccacaacttctcatctatcaactgcacactggttaagttggcaagatactttgggaagtgaaagtagctactatatccccaaagtagctataacacagaagggagacgtgtgtgtacacatgcagacactttcaatgagtaataaaacagatttaaaatgatgtttgattgtatttactggagaaatgtagaagtgtattataagaaatctttgtaaacaaaaaaacatttttatagatacacaattttgatacataacaaaaatgtttcatgtagcacaaaatacaatggaaagtgatttgcctgagtttttattacaaagattaattatagaatagagttttacaatacatatttcctaaggaaagtctataattaatattaacttctaaatattatgacttttaaaatattagatgattccaatgataagatgcttaaatatttggctatttaaaaatattttcttggtacgcaacattttactttaagggctatttttttaatgttttaatttgtttttttgttgagacagggttttactctgttgcctaggctggactgcagttgcataatcatggttcactgcagcctccacctcctgggctcaagccatcctcccagctcaaactcccgagcagcgaggactatgggcacatgccacaacaccatgctatttttaaaatgttttgtagagatggggtctagctatgttgctcagactggtctcaaattcctgggctcaagtgatcctccggcctcagtctcccaaagtgctgggattacaggcatgagcccacactcagcaagggcaacttattaataagaatgtggatatgtggacgggcacggtggctcacgcctgtaatcccagcactttgggaggctgaggtgggtggatcacctgaggttaggagtttgagaccagcctgaccaacatggagaaactctgtctctactaaaaatacaaaattaggcacagtggcacatgcctgtaatcccagctgctcgggaggctgaggcaggagaatcgcttgaacctgggaggcagaggttgcggtgagccgagatcgtgtcattgcactccagcctgggcaaaaagagcaaaaaactccgcctccaaaaaaaaaaaaaaaaaaagtggatacgtgatggataaacaacgggaaacataaaaggcaaagtaaaaaataaagttgacttgcctatacaccagtgtttttgcaaatgaaacagtgacttaaaaaatatactgaaaaatgcccagcattattcacatttagaccaataccctgacagagatcatattctaagtttataaggttcatgtcagttttattttgtgcaatacctaacatgttgtaggcattcaataccttttaaagtaagtataattatttttggtcctatggaaattttaggtatgtgtctatgtcccttccagatatttttcactaaatttagcattctttttttttttttaattcatttctctgcagacccaaagctctaagctgaaaagtatttggcaatgatttgcaggcttccaaatattctcattcagtatcaggtaaccattagaaccaataacattttgtaggatattaaaattcttattttctggtatacttccaattgagcacatgtagcaagaaaccaaacggtatttattttacatattaagtccatcttttctacacaaatatccaaattcttttttagagtgaagagaaagaatctatattcatatatgcaagatgattatgagaaaagcgttctgcagatgtctccccacgtttaatcttgctaaccacgatggatctctgcattttcacacagtggccccgcccattcacaaattctcctgagtgagctatttgggggtacaaaagatggaaagcatgacaactggttctatgctcgggctctgaaggcatgtacaagcaagcagtgataataatagatgataacccaaggccatgaactaactctgtccacacagagaactcaaattgatgttaatcggaacctggcacacggatagaggctagggtacgattccttggtttgtagatggaaataaacccatgaagaactttaataaaatgagttctagatggaacacagtgtaatgcagtaatgtagttcttttgctttttttccttcccagctacatctctgtaaaataactctatcaacatttccatgacagcattttaaatctgaggagaaaatgtttcattcttgccttctgtgaactgaaacacatacacactacaaatttaaaaaatcaactcaaagagggggaagggccgttttttctccctcaccgaaatctgttatgttttggccaatctttttgttacctttttccaaatggcattaaatttgtgaacatgaatatgcatttcacctctcctggtaagagaacttggataacacttggcactatagacacaaggtaacactacacgaatattcttgaaacaattttcagttggattacttttcaaatatcaagtccctaatttgtatccccaggcagtgcagaccctggtagcagctcatttcagtgccgattatgcacgcttttctagagaaacacattatctgagccccaggaatatgggaggctttccaaagaagcacagacagtaaggacctttatttgccagctaactttttcccctgtcctctaatttacagctcagggtattaggtaagaaaacaaaggattttcccacacagaaataaactttttgaaaaaccttcaaatgagattttaatgacactatttaccaatatagaatgcatgccgaaataaactgaaacacttctggtggtggatttttctttttccttttttctctttttcccctaatttaactattgcaggcaacatcatagcaatttaagttggttttgtgacaaattattaggacacttattttagaaggaaaatcaaccaataattactgccctggcacacggctattgttcacagcataaacagaagctgtggctgacagctgatgggcccagccccctgctatccttagaacacatttgcagatacccaagcctcttgccagactaagacatgctgtagcaatgcttttcatccaacagagctgcactgaccaggttatgctggctacaacagaatgacaccattttaggacctcctcccaggttggacttagctttagaagctaaaaatactgttataaatactagggattccacttgtataataacattggcctttttgcaccactctaaaatatgaatgtgtaatcccaagtacttgagtgttagatacaagatcccaagtgtttttttagtgtccacagatcatgatgataagaagaaaatgctttcttgtatttgagtaacagaagcatttgggaatgtatgccaggtcacacacatgagattctagatgaatttaatcttagagaattagaaaaggggtctgcaggttattgtgagataagcctttattccataccaaatgtaaagataaagcctctgggatctcaaaagttgagtgatacatgctgcttctttccctccatctttatataacccagtcatagtcactaatttaatgaaaggaaaggtgctttaaagctctctgtagcacctttgttcaattttactgtctgaagttttttggtaacctagacagagtaaaagctgccttttgagatggatctaaaaatgccatgaaagtagatctcctttcagggctgttgtttcagagggaaaaagacaaaagagaaatctaaagggatgggctgcagttaataattaaatatctattagttactccaattcgctacataaatggcctctgggggctgccagagcatctttccaagtcaaagtaaactacagggaaagacaaaaacagtgtttagaaattgcaaaacaacacagttatacttttacttagactggattacatacaaagcattcggtaatatagtcattatttttttaaagggtcaatataaaggttctgccatccttcactacccatcccatgttccaaacagtcaaacagctcccaccagtggtcctgaaccctttagtatatttccacacagttcctttcccttaagaatccccagtctgttctgaatggctaagctttgcctgagaaatcacaacactgtaagggctagtaccgttgcaaattcatgatctacagcctcaactatacccctctgtcatctatcaatcaacctcccacccttcactactctccagcaatcagcactgcactgacctctcacctccaagagatcgatgcttttgcctcctacatcaacagataaaataatgccatcaaacatgaacttgatggcaagtcacatcctattcactgtatacgaatttctaacttagaaaccatttttccctttatcttattcaagaccaattgcttcacttgtgctcttgatccacctcttcgccatgccctaggaaccttggtgcatcaattgtcccatctccctacataatcagcaccttcactctcttcctctttaacagctacttccccttaaaacagggcctttcactactgacattttgggtcagactattctttgttgtagagcctgtcctgtgcattgcaagagattgagcaacatccctggcttctacccaatagataacactaacatcctagctaccagttgtgacaatctaacattatcaaatgtctcctgggaaaacatcctaagttttagcaccaaaactactgactgtatctcaagaaaccacaggatggttggtcaccctagctcagatgcctccaaacatagtcaactaccccctacttggtactgctctattccatttaaatattttaatttctgcacatttcacctagcttataagtgttcatcttctctctcttctgctagactgtgagccaacaaaaggcatgatatgtagtgggtactcctccgatattacaacgctcaccaaggatcatgcttccactaaagtttatggagtaaacgacgagttcataagatttaagcatataccctgtacatatgagcatatttggttaaagccaaaatacaagaaaaagaaatacttatgaattaggcacctacttatgcttttattgacaaagctatataatcattatatatacatgtaagccagtgtaaaaaagatacatacaaagattatattccctctgtcaaattcaaactgccagaaacttaaatgtattttcaatttttcataagcattaagggttataataaagaaaaattacctaagtgaaacaaccaataattatttttggtaaaaaataaacttaatacatgactacagtaattggtttcccttcctatgtatttatttatccttggattttagtcattaggaaggcaatattgttcaagaccattaacttgccagaactgtactagcttctcaagttgaccctaatatgtgatattattagctctttttttctgttagactttccctgtagcatcttcatcaatctttctagcaagattgtttttttcataagaaaaacaatttcacatactaaaacgtaggataataggaattcattcaagattcctaaacataacttgtaaatgtaattggaattagattaacaacaagcaatcaacgattcaaaaaaattaaatagttaaaaaaataggaaagatgagaggatagtcttcacaaagtggcaatccagcctagttgataaagtactcaactctctggttatccaaaaagacatggaaggtttcctatgtaagcaggtttcacatgtgatacttctctaaggcacctaaataatcaacaaatacaacttctgctttcctcccctgcctctttggggaaatgtgttttataattgtaagtagaattcatagtttgatcgcagaaaggctgatgtgtcttgttttgtggccagaatttattgtaacttaggggttaaaaagagcaaagctgcaacaacataatttgtttttaaattcacagtggtccttcacccctgaataataaaaagcattttctggaaatagtgtgcctcattttaccaactttagatctttaacatctgaacttcaaattttaaacaacaatatgaatatgaaggtgtgtatagaaaaacataaaggagatttaaacataaagctttgaaaaagtcagtaattaatgaacaaatatatttcaatcaccagcagagcccctggaaatgccacatatatgaactttttcacaatctttctattttttatattccctagagcatgactctctcaaccattcccacttgctttttttttttttctttttttaatatctccttcacccttttcttttatattactgtatctttggcagcacttgcttattcttacttctggtctttccaaactcacccaaaccattaaatagacagtgctatccaagaaacgtgcagttgcaatcaggccatgaccttgttcgagaatcttccatggttcgctactattgcctacttagtgcagaagagaaagtcctgttcaaagaatttgctaaacctatcagacaagactttttacatctctaatttacccgagatagcatcaactctcactattcataaacaaatcagactcctagccttttatgaaaaaaacattttttaacatttttatttcaaaatactgcccaacagccccccacaactgaatcacctgttgttacttgttaaagatgcatattctctgagaccagatcctgaatcagaatggcacagtaaggcctgggaatttgtgtcacaaatgtctcctccagatgatcttttagcatactaaaattttacaacctttttgtgtatttgttaagactattccattattcaaaaatattttcactaaaacacctgcttcttgaaagctgattccactttcagagccatctcaaatgccttctcctgggtgaaatcttttctaatccccaatcgaatatcatttctaagggctctgaactcatgtatcactgtttggcctctctcatggccagaagtagatttaccttgaccttaggaagcttcagcttcaggaccctttccttgcataggtaccacacgtcacactggcatggtcaaatacattatacaatttgtaatagtgaggtatttccctcccaagcatttgaaggccactcttatttaccttcacacacagtggtgttagaaagctacaggaaattttgcagggtccagctagggaagctgaattgaaatatatttgttttggatttagcagaatatctttatatggttcacagttaaattattactggccttccggtataggaaaggtttctgggaatactccctactgctcactttattaactcatccagttccttagatgaggatgtcagtgacaaactagctgatatgtcataaattcaaagagtgttacaacctgtcactgtacaagaaaactggaacaccctgaaatcacatagctttacatcacagaaattatcacattaccaatagtaagttgtaaagatgaaagtttatgaattattaattttaagaaatataaacttaataattaccaatctgactggcgagggatggtagctcattatggttttgatttgcatttctctaatgatcagtgatgcagagcttttctttcatatgtttgttggtcacatgtatgtcttcttttgagaagtgtctgttcatgtcttttgcccacttttttttttttttttttttgagacagagtttcactcttgctgcccaggctggagtgcaatggtgcaatcttggctcactgcaacctctgcctcccgggttcaagtgattctcttgcctcagcctcctgagtagctggaattacaggcacccaccaccatacccacctaattttttgtacttttagtagagacagggtttcactatgttggccaggctggtctcgaactcctgacctcaggctattcacccaccttggccccccaaagtgctgggattacaggcgtgagccaccgtgcccggcctgcccactttttaatagtggttttttcttcttgtaaatttgtttaatttccttgtagagtctggatattagatatctgtcagatgaatacgttgaaaaaattttctcccgttctgtaggttatccgttcagtctggataatagtttcttttgctgtgctctttagtttaattagatcccattcatcaatttttgcttttgttgcaattgtttttggggtattcatcatgaaatctttgcccgtgcctatgtcctgaatggtactaaggaaagcatacattttactaagtctaagttttatatcctctgcagaaattggcacatgggttttttttaaaggcacacagtagtctctcactaaaagtctatctaactaaactgacttatttccatgatcataacaatttagatttcatttcaaattatttcttataataatgttttacatccttttgtaatactttataataaattatcaaattattttttctggatttcacaaatttatttgggcttggccaaaaatcttagcagcaaaatattgcttgtctttttaattaatgatgtacagagaatatgctttgttcttttatctctccccgaaataactgaattgagagaataatgcagaaaatgtagaagttaaactgattcttttcagcttatttggaccctaacatgttgcctaattacaatagcagtgaacacccacagataacatgtataacagattttatgggaattaaaggagctctataaaggactgatgttttcttaagcctattattatggaagtttatatgtaaatagcaatttaatttttaaaatccttactactagttgcaataaatgttcaatatttggtaaattaacaagtgctatatgagaaccactgtgagtccctctcagaactcacattgtgtcctattaaattgttctgacctttcccattaaggcaatttttcccacaaaggacatattgagagcttcaatgagcagtttttaataagttaactatcaagaaagatatttttctattagtaccagtagccaatatgtctatttttaaaaaatgatttcagtatttcctccaagaggactagattctctcatacgtatcctcagagatccacaaaataatatgaatttggccccataattagttttgcaattttgtgcagcatctagataaaagcacatttggaaaaaaaaaaaaaaaaaggtgaagacaagtcagaaattctcctttttttgtcctttttttgtatctagatggaaacactaccctagctacaaaggatgaggcggtatctatttctaccattgtagagtatttccttcaagaaggctggaatactacatttccttgatacggaatccctgatatataaaatgaccaacataaataaatacaattgcaatggatatctagacaattaactaaaatgctaatgaggctccaaaatccagctttagtgccaatttttacatagcatctcctctaatcgttcatgattatatttttgccgcaggccctttgcttccttcatccttaggaagccttgaacttattctcatccttcaacaatgtcaaaagaagtaactggaaaaaaaaaaagtgacaaaatcaagaaggacactgtgccattcctttgaagcagaacatttctgaatgagaggggcatgataattatgcctctcagatgcatatccacatttttgctagccatggtccttgaggatttggagacatttttaaaatgaatttcttcaagtgaatgctgagacactttggctgcaagaatctcaggagactgtgttggccagatggtggctaccatgccagagaagtcacaaaatgttccagctgaaaactgatttaagacaaggcaacaattccatattttatgagccaaaatattacactatcccatcaagagtcctccagattccaacctgttgttatcaccatgaccatcagtattttcaaatactactactaaataaaaaccagtcaagaggaaaggtttctaaccctctccatccaggaatatatctttgaaggtttctatcacttctaacttattttacaccatgttctgaagtaacaagctatctaaagtttaaataccagtagagtggattcccatctgtggggtcttggaccaagaagagggtacagaagtaattgattggggcaaatagaaaaggaaggaaatccttaaagcaaatatggggctgttcacagccatttcatcattttacagggatctgtttgagaataaagaaggattccaaatttaaaaattttctacctatggttttagatgtcactacaattaatatcaacgttctctaaattattagaatcattcctcttcaatgatgatatttgatctagagaaagaatattatcatggcagtgtaaaggaattattcaccaatgaagaataaatgtagagagagagagagagactggttcaaaagataatgcaatatcatacctattataagaaaaagaattgttcaaaacaacttcatccaaattggtggagacaccctctgttcctcaggtacaaaaatgtgtaacatagtcattaccacttcctaatgaattgcaaatgtgtttttcagaaattattttcccaaaaagcaaacatacccacctcagtttccccaaatattaaccacatttggttgaaatctttctgaaatatagcatgtacatgctcttgtcttacacaggcacatatcctatagaagaatcaataatctaagctaagcaataatagccatacacgtaacagggatttattttttaccatcacaaatatttaaaggttataggacttgcatgtattatttgttttccttttccgcttttgattctgtgtggctccgttcgtaacagtgctttgagggttaagcccactggtggcagatgactgggtcagatgcattcaaaaagataacacttatccaaattagttggagtcataaaaaacactgtttctcacattcctgtctcctattactgagtctgctttattggttactgatctttggctcccattttcagttatgcctccaggatcctccccagctggctcccagcccctcagtgaacttctccttttgaccctggcagactgccatgattccacctctgaaaccacaaactaaactggacttgttctttcttctgcaatgacttcacatactctgcatttggtcctgctaagccctatattgtatcaggcagagcaatcaaaaagcaaacctcaaagaagtaaggttttatatacaaggactcttgactttccacttactctttacctttttaaatttcattccttccatcaacttacaggaccttccacaacctgacagttgtcctggatagcagtaacagtgagcaatatgactccctaaaaactaaccttcatatggcatctcagacctcagaaaatcacatgagatttatcatttaactgagacacacacacacacaaacacttgcactcactctggctatgaaagagcttgtatcatttcccttttgcagatgatgaatctgaggcttattgttctcaaaatcagacatttttctggttatagaacagtcccaagttcagatattgtatctataaataccctgctctttttcatatgccagacccttacaagctgaagagacaaaaatgctctggacataaagatctacctggcctgaggacactaaaaagaatcaaaccttattataatggtcagagaaaatcctaaaggagaaatcgcctcttcatcatggtcaatacacagttcagcccaggaatatgattcactgttctaaattgcattgtcaagtattcaaaatcagtctcttatttctcattaccaattatagcagaaggttgtatttatagtgggggcatttccacatctagtatcaaggcagtactatgcctgacatatagaaaaaatgactttgtattccaaagggaaattttaatgtctaggaacaataaaagtgttagaatataaaatgtttacaaagaaataaaaagttcactttaaaagtttaacacaggtaagaatagctgtaattttacaacacttgttccttttcactaacgtttaaaaattttgtgcatgaaagcagaaaacaaaaaattgcaataccatcagcaattatattctactattactctgccatatgctgagaaaagcaagataagaatgttgatttatactttcacagttatttctgtgtttgtgttttatttctccaaccattgacacttattgagtgcttgtgacctatgcagttatagtaaagtaaaaatgaaaaatctcctcctggttaattctaaaacttcatagcattttgtacatttcactaaatattgaaagggacagctaattaagtatttggtctacaacacggatctatttatttatttatttacccattcattcattcattcactcattcattctacaggtaaagccttgctacgttgcccaggctggtcttaaacctccgggttcaagtgatcttctaccctcagcctcctgagtggctgggactccatatgcataccaccagagccaacttttttttgttttgtttttcatagagcttttcaaaacctacagaagaacaataacttatgaggatttgatgtattttacataagtgagagacaaccaagtcacaactgcatgtttaattacataaatgtatatgaagagcaccgaggttcaaactctcaaaaggaagatcaaaatcggtccctacatttgttactggggaaacggggtcactgctatgttggaaaacaaacaaacaaacaaacaaacaaacaaaggtcagactccaagaacaggatgacaagagaatgcttgaggaagaacaccaatcttgggatcaagagacaaggaagcatctctgctgctggttatgttcatggtatggtctgggtacaacagggaagagatgacatacaactatagtctatctgtagcccacacctgttgtctaattgtagacaactcttcagggctctgatacagcctaggaaaaatggaaattttcatcctctggcttttctccaacctccaaacctaaccctcacaagggtttcacttcctacttgttcatcccagtagcatagactcaccaattcaccataggccccaatactccctactgcctttccctcaaatcaggaccattttttcacttttatctggaccctgtaagcatctgaatttgtgattctcaaacttttatcccgtactaaaatggatattttttttccattttgcaaattcatttctgaaaacaactgttttaaattttggttctgtggcacacacatttacctttttatgatgattatcttaaaggaaacctctttctacatatgtatataaaagttaaatgctaagcatattatctaaagtcagtagagacacaccagggaaggaattcctggtgtctggaatatacaaataaaaaggttttgttttcatacacttggataactctaaacttctcagaataattagtctgttagcaatgataaaacctggtataaaaagtcaaatactttttattttatcaaataaaaactatttggaattgagcttttgaaactgactcttccaactggtcttttgattgaaagctaattttttaaataatatacttcttataatgaggagaatatttttcaaacatgtttgaggaatggaacacccaagaatcttgttttttttctttccaaaacgaaactagtattgagataattggctttttttttttttaattctgggtccacaaggtaaaagactcacaaggaaaaagctactattaagaaaattaaaattttggttaactttttatttaccaaactaaaaaaaaaaatatcactgtcactgaatgttaggtgggaaattttgttctgcatgtgattgtaaaagcatagctgtgattgaggattttaatagtgtatttttgttgttgttatttatttattgggaggcagtctcactctgttgcccaggctggagtgcagtggtgcgatcttggctcactgcaacctacgccttctgggttcaagtgattctcctgcctcagcctccccaagtagctggggttacaggcacctaccaccacacccggctaatttttgtattttattagagatggagttttaccatgttggtcaggctggtctccaactcctgacctcaaatgatctgcccgcctcggcctcccaaaatgttgggattacaggtgtgagccactgtgcccagcctttaatagtatatttgaaacatgatggtactatatttgcttaaatgaaatcacaaaaatgattaattaaagtgtagatattaccaattaagtcttcaaagtgcattaaaaaaaaaaaagcaagcttaaataattggcggaaaatgttttttaaatcactgtgtttcccaagacgatctctgatatttcacactgcttacagatctttccggatgtcatggaaaaatatttcctgcagtcttttcattatctctaccatgtcgagaggatattaacttttattttaaccaacatcatctggagactgaacactacaacacagtgcaaaaccaattggctcttcatcctctccaaactttcactagaaacttgaagatatgcaaacgtttacacctatcatcaaataaatccattcaagattcatatcagaatcttctcttaataagcctttaaaaaaatgaccaagcatcatattccttctcatttctcatcaccatcatgtgtatctatcaactcttctgaatcatattaaccgtgaccatcaaggttcaaaattttcttagtgaatacggacattttcctatagagaacacaagtgtgtagatgctgccaatcttttcttcaataaaggcaaattgttgtttaagcactatgggtacaaatacaaggcaagcacccatccctgatatcaaactgcacaccaagaagcatggaaaaacaagcctttatatagtactccctccaatgtgatagatcagccaagtggcatgaaagttacacctgccagtcaatctatactttcctagtgagcagagaccaccagctcatatacttccagatagctctggtgtttatggtatataatcctcttaaatgcatgtttgctgagacacagtaatgactcacattgtatatatccccacactacactattcctgcatacagccagaagctgctttaaaatatttccccagtcatattcatatacaaagataaataaatttttcagtttttcaccaagttttaaatgcaatctcttgagtcccatggttttatcacagaaaggtacacttcagcttaagaagggaagaattaaccattcaacttctaacaataacagtacactgaagacctaattcaattggcacagtctgggaaatgttcaccaactacacacaattgagtgatagaatgcaaaatacttcatgctttcttagcagaacactaaaatctatcagagaatgcaccttgattttgtcaaactacagcaataaaagtaaagcagcaaaaaaaaaatatgttcgctcattctcaaaaactgagttcgaatttttttggagggagggtgtggttctttcacaagcagtttttaatcaaaagtaagattttgtttatttgtttcaaatgtgtcaaattgctatgaaaaacagaaacaaatattaagctagccattgtgtccccacgaaaatgcagcaggtcttaatactctcccagctgttctgacaaccactgtaggcagcccttcccctctgtagacttggctgcattgcactggggagtagcatgatgtccacttgaaactgtattatctggagcttgcttttaatgtaattacttcaaaacagagaaaagaattaaaaggcagggttttttgtttttgttttccatgagctgatcctttgaacagctactgagaggaggacagcttacctgaattagaaagaaaagctcaactgttaagtcacttaccctaattaaagatcaatacagatattattagacattcattctacccatctaatccagagttgtgatgttacttttcataatacctgtatacacttactgccaaatctgttttcctgcttttcctattgtctttttctctattatttcccttcaccccacttttatttctcttcacagaaatgcccctgcatgacacatagtaacaaaagtcacagtccctttgcaagaaggaagaagcttgaatttaagcagttcttttaaaaattcaatatccaaagaaatactttactgtaacagtgtcattgctactccttagacttgttattatgtttgtgaaagttaattatctgataagatacactgtggttactactgtcacaaaaaaatgcatgggtatgtttattaattcaaagtgttccaatgaaataaagtgtgttaactaaagaactgaacaattatttccccgtaattattactgcacatttaggcgtttcataactgttttttttttttctgaatgaaaatcactttatatttaaaactatcagcatttacagctttgtattgtaaaagaatatgctattttgtccatatttttatactaaaggcccaggttgaaaaatccaacaatttaaattgaagatttttttcccctgctgtagaaaagtgtcaacatttgagcaaatcattaaacatactagaacaagaacctacaactaaaatgctgattatgattcatttcaaatattttaagtgttaagtcaacattcaatgcaggataaaatgaaatggtttgttcagaaggaatagttagagatctgcttactattctttctatttctgttattttcctgggataatccataaaaatcttatgtgaaagggaaaaaaagagaagatagtttaaaaatgaaagccataatctgaatggaattcgtatggcttcatatcagaaagcccttataggtgtcactgcctcataaaattctagcaataaaattgaagccaaatactctcctttcacagaaactacctttttctcaatatctaaaaatttgttctaagacaattggaagagaaaatacatgcactcctctagccaatagatctgcaaacttctaggtgactcatttgataacaggagacaaaattgtacaacacactaaactctattatttctacatcccagtagtttccagtataatgaatgtcctgtgagttttctgcagacatctagcagaacataactgccccctcgagtgaatgctacaccacctggattcaacaatacatatcactttggccatccatgacctccgccttctcaaactgatgtacgactaaaaacttaatattttcacactagcacaagcattgtgtcttgtgtacatacattatctctaacaagacacaagcattgtggcttgtgtatgcacattatctataacaatgttatttaatataattatacacaaaaataaagggaatttggagggccagtttgaaacaaaaccagaaggccaggcgccatggctcacgcctataatcccaacactttaggaggctgaggcgggcagatgacctgaagtcaggagttcaagaccagcctggccaacatggcgaaaccccatctctactaaaaatacaaaaattagctgggcgttgtggtgggcgcctgtaatcccagctacttgggaggctgaggcaggagtatcgcttgaacacgggacgcagaagttgcagtgagccgagatcatgccattgcactccagcctgggcaacaagagcaaaacgtcgtctctaaataaataaataaaacaaaaccagaaaattcaattttttttccatcttgtttcttaaatccaaccagttcaacatatcctcatgtactggttaagcttccctaaaccaaaaatctgaaatccaaaatgtttcaaaatccaaaactttttgagcactgacatgacaccgaaagtgaaaaattccacatctaagtacttaacagaaacttcatttcatgcacaaacttatttaaaagattgcataaaattatctctgtgcaatgcatataagacatataaaatataaatgaattttatatgaaatttcacatacatgaaatataaatgaaaggtaaatataaaatataaatgaattttgtgtttagacttgggtcccatccccaagatatctcattatgtatatgcaaatattccaaaataaaaaaataaaataaaataaaaatccaaaatctgaaacacttttggtcccgatcatttcagataagaaatactcaacctgtatcataattaccctgattctacaggcaattaatgcagtttcagtaagaaaattaagaaaatagggagtctctctgagcctattctggcttgagaagttgcccagtaaaaaataataaaaataaaataaaaactaagaagaaataaaatatacagatcactaattagaaaataaactataaatcatggggttaagttggtcacttttaattttttgcaaaagtgaagatacccaatgaccactggctaccatgttgtgctagtgtaaaaatatatcaccctggaaagaaattccagtggtaactgactcttttagcaccattttactcaatgtaagcaacaccaagaacagtgtcatgctacctaaagaggtactaggtctgaagaaagccacatgctcatttattctttgtagtaaaatctattctttatcatcataattattcttctaacctaaaagaggctttaattagatgttcaaaaaatagatcaaattaggtgaatattcaatttgcaaactcagccaaactcgacaggtttcattctaattacatgcagatagatacatggagacacatatgttcaccacagttttccatgtgcttcctctttcaggcaactgcaagattaagccaaactgtatggcaaagcgttccagaaagtaccatcttacatagaataagataatttctgatttttaatcttaactgtaatactaagagactgcatcaaaacaaagactagacgatttacttgtttaaaatgtcaattatataaagagatggtgaaattactactagaagaaaaaatgcaggccgaaaacaataaaaatagtgaaaaatatttggaaaattgcaatgtatatgcactgtgttaagtgattcataactgtctttcaattaaaactcgaatctttactataatagaattccaagagggattttcttagtctcaaaattgtgtctacaatctgaaattgagaacaaaaagtgcaaagtattccaaaagttagagatagcttgcagtgagcaagccagaagcttgtgggaacaattacataccttgagctcagaccaaaatataccagagcagatcctgctacaagtacctcccctcagcctgtccaccccttccccagctgtcacaagaagaggatcaaagaggagcactgaacagctttgtggggagttcagcggagagagagaagactcaattctctctcctctctatgggaaaggggagggaggtactccttgccccaaagtgatgaggtttcaaaatcagcactcagaagattagggatgcatgtaggcagacagtggcctcttattccttggttggatgcacacagccccactctggtactgttactagagggtagcggggtgaatttcaaggagagcttccagagagctcaggaatatggcatcttatctgttttactccccctccactatggagaaaagaagtttcttaccatgtatctcctgaaggctggggtagacctgagcagagagactggcgctcacttctgctatagagatttctgagggtataagacccaatatgcagtccataccagaaagacagacagacagtggtgaggtgtaccagggagaaggatgtgggaaatcccatccctagagtttgggttgggggctggaggaagtccctagtattttccattctcccatataaaaagacaccaaggttagtggaaggaaataggctgctgtgctatccaagtcacctcaaggagaagtcgtggaaaccccaactcatgcaaatctggaagtttcaaagagagacaaggaccttttaggatacagtaaattagaagagtaagagtagagaaataggtttgtccaagaaccaagtgagtgataatccaggaaaagtaggctggagtcacaaggtgggtcacctggaatgccagttaaaagaagtcatagaggttatgaataacgtggaggttatgaataatgtagagcctgtgaaggtttgaagctagagagtgagcagtactgtaggaaggaggagtgggaagttaatcaaatatcaagcaagaactttgcaagtccctgtgaaatgatgtcctgctttctctctcctctcctacttgtgccaaagaagttcagattgctaaagagaaagattataggggtcggtgttttctgcctctttttttttttttaattcatcaagtaagacaagtgagtaaattatcaaaaatcactcagctcactaacagagggacagttcactctttgaacccatggttttcttctctaaccccttgacttgggcaggaggaaaaggcatcagaaaaagatctacttatttaacgaaaatccctaataagacacaactgtattaactttaggcattatgtggtacattagatatttagacttgttcgtcctatatatctgctattttgtatcctcttgacctatatctcccatttcctttccctcccctgacctgtagtaaccactgtttcattctgtatctctgtgtattacatccattacacagagaatgaaacagtggttactatagctatatcagcttgaatgtatggattatagtctacatgtaagtgagatcatgcaatattttgctttctgtgtctggctaataagtagattttacctgcttttgtcagctaaaatatgtgagatgacagatgttaatctgcttcacaacagtaaccactatgctatctatatgtttctatatatctataagtatcccatactttcgcgttctaaactttaaatatgcataataaaatttgttttttaaaaatctattcagttgacagaaatggatgtcatttacagtgttccaaaagaaaggatgacaaaaagagattcagtgccccaatagcaagaagacaataggtcacctgccaaagcactgaagaactaagactaggggtgtggatgaccactgggtatgtgaaatgctacagagaggcgacagagaatgagacccagtaaaagcacatttctttcagtagttagagaggatcactggtacatttgagagagcagctgagtttttccggaggaagacagattgaagggaagtaggtggtgaagaattaaggcaaaaatttcttgaaagtgtgaggacaaacacagcctgtgtgtgtggatgtggaggtggggggaggatgtttccttcacttaatactgtggcaatagagacattcttgtatattccatttctacctatacagtgtgcttggagagtatcagcttgaaaaaggaaagtgaagaatacaattaaacaaaataaagacaaaatagaaaataaatgtattctaaacgaataacccaaaatttgaacaacttaattttgcagaaaaatgatgcgatacttctcatttaattttttaaaaatatatgcaaggtatcatccctaaactaatattcactaaatgaatttaaaatacaactaaagtaaaatgagagtggaaggcatataaattagtaagtcttgaaaaggtgttttggaaaaggggaaaagtaacaatggtaggaaatatgtatcatgtaaattaaaagaagcaaaagggaatgaaagttcgcccaggatacagaacatattaaagatacttttaaagcttattgctgtaagtatacttttaaaacttattgctagaattttcctgaatccattttctaaactgtaaagcagtttagaaaaaaaagtccactttttaaaaatgtacctagccaaatattttatctgtaggaatcagagaaatgcctacactgaatacggaaatacattcacttccagtaacctaaaagggcacatttaaagaggcatagacctaaaaagaaatctccagaaattattttttacacacctattgcttgaagagactgctgcatcaaaagctgcaacttacgacttttagaaaacacgccgcgtgcctttcttgtggttccatatgaaagaactgtatctagaaaggaccctatttttatactttgcactatttgtcctgaatcctttgaaaactctcttggacaatttcaaagatattggagtaactaaatgttggaaaagatacattctttacatacatactcaaatattcatcaggaaaggtaaacatctcacgagtccataaacattcatgggtacaaaatgttttcattcacaagttttcattcaaactaaattaccagttaaggctattatctcctcatacatgtgttaaattatctatttgtgttgtaccatctttttggttgtttactgttcatgttcatgacaatttgaagtcaatctaacactaataaaacctttgatgtaaccttcttggtttaagttacctctagatcttcttaaatccatttcttcgctgagacgtgaaaataattttattagtacagaagctctctaattaaacagaatgagattcaagtagtttatgcaaatgggttttcatcatatgataccaaatgcaaattaaagggaaaagtcacctgagacagacattaattttccccaaaagaatttgacactacacatatctacaaaacatattgactaaaattttcatttcagaccttcaactttgtctaaatgtaatctttcgtgctttattagggttgggcaggatgttacagatattaatagtgacatgctagggttccttgtaacacacatttaactctaccttcttataattactcattaatttgctatttcacttcttaaaaatattaaaaagggtgtaaagttagaaattgaatatcctctaatgaacaaatctccagttattaaatactcttaggaaagcaccacttcacaaatagatgatgtcacatactgtccctgaaatagtattcctttcagatgaacagataaaaatggcaactgattatgaaatttttagttaaggacctaaatataatgtccctagttagcaaggaacatgtaacataccttcattttccaacatcttaatttttgtactctgtgtggggggggtgggtgggtatgtgggggtgtatttttagaggcctaaatcctctcaatctttctgtttcaattctgccaattaaaaacagtagacacagcaaataaatgtaactggaaaatttatatggaaaagaatcagaaacctcctatccatttcctatattaaaatgagcttatcaaacctgcaaaacttaggtatttcataaaacacttgattttttttctactaagatatccttacacatcttaccatagatatttcaagctaatttgtattagctgatttttttttttctctgagaatatcagatcatctctcaaagtatttttctctatgaaacacagcggctgtctccatttaaaggaaaacacacacatacgcacagctaaaggttaactgaaacgtaagtagaaattgcacaaaacaaaatttgaagcaagttatgacctctttctcatgttgtcacctattttccccatcctaagcttgagttggctccatctgcctaattataagcttaaaaccctctgggtggtgactgagtctatattctgcactgcacttaacacatttttcatgctctataaattattaataataacagtagtaatagcatatacttttcctactataaaagaaaatatgaacctcacaactgccacttatttacactctcttaagccttccagataacagacagctgggtaatggttactaagatgactttgcctcttccttctattccatttttaattctccttaatgtatctcatttatgtttttctctttctatatttttaatttatccctctaatttcttgacctcgtatatttattctcttattctgaatgcaaagcagcaccagtattttttaatttagctgctaaggaaaatatctctatttgtgtatgttcaattggcataacgagtgcactgaagtagtgtttctcaactttggtgctattgacattgggggctgcatgatttgttataagtgctattgacattggggctgtcctgtgccttgcaggatgttcagcagcacccctgacacccacccagtacatgccagtagcacatcctgccccctattctgacaaccaaaaacgtctccaaacgttaccaaatattccctgggaaacaacttccccaccaggtggagacccactgcaatatggtaaaactattcccttcactgtgtcacattgctggagctaagacggaataaagatgtgataaatatgaaatgggaataacaaaaaatcacatagacacacacacacatatacgcatccaaaattattttgaatgtgcaattcaagcatttaaaaagcctgaagtttggctcatgcctgtaatcccggcactttgcgaggccgaggcaggcagatcacaaagtcaagagcttgagaccatcctggccaacatggtgaaaccccgtctctactaaaaacacaaaaattagctgggcgtggtggcacacgcctgtagtcccaggcactcaggagactgaggcaggagaattgcttgaacccaggaggcggaggttgcagtgagccgggatcgcgccactgcactccagcctggtggcagagcaagacgctgtctcaaaaaaaaaaaaaaaaaaaaaaaaaaagcatgaagttaatacaagcaaaaataagtaaaattccaatactaaggattatttgatggctaaaaaattagttctgctactttacttatgaaagctaacctggaagagctctaagtaaggcactagctgtgatttaagaccagtatgttttaacatccaattaaaataaatccttctaacagcacttttataaaatcacttagcttgttaaaacatataaaatgtttggctcccctgggctagattatgattaaggtacattcagagaggaaaaaaatgcttctcatttcacaaggtcacagtccatttccaaatgagcttatacttcactattttccaaattgggttgttttttgtatgtgttttttgtttgtttggggtttttttgcttccttcactaaactagccaaggtcctcctacttctgagcattactgtaaatctagatactgtcaaatagcatttaatctccaatgaattttaaaagccttgtaaattacaaaagaaataaccagggtatatttttttttccttttaagttttctctcctgtggtcagtaaatacatgtcaacatccaccttctttattttaagcaccaatgcagatagcattaagtggatgtcgcatacacttgggacatatgggaagcctcatgagataatgtttacatgcttgagatccgcagttgattccacccgggtttgaaatctggctcccaacctttctcccctatgtgtctttgaggatgttgccctctctaagcctctagttcctcaagtgtgaggggtggaaatttttgtacctattttatggaattgctatgaaatggaaatacaaaggttttatcacatatcctgcagagtgagctgtataataaatgttgactattacagattcattaatcaatagatgagcttcaacgtaagtattgtctcacgcaaaaaccccactcctccccctcctaaatctatgtaatcctgtatttctttatgtcatacccccacctccaggtacacactacacacatatgcacacatacacacacacacacacacaaaaaaaaaaaaaaaaaaaaaaaaacctcacgcctggcaatcctattccctccatcacactcaatacctcaagttcctatccaagacatgatgaagccctgtgcctccttcaacatcatcaaaacattccagttactaagcttgtggacccatcatctcacgtcgccttcaacatcttagacagatcttatctccatcaccttgtctccacccctgccgtccccactctgattcagtctcttgccttctacaaccagggcaattttagaagcattccaacttatctatatttacagtagcatccctactctgatacactcttcatagtgaagtcagagtatgttttctaaagaacatatcccatcattacttccctctgtgacatactgcaatgtgctcctggtccctgaccttcgggatcaactccaaccctcagaatctaacaggtaagtctatttatgacctgagccccgtcgttctatcccattttgaccaatagtgagtgcctttcatacaaacctatacaataaccacagcaaactatctccaggtccctgaataagtgacattactcctaatacttttttgtatattaagactgttgcctggcatgtaaatctccatgcatttgtttgcctagctcactttctagacctcctttaagcatcaccttcttcatgaagcagtttcagaaccctctgaggctgagagatgctccttcatctgaattcccttcttacaactccctaagcccaccttaaggagcttaccctccattatagtagctttctcatctatcacacccaccaaaattcacagccaaacattagctcattttcatttttttttttttttttttttttagatggagttttgctgtgttgtccaggctgtggtgcagtggtgtgatctcggctcactacaacctccgccgcccaggttcaagcaattctcatgccccagcctcctgagtagctgggattacaggtgcctgccaccacatccacttgatttttgtgtgggtttctttttttgttttgattgtttgttttttgatggagtttcactcttgttgcccaggctggagtgcaatggcgcgatctcggctcaccgccaccactgcctcctgggttcaagcaattctcctgcctcagcctcccgagtagctgggattacaggcatgcgccaccatgcccagctaatttttgtatttttagtagagacagggtttctccattttggtcaagctggtctcgaactcctgacctcaggtgatccacccgccttggcctcccaaagggctgggactgcaggcgtgagccaccgtgcccggcccattgtcatctatattttgttgttgttaaaaaaacggagtgcttggcacacagtaggcacccaaaataagtctgtaaaaaagaatgcctgaatgaaatgaacgaataaagtgaatattaaggaaattaatcgtttcatttagttataaaaagccataatggacaaagacataatcaaacggcatttttaaatggcttgcatacctaagatagccataaaggatgttgcactttaataaaaaattaaagatctgaaacacagaactgattttcaggttccacttaataatttctaaactggaaatctcaacaatcaaaacatgggagccgtaaggatgcatgcacacatacatttatcacagcattattcacaatagcaaagacacggaatcaacctaaatgttcatcaacagtagacaggataaatacactgtggtatatatacatgaggaaatactacccagctatgaaaaagaatgagataatgtcctttgcagtaacacagatggagtgggaggccattatcccaagtgaactaacacgcaggaatggaaaaccaaacacctcaagttctcacttataaacgggagctaaacattgagtacacacaaacacaaagaaggaaacaagagacaacagggcctaattgagggtggagggtgaggagggtgaggatcaaacaactaccaatcaggtattatctgagtgatgaaataataagtacaccaaactcccgtggcacacaatttatctatatagaaccaatctgcacatgtacccctgaaactaaaataaaagttttaaaaaatgtgatagccagattattatcagaaaccagcaaggcataaagtggaacatcaagtaccactttaatagcaaaatgtctgatttccccatgacaatctgtagtactccctaaattattaacagacccaggcaccacaagcagcggggactcacttgggaagcgagcaacacatttatttagttctaagattgatgaatcagaggaaggggaaagcagcagcagttattttgatctgtggggggtcttggtgccttttgtatctcagcctctgctggtgttgaggctctttgtgggtgcaggcctgcaggctgcttgtgtctctctctcctgctatctctgctgacagcttctctgtgtgacagcttggaatcccggcagtgaagtgtgaaaataaaacacaggcaaaactttacatgggaatttaaaattggagttatatttttgaaagttttgaacgcattaaacatccagaaaactgcttccttgttagagcgcacagggaaggaggagtgaacaaggtcaaatccaattcagacatcatttcacacgaggctccacaccaccctcactgtccttacgaccccgggagtcctagattaaatgttctgagtcaagttaatgtcaactatttgaccttttcaaaaccacggttttccaaaagttaacatctaccacatcacacttatgttccttctgttacatggtttgctcttttaatagaagttttaaaaaaactttgtcataatctaaggagatgagagaatctatactctcttgtctcttcttgattcagtcttctctcccccagcccccttcactttcagggcattccagaattcaagtttaacgagggcaaaagacagtcctgccaaagtcaacaatcaatacttctcaataataaaggaaatacagtattttggcccatatttgctttctataggataagattccaaaagcgaagaggaggataattatcaactccaattccccaaaacctttgtagtataaatgtttctgaaaggcactgtgttttgcaatggtttgatagaacaaactcccttatgtataaaatgacatatttttggccacagatacataaaaacacagaacacatttatatccagtctaataacataaaattgatggcatggtttggaacctattctctggattaaaagtagggtccagtagtagaaagggtgatttaaacaacctaaaataaaatgctttggtaaagaataaaatgtttcatgcaaatatgcattaataatactgtgccaataatatcgagagcagttcatgtcacaatgcaaatcagaaaaacaatctcaggaatttctgagttaaacagatgaccctgttcgaagtacatagagggttgggatggaaaccgataagaaatggaaggtggtagtacaggaatagcaaccattagcctcaacagcctataaaaaggattccatctttagaggcagaaactagtcgcttcctactgaatttctggaatcctaaaatgatgcattctcatctagcatcatcccacaacttcaaagcagtttgttcattatcatgcaatttcagcaaatcacatcctcttgatacgatttctgatctggaaattcagatatttaaataactgttctccaaattcctatttctaaaactgcttcaaaattcctaaactttcccacagttatgagaaaaatgtgtgatccttgatggtcatcacttcatattcactgtgattatctttgctctctcagagaatgatgtcagcaaaagtttcctttcaccacttgcgggtatctatgaaactacaattttacacaggatgcactgtcagacagcatagaacgccttcaactcctgaggcaatgttgctttcaaattgctaaattatcttttaaaagattcaccaattatgttgcaggaaaaacacatgtggtttagaatataaatatttacaacagatactgagattcagaggtgaaagaatgaatagtgatgtgatgttttctcccaagagacatttgccatgactgagaccactgccaaagaaagctttgttctccattccctctgtgttcctgcctgctgagctcttcttccactagtcattacaactacttctttggatagcttatgactgttgagcaaatatggcatttgtgccttacaaagctttcaatttaacaaaaatttctcaaatgcacaaatgtactaattctaattaccaatatcttatatttcacactgcatgtctactagagaaaagatcaattggccagaaagcaaattaatctcattaaaatccttaatgtaatccagtacagtaacaaggagattaaatgtaatattgaaacatttcttataaatcatattttatatattagatactatgattcttttgtttctactgcataattacacatatatcattttgaataatttatattatctatttaaaatctatttaattaatcaagagaaataaaggaaagaatgaaattgaaaagaaaaatttatctaaaagccgtatgtaagaagcaaaagcgctaacactggaaaaccaatgttgaaaagaacccacagttttcaatgataccacctgttcctccttgaaagctaattaaaatacaccttaggaaacataattgcctacagctttaattacatctcttccaagaataaagggctaccactcccaggatatgttttctcactcagctactggtgtgtcttctctcgtgttgaatctctttctgacatcataagtgactgcccacctttccatatatgtgcaatcatgagattcaaagcctgtatcatttcagaacctagtaaattcaatagcaattttatatttatacctatctctacattgagtatatatacacacaaacataatgtacgtacatctatatactatatatgatattaaatatacacacacagctacaattatactacctagcaaaatacagatactatataaatacataaacacacatacacacataaatacatacaaatatgcctatacttctatatctatgtctttccattaccagaacaaattatgatatgcatctgttggcaaatacattgtttgacattcagaactaattttccactggaaacaatgtcccagactagcccatggcaggcttacaaatccaacatgtagtcgaatgattggcctcacgggactgatttgagtttcagggccctggaagaagatatgctgtgaaagcagcagcaacacaatggaggataggaaagggaagaggagaaagaacacattttcctatatttcctaggttcaaaaatttgaaacagtcactttttggtattcctcctctcccttccttcacctatctcctgactttgttagtgccctcaagtgtcctccacattctgcctgtggccctctaccaaggttacgtcattcccaatcacgcctcatgccaacacatccacagcttccctgatcaatcatccatagacgcagacactcagtgtagatgaactcttttagatgttagaaatcagtttttagttaatggtaaagtccgtataaccaaagcaaacacattttatttacatgtttgtttcttaaagaacatgcttactaatgcaaataagaaactgagagaactatagctagcgaagaaaaaaaaagaaagaaaaagagagggcatagatgcagtgggttacagttttacatattttggaacaggctagtttgaagcaacagtttaaccaagaagctgctagaacttgagataattctgttattcccagccttctctttttccactgagagaagcaccatgtctttaaaagcttttgtccctcaatctgtacctcctccccatctccatacacacacgtatctagactgcttaggagaagcttctccaaccaagatcaggttagcagcagaagaaagtggtggtgcaaagccgccagccctgaacgatgtgcatgcgtcatatagacaagttgcttttgtagagataccccactgcaaacattcttttaaagatgacctgaaaattcccatccttgaatataaattcatttctccactgtcattattgtttctagcaaactacttaatataaaaagcaactacagcaataagaattcagtgattgcccttccccacttaaaatacataatatctactgttttcattattacattcttggaaaccagtacattacttcagctctaaaaggtgctgaacaaccgactacggtaggagaagacaatggaaatctccaaaaagttctacaaacatttcccacaaaacatgcaaggattttttttaaacccttaaatatgaaaaatcacttcatagcccacatttatgaacatatgtacgtaaaaaattcaatgagacagcaaaatagcgatatagacacctttgtcattcagtacaagctaaccacacaatgtgcagaatgtatgtgactcatcaaaacataataaaaatgcattatgcattaggtaaacaacaaatagtgtttttgcacgagagaagtctaaataagaatgtaaatttatttattaaacctcttcaatgagacttcgactcctaccgggatatacccattcttagcatgacaaacaaaaactaacaacaggagttcccagggaggaagcctgaacttgggctttaaataattaacacctttcaaagaaaacataaatgtttggggggatacatatccaaattacaccaatatcacacgtacccccaaaatatgtactatgtcaataagaaataaattaaaaacccctgtggtacacaacatatacatttttgcaattaaaaagaaaactatatgaaattataaaaaacatttaaaaataattaacacccttttttcccttaatttatgcctatggcaatttgttgttagcagttaagccaaaatgttatcctagtgtagcaggtgatgtacaaagctctttcttaaaacattgaacagaacatcacatttaaggaaaattaaggaggctgaaatgggggaggtctgagtatattttcattaaatatcaaagatttagtaatactaattacatgttttcttcccactcagttaagtgtataaaacagatattcactattttagctcttctaatgtaggcctatcataggtttttgctgttcctttctgagttgttgtttatttttttgtaagcgagtttctgctgttgctattttgttttcagtatttgtttcaagcattcaagactatgacttgcaggtttcccaaaaaaagtgtctaaaggcttttaaacctgggttctagagagatgagttttaacaataactccaacagttaccttaatcactgccttaataggtccacatgattttccacatcttaacttttgtaagaggaatataaaaaaagagcagcaggcttggaagaaaaggtggatctggcttaagaaggcataccacttttgagtgccacacacaaagctgtattttctgcatgtgctgtggtgtctctctgaaggaattctcttcaaatctgactttgcattcatgatttgactgtcaggtttgaaagcaaaatttatgaaaacatagggagaatataagaccctaaaagttaagcttctttgaaaaatgttaattcataacttggataagcctctctctttcatggagacactcctttctcaaaaaaaaaaaaaaaagtgtatacataagtgagagagagagaaaaggaaattacagaggacatcagttgtttgcaaacagttcacttttttcaggctggttttaataagcctccaattcagctccaacctgactctcagaacccacctcctctatatgtcatcaaggaaaaggaggaagaaataaaatttaaaagtccttcttgccagtcctatggcaggtcatattttccaaagatgcacatatctcacgccataaggtctccttccactagcagtggggagtctattccctccatttgaatctgggcacagggttgtgacagcactggccatagagtatgctggaagtgatgctatgtgagttcccagctaagtcgcaaggagacacggcttctgccgactctccttctggcagtcttcattctgccttcttcccttttcttccccgaccagaaccaggagtcctgggctaagacgtaagggttccaactactccgaagctgccatgctagagagaactcatcaggagaccaaatacagacagaaagggaggtgtctgaggagtcctaactgtaccagcagcgaatgttcaagaggtcccaacatcaaccagtgggcttgtgagtaggtaaggtcagaagactccagctacccacccctccttagagtcttctcattgcagctaagatatggtggagcagcgaaaagtcatctctgctgcgccctatctgaattactaacctatagaaatctgtgatagtaacagatgtctttttataagctaccaacgttttgtgtcatgtattatacacatacagaagctgaaacactcccaatgtgattgccagcaaacccaattctctgcaaaataaaaacaagtattatgtcccaagaactatattttgtatatcatcacttctcctcacaatgattttgtaagccatctctattttacaaatgagcaatactgggctgggagaagctaataaggtgctcaatgtcacacagctgacaagtgaaccaagattggaacccaagtccctctgactgcaaaccccatgatactcctctttccttcaatgatatccctctttctttcccctacaagttcacactgcagaggaaatcatgtgactaaggtctcagttatagtactgggctcagtaaaactagcctcactcatttcttcctttccaactaacctacactgaatcctatcatttacagactaatacacaaattatagtaatttctatatatgttgaaaaataataaaagaatgagggagctatgttaagattgattaacaggaaactatttacaagaagacacctatttagaacaatattaagggtgcctgctgtgttttgattttaagggttacagattgcactttgacaaaagtgcttctacgaattataattatattcatttacttcccaatgaatattttcattcaaaggattttactgctctctgtgggcatatgattaatatgcatgtgctcaaacaatattcacaaacttcacaatcctagagagagaaaaaacagtgatcagctttccccagtccgagtaaattgctttgagtgaatttctgcacctgtaaagatgctcttctggggatgggctgtgtttgcatccggggctggatgtcaagatgcccttctgtcctgatatttttcaagggcaacagcattacattgttattccaatggacagagctcataaaaagacatccttatattctggagcctttaggagaaagcttttctttggcagtgaatgaaaacaaaggcaaaagatgaaaggaaccatctttcaaaggaaacaaaaaggcctctacaaagaagtgcataaatgtagaaagcagaaaaaaaaaaaaggtacattatatttggcgtgagagtagagacaaagcaaggcccaatggagcaatactctttctttacaaatactgtcagaattttggggaaaaaaaaatcatttttgaaggttccaggaacaaaaccaacagacgagagcttaaaatatacacagccacaatgtttccattttgttggagtttcagaagaactcctgtgggcaaacgctgcatgtaaaacagactgggtgtgatgtaactatatcaaggcaacaaacacatcaggaacagttggaaaccagccaatactttggttttatataatgtccatcaactggttgggctgattttttaccataaatggcctgttttaaaactgactgaacagtggacttgaataaatagtgtaccaaactaacaccatagagaaatatacagaatcaaaggtgttcaagaatgtcaagcaacagcacagccacagaagaggtacaggccgatattaataaaccaaatctaatcacattttcattttccgactgaaatctttcccaaagcagtacctttacatacagtgctttttgttaaaaataaataaataaaaataaaatgccaaacgagcactaggctcctctttattatgtctttaaaaataaaagactcaagccagattggacagttttctttgaaattctagtttcagctgctttcagcggctcattttgagaaacatctgtccagtctggctcttggggagatgttcaaagacaagtgttctcatctgaatgctaagggactctcctaagggagtcaacagtcctctgaaagcaagcagaaactatcaaaacatctataacccttgaacttctttatcaagttcagtgcacagcgtacaatatgactcaatttcatctttagtaaaaaataaagtttgtctgcttcactgccacctttaagacatcatgttgttttcatattaaaaacttaaaatattcagtgaccaattaatttggaggcaaaattggccaagtataaagttatgcaggggagaattcagatttgaacacagctaacttggaatctgagttcatgtacaacatatgtatatacaaacccacatgttgcatttgtgaatgtaggcacagagtgaaaattctccatgtttaggtccacaacacagagccatgtcacgaagaattaacacatgttctaattctcaccagaagtgatccaaataggttaatgaacacctcctacatttcagatataataatatacattgtcacaacaatttcataaagtaggtaatagctccattttagaaataagtgaaggggggtcaaacaagccaaaaatgtgtccatgttcacatagttgcaactggcaaagctaggatcggaaccagagttattttgactaagaggtccagaaacttggctctaccaagccaccatccaagtagaaggttaccaaataccaaaatgaggaaatggtaaaatattatccatgagtcactgaaactacataataaaaaggaagccaaaataagttttgacgcatttaaagctaactctctaaggcatgggttaaaagttgaaagctagctatcagaagtttaattttatattctctcaagtaagagaaccaaacaaaagtagatcaaccagaccaaacttttaaaacactttaacttctctatgaagctaatgtgtaagatatggtatttcccccgggggagaagagcctgtgtaacattgcttttcactctcatgattgaaagaaaaatcaattaaaattatcctgggagacctttcataccattccaaagagccaagaaaatgctggatacattctgaatgcagcaaacactagactctcctaaaaaatattccacatatattgtttgctaaatcaaattcagtccttagattttacaggtttaagagaatctctggaatacatggcagaaatcagaaaaaaaaacaagcttatcctacatttggtttcaaagcgctttctttcaagatctcccaatttttctatgttaaaatttgtgatggcttctctcaaaactctgccagaaatttatgaggaatgaaaaaactcttctaacagattcagaaataaaactatggcattttcaaaggaaaaccaatatgaatgccttttaaataaagtttggtaaggacaacacaaaccgtatgttccaggtatgtgatgtgaaccacatggtctgtgaggcttcttgcacttgatatgctcctcctaaggtgccaacatcaacaaacaacaatgtgtactgtgactgaagttacagccaaggtcggatggaagtgtgggctctgttagccttgatctaattttttaatgtcaagcaagaaaactgacattttggggtacaatattgctatccaaagcaaatatgtggaatggaaaaaaggcaaatattaaattctgaagtaaacaaaataagaggtccttaggtaaaataagagtttttttttttttctcaactagtctccttttctcagagtaagtttcacattttatatactactcatattccctgagaactttacgtacatcagtgtctacatttggagatgatgaggttatttgatttaaaattgagaggccttggttcaaatctttgtctttgataatctatatgtataatgtcccaaataatcagaaaaataaacaattgagttatatcacttttacagttttttgaaattctgaatgcctacaaaattattctttattacaataaaaagttcgctatataatgacaatatgagagttatgtggcttaaaacaatttttatttgcataaatagtcatcctagtccacttacttggcgagtgatcagtaatttacaatgctgaataaatgtatcgttttcataagggacagatgtatttttatttttccttcttatccttctcatttcccttatcccattattctttcagtacataagatcaaatgatgaatacactgagttatccagatgtggttcaaaaaggaaaaatatagccaggcgtggtggctgacgcctgtaatcccagcgctttgggaggccaaggcgggcggatcacaagttcaggagatcgagactatcctagctaacatggtgaaaccccgtctctactaaaaataccaaaattagccgggcgtggtggtgggcgcctgtagtcccagctactcaggaggctgagggaggagaatggcatgaacccaggaggcagagcttgcagtgagccgagatcgcaccactgcgctccagcctgggcgatagagcgagactctgtctcaaaaaaaaaaaaaaagaaaaaaatatatataagatggtatctggatagcaataagttataaaaaaagaaagttatgtaagaagaaaaacatttagtaaacacgtattcttcaggtttcttattcataacacacaggccataataacccttgcaatggatacattctttttgtagaacaccaagctatccatccatagtcaaatgaggttataggagatttaccaaaaaatatacatcaaactacattcagtctcaattttctcatccatgaaaaacgaatggttttatccaaataatctctaaagtcccttgcaggcctatgactttatcactctaaacatctatgcctgtattcatatcattagtaccatcaacacacatgaatgcatttgaagaatgttctaaattttataaatcagggcatgagaaactaatacaggggcaaaaaagaggctcttcaaaattatggattagaagcaggatggattcattaatgtttttaatttcactcctcctgagaaatggagatgtctaaatcaggctgggcaatcactaaagtgactctgagaatcatccttacaaaaaaactttcttgttaaaatacagcaatatgattccacctctaattgataccaatatcattattaaaaaataaaaataaaaaataaactgtgtggatagaaagatgaaaacaaaatcagagtaagagtatatgactacagagaagggaatattttccctctgtactaattagttcatttcttgctacctgaagacttactgggttaatctgtggcaccacagtgtagtagtgtttttacactgctgatgaagacacacccaagactgggaagaaaaagaggtttaactggacttataattccacatggctgggaaggcctcagaatcatggtaggaggtgaaatgcacttcttacatggtggcggtaaaagaaaataaggaagaggcaaaagtgggaatccctgataataccgtcagatctcgtaatacgtattcactaccatgagaatagtatggggaaaccacccccatgattcaaattatctcccattgggtccctccctcacacatgggaattataggagtacaattcaagatgagatttgggtggggacacagccaaaccatatcacacaggatgtaatatcctatttggttcatctcttctttagaatattactgtttttctacactttgagtgaagagggaatacttatttggatagaatatttaaaatttgggccaggcacagtggttcatgcctgtaatcccagcactttggaaggcaaaggcttgtggatcaactgaggttaggagttcaagaccagcctagccaacatgatgaaactcccatctctactaaaaataaaaaattagctgggcacagtggcatgtgcctgtagtcccagctactcaggatgctgaggcaggagaattgcttaagcccaggagggggaggttgcagtaagccaagattgtaccactacacttcagcctaggagttacagcgagactccatcttaaaaaaaaaaaaaaaagaaaaattaaaaaaattcctctcctaacaattctaactccttctgcaacaaagtcacaaaggtaggatattttttcacatatatgactttacataattttcttctttaaaatatttagatttggccgggtgcggaggcttgtgtctgcagtcccagcactttgggaggtcgaggcgggcagatcacaaggtcaggacatggagaccatcctggataacgcagtgaaaagctgtctctactaaaaatataaaaaattagccgggcatggtggtgggtgcctgtagtcccagctacttgggaggctgaggcaggagaacggcatgaaccaccaggagggagagcttgcactgagccaagattgcaccactgcactccagtctgggcgacagagcaagactccgtctcaaaaaaaaaaaaaaaattagatttaatcatatggtcagtaatttatccataggggctaattttattcaagagaacacaatatgtttctcataaaatggagcaaaatgcccaaaacgatgttaaaattaagaaagaagatagtaggtaactgacagaggggggagaatgaaaaacaaaaaatgtagagaaaagacataaaaaatattaatttcacaatagtgaaatctactcttagtgaaaactaagaaaactcttttagcaacttaaaaatatacaggacattacttaatttcaattttcaaaatatgccaaaggactttgaatattcaagtacctagacctcccttttaacagacaattttaatcttgaatattaagcagacttaataattaagtggaaaaatggatttgactggggcatttctgtcttttcctccatcaagggaggtattagtaaatttcacaaaagtaagcctctgagaacatgtgaaagaaaaaattatctttctctcctaagagttcagaatggaaaacaatttgtaaactaagaatgagaagaaaggagttcaaaaaaataatgaaatggcttttgacaaaactattcctcgtggccacatccccgaatattccccatggccactgttctaaaatatgtactaactcatttgattcgagaaggacctaagggagaagagaaaaaaaaagaaatgacattttgattaaagaggtcgtttatccaaacatatgcgtatccactattggtttcttcctctccatcctactgtgctgcctccaagggaaacaatttctgaggagagtgtctacagtaccatgttcagaaggattctgaggctgttcttctctagagaaaaaaaaaaaaaaatagaagagtgctattatcaaatagtaatgtctgttttgaacaagggataaagagagtagcagcaacatacaaaggagaaaaaaaaaatgaacaaacctctcctggttggtcagaatctctataaatcttgaaatttcacaagtcttttgaaaccttcattacataagaattctattggatttgaaggtgatttgcctgaatatacttattggtacaaacagcattctgaattatcctttgaggttgtaaaatagtaaccagattccaagaggccaaacaatttttacctcagtacttgccagctttcttaaaatacgttggttatgacttcctttcacattttcaatgtgatgtgatcaaatcctcctgtaatctaaactaactttataccaaaagcaactttatgcaactttattttattccttcatattagtcccatctcacaccaagtatatactggcttgcatttcaacaacaaaagtcttgaaatagtgccattcaactcataatcatgttggtttttccttcatacctcctatttctatcattctattgcatactcactgggttcagaactgagggcatctacttcctggatttttactattctccctttggaaaattccgactctgatggtctctaaaattccttcttctctttttgatcatatttccttcttcagactctcaaacagctttgcattaatttataaataaaagattttcacttacatagattagtaataaaaaataatgaaaataaactaagtaaagagccagcaggtggattagagaaggctgactgctgttataaacagtctaccatctcagtagctgaacacaataacattaattgtttcattcatgtcacaatttaatgtgaattgtacggaggctttgctccatgtagacttaaagactcagtttcttccatctagtggttctatcatctcttcctggaatcttccattggacctcctgtcttcagaagccacctccattcttaaaacagcttagcctagaggtggcaccactcacttccacatcatttccaatcacatcccattaaccattgcctcatctttcctagctgagaatttgatttaatgatgtgctcttgaaaataaagaacgtattagtgaacactagcaatctctaccataggaaagctactttgatttccaagaaaatggcatattgaaattagccctatctgtctcaaaaagctgtcatgaaaatcaagtaagtcaggaacgtgaaatacttttaaaattgttaagtgctgtgtaatgatatggcacactgacctacgcctccttttgataccttcacttctatacttccacaaaagattattttccagacttttaagaacccccaaattcataaattttcaaaaagaaacacagtttttaacatgtgtcaagagttactgtcaacttaatccacaagacaatagaataaacctaaatcaaaacatcaatgtttggcagtaaactaaattcactactcagttttgggttccattcatcacaccaggcttaacgccagtgtgattcaaatccaagctccaaagattagcaaaatgtatacagactgcatgtcctgacactctgaggtatgttattaaaaacagtcaaaattgtaaatggtaactctatgattgttaggcctatgtggtattatgcgccgggagttttggggatacttgctcgtgtcctttgcacctgaaggttgaaggtaagtttcacagttttttccactgtctctcagtccaccaccacaactcccacctatacttttcaagcagctctgtaaatcctgtctacttcctgaaaccttactcagttgagtagtggaacacctcatcttcttgtctcctatggacttgaaagaaactcccacacgggatcattcactttcctctcatgacaaacatatccttcttctccatgttgacgtacgccaatgaaaataaactgggatatcagagaaaacatggaaagaaactgtatcctagcaactcatggccaaatataggcattaaggtgcttaaattattagcattcactatgttttttcatttccctaaagtcttattctttgcaagcactttatcagtacttagaaaataaggtggttaagcttcctccaggagctcatattctacgaggggtgtacatcaatcaactgtccatattcgatgtaagtgacagaagtctgagaaatcgctctctggttacgaggaaatgtagcgtgttaatcaaggtaagtgagctgtttctacagagcaagtcctgaaactgctttgcatacatttgcatgttcattgctctgagaagtcccatagtaaaagcaaagcaaagctgagaaaacaacacctacacacacaaaacacttccacaacaaaacaagccaacagaacaacttgcgttgcttgaatgtatttttgtagggtgacttttttctctatagacttgttaatagccctcagattttcctaaatgctagattgagaagcactgaaagatgcagatgttttaataatttaaaagtagataatttttactttacaaaagcattggaaatctcaaaagaaaagtctgtgtcattaatattcaaatgcttgtacgtttaagtcttcttgtaaataatcaggtaaatctctgaatatcttacctagatgtgaaaacatgatttaacaatggatagtgatgggatgtattttaaataagagaatatatttaaatgcagagctaataaatttttaaatctgaatgaaataaataattttctgggaattatataaattacttcttttgcctcaagaaggaatgggagatatgaatagaaaatagccatgggagagaaattttaaaagttgtaattttttttttcatgtttagcaaaaggaagcagaatccatagaggtatccaatttagagaagcctctaaccccaaaacaaatgcatactgataacattcatacaaacaacacttctacaataaaagtctgatggaaaacatgatttgtaatcggtcccactgaaatagaaatgttcagggatttggtattttccatagaaaagttaaatgtataagaaaaatatgtttaggtaggatctaaacatgctcaccagcagaagataaaaatgacaaacaacaatacattttattcaggattaaaaacacttgttttctgcatatgccaaggaaacttacttgcttgtgcttagacatttttacccacattcagaaaatgaagcaaaattcacaaattcaattcataatttctttttaagctgcatataataaatacctattattcatgggtgttggcaaatctgtatactacctatttttttttctatgtttagccttcggagctgcttaaatcttaaaatatgtaccttctttgttgttctctttcttactgtggagccccatggcttggaactgtaagcactgctacagtcccaaacaattctttacttgacccaacaaacatatccgtcaaaatattttgggctatagataacagaacatcctactaaaagtggtttaaaaaataaggacatcattctgtcacataaaacctgagggagggtgatttattcagctactcaatagcagctcaatcgctcagtcttttcccatccgtctgtcccctctgcctttctcattgtgctggtttgtctccttagactggttcctctcatgatccctacaggcctgcagcagctctaaacaccacatacagaggaaatattcaagaacagaaaaggaaacatctttgtcttggtgccaatcttgtgagtaaataaacccttctcaaaaactccccagtgtatttgctctaaattttcattcaccaggattgaatcacatggccatgtttaagtgcatcacttagcaggaaactgagaccacttcacttttttcaaccagtaagatttgccacttaggagccagccccacccccgcacccccacccactggcatacacagcaggttactatagaatgagagtagataaaatctgggtcaatgttataggcaagcaagaaggaagcgtctaacaggcaaacaacaatgtctgtcaatagtctgtttatatgcccagacactatcagataccaatttatattccaaggagtcattctcattggtaggtaagttgcataaatgattatatataatttttgagtaagtgataaacattttattctattttctcatctatatatcaaagctactatagctgaacttcatagaatcacaaaattctaaggcagaagctcctagaaaattaataaactgatctatgataaatcaaatcatattttaaatttcctagggatgctccctacttaagaaagccttcaactgaagtttgctttcactttgttttagcatatccagttttcttaagttggaaattactgtaagtaaatgtgagagtggtacacgcacaatcatttgctttctctctattctcagattatcttgttggacttttaacccaaccacctgctccaaaccaaaatctagatcaaaataaatgttattgactccttaccctatataggatttctatttgattgctcagaaactccagtatgacacctgacataagagagtaaaagcacaacccaagaggcgctccagaaactggatcagcagagacatcttcagaggcagcagacctcagctgggttgaggaccaaacaccaccttcacgttatgtttttcaaggtaacaacacaacacaacagagagaagaggacacgggatgggaaaccaagagggctggcctctaccattcttgctttccaacagattttctgtggcaaggctctttcccttatcttgcagatgaaggagtaaatcatcttcagtgaaattcagctctctcccattaactcattgatttattcacttaactatcaaatgtttattgaacacctacttgcactaaactctacattaaattctagatgtgtggaggaaaacagttaaagtccctccagtcttggggtggggggacaagtaatcactgagcaatccagatgggacgtgttatgaattagataaacttggtgattagcagaaggaagtagaggagagaggtccatttagagtggtcaggaaaggcatcacagaagagggggcaggggagaaagatgagttaggttagacggagaaagaattacaagaacagggaagacaatggatgaaaatgtcaagagaattaaaatgtcgtgagctaacagggtctgacataagatgacggcagagaggaatgcagaagctaggtcaaccaacggccttgtaagccaagataaggagtttttacttcattccaagttaaattgatacattttaaatccacataaattgcttatgctgtagaaggttctgagaactgtaaaaaccgttccctttcttagtattcctgccagaattgtcgacaaacatcacagctacacagaggtgcacagaagaaagagatgataccttgaactttccaataacggtttcttcattttagttttctctttcttttaaaaaatcaaatgggttacaaaatgcttgcggaagcgtgagaacaacagtaacagtttctgcctagaagaatcctatttttgcttccactaaataagcacaagtctgttgtctagtatttggcttttggacaaaacataagagtcagaaaatcacgaccatggaactagggtcaaaattaagtagttgattggaaataaaagaataaatctaatttctgaggactgactatacgtagggaagggaaaagggagaaaagggcttttacattcccttcatgtaccatcctcagcttaatagccagagaaatctagaggcccaatgagatggatcatggggctctttaaatatattttaaagcattcttttcctggtggaattttcagattgtaagtttgttgttgatttgggattttttattatttatttatttttatgtactttttttttttttttttttttttgagacagaattttgccctgtcacctaggctggagtgcagtggtgtgatcttggctcactgcaatccccacctcccaggttcaagcaatgctcctgcctcagcctcctgagtagctggacttacaggtgcccgccaccacacccggctaattttcgtatttttagtagagatgagttttcaccatgttggccaggctagtctcgaactcctgacctcaagtaatccacctgccttggcctctcaaagtgctgggattacaggcatgagccaccacgcccaggcctggatttttttaaagacaggtgtgtatgtgtgggtgcgtgggtgtgtgtgtgtgtgtgtttggggaggagcacacacaattgtatgcaatgacattattggtgggaagaataaacaactgaagttatcaaaactttctaccagagcactggtaaatatgggttgtcatttaaataacatatccctaattttccatccactgccatagtgcagaaacaacttaattacaagtgtccatgggaggctctaaacttctgaggtcatggaaagtgtcattcacagtcctctgtagtctctgctatgattatcaccatgtccacagtaagcattcagtataaatttgtgaaactttattttatacaaacataaagctttatgtcattttccatttaaggcaaccagttttaaatacaacactcaaaaaatgaggatcaaagttgatgatgtagatattgtaaaatgcagagtactagcatactgaatgcatacttatgcactgaatacctactgtgtgatagatgtttattcagtgctttacttacactgtctctaactgctgtagcttttaagactatccatttttgaaaatgctggtgaaaatcaagaatcaaggacagcgaagacgacagttagtgatagtgtaaaaaacggtggctgtaggcatagttttaaatgttcttgagaaaggattactgttaactgcggaaatgtagcaagtgtatctcctatgattcatgttacaaatgtaaaggtggtgtacatttattaacaaatagctggatttaaaaattcttcagtcattttctgttgaaagttttatctacatctgtactttatcaaggcctatttagtttcctacaaaacaacaaaggatacgttttatctttaaactcaggaaggctgtatgaccacaggttcaaaatgcatcctgaggggattctacacctgccgcctcatggtgaaactgcctgaaaactgtctccagggagagcatacagaaatactccggcataatacagaaatcgccttttcgcaggaaactagatagcttgttaccaatctgtttggttggggataacgcatagcaatcctatcctttgtttttcctgatttttactgttcttaacatgcccaataaataccttctcactgttcaagaacaggagtgctgataaacatcatctcaaaactggcatctacacccataatattatattatataataatattagaagcactctccagccactgggcaaatccttcatgagaaaacagcatccatttgaagttgtgaattcttttcttctttaaggatggatttctcataccctaccagaatttttgttatcacaaaatgcacactcttttttcagaattcctgaataatgaaaaatacagaatttatgatcctttgagtaaatttctaacaagtgatgaaattccgatgaagtgtataatgattcctcattttctttatgaaatctatcagttcaactctttgccttgaggacagatgctaaacagttgctctggcaagttattaaatcaagtttctggtttcttgcagggcctttcaacatatccccacagaaagatgaggcagacaaagaaactctgtcaatacacctcatatcattaaaagtaaaaaagattaattcctgaaataatgtaaatacatggtatttttcatgataagcatttgaggacatttttcccccatatcccttaacaactagaattaaatccctctataatgactcatttagaatacatttatttaacaaaggaaaacaaagtaaactgactccattggacaagtttgaaaataattttatgaaaacatgttgaaattaaaaccaagtgtttctgatttgtgattctacttggttgggccagtaactttcatgaatataatttcatataccaatatgaatgcttaatgtactaaataaacaagttgtaaaaaattaattcttttctgaaatggtatccatcacattgcttcagtagaatctttattgaaaagaaaggccagtgcaacgcccaaaagaaaaaaaaaaaaagaacacattcatactccatggtaatattttgcacaattaggtagcattttacattaaaatctgcagaaagcctagcaagagtttcccattgtgataagggcaaaaactaaacatggccattttgtaggccctgattgatttaaccatttttttctctgtgtattttcaaatatcagtaatgctgagaacccaattccaacatttatgatggcggcattcttaaaatatgggacatacaatacaaaatcagcaatttctgaacagtggtacaactgccagtaatcaatggttttttaaattccttattatcccatgggccatttcaaatagtttgtattttccaaatttcactccctttttaatcaatgcatgtgacattctgctgctgtaaatcttaatggaaactatataatttgatcatcatactacaaaattactttcatttaagaaactatgctgccatcagtaaaaatgcatctaaattattatttactgaactgtagtaaaaccctcgaattccactaagaagagtagtcagcataaaggaatcaaaacagcttttccatttcagaactttcacaattgtcaaacaactgctttatcatcatgatgtacttaaattcatttctactattgaatatcaccctctacaaaaagtgttattcaattacgtggttccacagcacactggaggtcagctgttaatagcaaagatgtattatgatgtgcttttattatttctaaggagtgagaaaaataatacgttgtattacagaacctcagtcacagtcaatgttttcattcatttgtaaaaacaggcaattgaatccagaagcacacaaaagagaaaaaaatcttttcatggagagtaattaaagaaaactcttgactttaccatcactaagcagtgaacaaatccacacacacacaaatctgaagttgcattaatgcagacatacaactttcaaataccctttagccaatgtttgagttgctaaaacactagtaatattcattcaaggtgtcttgtcctttaaataccattgctcaccaacaatttaaattaaaaagaggaagcataaagtttgggaattttttcatgaaagtaaaatttttcctgtaatcccagcactttgggaggccgaggcaggcagatcacaaggtcaggagttcgagaccagcccgaccaacatggtgaatccccgtctctattaaaaatacaaaaattagccaggtgtggtgatgcgtgcctgtaatcccagctactcaggacgctgaggcaggagaatcacttgaacccgggaggtggaggttacagtgagccaagatcatgccactgtactccagcctggacgacaaagcaagactccatctcaaaaaaaagaaagttaaatttttattttagtgccataattcagggggaaaaaaaataagaatcttttccattgctctggggagaaacaaagtatccaaccatggaaaggtaaaagagtacatttaatatttcaactcaagtattataatgacagaaagtaaatttctctatgttaatgcataataatttcccagccgggctcagcggctcacgcctgtaatcccagcactttgggaggccgaggtgagcggatcacttgaggtcgggagctcgaaaccagcctgaccaacatggagaaaccccgtctctaccaaaaaaaaataaaattagccgggcgtggtggcacatgcctctaatccaaagctacttgggaggctgaggcaggagaatcactggaacctgggaggcggaggttgcagtgagctgagatcgcgccattgcactccagcctgggcaacaagcgtgaaactccgtctcaaataataataataataatttcccaaagattttgtgccatttgctacatactgctcttcctttgtcacccttggatgcccaattcttatgcaatgcattcccagccccaaattattttaatctccctgaatactctgatgtgtttaccacaatactatctcagttactgccaccattaaaaatagagtattccatataaaagtgagggtttgtttctctaaactatacctattttcatactttattgtaatctttattcttttctcaatgtattaaatgtcgttctgcttttttgaacaacagaatgatcatttcctgataaatcagggtttatttatactgtttaagtaaattcatttatacatttggctttagatctgatagaaggccttggcagaccactttattttttttaacgtgaggactctcaattactttgtgtcactttagtttgctctcctactttttgtagcttttgttctcatctactttcatagcttttaatttccctgtcagacggttgcttggatttttctggaatttatcagtgggtcagcagttggtctacgtttatataggacagaatggctgccagataaataagcattttagtgtgtaaagtaaaaaaaaaaaaaatgctctgagtgaggtttctgggcttttacttgaaataaagtactgtgcttatttggtgtgccttatcttctgtggtcttttttttatacttcttgcttctcagttggatcagcatagttgaggttcatggattcattcaacaaacatttactgattacctactacgtgagttcatgagaataaagaaacagtatccctgtcttcagaaagctccagttttgaagagataaaaataaagccaacaaggacagttgggagttttttgatagacatctgtaaaggagagctgcacaagaggttctccctgggtctttaagaaaagccacaatataagaggtgcaattttttgggtttcttttagacagagtcttgctatgtcgccccagctggagtgcagtggcacgatctcggctcactgcaacctcccgtgttcaagcgattctcctgcctcagcctccccagtagctgggattacaggcgcccgccactacgcccagcgaattttttgtatttttagtaaagacggggtttcaccatgttggccaggccagtctcaaactcctgatcttgtgattcgcccgcctcggcctcccaaagtgctgggattacaggcgtgagccactgcgcccggccataagatatacaatttagttcagcctaaaaacaagaggaaggaggacattttggggagagttagcactactgaatcaactggattgactggagaagtttgtattattcataaagacaatttccaattacataaagaattttaagcagttcaccataaaagggttccatcaaatcagcagaagagctggtcagataccaaattatgaaaaagtacttggggattataccaatagtgaatctggaaatctatttagacttcctctccagaccaaatatgcaggatggtaatagactattctttgaggagatcagcaggaaagtgaagaaatatgataaagtctagaagcctagaagtttaaagtgctctttttttgttaaatgagtacttatgatattacataaaaaatattctgctttgaattgtctgagttaaatgaatattcccagattcagaattctctgttccacttctcccttaaaaattattcctctttaccctttcagttccaccattccaccacctcagtctccctgatgtcattaatgtccctgctattaccaagtccaatggacatgttcagatccatcaacagcatttgagagcagctttcctccaaacctctatgcatgcggcctctaggacacaaccttccctggattttcctccaactctattgtttttctttctcttttctcctgtttcccctcgacttctcatcctcacctctattaattctattaactggggaacccaaagcttgggtcttgaaccctacggcattgttattctcttttttgttgattttgtctaatcccgtggctctgtcaccatttatatgctagcgacttccaagagaatatccccagcccagttttctgagttctggattcaagtatcaaattgcttatttggcatctccagaaggttatttaacagacagataaaattcaatatgtcccaaaccgagctcatgattctccattcaagccaaacaactctaccctcctccgagtgtttcttatcaataaatactacaatcaccccaacaggtgctcttaacacaaatctgggagtcatccttgacatttccttatatactcaccctcaatatatgaggaaataatttacttcctcttgtttattcaacctgcctacatatttctggcatccatccacttctctccaattccacagccaccataagagtaggggccagcattctctctcacctgatcaaccactcttcccttgatgaacactgagtttacagagcaggcaaagttcacactccacaccagagccagcaacgttgtgcagggttggctgccttcccccctcccactccatcctctgcatctccctacacactccctaaactccagccgaattggtttcctctcagtaatataatctcagtaggcatttctgaatgaatgacggaagaaaggaaggaaggagttacagggaaggaggaaagcagagtaggaaggaggatgggaagaaggaaaaaaaggaataggcttaaggtcattaaaaagaaaatctgttcctggaatcagaaaatctgagtttgagtcctagctcattacgtagagtatcatgaacttgaaaatggacttaatgtctcccttacaggggatgcattaaaggttaagtgaggtgatgtgtatgaaagttgtctgtacactatcaaagcactgtacaaacagaatatggaagcttaagacaggtaaaatacccgaggagcctatcacagagataatgcaatttagatggtaaaaagaaatgaggcgagcggatcacgaggtcaggagtcgaagaccagtctggccaaatctctactaaaaatacaaaaaaaaaaaaattagccgggtgtggtggtgtgtgcacctgtaatcccagctacttgggacgctgaggcaggagaatcatgtgaacccgggaggtggaggttgcagtgagccaagatcatgccattgcactctagcccgggcgatagagcaagactccttaaaaatataaaaaataaataaataaaaagaaataaaagaaagttcaatggctctcaatctttttctccctctattgtccacaagtcataactgtataaattcatcatatccatgtaaaacaggttataacacacttctatctgagcctctccttatattactgcaattttcaataagtttaaaaaaagggctcagtgttgaccactccctgacccaaggattttcaaatttgtgtaattctcacaagaaaaatgtattattcccttaatgagtatgatcactttcctaaatttttgttgttgttactgttgttttgttttttgagatggtctcacttgtcacccagactggagtgcagtggcaccatcttggctcactgcaacctccgcctctgggattctgtgattctcctgcctcagcctcccgagtagctgggattacaggcacctgctaccacgcccagctaatttctgtacctaaatttgttttgaaacaaaagtattctataattttaacaaatgcagaggagcacatacaagaaacaaattcccagaagttaaggtatcaagtaatactagttttggattttgaattatttcctgattacttgggaacatcattttccatttctaaaccaacatttccttgtctcttaaaattcataagaagcaacagcaaagaagacataaaagatatatctgcttcttaagttagacagcagttaaacacataacaaattgagaataaaaaataatttatcatattcacataaaatagttttaaaggaagcacatacatgtcttggtagaaaatgtctttataattatgtatcacatgtttattacttactagattaaaacagtagtaataataatctactgctgatatagtaaaggcaattccctaggtgtttcttttggtaatagcacctagcatttatatttgttaagtgtatttttccatgagcagagttctctgaaagctctatcaatagtaataaaaatggccaactgtgattcggagcatttagtcagcactgtatccatatgtgtaaattccaagccaggcattcatttcaactcaattctgctgcttcactactgctatcttgtcgaccagaaaagtacaggactcaaattctcccaaagaactgccagactcacttagtccaagcaaaggagaaaagaagccaattatgaattttattacttccacaattctcctcaagagaaacattataagaaagaacactgaattaaaaaaaaagaaaactgcctcgtttccaagggatcttgatcaaaccaagcttactacggaagttcttctgaaattagatataataggattttcagggaggtttgatatttatcccaaggtaaaacaacttcttaccgctttacctttcctttatttagtctgactcgaatattattgtagttattggattagagattcattttaaaaagcaacttttcagacttgaaatagctttatggaagcatctcacatttcagcagctaaagacaagtgttcatggttttgccaattcaattcactagaagccatctaagtctgcatggtctctcttttttttccttcccctactgtggctttgaagtttaaaaagaacttcatatatttaggaaacagagcgattatcccaaggctctgaacttgagcttaagaaaaaaaagcgctcatctcaggagcagagatgcgtgagcatatgccaggcaggaatgcatgtcagagtcctttgatggaaattcacagtctcagagatgtacccaagcaaagcacaacaaacaatgaaagctaattgccaagagtcagggttgtcttcataatgcattgcatctgcatagcttggcgtccagtgttaattaaccacagccaggttgggattgcttcctgatttcactgcagcatgcctctgaagcaacagcaatgtccacaggttagcattatcctcccgtgccactgtccccgctggacagcacaaaacaccacaaatgaagaggcgaatgaagaactgaaatggcagttcttatgggatcaaacagaaaagcactgagttttactattttattacttcctttagcagggatcagctccaatcaattaatgatttaattacctagactaattaagataatgaacaacagcaagcctacaatcaattagctttatccaaactttctattttgagtataggaccttaaggactatactctatgtctttgttgcagcaataaaatatgtgggtatattacggaactgccagggatgtggtcactcccaaccttaagcaaacatacaaggtcacttgaataattctttggtgacagaaggttgtgaaaggatgttacctggatgggcaatggatatttctccatcagaaatgcagatcttaaattgaattatgtctctcaaaagcaagtaatggaccaaagacaggaacatgcccttttggtcagccagcttctgtgatttgagttacttcagagtaaccatgtaaaaataaaaagcccctttcaaacatccagcagaaagtagcagtgtttcttgattacattgttcttgggacaaagtgttccttaaattacttagcatgggctaagaaattcatatatttcctaagaaagaagtacagacaagaagcaggcagttagggaggtgagtagtctaagttctagtttttcctttccatctgttacatctactttgaaatttaaggcttaatgatctgattccctaattatattgggtgttcctcacagagagaaaaggtctcctactattgggtttaaccatggccactactaaagtataatctattattgtctacaataaatatttttcaataaccttttcctcaagcaagaaaccatataatgcataccacagtgttcacatctgtcatctcccaggtaccacatctctcggcttacctatactggttgtgtattgtctctctcagaataaaaatgatcatagtgcaagtttccttgtatgtgccagcagtattgcactatgcttttaggggaacttcaaacttgcccatggataaaaggcattaagattttatacctcacaggctaagctagctctgcaccatgcaagaaaactgactcactttccaaatgccttctaaggcacctctgaaataaaggggaaatctcaatccaacaaaaatggatgccgtgtataaaatttatatctgttctttgttcagccaaccagttattgagagtataccatgtctcagccaatgtgcaaatagaacatagaaaaagttatttaatatcacctcatgtctgttagagtggttgttatcaaataacaaaaggtaggtgttggtgaggatgtggagaaaagggaacccatacacgctactggtggaaatgtaaattagtacagccattatagaaaacagtatggaagttccttaaatatgaaaaatgaagctacaggccaggtgcagtggctcacatctgtaatcctagcactttgggaggccgaggtgggcggatcacctagggtcaggagttcgagaccagcctgaccaacatggtgaaaccccgtctctaccaaaaaaatacaaaaaaaattagctgggcatggtggtgggcacctgtaatcccagctactcaggagactgaggcagaagaatcacttgaacttgggagtcggaagttgcagtgagcccagatcgcaccagtgcactccagcctgggtgacaagagcgagactctgtctcaaaaaaaaaaaaaaaaaaaaaaaaacagagctaccatgtgatccagcaatcccactactaggtctatatattcaaaggaaatgaaataggtatgtcaaagagatgtgtacattcccctgtttattgcagtaatactcacattagccaagatgtggaagcaacctaagtgtccatcaatggatgagtgaataaagaaaacgtcctattatgtacacagtgaaatcctactcagcctttaaaaaaagaatgaaatgctgtcatttgcaacaatatggatgagtctggagaccattatggcaagtgaagtaagccaggcacaaaaagacaaatactccatgatctcactcatatatgggatctgaaaaactgatttcatagaagtagaaagtggaatagtggctatcagaggctgggtagggggttgggaggggttggggagatgttggtcaaaggacgcaaaattttacttaagaggaataagttcaacagatctactgtacaacatggtgactacagaaaatgtgatactgcattcttcaaaaatgctaacagaggccaggcgcagtggctcgcacctgtaatgccagcactttgggaggctgaggtgggcggatcacgaggtcaggagatcgagaccatcctggctaacacagtgaaaccctgtctctactaaaaaatacaaaaaattagctgtgcctggtggcaggcacctgtagtcccagctactcgggaggctgaggcaggagaatggcatgaacccaggaggcagagcttgcagtgagccaagatcacatcactgcactccagcctgggagacagagtgagactccatctcaaaaaaaaaaaaaaaaagaaaaagaaaaagaaaaagaaaaatgctaacagaatggatgtaaagtgttctcataacaaaaattataattacatgaggtaacacattggctacttagccaaatttagtcattctacaacatatacattaaaatatccagttatattcagtaaatacatataatgttgtctgtcaatataaaaaaattaaaataaaaaagaaatcatttagatcctaatggaagagtcagtctacataaccaaatacaggaatcaaagaggaaaaaagtgactagagttataaaatatgtttggtgtgctaagggaaaggtaaatagggcatctttaagtgcaataaagatgggcaaatgaagataatagagagtgcctcaggaattaagcatgtgatctctgaagtcagacaacctaggtatgaatcacagcttattatttattatgaacaaacagcgaacaactacggacaaattacttaacccctccaaactacaatttaccctatcttaaagtctaggctaataagggttcttaaaacacatgattgttattaaataatctgcgtgaagcaaggtgcacgcacatcctaagtgcccaataaatattagctctttgttactaatattagaagcttttttcctggcaatagtggaccatatatgctcctggtaatgagctacaaccctttgcaagaaagcaaatttctgaaagacttggctctcttaaaggtctcagggtcaagtacattcagctcatgttcattagctaataacattcaaaaggtaaatcaagaggatattaaaaaataaggccatgcagggtggcttatgcctgtaatcctagcactctgggaagccaaggcggtgggtcacttgagcccatgagtttgagaccagcctgggcaacatggcaaaaccccgtctctacaaaaaatacaaaaattagcaaggaatggtggcaggcgcctatactcctagctactcaggaggctgaggtgggaggatcacctgagcccaacaggtcgaggctgaggttagcagtgattgtgccactgcactccagtctgggtgacagagtgagaccttgtctcaaaaaataaataaataaaaataacaataataataacagtaataggatatcaaaaatgtgccctttcataattataaatgagtttttatgtcagaattaacaattaacgattttatatcagaaataataattagtataatctaaatactttagataagtcttattaaaaagactttatttctgagaactttacatatgaagggccttcaaacatttagtgttcacagaattattctcaggatctccatcaaacgaataaaactagccttaaactttaggctgaaataaaaattcaccttggtaagcactttgattatcaaaatatattgctttcaagtaacatttctactaagtttgggaaattaatttaaactccatgtgttcttatgtaattaatgctagatgtgaaagtatcttactttattttaatgtcagatatccaaaatgtccaatttatagtaacatttaatgttatttcatgccataactcaacataattaattaactggttgttaaatatcattataaaacactgtaagaatcactaccaatatatatgtaagataataatatatttcatcagcaatataaaataattgtcttggtaattaaggaagctcatttagttctagtaatagtttattcaaacatataattatactgtatagctaacaagtacgccttttaatcaaatatataattattaaaatattcttgagggatataattggcatattataaatatatttctatcatgactacttaaacctcaataaatgtacctttaaaaaggccttgatttaattagcatacagtaactctctccttgaaatgaaattaagtccttaagaaaaacaactaatatgaagcataatcttatattactcaaattactaaaccttgccaagcaaaaataataataaaaacccttcgagagctcatttaccaaaaatacaaagatcacgtctccaagcaataattctcagcctgattgcccagcaggaccatgtagggagcttttatgaaatctattagcccagaccccatctacagagattctgattaggttggttgggaggtgggcccaggtatctgttggttttgctttttagaaagtccataaaccaccacaccagagactgataaaacgtatttctcccagcccataaatgtttattgtagcttcattcataatcaccaaatatttgaaacaacccaaaggaataaataaaactgtgatacggatataatgctacgcaagcaatgatctattgatttatgcaacaacatggatgaatcttaaatgcattctgctcagtgaaagaagccagacccaaaaggctacatattgcggcagtgtgagggaaattctgaagtgaaggaactgctacatgtaattgtagtaatgaatacataactatgcatctgtcaagactcatacaacagtacaacacaaagagtggattttactctatataaatttttttaaatcgaccaagaagtaggggagggagggagatgcaatgcagagtgtgacaaatgaaataactgtcttacaaatgtatcacataactatattgaaggagacagggatggagctgtccttagtaattttggtaaacagtcttttggctggatattgtaagagtaaagacagcctgtatcaacagtattttcttgttctgaatgaaaaagaagtcattatttattacaaatatttagcttactgtttatcaattgtgtgtctttaataatgaacaacactaaacaatcttaaaatctgaaaggttttgtaaaaactttttactggtgttattttcgtcactatgtgccttttttttttttctttttggaaagaagctgggcaggatgagcatgtaaaggcttcttcaaagtgtgaaagtggacagatactgcctccaggatccagaacaacagtcatttacaaagctagagacagaatgcactgaaaatacagcaattttacaggtagttccagcaggggataatttatctaatcaaacagctgatctcctacatattctactgtattcagtcttttcatgttaataaaatttgaatatgcaaagatcgtatcaattcttttttggggggtggggggcatggactttccctccttgttgcccaggctggagtgcagtggcacgatcttggctcactgcaacctccgcctcctgggttcaagtgattctcctgtctcagcctcccgagtagctggggccacaggcacccgccaccacgcctgactaatttttgtatttttagtagagacggggtttcaccatgttggccaggctggtctcaaactcctgacctcaggtgatccccctgcctcggcctcccaaagtgctgggattataggcgtgagccaccgcacccagcctgattctttaatatgttacaaatctcaaaataaaaatctcagaaatctaggtatgtgtgtgtgctttttatttataaaacagaatctgagaggattaaaaagacttaaaaacaacaacaacgataacaaaacacaacttctcctgcataactgtcagtgccagaatttcagggtcaaacatttgatctgaaatttggtatccagttcgctcctaaactgagtctccaattgtccacttaaaatctttatccactgagcttttgcgggtggcggcgagcgcggagaggacgccatgaaggcctcgggcacactaagagagtacaaagtagtgggtcgccgcctgcccactcccaaatgccacacaccgcccctctaccgcatgcgaatctttgcacctaatcgtgtcgtcgccaagtcccgcttctggtacttcgtatctcagttaaagaaaatgaagaagtcttcaggggagactgtctactgtggtcaggtgtttgagaagtccccgctgcgggtgaagaacttcgggatctggctgcgctgtgactcccggagcggcacccacaacatgtaccgggaataccgggacctgaccaccgcgggcgctgtcacccagtgctaccgagacatgggcgcccggcaccgcgcccgggcccactccattcagatcatgatggtggaagagatcgcggccagcaagtgacgccggcaggctgtcaagcagttccacgactgcaagatcaagttcccgctgccccaccgggtcctgcgccttcagcacaagccacgattcaccaccaagaggcccaacaccttcttctaggtgcagggccctcgcccgggtgcgccccaaataaactcaggaacgccccggtggaaaaaaaaaaaaatctttatccactgacgcataacttggaggaccatggtgagaattagtgaggcctgaccttggtacacagtgactcaatttcaggctttgaatcagttagtcctatcagaatgctacaagtcagagtatcctggcaagaaatttactattggccataataatgaataacggccctaattaaagcctaaggtggatcagatgagaagcgggtcacaaacctaaagagatgatctatataatctacttgttcttggacatccatcacttcaggagaaaatttttgtgtctcagttatcagtgccatcaagagcaatgattattttccatattgtaatcagagtaatcctaacaaagcacaaatataatcatctttacctttcccctttaacagcttattgggtttttttttgttttgttttgttttgttttatatcacggcctcctttattctgccctttgcagacactagtcatattcctttgagccttggcacaagcttttttttctgcctgttggctcttaaatcccaacatcactagcaaactcctaaatactcctgttgcttccaggaagcctgacctccagatagcttggtgcgcagtagaatacctccccattataggatctctgtacaaggtttttctcctaatcctttacattttctccattcattccccttgctattcctagaacctgctagtcaaggtcctgccctagggtctttggactggctgttttcctggcctggaatactcctccccatggctaacttccctacctccttcaaatctttgcttaaatgtcactttctcactgacctgactacccaattttaaatcacatctgaacccctacccacccccatcatgcaccctcctgatttcccttactctggtctttctcccaccataatacttaggtcacctttgaacacataatatactttcctatttatcaattgtattgtttattatattgtatttattgttcaatttcataatttagagccccctagaatgcgaccttaatggtgcaagatttttttttttgtctgtcttggtcactgttgtatctcaaaagcctagaataaaaagaatatctctgaaatgaatgagttgcttaaggacctatatacaagacattcaagaagaaagagagaaagctcacacttccaagacctgaacaatatctgtgagttaaaatgtgaatgcacaaaagatctatgaaaaaaaaaaatagctgctgtaaatttaaggtagcaaattagaaggtgtcatcaactaagctcagcagaaaaagcaaatcctacagctacatcgaccaattatgagcctctaatcgctgccaggacctcaaacacattatcccagttaattctcacacaacacataacaactgcaggatgaggttctcacacccatttcacagatgagcaacctaagattagcctggaagctacaggagtgcacagaccctacctgttcccatcttgccatcataccaccagcatccagcgatatgctggcgggcagtaggtgtagaatatatagaagctgcataaaattaaaaaatatatatgctcagagaggttaacaaacttgaccaagaccacttatccagtaaatagcaaaatacaggatttgaactcagatcattttatttaaaaaccaatgctcttcccaccacaccatatttcttctaactaaagttataaaacacatacggacctacaaaaatgcaacagtcaggccaacgatctaccacagtcattcctcagggcctcttaacagagaaaaatataaattgatattcctaattagtgtcacctcaataatcaagcagcaatcatgtttcatttgatctctttaatattgagacaggcaaagtacattctagagacaattacaacaaaatagataagtttaaagtttagcaccaaatgtttagccttcagacaattcaaaagtcattttcacagaaatagtacacagacattacagtatgagtaaattcctgcttctacttagctgctcacttgggcaatgccctttggagcactggcccttgaaatgctaattcactggctgaactactgttcacctgctctttagccttaacaggtctgtggcttcacattgggtagccacagcagtccctaagagaaaaaaggagctccagcaaccaagctatttaattgcgaaaaccgcaattacctttgcaccaacctaataacctaataacttgactccagaggatggatgaaaccaggagaagagagggggagcctctctccccacccttgggctaggagacacctaaggtctgtaaacctggcattgttagaacctacaaggagaaccaaaggatttaaatgaataattcatcatcccaaattcacattcactagaagtatctatgtaattgtggttaaagtacttcaaatgtgtccttctgcttcatattttagtgtaagatactaggtaatagaatccattctctaattcactttacacaaacagaatcagcccaaatgtttgctgccaattcttacatttcctattgttaagcacagaaatagctggaaactgctggtattgagaaattttattcatttcagttctacaaatttctagaggccctacacagagattgaaagcctatagtcgcagacgagatccatcccaaagatgtacttcctttagcctcaatattattgtaaaacctaggggatggttcacatataaacctagactttaagctgcactaggaaaatcaaaggatccggagcatgcactcccaaataggaagaagagaatgggtggtggcttccctcatgagatacaacacaaactttcgaaacagttgaactggcctacctcaataatgaatgttactctcctggtcactggctgtatggaaggcccagtattggaatgtagggggttgggggtgaggcagaatctgagatgaataaataaacttgtatgagaattgaaaattttaggctgggcactctgggaggctaaggggagcaaatagcttaagcccaagagttcaagaccagcctagacaacgtggcaaaaccccttgtctacaaaataatacaaaaaattaaccaggcatggtggcatgtgcctgtaatcccagctactggggaggctgatgtccttgagcccagaaggcaggggttgcacctgtaccccatcctgggtgacagagtgtgtcactgtctcaaaaaagaattaaagaaagaaaagttagacaaatacatctaaaagtaacatatgaaaactatgatacctctaggagagacacaaaaaccgtatcaatgtgcattaggtgtgttggggggagaagcagggatggaagagaaatacacaaagtgtatcctccccaacctacgtctcatcctctctggctgtcccttctatgactcatcaagcacttataaagtcaactcatcatgacatcctgcaaattccacctcttgaataagttttgtatagggtcctttggtatcccatattcaaaaatacagttcagatcctcaagaccctcattctatttgacttcacagcagtctcctaactggtcttccaccctccaacgcatcctccacatagctgccagtgacctattgaaaattcaagtcaggccacaacacttcccagtttaaaactttcactgggttccctagtaatttgtaatactcagcctcacttgagaataaactgaggggcattttttaaattagctatgcttgatcctcaccttcacatgtttttattaaattagttggtgtggggcctacatgtctacattctattccaagtgattctgatgttttatcaagttgagaatcaccgttttaccggacaagttccaagatcattagctttgccttaatgccctccacaatttctctgtctccggcacacctatgaacattccctgtaaattccaataaggaacccgctcctggtagcatcctgtgcatatatctacctcctgccctgaattccctttattataattatctttaccactagtctgacagcagtgacttgggtctatcttccttgtaactcaaatgcctgcaacatagtgagcactaaataagagtggatgaagacagcagaaaaagatggacctggaagaggaggtgagacctgaaaggcaaagctgtgaagtaagaaagggagaaggggagaatgcttgtaaagctggaaaatcagaaagcactttttgggctagcaaaatgttggtgatcataatttgtcaaagctttcttcaggctagaaaaagcaatctagtggcctgagtaaatacaccaaagggatttaagccaattattccctgcccagtaggggtgtcagattcatttgttaaactacaagctctctagagaaactagatctcagaacgcaagtaactgttttattataattatcataatacccctcgtttccctctcactccaaatcacaacaattgaaatgaaaaagaagtatgtgttgttcagttgctaaatagtctttttataaccttttctgatgtagtttggattatttcagaaatagtagttctccacagtggtttctgctgcttacatcaaatgagtcatgctgtggggctctcactctttcccctgagagtttacaccatagttgaatagacttaactattagtcattttccttcatattaagccaagagttttgtttaatctaattagtccgccttctctatacaattctaaacaacctcagtccttacaagaatataggtatgcccttcctacatctgcagaaacgtgtgcctcctatttactgccaggacaagctgaccatagttcgttcttaaattttcccacgtgagccagggattccaattctgaaccttctcattcccacctcccacaaaagcgtttcagtttgctggcacgatggagcgtagtgttatttccgagcgtttgctgctggatcaatggtgttttctcattagttttattttgcttttgatttataagcaccaaaatggtacagagtatatctacaccagaagcatctataatgtgatcaaattcaccatgacttttgtgcttttatttgcctttatgaaaccaatctcaggcttcgagacccatgattacaaactgtttcttcacagaccccttacaactttccaagcaaatgtaatactttccagcacttttttcctcttttttaagatgttcatagctccaaatgtcaggcacaccgtgcaatgaaaactatccctcagctgataaattattcatttttcaggagtttgcaatttgaaatggcactaacagctgaatacctgaagcacccccaaaagacatgaagagcaataacatgcaaagctttttctgcatacattttaaaggttaagcgccattagacatctatgtttatcaagagatgtgctccttgaacatatttcttctaattaatctgctcccaataaacattactaacaaagcaaagtgataaaggaggctaatcaaactaatctcttccctttaactaacttcatcaggttaaacaaggtcctttgctgatattctccactttctcctgtctgatgaggagttgcaggtgagtaaggtcaaaagcaggagtgatcaaactaggactcttgaacaatctggcccactgcacgtatttttaaataaagttttattggaatactgttttacccatttattttgtattggctgtggctactttcttgttacagtggcagagttgaatagctgtgatagagacccacaaagccaacaatatttaccatatagctctttacagaaaacatttgctgacctctggtcaaaaggcatgcaaaatgtataaggcttttaaaatgttagcgccaagtagggctttagctaatgtatatcaatgtgttcatttactctaaaaaaaagaaaaagaaaaaaaaaaaaccttgcatttaaaagtgtgttatctagaataccatctgtgttacagttccagaggaaactgcaggtctaagattgttcctcaagctggtagatgcttcattttgataacagtaatcaccatgtgtttcagctatttattgctgtgttaaaaaccccttcaaaaatggcttaaggcaaagatttctttgcacatgattcttccctccaggcctcagctagaagattttaaactccacctcccatgtggtcactcatatggcttatagtcatgaagaagaggctggactctggctggaatgccaagatggcttggctcttatatctagctcctcacctgggacagctgcaacaggtgtgggctggctgagtatttctccctctctgtggggtcccttcagcagggcagttgagcatcttgctatgatgactcaatatgtcagagagtgaaagtagaagcttccaggctgctgaagggccaggcccagagctggtgtactaccacttctgcaccctcctattactgatcaaagccagtcaggggactaacccacattcaaggagtggggaaacggactgcaccttgatgagaggaactgtaaaatattttggccatgatttccaatttaccacaccatgatgatgagtaaaaagtgacaacatgatcacaatgacaaaatcttgaaagcagaccttactgctgacaatttataatcaaattgacaaataagaacaagaaagcctaataaaagaatggaaatcattttatagtgaaacactagtcacacagaaatcaaaaatttccaaattgatgtgtttttttttaattgaaattagaagccattctaaaagccactcagtgcttctcaattcttacacagtgtgtaagctgtgactgtgacataactttcctccatgactctagggcctgaagatgactatcaatgaggggcatagtaactacaatgaacctggataactctggacctgatgcccactggcatctcttgggccctctggctgctgtgcattttgagctctcttgcctgctcttttcagctgttctgcctcttctctggacagggaatcatgagtgtgtgttttaggtccttccccatcacctattcacctttttgctctaggcaggtcatctactctgacccttggatttttttttttttttttaatctgagaagtgaggaggataaaaattatgttgcctacacttagaatattcaggaacaaatgagattaagaagataaagtgtttaaactggctgggcgtagtggctcacacctgttatcccaacactttgggaagccgaggcagggggatcatctgaggtcaggagttcgagactagcctgcccaacatggcaaaaaccccatccctactaataatgcaaaaattagtcaggcatggtggcacatgcctgtaatcctagctactcgagaggctgaggcacaagaatcgcttgaacctaggagtcagaggttgcagtgagccgagatcacaccactgcactccagtctggacgactgagtgagactccatttcaaaaaaaaaaaaaaaagaaagataaagtgtttaaatcattattcaagtattcaagtgaaaggtatcacaatcactgtggtaattaattaagataaaattaattttattgataaaaataaaatattaacaaaattaatataccataaaatagtttataataatggctaatgtttatttagcatttactatgtgcaaggcatagtactaaacaccttacattgcttaacctgcttttgtctttacagcaatcctataattatcatctaatactccagacaacaaaaactgagacataaagtgataaggcaatctgcttctggttttacagatattacacagaactacgatttctctttcccaattcgcacagctgatttcaagagcttgtgaaaggtctatcatatttctaacaaaatttctcccttccaaaccccatattaattagaagggcattatctatctctcctaacctctgctccaaccttctgttccaaagctttcacaagcaacatcagtggttctcaattgggtgattttgcccccctcaggggacagttctcaatgttgagagaccactgggttgtcacaactggactgtaagctgcttcctgagtagaattccttgataagaaaaatcatctcaataggtcaaaaatgttaaatagctgatttctccatacattaagtattactctgtgtgtgtgtgtgtgtgtgtgtgtgtgtgtgtgtgtgtgtgtacagagagaaagaacagaatgaaaactgaacctcacaggacttcacattcaggatctcatttaaacttcacaggagcctgtgagagctgtgagcattgccaaagggtcagaattctcctacctattctcaattatcctcccaggagaattgagaaaattgctcctggtaggcaagggagccattatttaaggcaaatctggttactaacaccatgtactattttagagaaaacatttaagttatggtttaataatcattttatgtattaccttacattcccattggtcttaaaataaatccaaatatgttaaatcatataaacaataaagggtttttttttttcttaaatggaagaagtttaccaggaaatattttattaaaaagctttaatctatatagggacttcaacaaatcacttaggaatcctattgctgtaattttgacaaaatggaagcatatagggaaaagccctattgaagttcctttcttccctgcaattctatgttgaccatcaccctccaataacagccttactttacaaatgtaccgtccttcactatctgcagctatggatattgatgaaggaaagtgtagacttaattgcatgtttccaatgtaaaactatcatctgctttaaaagaaaaataaaactgaccagagataacgagctaaaagcagacatttgtgcttttatttaccaaagtctttggtgttgcaagtctatatcggctggtgcaaagaaaatttcagttaagctgtttagacagtgagtttataacttgatcaggaggttgtatcaaaccttcaatgcactatttgtggaaaaatatatacacattttgtcctagtagagaacagtagtacctaattcaagtttaataaatagatgtcccaataatatatgtgtttccctacatactctcctatacctagcccagcaatccgaaccctttatacgacctccagggccccatgatgtgtctcctggaccttattttgtcctttgaacacactaggctccctccttgcactaaggtctttacactcattcccccatctgcctggatgctctgaactccattttttcatagctggacccttcccattcttcggctcaagtgttgtatctcactcagtaacaccttccttgacatatgacaaaccaaaccaagacctatcctctcccttcatatcctctcttactctcatattacatcatgctgttttacgatctttgcagcatttatcactctccaaagtcacgccgttcagtgacttgttgcccatagccatgtcttgctgcactgctcctttctccacaacatcccaactagaatataaagtctgtggtaacaggaatctggatctggcttattggaggcacactgtagtcatgcgctgaatgaaaagtattattacttttaaatgaaatgttactgaaatttgttttaaaagataagtatagatattagaggagtttctatcaacctaaaatcactgtagattaaaggtttaaatgacttttagtgacaaacaatggcattttatttttctctcactcctttataagcatcttaaaaaggtttaagtatatgtttctctatatatttatctttacacacaaaaaaactaagaaaacatacttggtttagtagatttgttatactttccgtatttttagcttaaaaggaatagattgtgtgctattttttaaactgacgatttaagtacttagtgtatcttaaagccacatttaataactgtagttactgtaaataactgccacagtactatgttgatttttgaaaacctattgcaaattgtacagtgaatttaaaacttttatgagagaacaaagctaaattgtaatgtcttttgtagtaaggcactgaacttcattgttttaaactgattctggattccacatttttaacagatattaacaaaaagataagtttagataaaactatctgaacttcatgattaaaaagtgaaattacaagactgagtaaagataaatttggggggaattttttaaatgccatgttaaaaacaaaggattacttataaggtactgaatacactttaggtcccttcttaacatggttttctccttcactctaaattttaacaatctgttggtggttcagttttagaataatgcttcttcacaaaggtcaattttaaaaaatgtttaagtgtcaagcagtctagcctccttaaacctctatcaccctggtcccttgtaccacatctactccgtaacttccaactagcctcttaacagatctcaaggccactctggctggcctccctccaaagaatttttccaccatgctgcctcattgctcttttaaagttgtaaatgtcttcctatagcagcttaaaaataagtcagtgattcctgcagttcatagaataaaaaccaagattttgaacaaggtttatggagccttgtcttacccagtctccaccacttagccaggctcatttatttttatcatgtctgtaatctcagcacgtcgggaggccaaggtgggtggagagcttgagcccaggattctgagaccagcctgggcaacatgaggaaaccccatctctaaaaaaaaaaaatacaaaaattagccggacgtgacggcacgtgccagtaatcccagctactagtgatgctgaagtgggaggatcacccgagcccaggaggcagaaggtgcagtgagccgagatcgcgtcactgcactccagcctggataacagagtgagaccctgtgtccaaaataaataataataatagctaaaaataagtgcatgtaaaaactggtaaaatctaaataacacatgtagtttagttaacagtactgtgcaaatgttaacttcctggttttgataatgtactgtcattatgtaatatattaatattaggaaaactgaatgaaagctacatggaaaattcctgtatgattgttgtaatgtcttttaagtgtaaaattatttcaaaatagaaaaaataaatcactccctcaggaaagctgtggattacttttcagaacagatgagccacttggctgcttattttcttccctttaatgcttgttactgttagaaaatgtaaattttaaaaattaatgttaaatatttggctatgccactagagtttaagctttttaggggcagggatcatattgcttttaatccacattttatcctcagtagttaactcaatgcttggcacgggaaatgtgtccaataaacatttattaatgggactgtgaaagacatgaatgagccaatcagtcaatgtcccttgaaatcataaatgtatataaatatacatatttacattttaaaaagattctgctcaaattgtgaagttaatgggataatatatgccaacagagatctaaacaaagatgcttctaatttggaaatgacacaaactaatgagaaaaaaaggcataatagcaactaacaacatttagtgaatatttaatcctattattcaaaatgctttacaaacagttatttccttagtccttgtgataactgtatcaagtgtgtgctatatttatcttcattttacagatgagagacacatagagatttgtaccctgtctgtggtcagagtaattatacagcagaagcaggacttgaacacaagcactctgctccagggtccacattctttatgcattacttactgccgagagacaaagtctgagaagattgcttgagagcatcctaaacactagctatgaattctgaagatagattacaggctggtgtaggcccacactgtttaaaatttttatattcccaccacttcacacagagctttccacatagcagacagacagacagacagacacacacacacacacacacacacacacacacacacacagtttagtgaagaaataagtgaagctaaagcaaactgaagaaaaaagaatatactaaattttaggttaaagaattggttctaaaatggtatctccatccaatcacaggacctttctctttaattcttcacttcatgatagaggctggcttggagtttctgaattaacaagaaacacatctacgtaggcaggaggggatggggctcccaaccaagtcaaggttacttgaaatgggtcaggtacagctgggtgtggtggctcacgactataatcccagcactttgggaagccaaggctggcagatcacttgagctcaggagttcgagaccagcctgggcaagatggtaaaaccatctctacaaaaaaatataaaaattagccaagaaggccgggtgtggtggctaacgcctataattccagcactttgggaggctgaggcaggtggatcccctgaagtcaggagttcgagaccagcctggccaacatggagaaactcggtctctactaaaaaaaaaaaaaaaaaaaatatatatatatatatatatatatatatatatatatatatatatatatatatatatatatatgacagccaggtgtggtggtgggcacctgtaatcccagctacttgggaggctaaggcaggagaattgcttgaacccaggagatggagtttgcagtgagccaacatggtgccactgcactccagcctcggtgacagagtgagactccatctcaagaaaaaaaaaaaaaaaagattagctaagcatggtggcgcgtgcctgtagttccagctactagggaggctgaggtgagaggatgacttgagcccaggaagtggaggttgcagtgagcggagactgtgccactgcactactccagcctgggcagcagagccagaccctgtctcaaaaaagaaagggaaaagaaaaagaagtagatcaggtacatagaaacagaatgagaggaaaattaaagaagttaagaatgttaagggaataaaaccaggagatcacacaacagtagaatcaaataccaccagactattacaaataataagaattagttcacaaatactgttgataattgttccatccttagagtttagggcctattcccaaatagagataacaaacaggtcacactttggaattgtttaaaaaagcaagtcctactatactcaataaaaaatgctttgaaatgtacacgtgttgattttgtgacagagtcttaatcttactaggtagctacagctctgctgggagcaattaattcaaaaagccacagaaactccacaatgaggctaaaggatcagtaaaatagctggaatactttccttgcttcagacagctggatgctgctaatttagctactttaaagtgaggggaggaaggaagagggagtaattttgccacacctctactaatttagagaaaagagaaacaatgaaggctgataaacatggctacgtgtttatcatgtaaacatacaggttactttcagattgcatatactaaagggactctaaccaaagaactagggtaagcagaaattgctttttgttttggtttaggtgttttttgtttgtttgtttgtttgtttgtttgttttgagacagagtctctctctgtcacacggctgcagtgcagtgatgtcatcctaggtcactatggccttaaactgggctcaagcaatcctccctcttcaacctcccaagtagctaggactacagatatgtgccaccacaactggctgttttttttccttgttttaacagctttagtgagatataattcaaataccataaagttctcccatttaaagtatacaattcaatggtatttagtatattatgtttatactcagtaccaacactctaatctaacttaagaacatttttgaggccaggcgcagtggctcatgcctgtaatcccagcaatttgggaggccacggcgggcggatcacctgaggtcgggagttcgagaccagcctgaccaatatggagaaaccctgtctctactaaaaacacaaaaaaattagccaggtgtggtggcacacgcctgtaatcccagctactagagaggctgacgcaggagaatcgcttgaaccgaggaggcggaggttgcgatgagccaagatcgtgccattgcaccccagcctgggtaacaagagcaaaactccatctcgaaaaaaaagaacattttcatcatcccaagcaatttatcttttaaaggatacttaaatgatagagataacactcataatctaaaacaaaaacaaaaagacatttttattttactttctaagaatttttgtgcagatgaggtcttgctatgttgtccaggctgatcttgaactcctgtcctcaaatgatcctcctgcctcagtctcccaatgtgctggaattacaggcgtgagccaccacacatggcaaaaaccaaaatctttttaataagatatgtttctggtgtaaactgactctgcctactgaaatgtatgcattttaataatataagaaagttatcctttcctttcctaacttttttgggaagatctcgccaatttctgcaagatgcaatcatttgccctgctttcaacatcatcattttcctattcctttaaaaaaatgtttttggctggcacggcggctcacacctgtaataccagcactttaggaggctgaggcaagtggatgatttgaggttcgaagttcgagaccagcctggccaacatggtgaaaccccgtatttattaaaaacacaaaaattagccgggcatggtggcaggggcctgtaatcccagctactcgggaggctgaggcaagaggattgctggaaccccagaggtggaggttgcagtgagccaagatcacaccactgcactccagcctgggcaacagagtgagactgtctcaaaaaaactaaaaaatgtatttttttcctgcaagataattcctggtcatatcaatggccactcactctctttctcaccaagctcaccccctaccttcagctttctgaagaggcactgtattactgtgtttacctacagtaaatttctatagttccttcctgtgagctgctcaataaaatgtatgtaagaggcaaccgtacaaacagaggaaacgccttctactatccattctacccaagccaaattaattttaaatgtgtaattctaagaagcctttttttaaccactttagactaaagtagatatgcttcatatttcccctcttgatcttcaatttaatgcccggaagcaagggtttataagaactcctacatataggactttgcagagaagcaagctggagactttaacttgctacaagaaaacctggcttatccaccacccaaattttgataacctctaggtcaaattaaaaaaaaaaattagcacagtgcttcacacgtgctcaataaaactgtttgctaaatcttgttgaataatgatataataacagctaacattcacgaaacacctaccttgtgttatctgctaatctatgagttttcttttaattcagcaaatcctcgcaaaacccaggagtattatatcatgaccatcaccgtcatccacattttaaaaataggaaaactgaagcaaagagcaagattgatcaaaatgacaaagatatgggaaactgaggctaaaagcatgatttaccaaatcacagccagacttcaaaaccagactatggcttcagagctcacattcttaaccactactctatgctgcccatcaggaaatacttaagatagcaaatgattatcttacaacacagatgtcagtctatgctctaatgtcaaagaaataaagaaactccatggtctacagtgatataataccaaaggggtttgaggagggactcactgcttccataaaagacagaaatattgtgagtataggccgggcgtggtggctcacgcctgtaatcccagcactttgggaggccaagatgggtggatcacgaggtgaggagatcaagaccatcctggctaacacagtgaaaccccgtctctactaaatatacagaaaattagccgggcgaggtggcgggcacctgtagtcccagctactccggaggctgagacaggagaatggcgtgaacccaggaggcggagcttgcactgagccgagatcgcgccactgcactccagcctaggcgactgagcgagactctgtctcaaaaaaagaaaaaaaaagaaagaaatattgcgagtatatagtgactacagcaaggctctttaacaataaggaaggagaatgaagaagtattcacaatctgaagtggaaaaatgacaaaaagcaacaagtaaatggatgaactaaaccatctgaggaattaaattatgaagagtgtgtctctacaatttaaaaaaaatgttctatttctgagatcaggtaaacattcaggtttaattataatgaccacagtgtaaactcaggtctagaatgtaacagtatgctacaagtgatttcgttagagtgaaactggtctgacaaagaagatgctaacagtaggttcttggtctgcatttagtttttcttttttaaagactggtaaatagcaaacgaaatttatgtatgaaatacaactaacagaagctattatgaaaactcatccagaagaaaaacattcacctgaggattacattactataatctatatgaatctttaatctgcatgcatcttacagccgaatggttctcggagcactacctaaaccacaaaactggttggccagccctgaagaagagcttactcatgctgctcgaacagaagtcgcatatgcccttccctgagatcacagctctactgtccagacatgcattcaagaaacaacaagcaaaatcatctgggccattcaagacaccggaatgaacagaaatcagatacaaacacacgtctagctttttcaaataatagtggatatacaaggcattttaaactggcaatggcaaagactataattttctgctgagggatattatcacaattttccaacctaggtttgaaccaaggcttataagagccctcctccttaatgcaacatcacacccagtactttgctatgacattctatacagcagattataaccctgactctcaggctttttggagttaatcatttcaaaagagagtgagttggacacattaaattaacatggcaaactagagtggtttctttccattcccatccccatatggtcttctttttcaaaggaggacaaacatttgaaaaaattatttcagagttctaaaatgactctgacaagctactattaataactcttgatcctttggatcaatacgaaacacagttaggtaaaagggaaaacaaagaaggctagatgtgctaatgaaggcataagaaaacaaatcagtgacccaggcaataaaagcctgaaaaatattatctttatatatgatagtgaataaatcaaatttttctgtagtgttacttataactttatttttatttcagtgtttgaagaaaaggtaatgacagtatttgataagttataatctggatcctattttaccaattgtttttaaacatttttagtgactaaaatgatatctccgactctaccatgtgctttcacaaaccacaggtatcttctggtagattgcaaatggatgtcccttcttcttttaaaatgtaccttaaaagatatggttaaattttcctctttcgtcaataactttcagaatacacatgctattcaagagtgccaaatgaatctgtgaaaaggaaaatatactacatggaggctgattagacaaggacaaagctaatcaaaattgatttggccaagttgaagcctgcttcctctttttagctataatgggaggagtgagagggagtagattctttttcaagggacatcttaaggttgaaagctggtatcacaaaacatacagcatgataaatatcttaactaaaaattgctaacaagggcctttgtgatttcttttgtaagactacacagcataagaagtgtgatgaagaagaacgagaggaagatggaggagaaaaccagtaagatgacggttatctgcagaaaagattgttttttcaaacacaattttaaaagtcttcctttctaaactccacatctgtctgccacttttcaccagagaattaagcaaaggcatcactcctcagtagaagaacatttttagttatctggaaatataacttcatggacgtacaataattatatctagtaactttaagaaaaactctagctgtgatctgacattaaactgggctcccagggtctaaatgggcttttgccaaaaattaacaatggtgaaacaacttacttttgcactctagccaaacaaaaataataaaaccatagtctcaatttctctttaataaactaaatttagattacacctttaaaataagctttgacataaatggctttaaaataacaagaacatctaacatttgggtcttttcccagttaattatttgctggcattagactcgaaattccttggcttcaccttaagttgacactcccaagtgctaattaggaaactatatacattattaaccagagaatgttgtgcttaaaacatgcatattacatatgtatcttcttattaatgttattcctttcacttctcaaaatacctctttagaaaatagagctcctatttccatgaagcaattggtggctcgtgagggaattcctgtcaaaatgcaattaatagaaaggggccaagatgacacaggatacttgtcttggaaacatccttaacatgagtcaaatttaatctcactgaaatagtggagagaaatgttaatgactgcagatgtcacacattttactcatactaggtgattcccaaagaaaatggctaactcatgtatgaactaaaccactaccaaggaaccacacatgtcagggagtacaaggccgagacatgcctttctccaatactatctcttccaaaaagccacaggacagatgggaaaataaatgcaggtaaacaaggtagacctaatgatttcctaattaggaagatgtgatcttctcattaattgtcaagttaatggaccacaatagcagtttcataaattgagtccagtaatccaagctttggtgtctctagtccacagaattctcctcatacttccagacccttcatccagccacaaagttgtcagttctgcttgatttgtttcaatactgtactcgacgacagctgtcggaaacagtacattagaacagctgctatgacagctacaaggggcttggaagtttaattaggctcattgtgacattgtgcatttttctaaacacggaatgatccacaaaaataaagaaattttgagtgggtctgaacaatgtttacttattggcaccaccaactggttaacctcagtttgagttatatccttggtctcataatatctttgctaccaggctgataagaggtataaaaaaataaataaacaggaggagcagttagatgcacaagaaaaggggcattaaaacggagaggaaatggtgaggaagtcacgtcaataatctctttcaaaggctggctggtagccaaggaggatcccgcagtgtctcaggatttacttccaaaggaaatgtattcagaggccctgagcctggtgccaactgcaaacaaaaccactcattatggtcacagccccctagagaaggggagaatggcttactctcagcatccgtgcggaggaagaaagtgaggagcagcagcagcagcctggctacgtgcaccatcctgcagcttggcagcagcgtgcgcgagcagcttggaatcactgcctccggagccgcagcgagtctgtccgatctgaaatttcagctggaacactttcagagcctgaaagcggggaggaagagaaaagaaaaggaagaaaacacaaaagtgcttagatttcttactctttcccccctggttccatcacaatcaccatgacagacacaatccattgtaaatacacaataaattgtaactgtcatactttgtttgtattaggaaggaaataacttggtttgtaaaatgtaggagtcttagactatccgggtttgtgttacgtgggagctctcgcattcccaattttaggctctcctaaagccaaccaccttgactttcattctttgcttatgccaccttttgggcaaagacctaaaaaaggaactgtcacttcttatgaaacattacgtaaatacatcagtgcaaagaagcacaccagtgctatgagaaagatttaagagaagttcctccatgcaggataaaagtctattactgacacaataatggaagctgcttttttggcatcagttgaaatgacagggctaattcaacttctccaggtaaatagcagaggttagaattttttacactagcatatttggcttcttccctgaagacacatcaatgttcaagtctagtttggcatcaataagtcaaaacaatagttagcatgagcctctttcatttaacaggatttttatatgcctcctgggcaagggtttaatttcctcagtcttctctgtaaaatcaaaaagccacaaactatttttagagcacctactgtgtgcaaggcatcaagagtgacagcacaaggtgtctcaaggcagaaagatgagtcaggttctattatttttgtttccagattagtagggaaaataaagcaggtacaccagatgattagtacaatttaataagtgattagcgccaggaaggaaaaccagataatgctataaaagataggatcaagactgacatcatggaaatagtgtctcaaactaggccttgaagtttaaccaggattttaacaagatgacgaaaaggcattccaggaattctatgcaaaggcagggcagtgggaaaggaactttggaaaacctgagtttcctggtttggttggaatagggcctcccaaaggtcagcatgcacggggccccctggaagccttcttagaacagatgcgtgagtactaccatcagagttcgtgggtcagtaggtctgtggtggggatccaataattcaataatttggtttttttttgtttttttttttctgtttttttttttgagacagtctcactctgtcacccaggctgtagtgcagtggtacaatcacggctcactgcaaacgctgcttcccaggttcaagtggttctcctgtctcagccacccaagtagctgagattacaggtgcccaccaccatgcctgggtaatttttgtacttttagtagaggcaaggtttcaccatgttaaccaagctggtctcaaactcctggcatcaagtgatctgcctgcctcagcctcccaaagtgctaggattacagggatgagccaccactcttggcctaccaaagtgctaggattacaggactgggtcacatatttgcataaatttgcatttctacatgttcctgggtgatgctgatgctgccagtccagagaccacactttgagaaccttctggttgaagtcatgggaaaccatcttctattaggaaaaccagaagatgaagcaaaagaaaatggttcagagtcaggcgcagtggcttacgcctgtaattccaccactttcggaagccgaggcaggaggatcacttgaggccaggagttcaagaccagcctggccaacatggtgaaactccgtctctactaaaaacacaaaaaaattagccaggcgtggtggtgcatacctgtaatcccagctactcgggacgctgaggcaggagaatcacttgaacccaggagacagaggttttggtgagccaaggtcctgccactgcactccagtctgggtgacaagtgagacttcgtctcaaaaaaaaaaaaaaaaaagaagattcagactttaaaaaaaaataggtcacagagagccttggatggcgatctaagtcaaatggcctttattcagcaaactacaaaaagagccatttaatgttttagagcagaggaaccatggaaccaggctttggaaagattaactgacaactggatcagggatgatttagagaatgctattaggccacagcaagagtttcaggtgagaagtgacacaggacttaagagtaatggtggtactggtgggaattaggaagggaggcaatgactggctccaagcaatcatttgaagtataattcttcacgtgttaaataattgtacctatagaaccctcaataaatctagcacagcctcttatgcagagtacactcttaatgaaaaatttaaaaataaagagagtagatcacatcctactgcatcctctattactgcagaaaatatctgaaaatgactatcagtattcatttgcaaaatgaaactgcatacctttaatttttaaaactgaaatatttgaaacatatacaaaatttttgacaggaaatactagagatatccagcaataacctaatccactaaaataacttgtactttaaaaagaattataatgcagataccatagtatgtcatttctgaaactcagcttaagcatgagaacaaaaattgttttaaagatattaccttttttattagtattcataagcggtttgaatgcaggaaagataaaactaaaaaggagaggaatcactctaccattctattagatagtctcctttttttttttttaaacagtgggttggcatgaagaagcaagtggtacagtggaaaacttcttgaatccagaagctggccagctgttccaaatcagctattgttatcaatcgcctctgaaaatcaacttatcaagcagttcacagctatcagatgttaaaaatctcaaaagttcattggaaaagtgctaaaggaatcagctctcccctccccattcccctcctcccgctttcactgctcccatcctcatgccagcatttcaaatgacagcaaagtccaggagacatcagtcctgtcggactcaatttgtgtctgtgcaagcgtatcagagccaactgctacataatgactccgtgtgatcacagagatggagacctatgaatgctcactcagggaagaagtgatttggcttttcctcctactcagctgaagtgcataagaagaccaaattttttcaaatgaaccttcaaatgttactcctggactagcaacagtgataggatctagcactctagaaacgaatgcaggtataaacatacatatttatccttaaatgggttgtgcccaaaggaggtcagaggtgtgaagatgaaacgtattctaaatgttcattccagctaatctccattccttatcttgtttattacacagcaacattgccaaaagggaaatgctagctgcctatcagtaaggtggaatttaaatttaggtacaaaaattggaaatggattcttaagaaaataattaaaccaaaaataaacaggataaaagaatattataaggagtttccattaatctatagtaaggcttgctaagtactctgaaaaaaaaaaagagcaaggaggttcagtgatattaaaagtaccacgttttaccttacttccatcacacattatccagcatttgtccaatagcctcagcagaagccaaccctttgatttttatatgttctgctccttctttcttgagacagagtctcactctctgtcaagcaggctggagtgcagtggcacaatctcagctctctgctacctccgcctcctcagttcaagcgattctcctgcctcagcctcctgagtggctgggattacaggtgtgcgccaccacgcctggctaatttttctatttttagtagaggcagggcttcaccatattggtcaggctgatcttgaactcctgaccttgtgatccgctcgcctcggcctcccaacgtgctgggattatagatgtgagccactgcacccggctctctgtctttcatcagcagggacatgcagatagaactcaaccatgtatatgaatctaaaatacaatttcaaaaaatttataactccccggtttcttatttctcataccacaaagatcttatgaaacaataattttgctgaattccaattaactgaattgtatatcagcttctgtatatctgtacatgggtggttggagaaactaacagttcagagggcaatacgatgcatgtaatataatttgaaatggaacaacaaagagcgcacttgcctaaaagccttaacaaatcacggtttcaagcgatcacataaagtgacacctatccaactctttttcttcaacttaccattgtaacacttttctgtaataagtatattcatattcaaaccaatatgaatgttgaaggatttgtactattttttcagctttctatactgttatttgtgtctaaatactgtattaaaattttctttaaaaaaagacaaactagggcctagagtcccttagaaaatggcagattataggctttgtatgggaaatgtagaaaattagtcaacatcttgccataccagaagcaaggaagttgtcggaactactaggctatattaaaaaaaaaaaatccaagatgatgaggtgcctatcagctaaatgtagggaaatctgagtgacaaaaagaataataactgcaaagaactacaacaaatcacattataatctatgagttcataattttaaaaatttcactggttactctaggagaaagttagagaaccaaatcattactctgaaaacgggaacagaaaaggaaagaattaagcattaaaaaaacaaaaacaaaaactactgctgtcacttaaaactaggtatcattgtttatctctgaacatttttcatttttctatcataacaaacccatcctctcaagtctagacatctcagaagcaatatcataatgatatttaacctgaacatacatgcataaaagatatgcattaagttgggggatggtatgggaaggagtatgtccccaaattacttctttttatctacctcccaaaccaggcctctgtaaatcagctgaatgtggcttctaattatttaagagaaggatccatttgtacaaacgatgtgctgctaggactctccaatttgtaaaacagacaaaagcagggctgctctggctgaagcctgaaggaggggaggggcctggagcctacagcaaacctgacagaggcttcagggggcaccccaggaattccctaggccctcagtgtccagctacaacacaagtacatgaaaagagaagagaacccaaaagcaaactttcaacatttcactgacttgtggattttccaagagaagggagccatctaaatattttaacgtggtataaaacaagaatcttccagtactgacagatataactttcttcaggatagaaatgtttttttatctgcattgactaataattgaccactttaaacgtagctagtgcgactgaggaagtaaagtttttatcttattaaagttcagtttaaatttacacagccacatgtggctagtggctaccctattggacagcacagactacaactacaggtttacagcactgaacagaaagtcagtgttttttggaggtgtagactgaaacaatgaggtgagaattctgagttctcgtagtccttggcttcccaataaccagacactaaagattcactgtgttatgtgaggatacccatttaagctttggatcactcactaactgatatggtttgactgtgtccccacccaaatctcatcttgaattctcatgtgttatgggagggacccagtgggagataactgaattataggggcagggctttcctgtgctgttcccatgatagtgaataagtctcatgagatctgatgattacgtaagggggagtttccgggcacaagctcttttctcttgtctgctgccatgtgagatgtgactttcaccctccaccatgattgtgaggcgtccccagccatgtggaactgtaagtccattaaacctttttttcttcccagtgtctcaggtatgtctttatcaacagtgtgaaagcagactaatacactaacccacccatgtccctcatcctgccaaataaaagatttcattttttttaaattatttcatagaatgtaaagggaagatcagtctatgaccaaactaccctgaacacgcccaatctcatctgatcaagaatgcaaagggaagatcaataagtggttgagtatataactggaaaatatccaagtagaaatagtgttaacgaatgttcctttaatattaaaggaaaaattatgttaaagatggcgtttcatacttcattgtatttctcactacttctggcagcaaagaactgccacattctatagacataaaggacaagcatacttctaaacatcctcatgaaataatttgtatagttgtatagtttttataaaatggccacattcgattaatattagcgagggatacgggaaacacattcttaaatgtatgcagggcaccaaaagctttaatgtcaattacggaaaatattactgagaaaaggggccattgaacaaggttattgaatttaataaaactatgaaaaacaaccacaaaccaagcacctctgaataaaatagtcaaacctaaaaatataagaaattatttgtatgaaacttgtaacacctcaaaattatactccacataatcagcacatcaaatcaaaaactccaaatttttctgttttgccctaaacatgtttttatgacaatcagttaggaaaaacaacaagaggtagtttaagagctattacatataaacacaaagtgataattcaatcatctcatttttggcttaggctatgacttaatatgaagaccccaggggactataagcacacaatgattctttgaagaaatcaactgaattttaagaatacccgaagagtaaaacaattcctatcaatatagacacttaaaagatcccttatatgcctaactctaatacacagagaaaaaaaagtcaatagctattattctgagctttttctatagtttatgattcactttccaaattattattgatgcatccctgtaagatatcaagtggctttacattggaagcacatataaatattagttattttcaaggatggcaaaatgacattattaactttgattgtttctttctcctttgggaagaaaaaaatgaggtatgccgtgagaaatgaacagatagaaaggaaaaaaaaacctcatctccctttgtatctattgttcccctacaaatagaactataattctgatttgaaaagaaggatagctttagaaaaagaatctaaaatttctttcagttattactgcatgtcatagcttctatctagttttatgtgatgccagtagaaactggcaatgaaacggttaaaatacaagtctattcaacatgccgttggaactctaatatttgttcctttcatccaaaaagacactgtacaagtgagaaacagatctttctcgcaaagtgtagatagatatgcaatccagccactttccactcaaacagaacatggattctattattttaatctcaggcatttctttttttttttttttttttttttttttttttttttgagatgaagtctcattctgttgcccaagctggagtgcagtggtgtgatctcggctcactgcaacccccaacccccacttcccaggttcaagcgattctcctgcctcagcctcctgagtagctgggactacaggcacacatcaccatgccaagctaattgttgtatttttagtagagacaggatttcactatattggccaggctggtgtcaaactcctgatgtcgtgagtggcccatctcagcctcccaaagtgctgggattacaggcgtgagccaccgcgcctgaccgggcatttctttttttatgttaaataatttattaggatattctgttcaaccaatcaaaagaagtaattaatatgcccttgattaagaggtctagacaagacattttcatgctaggagtatcaccataagcctaatttatcatgaagcgattatgcacctgttccaaaatttcatattattccctatatttcacttttaataacctatatacatcaagctataagacattagttatgaccaataaactaatatgtcagtcaagctttaaaatttccttgatgacagactgcacacattacaataggatcttatcctaatagtaatgtatgatttgttgttttattttaaattgatatataaaactgtatatattatgcacaacatgatgtttgaagtatatatagtatacattgaggaatgactaaatttagctaattgacatatgcattacctcatatagttatcatttttataatgagaacattttacatgatctgtcttggcatttttcaagaatacatggatatgaaactatcatttctacatcaatataactgattttgtcatctttaaaaatcaaaacaggttttcttaatgaatgcaaaatatctgtaaaatacatttacttttcaaatgttatgggtaataggttttatttattattgtatctattttatttgttttagccctatcaatacatagtacggaaaagtctggcaatacatattttacttctttactatgaaaagcaattttaaaaattcactttgaggagaatttaccactctctaaagggaataatctacattgatctcttttccttaggattattttaagaataaagtgaaggaccttttaattgttttttaaatagttcattatgatagctcaaagaaaactaatttagcgcctcgcaggtgtaatatttattggtagctccatcctcagggtgatcaaatctctgggccagctgtaaaagtgactttgccctctccctcagggaatgcctagagacaatttttgttgtcacagcgcaagaagggtgacccatggcacctaagggtagaggccacagatactgccaaataccctataacacacagaacaactacctgccccccaacaagaaattatcccattcagaatgtcagcaatgccaaaggtgggaaaccctgtcctagaacagctcattggcacagaggaaaaattccaaattaaaaaaaaaaggggggggggacttttaagacataatctaatacattgctttctaaacccaccaattttaggtgttttcatacataaactcaaaacagatttgaatttctgggcatgggaatatggatgacacccaaatttccctttttgtcctaagttagaaccaaagttggcttgccttaaaagtttagttcacaggcttaggcagcataaatattgtcaccaattaaaagaatgaagctgttaaatggaacagacattgcactgatgtcagtcagtgaatagatatggttcccatgtctcatgatgggagcttagctcttctctaagggaacagtctcaggaaagaaatactcagtttcaaggactgttttctcatatcactgctagcaatagagatcaatagtggaacggtgaaaggctgtcataaatggctaaggaaagtggaattaaagaatattctcttcatacctctctcaccttatacacaaatcgactgaagatgaatcaaagagttatatctatgacccaaaaccgtaacaattctagaagataacatcagaaaaacccttctagacatcggcttaggcaaagacttcatgaccaagaacccaatagcaaatgcaacaaaaacaaacattaaatagataggacttaattcaactaaaaaagcttctgcacagcaaaaaataacaataataataataataataataataataataatatcaacagagttaacagacaacctacagagtgggagaaaatcttcaaaatccatacatcgacataggactaatatccagaatctacaaagaactcaaactcaaatcagcaagaaaaaaaaaatcacatccaaaagtgggctaaggatatgaacagacaattctcaaaaaagatatacaaatggccaacaagcatatggaaaaacgctcacaaaatgctccctgatcactaatgatcagagaaatgcaaatcaaaaccacaatgcaataccacctcggtcctgcaacaatggtcataatcgaaaaaatattttaaaaaatagatgttggtgtagatgtggtgaaaagggaacacttctacactgttgacaagaatgtaaactagtaaaaccgctatggaaaacggtgtgaagattccttaaagaactgaaagtagatctatcatttgatccagcaatcccactactaagtatctacctagaagaaaagaagtcattatccgaaaagatacttgcacacgcatgtatacagcagcacaatttgcaactgcaaaaatatggaaccagcccaaatgcccatcaatcaacgagtggataaagaaaatgcagtatacttataccacggaatatgactaagccataaaaaggaatgaaataatggcatttgcagcaacacagatggaattggagactattattctaagtgaagtagctcaggaatggaaaaccaaacattgcatgttctccctcataaggaggagctaagctatgaggatgcaaaggcataaaaatgatataatggactttggggactcaagggaaaggctggcagcagggtgagggataaaagattacacattgggtgcagtgtacactgcttgggcgatgggtgcaccaaaatctcagaaatcaccgctagagaacttatgcacataaccaaacaccatctgttcctcaaaaacctattgaaataaaaaataaattttaaaggcagaacattataatcccaacgttgtcctcatgactattcccacatctctctaagatactattaacaatttacatagtagagaaaataggttgtgtggggaaactaaataaatgactatcaaaccaaacagaaacataaaatctaaagaaaggtaaagaggacaaatattaaccatatatatatccaaaatacactcttcacttctctcactctgtacatatatttcattcagttatattgcactcatctttactgttagtgccctcttcacatctactccctccttcaatgaaaccacagactgataaaaatcagaagaaaaaaataacatcattttgggcaaccctctcatttaacagacaatgcatgaagtacaaggacataatggaattaataacctcaaaatgcacaagtgagtagtctcagaggagggcttagaaccaattttctttcttctatagcatggtgtatctacttttactatctctgacttactgcaacagaaatagatagctgaggcgatgtcatgattaattccaaagtgatcaacataaagaaaaagtccctcctttaattagcaaagagacaatattacaatgggcataaacgaaaggggaaggcaaccttaaaggcggggtataggaaggcaggatgaaagaatctcactgaatgaaggtatttggcagtcactgtcctagaccaataaataattcacaaatgaaagtttatcctatgagtcaaaaattttctaaagggtcaatctttaacttggtacctgttattatgtacctgtgtatcttagagtaaaagtttatagacgtgcttggaaggaaaaatgattaaccagtaatagattttctaaattctcacgtttgtaattgaacgaataacatgcagacacatgtttataccaccttaaggtatacctattttgcatattaccatcaagttctattttatggagtttctctctctctctctctctctctctctcttttagatagggtcttgttctgtcgcccaggctggagtgcagtggcacaatcacaggtcactgcagcctggaaatcctgggctcaagctatcctcccgcctctacccccagagtatccgggaatactggcaagtgccaccacatttggtttttcaatttttattgggaaggggtcttgctatgttgcccagactggtcttgaactcctggactcaaaacaatcctcccaaactggcctcccaaggtggtggaattacaggcatgagccaccatgcccaatcgattttttttttttctctgtaaaatttaaatgtcagcaaggacatatgttgagtaattgtgacaaggtgggaacgggttagattctgaattcacagagttatacagtctggttatctcagtggagagacaacagcctgagtgcactttattacgaagttgctgagggcaacatggccatattgaaagaagaaatgaagatacacaatggttatttttcaaaagaagttggcgttacaaagtgatttgataataaagtacgaaaatttcctgcagcaataaaagcactatgcatttcccataccaagatgtatcagagtggcagcgaaaaaaatattattccaatactcactcctttagaaaatatatttgagacctctggaaagactttttaaagtactgtcatttttattgtacttctataaaatactgaaacaaaatacacaatatggatatcaaaaagggagtttaaagtcattaaaagcctgctagcaaactagctgtagtaactttctcaacaccaaactttctagaaaccaattgttatcttaaatgaacagcccattaaactaaaagaaaagaaaatgttgaataaaaacatcgatcaaacttctctgctgggtcaggcacgatgcctcatgcctgtaatcccagtgctttcagaggctgaggcaggaggatcacttgaggtcaagagttcaagaccagcctgggcaacataacaagaccccatctctaaaaacaaacaaacaaaatttatctgttggatatgggtctcacataggccttttgaaacccagatatttatatttcaaagtagaggagtagtcattctaaaatgagtaggaataggttcaggaagcaagccaggagtgtggctggcaaagatgtgcaaggatgggtggaagagaagtgcagggaatgcctaattgttatctggtgcaggatcaagccccaaattaaaatgccatctttttaagaatttctctatcttttgtggtgtacctaacaatgtttccatcacaaactgaatatagactgaccctttcctttattatgtttcctttaatatttttaaatcataggtttaatcatgaatatttatattgccttgtttaaaaaaattgaacagccacactttagaaaatgtgcttacttcactaatagccctcactcaggcactagaattaggaaaaggaaaaaggataaatatatatacaggctctaagtatgcttacctagtcctccattcccatacaacaatatggaaagaaagggaattcctaacttccgaggaaacacctatcaaacatcaggaagccattaggatattactattggctgtacagaaacctaaagaggtggcagtcttacactgcaggggtcaccagaaaaagaaggaaagggaaataaaaaggaaccgccaagcagatattaaagccaaaagagccacaaggcaggaccctcccttagaaatgcttacagaaggacacttagtatggggtaatcccttccaggaaaccaagccccagtactcagaagaagaaatagaatgaaggacctcacgaggacgtagtttcctcccctcaggatggctagccaccgaagaaggaaaaatacttttgcctgcagctaaccaatggaaattacttaaaacccttcaccaaacctttcacttaggcattgatagcacccatcagatggccaaattattatttactagaccaggccttttcaaaactatcaagcagatagtcagggcctgtaaagtgtgccaaagaagtaatcccctgcactgcaggccatacatttcaatccctgtatctttaacctccttgttaagtgtgtctcttccagaatcgaagctgtaatatatatggttcttcaaatggagccacagatgcagtccatgactaagatctaccgcggacccctggaccggcctgctagcccatgctccgatgttaacgacattgaaggcacccctcctgaggaaatctcaactgcacaacaactactatgccccaattcagcaggaagcagttagagcggttgtcagccaacctccccaacagcacttgggttttcctgttgagagcggggactgagagacaggactagctggatttcctaggcggaataagaatccctaagcctagctgggaaggtgactgcatccacctttaaacacggggcttgcaacttagctcacacccaaccaatcagagagctcactaaaatgctaattaggcaaaaacaggaggtaaagaaatagccaatcatctattgcctgagagcacagcaggagggacaaggatcaggatataaacccaggcattcgagccggcaacagcaaccccctttgggtcccctccctttgtatgggagctctgttttcattctatttcactctattaaatcctgcaactgcaaaaaaaaaaaaaaaaaagaaaaagaaaaagaaaaagaaaatgcgcttacttcttcccgtaattgtcactagggtcaaaactattcattgcataaatcttcatcactggccaggcgtggtggcttatgcatgtaatcccaacattttgaacagccaaggcagacggatcacctgacgtcaggagttcaagaccagcctgaccaacatggagaaatcccatctctactaaaaatacaagattagccaggcatggtggcgcatgcctgtaatcccagctactcgggaggctgaggtgtgagaatcgcttgaacccaggagcgggggttgtggtaagccaagattgcgccagtgcactccagcctgggtaataagagcaaaactccatcataaaaaaagaaaattcatcattttctaacttgcactttagattggtccatacactccatcacacaaatttagtgcttatttcaacacacatgtgaaaatatgtatttatatattatatacatttactatgctactaatgaactaaatacattttcaaacacagaattagaaattttaaaaataagaaaaaaaaagtagaagttctataattcttttcctaggccatataaataattaggggcccattgccctagatatagttgggattttttgtttttgttctttgtgttgagacagagtctcgctctgtcgcccaggctggagtgcagtggcaccatctcagctcccagcaatttccgcctccgggttcaagcaattctacattctcgtgtctcatctccctgagcagctgggattacaggcaggtaccaccatgcccagctaatttttgtgtttttagtagagacggggtttcaccacattggccaggctggtctcaaactcctggcctcaaacgatccacccaccttggcctcccaaagtgctgggattacaggcgtgagccaccatgaccaggtgaagtttggatttttttaaacctatattttaagtgaccatagacaaaaatgacatattttactagtctgtccaccaatctctatgtgacagctgatgtcaacaagacatattataacacatagagaagacactgttgtttgggattttcagacaatgtcctcatgttatcattgtaaaccatctacattaaagtagaataactttacacacaaacagtgtttgtgctttaaaaatgaattccttcattcttttattccatgaatatttctgaataccaggcaaggtgatagggacaagagacttataataaacgtacaagacagcaaggtccggctgggtgcggtggcttacgcctgtaatcacaacactttgggaggccaaggagggtggatgatctgaagtcaggagttcaagaccagcctggccaacatggtgaaaccccatctctcctaaaaatacaaaaaatgagccagctgtggtggcggtcgcctgtagtcccagctcctcgggaagctgaggcaggagaatcgcttgaacccagaggcggaggttgcagtgagccaagctcgcgccactgcactccagcctgggcaacagcatgagactctgtctcaaaaaaaaaaaagcaagttccctgatactgatacattctggtgctaggagatagaaaaatacaagtaattttttgagacagagtctcattctatctccgaggctggagtgccttggcaggatctcagctcactgcaacctctgtctcccaggttcaagcgattcttctgcctcagcctcccaagtagctgggactacaggcgcgggccaccacgcccggctaatttttgtatttttagtagcgacagggttttaccaagttggccaggctggtctcaaactcctgacctcaagtaatccacccaccttggccaccgaaagtgctgggattacaggcatgagccaccatgcccggccaagtaagttttttttaaggtacctggtaagtgctcgaaagaaaattcagcaagttaacaggggtagaaaaataactggtatgtgggaaaagaaaggggagactttagaatagggtgacaggaaaggaccctagagaagggtggggcatgtaagcctgaacctgaatgacaagaagaaatgcagaaaagcttcccatgtgaaggcacagactgcccagggcagaggctgggatgcaggaatgagcttggttgtggctggagcccagagattcccagcagagaatgataccaggcagactgggaaaataaagtgggcccaggttgcacagggcctgtaagcaacagtggagagactggattgcatctgaaatgcagtggaagacactggagggctttatgctatggagtgacacggtctgatttatatttagatgacttctccagtggctgtgtgccaatggtctaaaaaaatgcaacctcccccgactgccctccctgttcccaagtctctgtagagacttccaatccatttacttggacatagccattaagctctattgtgaagtcttttgaccctttataaaaggctcaccagtttcacttttcagtgatcctatggcagtctcctcttcccaattcagaaaacaatcagaaataatgtgtcgctttttaatgttttcagctgcccttctctgttcctacacagcaacctgccctacaaaatcaaatgactttttttctcccatttctcttccatagagcagtttaacacactttagaatttttacttaaaaagtaaagtacctgacattagttctcatttgcgttcctgaaaaacgcaaatggaaaaaatctgctttcatgtacaaagaaacggtcagcattacggatctctatggccacacttttcaatctgtgattccggaaaggctttctacactcacttaaaaaaaaaaaagaaaagaaaaaaaaatatttttaggtttctgaagttttgtagatcaaagccttttttgtttgaacattttaaactctgtaatgttagcagtgatactaatacccaatagtacactggaattcaggctattagaaaacagggcccttccaataattcaaacattctttctttcaggatttagaagccaaggcctgctgtgagtcaattgctggctatctttccaaattagcttttcagtcttagttatcttttacatttcatcccttagtcttcactccaggatttcctccattattgaagcaaggcttttaacaccccaacatgaagtcatttaactcctcagtgtttcttattagttacctaaatagatttgagactaccagtatttaaccctctgtcttaaaaatgcattataaaacgagacagtttgttatatggagggtgtagaacctgacacacacaataatgccaccttattctgcttctcaagtagaaaagtctattcccttcctggattgacctttctacatgccttggccaaaagaatgggacaaaagcaacgttgtgtgcgtctgaccctgagcctcaagaaacccaagaaacatcaggaagaagctctgcatggtcccttccacttgctgacctggggtcccctgccaccgctgtcagagatgtgtgaaccagagcaactttatcttgaaaaggggctgggtaaaatgaggctgagacctactgggctgcattctcagacggttagggcattctaagtcacaggatgagataggaggtccgcacaagatacaggtcataaagatcttgctgataaggcagcttgcagtaaagaagcctgctaaaacccaccaaaaccaagatggccatgagagtgacctctggtcgtcctcactgctacactttcaacagtgccatggcagtttacagatgccatggcaacatcaggaagttaccctacatggtctaaaaaggggaggcatgaataacccactccttgtttagcatatcatcaagaaataaccataaaaatgggcaaccagcagccctcagggctgctctgtctatggagttagccattctttcattcctttacttttcttaataaacttgctttcactttactctatggactcgccctcaattctttcttgtgcgagactcaagaaccctctcttggggtctggatcgggacccctttcctgtaacaccaccaccacacaaacgagcccagactagcctggtggaggatgaaagaccatggggagcagagatgaactagctaactgacccactgtagaccaatcattccccagaagacctgacagctggttgcagactcaagagtaagtccaatcatgatcatctaagctgggccaccaacagcagaaccaccaagttgagcccagctcaaactgctgatccagagaattgagataattaagtgggtactgggttaagctactaagtttagggatggtttggtatacatcaaaagctgacaatacaaaagtgtttaatattttcctcatgcactataaaacaaagataaataagtgtatgttttcttcagtacatttaccctactttaaatactcaggtaggtaacttggcttcttacggttacatctaaattaatttggtcttctggcagcaaccaactaataaaatcactagctttcagatctttaaagtaaggtacgttattctgtgatttagaatatcagaacttatttgtgcctcttggcccctttttccgattataaatattttctgccacatagctcagggacagcaaaattgtcctaaaatgtccttaaccactggctaaaaccatgaagcatgatgttcctttctggtgatataatggaagtgacgtatgtatctgagatgtcaactgatttcaccaagtacactgacaggtagtagttagcataattttagatgctattttccttaagcaggttctgccgggggataaatcccacaattcaagtagggttgatactttaaaagcagaaaagttttcactcaagcttcttaaaggaatgatattttgaacaatctgtctgtgctcctctggccggtttctaacagcatgttgtatgtgcctctccttaaacaggagctagtcaacttgactagttactagaatgtgtgaaaaagtgaggagacatgataactattgaaataaataaatgaattttgcaaggctgctaaatacaagatcaatataagaaaccaactgtattcagaataattaggtatttcttaaatgtgctatttatagcagcatcaaaaatataaaacactaaaaatgtaacaaaagttcacaagatttctatgcagaaaattagatagcatgatcaataaattaaagaagacttaaataaatggatgattatagtatgttcacagcttaaaagactcattattgtaggccaggcatggtggctcacgcctgtaatcccagcactttaggaggctgaggaggttggatcacctgaggtcaggagttcaagaccagccaagccaacgtggagaaacccggtctctactaaaaatacaaaaattagcctggcatggtggcacatgcctgtaatcccagctagtcaggaggctgaagcaggagaatcacttgaaatcgggaggcagagggtgcagtgagctgagatcgcaccactgcactccagcctgggtgacagagcgagactccatctcaaaaaaaagactcattcttataacgatgtcaatctttcccaagtttatctatgaattcactgtaatcccaatataaacttcagcatactattcttgtgaaatagaaaaactaattttataatttataagaaaatgcaaaaacacaagaatagccaagacaatcttatagaaaaacaaatggtaaagaatttatactaccagttaccaagacttattataaagccacagaaattaagatggtgaagtgttagctcaaggacaagcaaaatagtggaacagaaaaagaagtctagaaacagacccacccatatgtactctcagatgatttatacacagctatgtccctgtattgcaatggaaaaagaatcttttcaatcagtggtgatgggttaaatgggtatctgcatgaagaaaaacatacactgaccctctacctcacaccatatacaaaataacatattagagacctagatgtgaaagataaataatacatcttatagacaatggcacaaaagaatatctttgtagcctttctcaaagcatgttttgaaaataaggtaatgacaataaagattgataaatttcaattaattaaaatttaaaatgtctgttcatccaaagatattatcaagaaagggcaatctacagagtggaaaaagatatttgcaagaaatatgtccacaacagccctgaagctatccatttctattgtattctctatccttttggggaaatggggtggagataaaagccttaaacaggcaattcacaaaagagataacccagatggtcactgaacatatgaaaaaggactgaacaatgttagccattaaagaaatgcaaattactatcaaaatgagaaaccactccacactcaccagaataattaaaatcagaaactcgacaccagtacatgttgggaaggttgcagtgcaaattaaaactcatatactgctggttagagtgccaactggtaaaaactcctttgaaaaactgttttgctaaacatatacctaccacatcaaccagcagtttcattaggttatactcaacaataacttagatgttattattaaaaaaaaaaaaaacaaaaaaaacaaacaggccaggtgcggtggctcacgcctgtaatcccagcactttgggaggccgaggtggacggatcacatgaggtcaggagttcgaggccagcctggccaacatggtgaaaccctgtctctactaaaaatacaaaattagccgagcatggcggtgcatgcctgtaatcccagctactcaggaggctgaggcaggagaatcacttgaacctggcaggcagaggttgcagtgagcccaagacacaccactgcactccagcctgggcaacaagagtgaaactctgtctcaaaaaaaaaaaaaaaacagcagcacaaattagaaataacttacatattcatccaaactagagtgaataaataaattgtggcatattcataaaatcaaatacttgtttacagcaatcaaaatttaaaatttctgctgagaaaatatagcttttctagaaacagcttattaatgcatagtttgtcttagttaccttctaatcattttgaagaaactaaattgatcactaagaataataaaagtcaaagttacacacaaagtagaattgaactcaaattgtcttggaaacatatacagaagggagaacagtaaatgaccagcccaaagcactgagactctaaagactgatttcagtaactagcctctaataaatttgcttatctgaaaatacagcaatatgtaatattagtaaagcatgataatatgtgttaagacccaaataaatggtctgaatgataaacattagtatgtgtgtagaagaggaaaatatgatctcagacttttagttcatactggtagaggaaaagataatgaaacttgaagaaagaatccaaatgggtagagggaaggcccctggggccaagagaatcagtgtagtgcaaacaaaggaaccgagacagtcaaagaaccagattctagaccaacttcagcactgactttcttatatgccttggccaaatcactccccttctctgcctctagtttccctggttgctctgttttatagcatttgttaccctcaacatgttaatattatataatagatttgctaggttttgttgtcattgtccccacccccgggagactgaagttccacaaagacaaagattttttttaaatattgttaaacatgcaagatttgtgtgaaagtacatatatgtaacatgcatggaataatcttattttgcaagatgcataaaaaacaatacagcaaatccatctgcaatttcttctaactcacagatcaaaggagactgtggtatccatgttaaagctgtatcagttggctacagtgtttactttttgtaggaaacaatactgggctatttgagagtgggttttataaagctccggagttctaacgttgttagggaattaaggtccaatcaccaagcctagtccatgcttaggaatttccaaggtacttatacaggcaagtgaaaggaggtaaaaatccccaaaataataacctattttcagaagcatgtattttctttctttaaatattaatagggaaaaaataattaaaaaaaaatttaagtagttagaaagaaattgtttagtgataaagccaaagagttgaaatatggctccaaagaatctataaaccaggccaggcgctgtggctcaagcatgtaatcccagcaccttgggaggccgaggtgggcagatcacttgaggttaggagttcaagaccaccttggccaacgtggtgaaaccctgtctctactaaaaatacaaaaaattagcggggtatggtgatggacacctgtaatcccagctactcgggaggctgaggcaggagactcacttgaacctgggaggcagaggttgcaacaagccaagatcgtgccagtgcactccagcgtgggcaacagagtgagactccatctcaaaataataataatctatgaataaatatttattgtcaactctctgtttctcagatcatgctaatacatgttagacaaacaaaaaaaggtcaaacaaggacaatgcctctaataaatttgcttatctgaaaatatagggaatgtgaacaattagaaaagcacgataatatgtgttaagacccaaatacatggtttgaatgagaatatgtagaattttgagtaaaaagcgtatcaataatcagcataagatttagatgttgatatgttcaaaacattatcagaaactaataaatcggctattttacaaataccatataccatacagtttgggtgtaagaaggaattaagatgtgagtaaagccaatttgtgggagaccttcaacaccggctgagtatcccagggaacaataaatctcaaactatcaacaggaaaagtagtgatagagttggagttagaattctgcatatatataaattctgcatatatatatatatatatatacatacatatatacatatatatatacatacatatatatatatacataaaaacattgaatgtcttaaaggaaaaagattagaactatactgatagcaatgagctgtcatgtggatattggtgaactagataataacaactcatgatactgcattccaaaaaacttattcaaattaaacctttgccatcaaaatataatcccaattttgacctgtatggcatgagacatttctgatttccttgggatctctatctatataaaacacatgacattcattttataatttgaaatctggatctcacagaagcagactggtggttgggctgaatgggtgttacattctccactttctcattatcttatttcaagaaggctctggagacaattcctgacatctccgtgcttcaacttccatctgtgtgaaatgaaataatggctgcctccagcctacctcatcaaaatcagtgagccacaaaagcacattaaaatcagagatgcaggaaggattttgaggaaacaagcttctgtccattatcattaaaaacaaaacaaaatgtagtcagcctttctcaactgcggttccacaagataatcatgccctacagaatataatttgagtgactcctcaattctcctgagatggtacaaatgtagtaccactctagatgcataggaaagaagttaactcattacatacaatagatcccttaaggcatcagggctgaactctgtgagttcaggatgggaaaagctgataccttatgttatatacaaattagggtatgatatttgatatcattttgttttaaaaaataaaaagctatgagtttacagacctatagatccaaagcctcaccacattccagaataaaaataaaacagcctagagaaatgctagaatgaaaggctcataaattttgggctgtcacacagaagtaacaaagaagcaagaaaagactaagaactcatactttacagtttacaaaatgtttttttaaaaagaatttctgacttaattgtcaatatttatggagctcatttaaaattctacgcaatatgctacaacaagacaaacatttcttgtttgagaggaggaaagaacgagatattagaaaataaccttttttttttttttgagatggagtctcgctctgtcacccaggctagagtgcaatggcgcgatgacaggcgtgtgccaccacgcttggctaattttttgtatttttaatagagacggggtttcaccctgttagccaggatggtctcgatctcctgacctcgtgatccacctgcctcagcctcccaaagtgctgggattgcaggcgtgagccaccgcacctggcctaacagggtcatttttttaagctcacaaaggtgttctttggttttgggtttttttttttttagaaagagagcatctcactctgtcacccaggctggagtacagtgacacgatcaaggctcactgcagcctcaatctcctgaggtcaagcgatcctcctgcctctgcctcccaagtagctaggatgacagacacgtaccaccttacttttttattttttgtagagataaggtttaacttttttattttcatagagatagggttctactatgttgatcaggctgatgttgaactcctggcctcaagtgatcttcctgccttggcttcccaaagtgctcagattacaggtgtgagccaccatgcccggcctaatgttatttaattgtaattttgatctctattgtgtcttggaggaggcaactaatattttaaagcttctgttctctgctctctcttgttttcatctctctcatctttatcaaggtattgtctggtcttctgaatcctgtgagacctgacaatacactgactttacataataatttttcaaattttttacactgtcaatcttactctgttctagctcccagtattttaatctgctgttggcatcttttgttcctgttacatttcttttttttttttttttgtcctcatcaatcttcttttcctactcatttcactatgttttcttttcactccatcctgctgctcatgactttctgctctttcatcaagactatatcttcttcctttctgctgaggaagtaaaacattcacttgaaattctctcctggtcctataataaatcctattgagaaaagtggttcttctcttcttccgaggtctccagacaagcattctttcccttgtgctgaaacattatttcctggactcgtgtttgtttgtatgcttcgatttactatcctctaactgacaggacctatccagacactgtttgttgaaagattccatgacaaagtttgtctgtgtcccttctccctactaatcaggagaagattattgtaatctcctcagatgtgggactcagtggtgcttgtagctggaatctaaggtagctgggattacaggcgtgcgccacaacgcccagctaattcttgtgtttttggtagagaccgggttttaccacattggccaggctgttctcaaactcctgacctcaggtgatccacccacttcggcctccaccgcgcctggccagcctaacacctttttaaaggaagaagcttagtcagaattttaaatacacacagatacacacacacacaaataattttatttcaatcatcagcttttttccttattatagtatctaaacagataaaaataagtgagatcaatattcatgtttggagttttgtttggtttcttatttcacttacttttgctgctaatctctattttaaacaattctttgttatgaattcactattctagttaaaaataacaggtatgttatttcattgctgagctattaatatccccacctactcattttctatttcctcaaaatttttttgaatgtcagcattacaaaatgtggaaatggagaactcagtgtgcattttctctctcccttgctccctctctctgtctgtgtgtgtgtgtgtgtgtgtgtgtgtgtggcggtggggggatgtatgcatgttttatggaggtgcctagtctggctagcagagctatcactttgattcttaatgggaatgtatatctccctttgatgtttctgtgggtctgaagaatgcaatggcctttctagtgattattctaggagatctggcttcccacaagaaaaaaacaaaaggttttatctcgtacaagtaaagtagaaagtaaattgaggtaggaaattgtactatggttccttgctgaaataattttgggattagtgaagatgtgagtagttccacttctatttctagtgcctactgcataataggaataacatttttaaaatatatgatttcatgaatgaatcatttaatctttagtcccttttttcactaaaaggtttataatttggggcaagaaggacaccaagctttttacatctcatgtgtcagcagatgactgtgggatgaagctacaggtagaaaaatttaaaaagacagaagctgatttcatttatttgcctaaatataaatgatctaaaagataagccaaaaacattttacaaatagaggcaaatgtggttgtccttgcatcctaataaggcaaaaaggcaattatcaagtaaggtggggacagaaaatagaagttttaacatggtagctataaaaagagactaggacactctagcagaagaaaaaaggtggttaaataaagaataatttgataaagtgataacatatattataactaacaaaactgaaagacttctgtctttttcacaattataacatttctttgtgtgctttttttcctaaagtgacataccacacaatatggttactgtttataatgaccatggatggagagagcaagcaagctaaattagaattggaggatagatgctttttcatgagattttaaaacccagggttgcagcacagaaagcggagctgcaaaggttagtagaaagaactaaaatacatcaaatgtgtctcctaaggagttacaatcctaagaacgtataactaatcgctaactgtaaagctcatctacatggataattttatagacatctaataatactgttaataataaccatggtcaaggacgagaaatgaaaagatgtagggtctattaaagaaaatgggaaagagatgaatcctcagaagaaaatcattttaaaggtcactaaattctgccacagtagtggaagaaggaagatgagattacagttttagttttaaatatatttgcaaagtggcctacatgtggatacagtctcttatccctagcttctctggtgagctataaaccaaggtccctaaggcaccattattaacacatgaatcacagagggtcaaataaactcagatgcccaatttaggtacattaaaatatacctactggtgggaaaagtgagtagggagattgagactgaagactaagtctaacctttttaatgtccatactatagcagtttaggggatgtgtgtgtgtatatatatacaaaggttctgtctttctaggaaaacattccccactaaattaaatatattagtataattctcaataatttttcctctgcattcaatagaactgtatcataactaatttcatggaggcaagagagatcaagtttgaacatcaaaacgagattgacttttgggaatttgtttggttttgtttcctactgacagtataaaagaagcacccttattgttaggactatatcaataaaactgcatatatcaccttcatggaaatatttaaagcatgcagaagtcagctatgttgatagaatacagatttacaaatcaaataataataaataatgagaataaatcttttattattttcttaatttaattcaatttcaagcattttcatataataaaataaataatttgtttttctaacacttctctctggcacggaggagagaaagcaatacaaactaacctatcatgtcaccagatgaacgggctccttcaatagaaaacctcttttaaaattaatggcctgctgcagcatgatgagtgctcaggaaaagaaatatttatgggttttctcctaacttctgacccttgaaactaaaagcactttctccacctcctctgttccagttaacccataggaaaaacgtctctctttatggcagggagaaatttttatgatactcagagatatagctatatagataagtgagccagtacacagcttcccccaaaagcttgcctcccagcggtgagaaaaagcacagaatgccttgggaaagagggtaactggaacatgcatcgcctactcatctcccagcatgggatggagcctccttccagcgtgacactgaaatgcccaggccattcttcaggctatccaatgagtctctgtagttaataaccaacctgagcattcaggtaggctcaggatcctggctcagatataaacccagattccagcaggagtagccactgaaaaatcaagctttttggatgctctgccaaagatggtttcaagctactgaagatctcaaaaagaaaacactctttctctctgttctcatttgttagcttgagacagtagagcagactataagactccagtcataaataatggtaggccagggatagtggctcatgcctgtaatcccagcactttgggaggccgagttggatggatcgcctgaaaccaggagttcgagaccagcctagccaatataacgaaaccccatctctaataaaaatatacaaaaattagctgggtatggtggctcatgcctgtaatcctagctacttgggaggctgaggcatgagaaccacttatatccaggaggaggaggttgcagtagccaagatcacgccactgcactccagcctgggtgacagagtgagacttggtctcaaaaaaataaaggcaataattatgtattaatataacatatatacattatatataacatatatagtataacataacactataatgcattgctacaaatgtcatttttgttttgaaaaacaggaaagaaatagcacacctaagagaaagtgatgttccctaaaacaaaaaaaaaaaaggtcacaatcttcttttggaattttgctatttttgagaaaagtttttcgttttctagaagagaatgatcataagttacccctctcttatatcaaataaaaatgtcccacatcaaaatgagaccatgagcacaaagacagctagtcatacacacttcataaaaagccacaaaatgtatttcctttttaaaaattctctctcattagcttactaaatatggtaaattcaagacaagactgaactattctcttgataatttattttcagaaaattaatgctttttaaatatcagtttcaagagttcattaaaaattattgagggattgtttcttaataatgaaatgcaaatattataagtgaagggagtgttaattacttcaaaatgtgaaaccatttgcagtatttaaaataaattaaggacactctcactctaattattccaggactgcagttaagtctcagtcctctatggttgttgtacatatggcattacatcagatatgacacgtatgtgaaacatgctttttcttcttcctactctacatattttactgtgatgtgagccatatgtttcattacaaagggtggtatgaaaaggctattgcaagagaggaaaactcttgattcagatttcagcaatacagaaaggcctcttcattaaaaacacattattgtttggtttcaaggcatttaccttatgttcccagtaacaccctgacagtttagagatttaaaacatctggaatttaggcattaagattttagggatcatggatctgacactaaaaatacggaccattatgggacactctaaagaatgggttatttgagccaggcatggtggctcactcctacaatcccagcacttaggaaggccaaggtgggtggatcacaaggtcaggagttcaagactagcctggccaacatggtgaaaccccatctctactaaaatacgaaaattaaccgggtatagtggtgcgtgcctgtaatcccatctactcaggaggctgaggcaggagagttgtttgaacccgggagctggaggttgcagtgagccgagattgccccattgcactccaggatgggcaacagagagtttgtctcaaaataataataataatgataataataataataataataataatagcagcttatttgatggcaatagagatcacatgatgcatatattaatatgtaatcatttaataattaaacacatctcatgattgggcatgaggatacatttaatgagttataattctgggtcccaatattatctcctgtttattagccagacaacctttaaaacactgttctgctctattaattccagaagtttatttcagttgtgtgattatgataaaatgattatctagcttcctttcagggccaggaagtgaaataaaacgccctttgagcagaaagtacaaattttgcaattaccaaatgctaaatacgatttaaacatatgtgtagtagtttaaagatatgtacacaaattatctgatactcttcccctcaaaagatggagcataattccactccccttgactgtgggctagacttagtgactgcttccagcaaacagattatgccagaggtaatgcaataacattatgccagaggtgatgcaataacaataacactataagttatataaaaaccatgacttccctcttgggtgcaatctcccgccatcttcattctctctggcataagccaaccttcatgttctaaggacacttaggcagcccgtggacagccccacatggtgagaaaaaccaatccctgccagcaaccatgtgaataaggttagaagcgggtattatcagtcctgccaaaagccaagtagcagagcctacaagccaatattcccccagcctagccttgagatgaccacatctctggccgacatcttgactgcaacctcgtaacagatcctaagcaagaactacctggttaagctactcccatattcctgactcacagaagctgtgagataataaatgctgttttaagttgttaaacttggcagcagtagctaactactacagtattagtagtcagaaaaagctaactactacaatttgtaatcagaataagctacagtgggtcaagaatgagtcctgttctccaaacccagcattatgacttttcagctgtttgatattggacagtgtatccacagcttctgggcctcatttcttcatctatacaacaaatattttaaccaaaatgatttctaagactcctctggtcaacaaaatatagtactctaaagctataaacaggtagttctaaacctgatgtaggaaaaaatgacaattggaatagcccagcatcagggactgtctttaaggccctcttggtggatagtcattggtagtgtccataccaagagtttccttacactaggtgggaaatgtaggctgaaaacctaacagcaggtcctcaggtaacatcatttggttcaaccccatttcgttttaccactgatgaaaaaaaaaaaaaaaatcaatccccagccgaggccactgtctttgtggagtgtgtgcatactccccaagtatgcatgggtttcctctgggtacttggtttcctcccacatcctaaacatgtgcactgtaggtgagtcagtgtatctaaagtgtcccagtgtcagtgagtaagtatgtgtgagtgtaccctgagatgggacggcatattctgcagggtcaggtccccaatttgcaccctgagctgccagggtaggatccagcctcctgcaattctgaacttgaataagtgcattggaaaatgaacaaatgaatgattaaaaattactatcaaatagaaaattaataatttatctataatcatacaaatacacgacaataaacactgcagcacaaaagcactcacctatgtttgtaattgattgcttttgaattgcatggtgggaaaggacacttcttacaattttcactttgcaaacatttattccttgatttaacccaccaccactaggagcatcatcactcatggattcaccaaaagttgggtaaataattgtcttacttgtttttatgaatctttcttaaatgtatataaagctcacattaatttcaatgtttaatattagaagtgtttatttagaagtttcgtgatgtgtttgtgaccagacatatgccataggaacttaactcttgtttatatcaattagccgatggtgaaattggcttcataggtttcgcataaggtcatagttttcaagaacctatcaacaatgttaagtgaggacttactgtatatgtttcctttcaactctggtatgctatatttctgaccctaagctttaagaaaaagagaaatagataatgcccccaaatcaaacaaaaccaaaatgaagaaccgcatatgtaagagatttagataaaatatttccccacttttttttcttttttttgagatggagttttgctcttgttgcccaggctggaatgcaatggcacgatcttggctcaccgcaacctccgcctcccaggtttgagtgattctcctgcctcagcctcccgagtagctgggattacaggtgtgcaccaccacaaccagctaatttttgtatttttagtagagatggggttcaccatgttggccaggctggtctcgaactcctgacctcaagtgatccacccgccttggcctctcaaagtgctgggattacaggtttgagccaccacacccggcgtcccacattttttgaaccagtatttccccttgtacaactctactcaaagatcatttatataggaactcaaagacacatgtacatttgttgcagcattttttttgtaatggcaaaactagaaaatatctgagtgactatcagtgagggtgcaccatacgttgagtcataatagatgggtggccatgatcaatcttcaacaaagaaaacaaactctaaaagctttgttaggaatctcaaacttgaccatacaatagaattatcagggagttaaaaattttgtgtttgtttttttaattcggatgctcaggtcatactccacaataattaagtcagaatctttcaaggggagacccaggcatctgtgtatttttgaaacttaccaggtgattccaatgtataacttaagttgagaaccactcagtatggtctcatttaagttacagtaaaaagaaaaaagacccactgctgtgtatgggaaagatgaaaaaggaaacatatataactaaacatggtgagaattaggataaagaggaagttttactccttacaaattttttacaacaaatatactacggtaattaaaaaaggtcagagggaaagaaaatatttcaccaatttctcaaatacagtagggtctggaagaacaaagacagttgttactatttggcctgaatttgcgtctttaaaagatattaagtgtgggcgtgatagctcacatctataataccaacactttgagatgccaaggcaggaggcttgcttgagcccaggagtttgaaaccaccctgggcaacatagtgagacccccatcttgattaaaaaaattaaaaaataaaataacactgggtataatggtacgtgcctatagtcctgcctgtaatcccaacactttgggaggctgatgcaggtggatcccttgagcctataagttcaggaccagtctgagcaacatggcaaaaccttgtctctacaaaaatacaaaacaattagctgggtgtgatggcacacacctgtagtcccagctactcaggaagctgagaggtggaagaatctcttgagcccagaggaggaggctgcagtgagcacagattgaaccactgtacttcagcctgggtgacagagcaagatcctgtctcaaaataaataaataatttttaaaaataagaaataagagtcattaaacctttaactacaaaatgacacccagctaaaaagtaaaaaatgtaactaatggattagacactacagaagactactgttgttactgttttatttttcccataaaacttactttccttctaataatgattccataaagatatagtccaaaacccttcattggaagaaaaataaaccaaatatgtacagaatttataatctggaattaatattagaaatgaagtaacctagctcttcttttaagatataagaaaaatgaaactcactgaataatcattaaacagtttgcaagggactagtacactgacttactaagggtagtctaatgccgttcttaccatgttatagcactatataataaaaacagatttcccgtgtttcaagggtgtttgtgtacatggcagggaggcacaggggaggtgtttagccaaaagcaacccacctaattctgtgtgttagcataacgccaacttttgtcaatgatttatgaatcacccaaggaaaatgttttatgtaacagtggaaatatttttatatatttaaatgtgcagcatgaagaaaaactaataaagataaatgatttatgttataatgtttactaggcattgtatcaggaaacatttgtgtctagtatttgtttgagttcattcggaatttctttatttactcactcactatttatatatctttgtttagtttcctcacaacgctacagttttgtaaacactagtactgagaactaaatgaaaattgcaaaagcgtaattacagctggatgagaatgttaagcactcactccaagttttaacctgagagtgttttcagtgaatagcatcatcaatcaatatttattgaacatccacaaagtgtgtgatttggccgaggcagtagacaacaaaggcatttgtagttgtgtggttctcccttcttcttgcaagtagtggaaaactgccaaaaacttaatgtgataaatgaaaaaatgtgtcccccaccactcatctgaataccaattgcaaagtaacaggtttctctctaaacatcagccctcagtgtaaaaatgtaatggttctactgtgagaatattgatgtcagaaggaaagcaactctgttcaacagttttctatctcttaaaaaactttattgttttatatttctaaaacaaagaggggagggagagtttttgcttgtaaatagttcaaaatttacaattagaaaaaaaaaaaaatacatagaaatctgaccgcactcccctgctcccaatccaaggatgccagtaattgcaagctggtagatacacaatgggtttaaaaaatggacattcacgtaaataggaataagaaatgatctgccaaatattacagtgctaagacagctatgagtgaaaactgtctgattgaaagtaccggtcaggcacggtggctcatgcctgtaatcccagcactttgggaggccgaggccggtggatcacctgaggtcaggagtttaagaccagcctgaccaacatagtgaaccctcgtctctaccaaaaaacacaaaattagccaggcttggtggtgcacgcctgtaatcccagctactcggggggctgaggcagagagaattgcttgaaccgggagaagtggaggttgcagtgagccgagatcaagcccactgcattccagcctggatgacagagctagattccgtctcaaataaataaataaatagaaagaaagaaagtaccttctcaatttgctatgatagtgtaataaaaaaaaaaacacgatccactatctattctaatacaatcaaataattagaaaatacaagaaaatttattcaaagaatgaaaaaatatgttctatgagctttgtctattttctattcaacagcaattcatttttctctcattaaatatactctctaaactgtgtaatatggaagatttaattattattagacaatggtgtagtcaatccctctaggaaactgactgagaagctttcactaaatccaaaatcttacacttcagaccaaactcaaagaagatccaaaaacagatctacttgatacttgcttgacctttttttaaattaaatactttcgtggaaatatatattgtatgttttatgtaatgtatgttccactaattatctgaagtcttttccaaaaaatgttcatatattaatgggcaaaaacgtcaaatattcaaactcaattgaaaggcaaaacacaatagaaacctgaaaactttaagatgtaatcagcattcattgaacggagtaaaacttcccattgcacagtttctttgataacagtctttatgccaggcgtggtggctcacgcctgtaatacctgcactttgggaggcagaggcgggtggatcacaaggtcaggagattgagaacatcctggctaatacggtgaaaccccgtctctactaaaaatacaaaaaaaattagccgggcgtggtggcgggcacctgtagtcccagctacttgggaggctgaggcaggagaatggtgtgaacctgggaggcagagcttgcagtgagccgagatcacaccactgcactccagcctgggcgacagagcaagattccgtctcaaaaaaaaaaaagatagtagtctttattctttattaaaaatttaaaattctttctattctaactgaatacactgatttgtaaaatattttcctagttatttacaaaagtttttcccattatggaggaaaaccaggcatgtatgcaagtccgtgtacacaaaatactaaagactatcactgtacttttaaaaattcttagaatttagaaccaaggaaagtgttttattccttaatatatctaacagtagtgctttgtgtgtcatggtaaaacatgaaatctttttcccaccaaaaacaggtgacaagtctaagtcagtgtagtatagtgacacacggactttaaataagtattcagtaaaacccaaagacctcataaatttccaatgtaaattttctctttggtttgtcacttggagatttgtggagtggaaataggtattggatgtttgttttatgaatataaaatttactcaaagttccaaagtcatctaaaaagaaaagtcgaatacttaaaggataattataagagaacactgttttcaaattgcatgcacgtatacatatgttcaattataagcattcaacccttgttttagatgaccaaactagtagccacagctgtgacctgtgcatggctttaaaaaaaaaaaaaaaattcagccatcagtcatttactaacatcatcttataaaaaagcccaacgcagtgtacctcacgcagaaaagctgggtcataaaccaaatgctttatcaactaatcaatattagcaaatatcagactgtaagaataattactaaaaaaagaataaatgcttgagatggataccccacctaccctgatgtgattattatgcattatatgcctgtaaaaactatctcatgtactccataaatatatacacctactatgtgcccacaaaaattaaaacttaaaaaaaaactattccttcctgaaaaaacaacaacaacaacaacaacaacacagattttgaggccagaactcttttaaattctgcttatttttacataattttattgtgatggtttcaagttcattaaccttttcttctgtaatgtcttgttggctattaactcatcttctctaattttcacctcagacagtgtagttttttatctcaagagctccaatctgggtttttaaatatttgcatgtcactacttactttttaaaacataaaggagcacagtacataaagaagtacagttaaaaacctcaagcagaagaactgcttgagaccaagagttcaagaccagcctgggcaagatagtgagaccccatctctacaaaaaattgaaaaatcagcttggtgtagtggtgcatgcctgtggtcccagctactcaggaggcaggaggatcacttgagcccaggagtttgaggatgtagttagctatgactacgccactgcaatccagcctgggcaatagagcaagaccttgtctctaaaaaaataataaaaataattttttaaaaacttgttttaatgttcttgtctgctaactctaacatctgtgtcaattctgagtcagtttcaataggttgatttttttttctcatgagtataacttttctgcttccttctatatctggtaattttttattagataccagatattgttaattttattttgggggtgctagatatttttgtgtccctataaatattcttgctttttgttctgagattcagttaagattcttggaaacattttgataactttaggccttgtttttaagattctttagttaggactcagcttagggtttaacctaaagtcaatttttccccacttctgaagcaaaacccttgttctactctactgaatgccctatgaattactctatgaatgtactctactgaatggcctatgaattatggagctttcctctctggtgggagcaggcaatattcccagccctgtgcaagctccagagattgtttcctttagtctttttgagtggttctttccccagccttgggtagtttgttcacatgcatttgctggtcagcactctcttgaatatcaaccagagaggaagcctctgtagatctccagagctctttctgtatagctatctgtcctggtactatgtcctgcagactccagctgccttagcctacccagacactcggccccatcttcccaactcaggagtttgccaagttttaattgatctcttctgtttaaaccctagaaactctcgccaggcagtaagctgaggcaatcatggtactcgcttgttggtttctcatcactcagagggcactgtacttcaggacctgaagtcccatgtcttgaggaccactgttgcatgtattttatctgttttatggcttgtttcacacaggagaataaattggtccctatcctacttgctcaaagctgaagtcagaattatcttttcacaacaaaaatctgataatgtaaatcccctgcttaaaacacttcattgaattcccatcattaaaataaattccaagctctttacattgatttagaaattgacttcataatttaaatcttgtctactttgctagctaatcttgtgacttgtttacaataactatgattcaaaataaaatagctgcagtttcaaatatacaaaatattctttcattacacttgcacatgctgtttcctgtctagaactctcttttctgccctggctactgagaaagtcttattcattcatgagtgatcaacacaaatgtaatgtctgtgaagctttccttacatgacacacttccagctaccttctccctctctcctgactccaaccccaagaagagttaggcagccctcctcaacgcgcaaaggagccatctattatccaatctcctgttacagtgcccattactttgtaccacagctatttatgtaaatatctatttccccaccttggacaagctcctcagatatgtttcctcatttgtaaactggggataatacagggtgtcaaaaagttggggtgcacaggataaatatatcttaactgggatgatacttgcattttcaaccaatatgctcaatttggtttccttcaacgtccggatatcttttttaggtagcataccttataagaaattggattcaattgctaatttgaataacatattatttaataaaaacactacagagaaaatcctaaaacatgaaagacctcagtgccttcagaaagggagaagattagagattacaggagagagctgacaagatgaagatgaagaaaaaacagggagctttagagactttgtaaaggattttatgatgtaacataaatgcaacaatgttacacacgcataaccaaaatgcatgtgaaaagtaacttttttttttttttttttttttttgaaacggagttttgctcttgttgcccaggctggagtgcaatggcgcaatctcggcccactgcaacctccgcctcctgggttcaagtgattctcctgcctcagcctcccgagtagctgggattacaggcatgcgccaccacacctggctaattttgtatttttagtagagacggggtttctccatgttggtcaggctggcctcaaactcccaacctcaggtgatccccccgcctcggcctcccaaagtgctggaatcacaggcatgagccactgcgcccagccatgaaaagtaactttaaagggagaaaatatattagaggttagcaataattcaaatgttgattacgaagatacttcattatatggtgccatattttcaattgaaaatatagtgaatataaaggaaaaattaaagtctctaccaccctgtactagggatggcaacagaaaggaacaatttttgatcgggcgccatggccaaataataacccacaagtctccaattaattgctatgtccagtgatgccttaagtgatgcaggtactaacatctttggaatgaactttgaatcaattaattgtattggtatttaaaataaaatacatcattaaaaaatgtctcatacgtcagagcaaacagcagaaggtgaggcataatttttaaaaacaacatttcaggggggtctttttttctgatatggtctgtttaagctttgtttactttctcagcaagaataaagacctggggcaacatttaattaaaatgttgcctaagctttcatgcttcctgaggcagtaagactggggacactgctatagtcttcttgctgtggactaggaaataaacaaggatggataactttgaactctctgcataatatgtagagcaaagccatatccctggaaaggccaaaattaggtgagatgcagtacataacaggtatggaatatactaatgctttggattgggagcaaaaaaaactggaaaggccttagtcacatgtactttctattatctcaaatattatttttataatttcaacttttattttagagtcaaggggtacatacacaggtttactgcatgggcattttgcatgatgctctgttatctcaattataaaccactaatttctaagatccaataacctggctgggcatggtggctcacacctgtaatcccagcactttgggaggccaaggcaggaggattacttgagctcaggagttcaagaccagcctggacaacatactgaggccaagtctctctaaaaaataaaatttgaaaatggaaaaaaaaaaatgatgcaataatctgcaggaatgaagaatagtaacaatgatataaactactattcacatgaacagcttgatgtttcatttaggctgggccagtcctaactcctagcagtaggtaaagttgatggacagtaaatcaaaaaatgcttcgaaactatgagttaaaattaaaaagaaatgaagatttggtttggtagtgcttcattttctttgatttttaaaagcagacaataacaaatgttcccagagactatcatagaatttccttggctcaataactagaaataattataggtcccaggatggaagagtagaaggaccgcaccctgattttgggacagtgaaaaggtgagattggaccctgcacaaggcatacaactatactaaggctcagtttgccatgggtaaaatgggatgttgtcaaagttaaactagacacctcaaaagtaggcatttttgtttttatttttgagacagggtcttactcacatcgcccaggctggagtgcaatggtgcaatcttggctcactgcagtattgatcttccagggtcaggtgatcctgatacttagcgtcccaagtagctgggactacaggtgcacactacaatgtccagctaatttttggttagtaaagatgggatttcgtcatgttgcccaggccggtctcgaactcctgggctcaagcgatctgccggcctcccaaagtgctgtgattacaggaataagccactgcacccagcctaagaataagtatttattaaaatgaaagcaatgatgggggtgatccaatgggctctgtaagattattttagcagcagtatgagtgatagccacaaaacaggacatttgagaggcagggattccattcagaaacaaagacatttaaatttttagaataggctattttttttttgaagtcctaccctttaaaaaatatgtattatatatatattatatatgtataatatataaatatataacataatacataggtataatataaaaatattatataatacatatgtatagtatatgaatattatataatacatatgtataatatatgtataatatataaatatgatgtaatacatatgtatagtatataaatatattctattcatatatatatacatttttttctttttttgatatggtcttactctgtcacccaggcaggagtgcagtggcaggatcacggctcactgctgcctcaacctcctagcctcaagagatcttccacctcagcctcccaagtagctggaactacaggtgcgtgccaccgcgcctaattttttgttgttgttttttagagatgggggtcttactatgttgcccaggctgatcttgaactcctgggctcaagtgatactcctgcttccacctcccaaagagtaaattatcatttaaacttttttgttaaactagtatgcttaagaatgaaatttaaacagaggtattacccaactggttgacaaattaatacatttgtcttttatatttccttctggaaaaaaaaagagcattaaagaaaaatgacatcaatgtaaactagcagtagttaacagcaagacatttttacgtaattttgaaagtagttgccatacctccttcctcaaaatataaagacaattttgtggattatgttttctgtcaaaagaaatttcataatctaggaaaaagtttacagctagtgcatttgttttttaagatacctaaaactgtcctgagaatgtgtatcccattttgagtgagtcatacattaatttttgtaagtcagtccaacacttagcaatcttaaataaatgacacatctgtaaacattcagtggtatgaaggtcagtgataaaagagagctggtcatatattaaattgaattgaaagccttatttactgtacttcctgatttatgcagtcctatattcattgtaccaaagatatgatcctatgggacctaattttagtgactggagcaaagcatagtgattatctctcattttttatcaaattgtagtttcacatgaaatccttcctacaacccaccatgaaaaacatcctctatacaacagaagaaattttgggctccatcctgaggtatttattaaccaatccacagagcgtcttccatatcaatgctttcaaaacaaaatacaatgtctaggattggttacttgctttctcagcagaagtaattcagatgtgggctctcagattagaaactactgttgctctgtggtaatacattacatttccatctgaaaggttcatgctactttttactgtttaggtggttttatgtcatatatatgtatgtatgtattctaatttaaggccggcgtgatagccacaggctagacaatttaaactgattggcaaattataacatttcactacaatgagccaaaattagtaataaagattattcccttcttaaaacttgagataattgcctttttatcatatttttgagacaccaaagttcctttcttctttgatttatcttaggcctcaagtcttgtcttttgcctggccaatatctgttgtattcctgacagctcagcctcctctaacttctgagaagttctcgctacctctggataacagagcgaccgtgtctggacagattactagctgcgaatctgcccaacactgaaactgacttcatgctgcaagatcactggtgtctttttgctctcattcttgcgctgggtcctgggccgtgacttccaagctccacaggaccaattctgctttgttgaggaaagcaccttctactgcctaagagatgtggattccactgtttacttaagcccttttctactggaaacagaaaggagatctgcttagaaagatcagtaatactgaaactaggaggccatggagtgtttcccacttgtccactctgagaccgtggctacaatattcatccactctgagcttcagttttatcacataaaaatggaaataatatcatacagagcccatagggttgctcaatggattcagtgaagtaacacatgtaaagaatttaccacactgctcaacacatggtaaaaggtgttttattaccaccaccaagaaaattacttttcaagagcagtgttaaaaagcaacacaatgattctttatgatatcttcactctaaatcatgtaaaagcttatttaagatccactctgaaacgtaaagctcaaagggaaaaagaaggtggagggaatgtcagaggcaagccctgggctaaagacaggagatgagaggagaactagtccctttataccctgatggaaagacagtatacccatagcagaaggctgacagaaaaataacagcaggaagacagagagagcgagcgaataatataaagaacaacaagaatctgttaagcaaaatacaataggaagccattttaattcattctccctttccagttcttttctttttggaacctgttctaccattaaccaaggcaaccaagtacttacccagcccctcctttagagatgaaaacatctctcagttatctgtcagccttttcaacatcacatgtcatgggctgggtggggccgggaggtggggcggggcttcaataaaacctaatgtgtcgtcccggggttgggtttccatgttaattttatccttccaattattagaaagaatgtaaagctagcattcaccaccaaagactgtcatacatattattacaactaggaataacactaccaaggcccactctctttctctaattctcccatccctgctcctctctccctcacacacacagagccagagatgccactatctcctcagccatttcaagctttccttttaatcagcacggtaaacaagcttctatgcctcaggctggcgttccacaaactcagccaaatcgtggggttttgtgaatgctgcagtcagcagggcccaagaaggcatatttgctcacacattatgtcgatgttttgttggtttttttttttttttttttggtcctaaggatactccttggactgtgggtatgatcaacaagagatgtcatttatcttacaaagactctaattccattggattttgattagcagtggtaaccaggtgaactgaataattactgttactaaccataatattctttacatcttactgcacaatgtaacatcaaaatcctagtgagggaaaagttaaagtgtcaaacattcaaagtcataagccctcagtgctccagttctgagaatatctgtaaaggatctcccttctggggaaaaactaagaatagcattttccaaacaaaaggaaataaaacgactctaaattcaccagatcataattattgacacaaaattataaagtataataccttgtgttcagtaaaaattctagataattattccaccgcacaggattaggccatttattcaagaggttctcatttgataaatttaggaactcttaccaatccatcccttttccccgagagtaggtgtaaacatgtaaaaatattccttaaataccaattctgagctcaacctgcgctaggcacagcagacacaatagccaagaatttgaactttgttactagactcaggtttctaatttaatcaggagcctcctgagtgtttgagactaggtaatgttttcctcagacacggagggattaattttgcaacactgggagaaggaggtaccggagaagtctaacaaaaaatgtccatggtagtttctgccaagccaaggtgcttttattctctctgtgaggtacccgaagcaaccccagagccaggctctcagtgtgtgtcagtcagtagaatgaaaaactagactcaggcaaggcctgagaatctacctcatgtgaacatgaattatcatgcatgaccttcaaggccaagaaatattctatcctcaaaatcctgaggtaagtaaagaaacaaataagtcatccttaaaccccagtttatagatgccagaaaaggaaggagattgtgccaaaaataatctcggaagtggttgtatgtgtatcaattgtggaggtacgtttgcttacagtatctccagtgcttccttctgcacatcacagatttgctattgatcagctgtggtcagatattgtaagtataaattaacctgctccagtgaaaaatacccaggggagctattacactctgaagaaatcttctctttaggtttaactgtacttacaagtacaattcaataggaggatgcgggatggttagctccaatttcaccaaccacttttttttttccagtccctgattaaaagattctgcagtttatgaccagcaaaaggctttgccttggtaccacttcaagactgaaggaatgatacaagaaagagaatttatcatcggcagggggcaatcagctgtccagaggtgcactctttatctaaagaatcttaagagtcagggggctgctctttaaatgactttggcaactcctccagaaggcttaaaagctgtctctgaagcctgtggtgtggtatccatattaatccatttgagtgaaaattaccagttccaaggaaaatacccttaggagataaaggtagtaagggaaagaagaaagacacagtcaggagacctgtgtcctagctgagaaaaagatatgtcaaaagatttactgaaaacagaaggcaggttttaaagtaagagtacaactcattagtataggaaaacaggaaaaaagcattatccaaagcactaaaataaagaaagagtcaaactctatcattttctaagcttttaaaggtcacatggagcactatgctaatattttgcaataatggactctggggcagtgctttaatgaaatgaaatgaattccaaggctctctgaatcttaatcagactgtgcaggggatgcaggaaggtcaggctgacaagcaaatgatgcaaactatactttcatattacaatgagtacgttttcccaaaacaagtttagtgtcttctctatatttaaggtcctagtaacttatcacattgtgaaaggtccttccatgtcactctgtatgcctaacaggccagcaagtgggtcagctcatggtccatccataagacattctagtaaatcaatttaaaagtatggtgttagcagtggacatcctcaatttctttttttttttatttttcaaacggacaaaaactgtatatatattatgcatattatgtatgtttattatgtatacataatgttttacgtttatggtataaaacataccataatgtttatggtataaaacataccataatgtttatggtataaaacataccataatgtttatggtataaaacataccataatgtttatggtataaaattgcatatgtgtacatatacaaaatatacatgtatatattgtggaatggatcaagctaattaaaatatctatgcctcactttttgcggtgaaaatatttaaaatctactcttagcaattttcaagtttataatacattgttattaactgtagtcaacaacttttttatggtgaaaatattcaaaatctactcttttagcaattttcaagtttacaatacattgttattaactgtgtcaccatgttgtgcaatacatctcctgaacttactcctcctatctaactgtaattttatatcctcaatttcttttcatcatatggctaaaacatatgccaaacacccttttcaaggtaaatgggaagggaaccctcaacctatttcagtgctgagacactcatgaaaacagaaatacttaacgctttttttttttttttttttgagacggagtctcgccccgttgcccaggctgaagtgcagtggcacaatctcggctcactgcaacctccacctcccgagttcaagcaattctcctgcctcagcctccggagtagctgggattacaggcgcacaccaccacctgactaatttttatatttttagtagagacagggtttcaccatgttggtcaggctggtctcgaactcctgacctcgtgatctgccctccttggccccccgcaaagggctgggattacaggcctgagccaccacgcctggcctacacttctttttcatgtgaaattcaatagtctacgtagccagaaaagctccaaataggtaagcagtgatgttttatctcaaaataggtttcttctctacccttgcagtttttctccatccaactaaatcttacccattcctcaagactcaatttcagttttaaattcaacaacccaccacaagaagttcgagcaaattacagcatatcaacatgaccagaatattaaacttgaaaatatcatatatgaatcataacgaagaacggaaattttcataaagaaatccattttaaagtcagaacaaaaaaagttcaaaatgattgtaattatataaaaaagttgtacattgacattcacaagtgaatgaataatgacataaatagagcacaatgttggagttattaatttcccacaaagttaaagacttttcctagtattagtaactttctgtatatcataaagtaactggtgtttcctactcaaattcaactgaaaagtatgaagtcattacggtttattttgctacatgatggatgctgtactgaagttttatatgtattctttcattttatccccaagtgattctatggagtaaataaatactattacttgacaccgttttgcagataaaaaagcccaggcctacttaagttacataacttgtcaacggtgacattgtgacagaagtaggaatttagtcccaccataccctggtcattagaacacactacctcatacctcaaggtgaagcccactggtgcttgagagtggccactgctttggtttcccagattgttaagatgacaaacggctcagttccgtttcaatattgcagtactggtctgatggctggattctactgtcataggattttcaactgtattttattcctttacaaattcccagatagagcaggagggcaggtaaagaagacatattaccctccaaaaaagaaaaataaaaaacttgagcatcgagacactcaatatttacgctaccccttcagtgctatacatcctaacacagcttaaagtttttattttactcacaagtcctgctgctttggtaattcacgaaagggttgtgcgcctgacctctaatgataattcgtcatatatcctcatgctttcttattggagctgtgaaacaatgaattagcaacaaatcctccactctttgccccttcagcccttggagtttaactcctctcacattacagtatttattgaatttcccagccaaacggtgttgtgctccataaaattctgacaagtggactctgccaagctaataatggcttcattctgctgaaataaacttatttcactgtggcaaacaaaacgacatgacctggaaaggttatttttaactgggtaatgactcagtcccaaccaagcttttctctcaaggttcccagttttaaataaatttcatttcttaaacgtaaatgcatgctattacgtgtgttcttgtctgtcaatctttcacaatgaagtaaaggcagatattttcattgcttaaggtgtatgattctctttattcaataacttggtcggcttatcaaactattcccaaggatcctggcatagagaagccacccagagaacctgaaagacaaggctacataaagaagcaaaatccttttaaacagaatctggttttattgcatttttcttttaattaaacagcgtcagaacctttccaattcggcaaaacttttaagagtgtgcctctgagaaagagctcttatctcatgtttttaaagcgtgaataaattttgctaagtttgcttagcctgcttaccaaataaagatatgccaggacaaatttctctacatccacattagttaacatcccccctgtatcttaaactctccataccaaaaatgtctgctactaaaaagtttgaaaagcagaaacacgcgtttttctctatactgcctccatatcttacagttatcatttacatctttttatcttgcactgcgagcccctcaaaaacaaacaaatgaacaaacagaaacaacttccatgataaggtcaaattttcttcaagtttcaaatgatcagggactccgagagcaccattacaacagctgggatcttgtaccaacatgctgcaccctgccagtcctgccttctgagactaataaaagagaaaacccttgacagctaacagctgggctccttatgaagctgttcaatagaaacaacaaggcctcccacagcccaccaaaaatcaggacttggtgtatagacacaaatatgtacaagaaaagaaatttggtaagagggaacacatatttaaaagagactgaaacaaggagatgatgaagaataacaggggaaaaaaacactaatcaatgaaagagaaacccagtcataccggcataactattgaagatgttaagagttagtgcaaaaggaattacccatggttttaatctggctggagtaggggacttgtattacatatgattagctacaaaggcaaaagaacaagaaccttttcagtaaattcacatagtcatggttctgtccaaaccacaatacaaaatcctgaatatccttttgatgacctatagtgtgtattcacacttgcagtaaaagaaactaatgtgaatcgccttactattgcttcctgccagcccctctgcctccatattaaagaccatcagctaggctgtggctaccagctacaactcctcagtcaaagccatgtcacagaattactgccagtcggcttaacaaataaagtacaaaaataaaagcacactgaagccatataaaagtactgtggctaaacaaggagtggttatgctggccattgagtaaaaatatctgtaattccttcaagttcagtaagttaaagtaaagcttcaaactagggtagctgaggttatagtcaatatacagataatacaaatagaaactagcaaaagcataaggaacacaaaaactctcctgtaatgtattacagatggtttttaaaagtttctatggctactagtaaggaaacaaaagcaaaatctttttcctttataatgtgcactttagatggcccaacagaatcacttccaattgctacagatagataacaaacaccagacaggcagtctgagaagccgcttaatttgttgtgtgtgtgtgtgtgtgtgtgtgtgtgtgtgtgtgtacctcatacacattgttcaccgctagtggcaattcagatactgacccagaatatgaacaaggtagggtgggagggattcagcattactatggaaaatggccatggaaccattcataaattaacgactcagagataattgaacttgttcctgtgttaactatgagtttcattttgttaaacagtcaacactgaaattgttttaatcctataaattcaactaaaacaattactgaagtgtgttcaatgccgtggttatttctatttttgcaggtattaggcactatgttttgaaatttgttccaggcagacaaaaaaggaaaagtttggagttctttttttttttttttttttttttttgagacagagtctcgctctgtcgcccagcttggagtgcagtggctccatctcagctcaactgcaaccttcgcttcccgggttcaaaagatctgttctcccacctcagtctcctgagtagctgggattacaggcgcccgccaccacgcccggctaatttttgtatttttagtacaaacggggtttcaccacgttggcgaggctggtctggaactcctaacctcaggtgatccacccgcctcggcatcctaaagtgctgggattacaggcatgagccatcacacccagtcaaacatttggagttttatacctgaatcctcagggaaaaaaaaggtgggggggcggggggcgaggggtgtattttcattaacaaactgattcccagagcgtgaatctattttaagtatctcacctaaggaaatgtttatttcaattatgatacctaggtgtctgctgaggaaatataaagcatggtgagaaaactactttatttatttagagacagggtctcactctgctgcccaggctgcagtgtagtggcagctgggactacaggtgcgcaccaccacgcccagctaatattttcttttttttgtagacagggtctcacgatgttgcctagtctggtctcgaactcctgggctcaagcaatcctcctgtctcagcttcccaaagtgctagaattacagacatgagccactacgcctgacctgagaaaactatattaaacagcccagaacttacacattcctattgctattgcatccttttccatagttaccttgggaagctagacactcatgctgcttaagcagatttttctagcaacactttcaacacacaacttctagctttactcagcttctagttactctacttgagcaacagcaatatggagtcaaagctgctttgaggattattatttctctaatattaaaaatgggtactaaccccttaaacatccctcatttctgacgatgacaatttgttccctgccctttatcttaaaattttttaccttctcattttcccccagttgacatgtataatttgtgcctttttctagtctattaatgtctaggacaggggtgtacacaataatctatattggttaaaaaaaagatattgaataaagcctagatccatctggatctttctcaatccccctggaaagatatgtgaaatatctaaagttgaagaaggtagagaaacggagcaggagagaagattagaggggagtcatgtggagatgacaggaggggaaggaaggagagatgggacaggacaggaagacaggagagaggtccctattaggtctcataactacatctttgcaagtatgtgtactgactctaccctttatgtcatgtctgccccagcaacacaactcatgctgcctccaccccagtcatcttccaaatgaatgatggataatcttgcttactataatttcaacctctagaaaggaagcattttgcaccctatcacctttttttaaaactcattttaaccctatctacaagtgttatttacatttaaaaggtgctttttgctaactttgagaagtaaaagatttgctaactttgagaagtaaatgaatccagtttagttacttacttttgtgaaaatgttccattacatcaaaataagggagaaatttttttcttaataacaggatgtatcgaaaacattctgtgcttgatcacatctgttattctgcattcaaaattcatttaggacaactaaattaagaaagcaaaaaatggttatgagtaaccatggccataatggaaaaacatagccaaatatttttggttcatataagatgatttttttttttttttttttttttttgtgtgtgtgtgtgtgagatggagtttcgcttttgtcgcccaggcaggagtgcaatggcacaatctcagctcaccacaacctccgcctctcaggttcaagccattctcctgcctcagcctcccgagtagctgggattacaggcatgcaccaccacgcctggctaattttgtatttttagtagagacggggtttctccatgttggtcaggctggtctcaaactcccgacctcagatgatctgcccacctcagcctcccaaagtgctgggattacaggcatgagccactgcgcccggccaagatgatattttttaacttagcctaaaaacgtttcccttaaaatcagcaaaggaaaagttatggaggaaaatcaaaacaaacatctacactgatgacatttcttatcattcgaatcagccataactgttttcaagtgcaaaatcaaatttaaaatatcaggaaaaatagcccaagtcaatcctattgcttccaacccacttccgaagaacagaattcatttatcaaccaactgtttactcaggaattgatgcaatgtgcagtacaactttggaagttcatggaaatttaatccagtacaggcaagatgtcttacatgttatgatgttcttatatcaccaatttaatgtttactggaccttatcaatgtcacattactttacataaaaataactttatctagctatatatatgcatcacagttcacagctaaaacagacacaggactgagtcattccaattattataagaagcagtactgtgagaggccagtaagaagcatttgcttagaggaagccagttgactgcctgaaggatgactccaaaggcatcaccaaagatgccattttatgggctcaattagagtatgagtaaaggcaccccgagacacagattatacttaatgcttctactaatgaattgttttttcagcatttggcccaaaagttctctcttctcatctgccacattttgcagcagaagccaccatagctgattggcacagaggtggttgtctgacccaaaatgtgtcaatgaaaatgtgggacataaatggaaacagacttccttcagtagttggatacatgatatgtaaagctcaggaactgttagtagccgtaattcccactgacctgctctgtagaaaaatgtatgaattgatgtacacatagcagtagaatttcaatctattcctaaggctgcatccctgccttaaggttctgtgacccatattagcactcctgtcttctttggtgtttgtttttagctagttcaagtttaaattccgttattggcaatgtaaatgccactgggcatttaagaggtggtttagaaacagtagagcaattttttaaactgctagtaccttattattgaggggcaaaaaaaatcaatttaatgagttacaatcagaaacatctttaaaaaaaaccagaatagcagagaattagcatcccatatcgggagggggtggaattcaacccgtgtctcacaccatacacaaaaataaattccaggtggattgaagacttaaatgtgaaaattaacactataaaacatttagaaaagactagagtgtatctttgaatctggagggtagaaagcagttcttaaacaagacacaaaaagaaccatatggaaatgacagataaattccactataccttctaatacactatacaatactatacaactcactttcattgtgtttattatttatttacttgcctttttcttttttttgagacagggtttcactgggtcactcaggctgaattgcagtgctgccatcatcactcacggcagcctcaaactcttgggctcaagcaatcctcccgccttggcctcctgaatagctgggactacaggcacgcatcactatgcctaatattttttttattttttgtagagacgggatctcactacgttgcccagactggtctccaacccctgacctgaagtgatccttctacctctgccttccaaagcattaagattacaggtgtgagccgctgcacttggcctcatttataaaaaaataaataaatttattatttattatacattgtctttcttgtccaataaagtgttagcctcaggagagtagggaatcttgtctgttttttgttttattttgtgtttttgagatggagtctcactctgttgcccaggctgtagtgcagtggtgcgatcttggctcactgtaaccgccgcctcccaggttcaagcaattctcctgcctcagcctcccgagtagctgggactacaggtgcctgcatctgttttattcacagatacatctacaatgctttgtacgtactagatgataaattaatacttgttaagcatgtatgaatatctaagcataccttagtcacaagagaaaacattttttagtgtggattgaggttaaaaggttgcaaaatattacattagatacatacaatttgtatatttgcttagtatgtagggaaaggaaaaaaaaaagggggtagtgacaaaacagaaatgttgtactttattctatagacctatgctatccaaagctatttaaattaatttaaaattaaaagtaaaaattcggtccctcagtctcactatccacatttaaagtactcaaccgccacgtgtggttactagctctatactggacaaaacagaagatacagaacgcttttgttattgaggaaagtgatagtaggcagtgctgctatagccaataaagactcacaccatatttgaagctggtgaatatcaagattacatcaggatttttaaggcaactggcttctatggagagagtgaactaaaggcagaagaaagtagaatcctcaaagaggccaattacatggaaattaaaatggtaaacatgagaaacagtgacaaaggatgtagaaagaatacaatgcagaggagaagacaattttttttttcctttttctttttctttttgagacagagtctcgctctgttgcccaggctggagtgcagtggcgtgatctccgctcactgcaaactccgcctcccaggttcaagtgattctcctgccttagcctcctgagtagctgggattacaggcgcacaccatcacacccagctaatttttgtatttttagtagagacatggtttcaccatgttggtcaggctggtctcgaactcctgacctcacgatctgcccaccttggcctcccaaagtgctcggattacaggcatgagccaccatgcccagacttttttttttttttttttttttgagacagagtcctgctctgtcttccaggctatagtgcagtggggcgatctcggctcactgcaacctgtgtctcccagtttcaagcgattctggaggagagaaatccaaaggaatttcagagctactatcatgagggtttgtggactgaacatgagatttgaggggaaagaaaggaacgtgagatgactgaggatgctgactggctaactaggtgactggtgaagagaagtcatttttaatggacggatactagacaggctaaaagctcttttgacccaggtgttttaacttagggaacatttcaaaatgatcaaatcaaaatgcgggaaaacaatgtgttttaaggccagggaatgactgcaatggacagccagacctttatccttccctgacgcaggtctcagataaaagggagagtgaaggtcagggactgaagaggtaatgaagcaagaaatgtgtgagaattatgagggaatgtgtgaaattatctgtcacaatcatttcttaagggcggaaaaaaagctgaaatagttcgtttttagacaacgtcaaaatgacctcgtcaaataactatcaatatagcatgtatatgcagagggtagattgaggggataatgcatttggccttggacacatgaatttgaagtacttatgactccacttggtaaatggtctccagtcacctattgtactacagagattgttactttgattctaaaagtaagatgtctccacaaattggatgccacaaaatgaaactgaaagtcatccataggggaaatgagttccagaacatacgcattaaaaatgataataaatgcagtcactttctagattctagtttatacggagccaaggtcagtggcttatggaaatactaacggctaccttagctgtccttttctaatgggcggcagaagcatttataatggaggtgagcattcagttccatttttgaggaagacaatgaggaaatattggtgctgatgactgaaatctagcttttggactactgacttaaattcatttgattttactcaaatctgccccagctgagaagaggggcttgtcatagcctttccgttgttgtttaatcctttaaaaaatgaaattatatatctcgaggatatatttaagcacacattttgtgagcaattaaatttaactattgatagaagaagacgcaaaagcctccactagaggtaaagacctctcgtccttgctcataaaagacacactttccttttttgcccctttttccttttctccatttctctccattcttctctccctcttttttctttccttttattactgctaaaaagtaatatgattccttaatcaacccccacagttacagctacttcacatttacaaaatgctctcacatccatcatttaagatctttacatttcaagggatcagtaggaaaagtggtacaatgcccctgctgccaataaggaaactcaagctcaagaagctggcgacctatgtaaggtcctgtagcgctttagcggcaaacagatgactcgtacctgggtagccagcctcctggttggccctcaattatccctgcttccaactatgcacatattgtctgtagccctgtcattgtaacagggttactgcatgccatacaatgatggtatgttacttctacaattaggttataagcagcttctatctttggctcttactctctcttcctttgatcactcattttggaataagccagctaccatgtgagcagtccaacggtggaactcaactgataaggaattgagggttccttggtccaaaatggaagtaagaatgcttgtcaacaaacttccatcttggaaaaagatcctccagccccagtcaaaccttcagatgactgcagccccatctaacattctgactgcagcttcatgagagactctgagccagaactacacagattcctgaccctcagaaaatatgagataataagtatatactgttgtaagctgtcaggtttgggataatttgtcataaagcaataaatatgacaatgtctaagtcttctcattctgagtccagtgctcttcctactctacacagttacacctgcattcagaacacttttgtttgcagaggtttgccaaataaccataatattctgttagacatcatttttaaaaagacagacaagactgacaacatttgcgcatgtaatttaaaataacgcaagtgctttatttggatattagaacagaaaaaaaaacctatactgaaagtgtgctatagatacactatgtatctaggtttgtatttttgagttcatttataaatccataaccacctgtctaaaatcagtctcaaaactgaaggctatcagaggaagaggtctggctggattaacttttacccaaaggagaattaccaagagctgaagaagttcttcgattccctgcagcacagctgtgatattgatatagagtactaggaaactaaagaaacgtcttacttgactgcagttgtcacattatcatgcattacagtgcagcagcctgaatcaaagagatatgcaaaattcaccaaggacagcagcaatgcattttttccccctgtatttgtggaaagacatcaggaaaaggaaggcaagtatgaatgcaaaaacatctgctccctaaactcatttaaaaaatatcactgcaaaaaataaatgtgaatcatctatagtgtagagcagatggaagtgcaatatgtttaacttaaggcagaaaggggatgcaactgaagaaccagaggatatggaaataaaataatacttaagcccattttacatactgctgcccgttaggttacactctggtaaaatgtgtagaaaatcatcttttatctatatcacactactttgaaagaattccaaataattacagtagactgtccagtggcacttatattcacactctctagtgacatttatattcacagaagccatttttttttttttttttttagacaaagtctcattatgttgcccaggctggactccaactcttgggctcaagcaatcctcctgtcttagcctcccaagtagctggagctacaggcatgtgtcatggcccccagcagaagccaaatttgagggcagcaacataacttccccctaaaatgagaaataaattacagagttgtcttggtttcaaagagattttaagttcactgacttgcctcagaggaacttaacaagaaagagcaaaccgaggagtaagttattttagataattgcagcaacaatgcaatgactcaggatttagggaaaaattacatatgaacttatgatcatgaaaaaaaaaaacatcaaactgtccaaatgccttgggataaatggtcaatgagtgacagtatacaaaggaacataagtcaatttttttgtactgctgattaattatttggaacccaattttaaaacaaagttgtttatcttcttggcatgcacttacatttcttgaattcataacatctcttagcctcaaaaatggaaccttttcaaatcttccgcattcatttaaaggcgtcattttaatttcttgggcactaccaaaatgggaaaacattagtatcatccacccctatgtttattttatatgaagaaaaaaaaaattttttttgagatgagtctcactctgtcacccaggctggagtgcaatggcatgatctcggctcactgcaacctccgcctcccaggttcaaacaattctcctgcctcagcctcccaagtagctgggatcacaggcaccactactactcccagataatttttttctattttttagtagagacagcgtttcaccacggttggccatgctgatctcgaactcctgacctcaggcaattcgcccacctcagcctcccaaagtggtgggattacaggtgtgagccaccacacccagccaatgaaaaaattaaatagcctacttaggaattacacaaaagaaagtatgatggagaattaatttcacacattggataccaccaccaataccacagtcactggactgatagatgaaaacttttgggttgtggagacggagtaacagcaatcaatatatcatttatcactatctcagtaatattttcatcatagcccacgtaagaatagattgcaatgtccttttaagacagtccaaaaattttagagttagaaaattattacaaagtcttatttatgaagtggaaacgcgtaaaattctaaagtcaaagttatctaaagcaatctatgctactgttcactatgtaacatataagatctagaggagaagattatttgttaatatactctcattttgaaaaataagctcaaacaaaatgcataaaagtatgcaccaagtcgcatgttcaaaaaaaaagaaaaggcactttttaccttgtatagttacactatggagcaaagttcttttaacttcgataagaaaacacttctgaagaaattaagtgccaaatgataaactatgatgaccacaaaggcaggtttaggtttctaacaaaaacgtatgaagttaagcctttccaaataatctatgcatactgttggtagccacagcagaaaatgctataggccaatagatgtttaggaatatacatgtttatctatatctgcatgtttaaaaacatatagatgaagggataattagagatgaactgccccaattcttaattgccaagttttaagtaaattttaattatactggaatctaatatttcaaatttccttgggggataaatatttaaatatataaaactgaacagtattctataataggggctagtggaagcctgtgaaacatttgacctttaccattaatacaaaatgttcttcagtaggctgacactgggatgtaagaatggtcccactaaattacaattatcagcagctcagagtaagtgagtattgcacagcctacaatacttatcagtcatcagagtacttgtgactatcaagtagaaatatggaatttaactgtctctctcctcccaatatttaatttcttaaaaactctgcagttatctgtggcttttttatttggatgacagtaacttaaaagccataacttatcacatcaaatcatcatgtgcctgataatcatggctttgaaaatgagtacaatttctattttattcacataatagatttatgtaggagactaaacatggaagctctaatcttctggttgagaaattcaaatttccttaatccaggattatgtcaagttcccataatttattttctagaaaataaaggataacaaacactttcattggtaaactcaaacatcgcctagaacttgaaagagctttctaaataattaaatataaaattcaattcaaattatattcagagtattttccatgttaaaatttttgttttttttctagtttatggaattgaataatccaagtaaaattttctgtaatctcttagctactataacattagattaattgaaacagtccattccccaaccatttgggataaactgaaaactgccataacatgatacgccttactattagtacatattcaagagacttaaagcacacaagatttgatcatgttataaaataaattcaagcttttcgaatttgtctagcaggctttccaatttttgccagaaagccccccaccatgaaaaataaataaataaaataaattcaagctacaaatgaacgtaaatcctaatacgattgccttatggccaagagatttactcctagttcttctcacgataaccataatgtacaataatatgaaaagctcatttaaaggaaaagtcatgaataccaaactcttccaccatcaattcattttccaaagctatcaaatagattgcttaactttgatttgtttattcggtgctagcacacagaatcttgatgatatgcaaaaaggatgtctaagcgatatatgatgcagttaggaaaagttctttctgcaccatcacacactatgaagatcgccttgcccttgagatcccttaccacagggttctatcttgcttatcaaacatcccactatccagcagaaactctctggaactgtctcaaacactatcacatctgtgaagctctatctcatccaccaactacatgtgattttcctgtcactgatctcaccaggagcaaaagctgaaccatttatcccactatgctttgtattaaagatatttgcatatttgtctttggctctctgttggactccaaggtcctcaagagtagagaatgtgtcttctcatatttgtatttattcactttagtgtctagaacaggacagactctcagaaaataaatttaacagaattttttttttttttcatttttagagagtcttgatatgtcaccgaagctggagtgcagtggcaaagatcatagctctctgcagcctcgaactcctggactcaagcaatcctttgacctcaaccttaacagaatctatcttgcaagagaaatggtaacttgagtcaaagctcaaagtcttatgctggtcttacgtggaattctaccctatatgctttatagaatggaattctctccttttttacttcattatatgataattagaacattttatatgactaagtatacatctatggatcaaattttcttttttcttctttggtgtctcttttcccaatcaagtcttaatacattagatctttaaataaaataactaaacaacctgatcatatagggtaaatcctaggatcattaagtccagttctccagcaactctttaagaaataatcaagataatcatcactttaaaaattttttaacagtttaaatcataccaaagtgccaagaatgcagataatactgctttcaaacggattagagaatggaaaaccaaacaattctgggtttgctggcctaagcacaataaatcagcagagaagttctgatatttactcacaggaaaaagattataaatggaagatgtttaaatctacccaaatcattctgaaccatctttaataaagaatagcttcctgttgcattcaaaagctagtataccatatcgtctaaaagctgtgacttttttactcatccattcatttaacaaacgtgtattaagcatctactctacgttaagtgttgatggtgggagttgcaattctgcagttcatacaagaaagctgtgccttcttgaaatttacaggtagttaaatgcatttaatctgcaatattggctcctactagtgcttcggtgatcatatttaataaatacagttattttagtcacagacttctcattgatataaatttacaatgaactataagtcagagtatctaggtcctagtctcattgctgcagtttaagtgcctatgagatgtcataataacgactcagagcctagctttcacatgtaaagcctgaatgcataagcccagcctgctttccttacagggttattataaggattaatacaaagatccaataaagtggtaatgcactgagcatatttatcctagatactatattaatttcacatgcattgctttatttaatattaattagagtcctatggtactataatactctttatctacatgtcagagtccacaggtatctataagaaacttctctttcaaatttgtctgttttaaaataaatgcatgtatttatttacacagataattatcaccagtagtctggtagcaatcacttcccatgttcactgtccttaaaggtttcctcaaggaaccttagcacagataatgctagaaagtgtttcagttttgttgtagttggtataagaaagaatccctggaggcagcttagaattcattaaagagaactgcctcagggtgacccctgaagttctttgaagtttccctgctggaagagacctggaattgtccagtttggaagatataagcactaaatacatcagcctaataaaaagagaaaagaaaaggaatgcatttggttgacaggcagtagggaagaggaaggaagtgttaccttgcagattcctagtatctgtaaagtaagcaaggaagtttgttgttatttctttccagaaatctagctcaaagtcttagcaaccaactgaaaactccagctgccctttcaacttctgccttccttaataaagatggtatagcagatgtagccaggttcaattaacttttcttttatgaaaagaattattcttttatgtttagatacattctgtaatgaatatctgtcactcttatttactctaccaatgctccagagaaatcctccttctttaattacacttctaatgttttgatctcccaactcccccacacactttttttttcttttcaagttggtatgtgacttcagtcaatccagggcagattttcccagacacacaaaaaactttttgttttcaggcaaataccagtaagattctgttagaaataataaatatagtgctgccaccataattttttagagaagatgataaacaaacattcatatccatgagttacaaaaagtatacaagcataggacggcactaccattatttgtcaaggctccaaaggtgtgataaacagcaatcatcacttcttcatttccctaccttccacatataagtacatatgtatgtatgtgtgcatgcatcatgcctttctgatgactgctgaacaccaaaagttttaatgacttcatttttttggctttttttaaggcatgtatatttaaaaaacacgtgattctatttgacatcatgtcagccattctgtcagaggcatgtgagccagagcaactccatcttgaataggggctgggtaaaacaatgctgagaactactgggctaaattcccagacagtgaaggcattctaagtcacgggatgagataggaggtcagcacaagatacaggtcataaagaccttgctcataaaaacagcttgcagtaaagaagccagcgaaatcccaccaaaaccaagatggccacaagagtgacttctggtcattctcactgctacactcccaccaacactatgacagtttacaaatgccatggcaatgtcaggaagttatcctagatgttctaaaaaggggaagcatgaataatccaccccttgtttaacattacatcaagaaataaccataaaaatgggcaaccagcagcctcggggctgctctgtctatggagtagccattcttttatttcttcactctcctaataaactcactttcactttactctatggactcgcgctgaattctttcctgcaggagatccaagaaccctctcatggggtctggattgggacccctttcctgtaacaattccattctttctctgaaatggccaaaagacatttctcagaaaataatattggtaaaaattgtatgaatgatattataaatgtaggagctgggaaacctaggcaggcagtcctggatttgaacatcaatgctatggggctatgatacaaatacttaatctctctaagccttagtttcttcatctgcaaagtgggtttgtttttgcaaggattaagatgtgcaaaaaataatatgtagctttcaaacatataatttgctcctttcccaatttctctcttgctggagtcacaagatcatgatgatggtagttcaggaactaaccttccaaagggtcacaaaagtcaggataaactcagaaataaaaatgcactggcagtttttattgactcacatagtaattactggttctcaaatcttgctatagttaataaacttccctttgtctcatattgatcattttggcatcatctgatggaattaaaaatggagcttagatatttgtttcactgatgtttaggtaacatttcagtcattctgaatacattttaatcattttgatgataacgtgaaataagggttgcccatcaaacctggccaagcacagtggctcacgcctgtaatctcagcaatctgggaggctgaggcgggcggaccacctgaggttgggagtttgagaccagcctgaccaacagggagaaaccccgtctctactaaaaatacaaaattagccaggcatggtggcacatgcctgtaatcccagctcctcaggaggctgagtcaggagaatcacttgagcccgggaagcagaggttgcagtgggcagagatggcctcactgcactccagcctgggcgacagagcaagactgtctcaatttaaaaaatgaataaataaataatattttaaaagtgtacaggagtgttacccattaaacctggctcctagtgttacttctttcactgtgtgccatgtggcctgacctctgtttagtctcaatattaacccttaatggtattaccacagttatttgcatactgtacaaactgaaaagcagtttttaaaaaagaaagaaagggaaggggaggagatgggagaggagggaaatgtgaactgagataattcccacttactttacctctcaatgaggtaagggtaaagattttgaaaatcctaaaatattatttattatcgccaatctgaaacttttatatcaccacataactggagtcagactgtataatgattaaattgctctcttaatatactctttaaatgtaggctttttcagagccctggtccttccatccccccatagtcacagattaataaactctaactagagaaagaaatacagggattatctgagtaatgttcccccacaccctgttatagatgcatccattaaagtgaaatggtgaagggttttttggtacaagtctgagtgtagaaagcaatacagaaatctctacttcagacaccatgtatcacagggatcctgaggttgcttccctgactctcacgccattaatacgcttcatatgctatccagccacacctaaaggccctcaaatagaagaacattcacaatcgccttccttaatgacgctccctgccctaaaggcaaagaaaggaatcacaaaagaaagtgaaaggagatgcacaaataaactgagtaatagcctgtgcctaagggaaatctggattttcctgaaaactggcctcactcagcctgcaggaagttcccaaaagtggtaatatttccaattacaaattctagctccttccttctaggtcaatttgtagatcctaaggccatatgtttttattcggaaaaggccctgacaacccacaactaacatttaggagttatgtggtcttggggaaattgcttaaattcttccaattgcctcatctttaaaatggagatgggctaggagtggtggcttaaacctgtaatctcagtgctttgggaggccaaggtgggaagacagcttgagcccaggagttccagagcagcctgggcaacagagcaagatcacatctctacaaaaaatttaaaaattagcttagtgtggtggcacacacctgtagtctcagctacttgggaggctgaggttaggaggatcacttgagcccaggagtttgaagttatatatagtgagccacaacagcaccattgtactccggcctcggcaacagagcaagacctcagctctgaaattaaataattaaataaataaaatggacataataattatacttacctcctagggcggttaaaagaactacacaagataacgcatgtaaagcaattgacacatagtcatcttatagccaatgttagctattatttttatttatgaatgagtacacacatctgaaagtgtttgtgaaaaaaagtccccttctctctctgatctgagcaaatgtacaccttagataatatgaataataatgtataccataattattaggcttccctataatttaattacctgaggaaataaataactatgattactgaaatcagtgaaattagttttgccgatgagaaaatcaaactcaattggaagctctttgacactccctttagtaatctactctgttcagatccttttagcaatgatatcttctagcattattatctttaacctttgagttctttacacttacatttatattataaaaattataacgcctgagcaacatagtgaaaccccggttctacaaaaaattaaaaaattagtcaggcatggtggcacaggcctatagtcctggaggctgaagtgggaggactgcttgagtctaagaggtgaagcctacagaaagctgtgatcggctcacttgtaaccactgcactccagcctgggtgacagagtgataccctgtctcaaattaaaaaaaaaaaagaaaagaaaaagtacgaaatcatgtttggtagtcctattcataatacctttttttggcagaaaaataaggaaaaaagcctattgccaaaaagccatgtgcaaaacctatttattggtaaacaatattccaaaacttacactaaaagtgttttttcttttaatatctactggattttttttttacgtttgaagtccctcacttcttccctccacccccccacagacggagtctcgctctgttgcccaggctggagtgtagtggtgcaatcttggctcactgcaacttctgccccctgggttcaagcaattctcctgcctcagcctccttagtaactgggattagaggggtgtgctaccatgcctcactaatttttgtatttttagtagagacagggtttcgctatgttggtccgtctggtctcgaactcctgacctcaagtgatccatccgcctcagcctcccaaagtgcaggaattacaagcgtgagccactgtgcccagcccctcatttctcttaataacacaaatctataggcactttaaaacaaactatccttatttatattgaccaagcacagtggctcacacttgcaatcccagcattttgggaaccgagagcaggaggatcactagaacccacaaatttgagaccagcctgggcaacataagaagactccgtctctacaaaaaaaaataaaactagccaggcatggtggtgcatgcctgtggtcccaattacctgggaggctgggacgggaggattgctgggcactggaggtcgaggctgcagcaagctgtgatcacgccaatgcactgcagtcccgtgtgacagagagacactctgtctccaaaaaacaaacacaccccctcccgccccaccccttccaaaaaatatatatgtatctcctaactggagaaacgtgtggcatgaactttttcttactcagaatactctaaaactcttacttctttctagttccacagaccttgatgagtggccaccttttagtgtgctgaagaaataagagtaactgcgacatgatccctagccacaaggactttagctcaaagtccaggagagaagacagataggtacactcataaaaatagcttgtgttgactaatgtgatgttttaacacctcccagatctcataacatcctgggctttctaaatttgaaagagaatcctggtgaatatactcaattagaaagctttttctatttctgctgtaacagaggaaaaagaaggggaggctcagaagggattacagcatgcttttggtagaaattcccatggaacttcatttcatgagacctgtgctgatcagatcaaagccatgggatcagaacctatacctcacagatagtatctggaaaaataagaagaatgaaagaaaaatgaaccaagatcaccttccttttgtgggcctagccccacttaatttcataacaattctatgaggttggtattacccaaattacagtaggaaaactaaagttccaaaaatttgagtagctcaagtccacaaagcaagttggagctgcaattagaattcattttccccatttgaaggttctgaccaggtggtctctctctaaattctacatatccttgaaggcaacatgaacatcagagtaatccaatcccattatcagaaatgaaaatattatgcacatcatctttatacaataatcgtagtaagaaagccagtggcttgccaattttggaaaatgattataaacctcaattgcaatagaaaaaaaaaacagaaaaataaatatagacagaataggaaaatctttttgatatcaatgctataatttacagcttacaatttttattttttattattattattatttttttccgagatggagtttcactcttgttgcccaggctggagtgcaatggcacaatctcggctcacagcaacctccaccccctgggttcaagaaattctcctgctgggcacggtgggtcacacctgtaattccagcattttggggcactgaggcggacggatcatgaggtcaggagatcgagaccatcctggctaacacagtgaaatcccgtctctagtagaaatacaaaaaataagccgggcatggtggtggacacctatagtcccagctactcaggaggctgaggcaggagaatggcgtgaacccgggaggtggagcttgcagtgagccgagattatgccactgcactccagcctgggctacagaacgagactccgtctcagaaaaaaaaaaaaaaaagaaagaaaaaaagaaattctcctgcctcagcctcctgagtagctgggattacaggtgaccaccactatgcccagctaattttttgtatttttagtagagacggggtttcatcatgttggccaggctggtctcgaactcctgatctcaggtgatccacccaccttggcctcccaaagtgctgggattacaggcatggagatactgcgcctggccagcttacacttttttttttggtggggcgggggggggatttttaaggagctaacttaatgtgcacatattaatgtgtgcataaatatcacactttcatttccaaagagttataaaatgctgacatcaccagtaaattgatttcaaaattcaaactgcaatcatataattttttgaaaaaaacacaaccaatattcatatgtaatgaacagattcaaacctatctcttatcagcaacacttccagagatgtaaataatacctgctacactcaaacaaaaccatcttacccccttttacattgacttctatgagtcatgtagctttaaaaagtgtatgctattagattatctgtaaatatccagcaagtattgacaaagccttcctgaaattaattctatatgtttaagactagccaatattttaatttcataccttggctggcttaagagatgacatgatcactctactgtaactacctgaggttctgttctgatgttttaatgtgttccatctgattaaaggggttttaatagaagatacttagattactgttagaaatatattttaaaaaccactttgcccaaattaagtactcaaacacactccctccacttggctactgtactaagatttactataatggtgccagaaatacatttgcactgatataacttatttgatggaaataaaaacctaattctgtcataggagtaagtaggacaactaaaatgtaggaagacccatgaattgcctttgttccatcacaattacagtgacaaaaatatttatgttaagagaatagctgctgatactgaaagaagtgggaagtaggccaggcacagtggctcatgcttgtaatcctagcaatttgggaggccgacgcaggtggattgcctgagctcaggagttcgagaccagcctgggtaacacggtgaaaccccgtttctaataaaatacaaaaaattagccaggcatggtagtgcatgcctgtaatcccagctacttgtgaggctgaggcaggagaatcgcttgaacccgggaggcagaggttgcagtgagccgagatcgcaccactgcactccagcctgggtgacagagcgagactccatctcaacaacaacaacaacaaagttagaagtaaggctttaaaaagatgaaaatagaagctgggagttttcacagactccagcttatttggagatacaaaccactgcacctacctacccaatcaatactaatgaacactataatcactataatcaaacaaacaaagcaactacacatgaggagagaattaaactattatttagaaagtttcactagttttctgtgtgggtaattttatttgtgaatggttaaagaactttgaatagctttttttttttttttaaggattttgctttctctaatatggatttggttagagctcacctcatatcttaatcatcacccttttagatataagtttatgaaataaaacacaaaacgtctttcatggttattcagaacttgatcttactaacagttccaacgagtgtggtctgctcctttcctgaaatttgtttcatatccacagtccttccatttcaacttagagatgaacctttaataaaatatacaatgaaggtgggcaacagtggtatgtatggcgagacaaggcaaaatgggtctaaagagaatctgtattccactgaatgcactaattcagtctagtgtactcactcttgtatgttaagttctacataaattagaaacctaaatttcaaacactgcttggggacatgtatgctctacaaaatgaaaatgctatgcattttgcacaaggtcatgaaagtccccaattgatttccccctgctcttcatcattgacaccactttaaactcaaaagtatcatcgtgttttgtctttttctttcatcaacatcctgttcacatgtctaaccgatttaggatttagaagcacacatgagtcaaggatgccaccataccactggaatagaggtttctttagttaaaggggaatggtgtgagaggtgaacaacagcaaccacagtgctgctcccatttgctccctccaccacaatcctactccgtgcagacactgcgtcaagtctttttcatggtaagcacttttgggaaaacgctaagctaaccccacattcactaactctaaaatgattctgatgaaacaccaaatacaaaatttatatgccagtagaattttaaaagccccccacctttttttttttttttttttttttggctttcatggagaaaaccagaaagaatatgacttacgtatgcaaaaccatagtacactaaagcccagagacactcaataatcctggttaatcctggcccactgtatttatgcaaagccaatttagtaatggaagtaaagcagtagactcaatacaaaataacaatcaaaataatatctttttgaccttgtaaattattaataaatattaataaaacatgaaatgtatatatgttctacaccaacggttatcaaaagaccacctgcactagatttaaatgggatgttgataatagttcttcctaggacccagactggactcaatgaatcaaactctctggatatggtgtcccgaaatatacattttcaaagagctccccagatgccttatatgcaattaagtaccgctgactgaagcatgaacagtgtttacacttcctgatcacaaagatgaaataacactgtgagatggaacacaagtgcttaagcaaaaaaaaagtagccactattcatagaacaaaagaacggaaggaaagtcagagaccactgtccagtgaaactaactaagaccacagcttggttttcaaggtcaccaagctagttgttacaccacttagacttgaaaacagatctcctcattctgcttggtgcccattccagcatcctatacttcatctatctccacaaaacaaaagcttgaaaatactagttgttaaaatgtcacataatgttttgtaatatctgtatattcagagactgaaacaatactaccgttgtatgtttatacagttctttgccaaccaaaaaaaagtgcttccaagtttcttataatctctgacatacagtgtaaggtagccagggtagaaattggcatctgcatcttacaggtggaaaaacgagatttccagaggttgactgactcctccaaggtctcataggcctaacagtggagccaataacccaataaccaacgtctttccattttccatattccaaagaagctgtctgctttccatttacacctccctgaaatctgtaaaactctcagctcaaccactgactattttccacttcttaaagatttagtcctcaaagatattattatgaaatagatgttgccctctgcaaccagagtctctgagcagatacctgaaaaattccaggtgttaactacatcttatctccattgatttctatgatatagctggcataaggtttactctgcgtacaaatccagcagatacaacactgctgtcgagagccagtgttcattgtattatcagtttcagcctgataatttgatatgacgggtgtgaggcacaagctacaagtctctccttcttaaaacaataattgtaagcctttattcttcaccaggaatatcaaggtcattgtctggttcaaacctaaaagggagcttccatcaacagatgtcataagagataagctccaatttgacacgctcttgcagaactatcacctgctatcagagaagctatgacagctgtgtagtaagacaatgtgggccaattcatcagtcctctgggccccaagtgctcccctaatggatatgacaaacatatgccccactgccacacactggacgtttactactgcagggctgtttgtataacaatccaattaatcaaggtagatagtcatattttttgtaattgatggaaagctagaattgcataactctattgaatgactacatcttttgccatagtatgatagactttggaaagaaaaaggtagactattgcacacaaaaaaaatcctgtggcgatataaacaacatgcccatttccttggctttgagatgatgttaccattgccatgtagggccttctccctcctgcttggttaccttcttcaaaggttatcttcctcttcctttgaaagcctcaattcaaacatcaccctggatctcaagctcccctgcttttagcgtctgagtggatattttgaagaaagattcagactgcatgggcattaggatgtcctaaaaagttcagatcacctcattttaagaatcagccactcttcagcatcagctgaagcccaatcagtttctcttgattgggcttgggttatcgaacacgctctaaaggaacacactctaacagtcatcacgtctttagtgtttcaagagaagtagagatctgaatttttatttgccattctccagtttttaaatattggcaactatttgaattttggttaccctgaaagtggagcctgagaaaaggacttgcagtagttttcttcagaactaactctaataatcaggagagagaaaagtgggacaaaggaagaataaaaatcaaccatggggtcttcgtgaggtctcagaggctcacagtcttccctgtggatgagggaaggcaggggcatttatcctccaagcccctttcccttgttggctatgagttcgtcctaggggcattaattccactacactttccaactgtacctgctgaagtgctgactgagcttcctcggtttgggagaaagccctgaacagaaaggaaacaactgtgcccaggcagggtgcggtcagcattcagagaatcaccactgtgagtgaaatcgaagttgaccaaggggatctgacttacggcacaaaaagcaactactccagcaactaagaaaaactgtaaacatagtgcaggtcaaacaattaattaatgggcgcagtcttgatctcactcatggactccatctccttttcggcttgagagaacccttcccgacaacttcccagtaccaatcctttacagtaaagctcaacattctaccaccaagatgctggcatttataccactcaacttcaccatttatagtcaagtccattgacccccctaggctatgagcacaacctgtttatgacctccagcacctgggttaaggtaggagtacaataaaaatctgccaactgaattagtccctggaaaaggcccatcagtgtttgtggaactgaataaatgaatataatttttaacaaagctctgttagctataaccataacccaagcccaatcgggaaacagtcctgaggtcactaaggaacagaacaatcattcttaattcctgctctaaagagccttattactcaaatacattaatcactgacaaagatgaactttttttttttctgaaaggctatactgcctcaactattaaaagtatatattctcaacatatgtgctttttcatatcactgaaaaagtctagaaaagtatctttgcccccagaaaaacaacgcagtcgtaattcaatttcatctcttgctgttactgaaactggatttttcttacatgcaacctagaaattcaccttgtttcctatgcacactcttcttgatatttccacctttcgctaaggatctcagagcatttcccatctgaaagacatccacttgggtggggacttgaggcttgtgaggcctgagtgaagatctgcacagggaagcttcgaggagatcaacacagatgggggaattctggaattgtgaaacattccataaagatcaaggttctccttataccagctgagtggatacttgaacataaatagcagaggagcaggctgcatgttcctatcctacatatggcacaaacaaaagagaaaaaataagtactcattagggaaagctaaatgtagaatggcaagatccccaacagacttccattctttaaaaaagtgaaggaaggtcttctgtgttaccaagctgctacattatttctagcaattatatatatgcacagatagatgtacatatatatttataggtctacacatgtatacatatatattttaaagcataagaatctatataaatgggttcttatagaaaataatgtcagtcattcttggataataacattacttatagacctaggaatagttgggtaaagtttccatgtatctgctaattaagaatcccctgctttggtaaacttatatccatcaattcccacttattttttactctcaaagggagaaataatttccgtagatgataaagttatttaatatattctgaaagtacatgtgcaacgacttaagaaagatcaactaagagaggcaggggttggagaaaatttgataagagttcaataaactgacttcattccaaccttccaatctttagtccatgttgaccttcaacccactgtatcaaaggaattagccaatgccatagcaaggtgacaaaccttacaaactctggagaggaggactcggtggggcttgaaggctaataaaatatacaaactttttttttaaagacagtaatgatcttggacttacctcagaaacattgtttagaaaaagatctagttgcccacatcttaaggaaaacagtcttgagtaatatgtaacatagcctgatgcaaactcaatcctgtcaaaataatctaatctctcctgatggagtgactagcccagtagatcaagggaagaagcaagacacaatttatattcggatttttacaaagcttttgcttccgctcctcatgatataatcatcaataaactgagaaaataggatctacactgcatagctatgaaatggcaggaaggtcatgcctggcagggcgctatcggtggaaaagtgtcagctttagagggagtataataaatggggctccaatgtgttcaattctgggcagtactccagtggacatttttcattaatgacctggagggtagaataattatcactgttattaagtctgcatatgagaccagacgaggaggaagcattgaggaagggcgggggggcagaggctggaggaagaggccagagggagtcaccagccacaaaggaatagcttatcagaattcaaaaggacctcaaaagtttgaaaaagaagctacaaacagaatgcatcttaggaaataagtacaatgcatgctattccttttccttctcctaacgtttaccacagctcactgctacagccttgacctcctaggctgaagcaatcctcctgcctcagcctcctcggtacttgtgactacaaggcacgtgccaccatgcctagccaatttaaaaatcttctgttaaagacaaggtcttgctttgttacccacgctggactcaaactcctaggctaaagcaatcctcccgcctcggcctcctgcagtgctgggattacaggtacgagccaccgcgccgggccttcctcctctctcctttcatgagctgtgaggctcgcttctcttaaaaaagggccacatttactcatttgataaatatacaagagatgctttgctgagttcctgagctactttgttaagcaatacagttctgctgtctaatatcacagaaagaattggcttactgaggaagaaatttaaaagaaaatgacaacatcgtctgagaagtcttctttggtcctggtccaccattttcccctctccgagtctgagttagttatttctcttaggtgctttcacatttctttcggccttcctctgtcacacaacactgaagtgtaatcaggtgtatttatttttctcccctctaaattgccaggcatgggccatggattctgcaccttggtatctccccagagcacagcacctgacacataatgatgctcaataaaagtttattgatttagaactaaatacaaattatacacataataagtggctttatgcaagtattttttttttaagcctagggatgccatcctgaaactcaaaagttaatgccctccctatagccagaaagtcaaggctaaaagtaaagagcagggcatcttctgcatatatggtaatttcatatgcggctatgaagtgccctcattcacatctacagaatgcgtgagggcagacggcaagactaagcaagaatgtcttcacggagaacgctttaagtgaaggaaacagaggagggtgagaaggaggggaagaccccacagaaggaatgttcaggaaaccaggggcggctgcaaacctgaagctgagaccaataggaagaccccagaaagggtgaggtcaacagcaccaaagacggcaaagaaattaaggaagaagacatacctgaggcggaaaccctaggtgacacgagcaagtcaaaatgtgttgaaattgtgagtgaaaatagaagacagccatccaagggcagagataaaaacaagggcatgagtttggagagcacaaaccatctgtgacgtagattatgcgatgatccaagtataaccaaggatgaggaagaagtgaggtccttcactggaaaagtggtgccatacatacatttacaaatagtatggattatacaactagtatgagatagacaaaggctacaaaaataataaagttaacttagaagaacccttaaccttaataagaggggagtacttccatggttgaaacttgttttatttataatgtgcattcacatagctttctggagaagagcgttcatatcaatagaaagtaacttagaacaaatgtgcaaattttgtctgaaactacctcttcttattcaataaatgctgttctcaactatagccaaatctgtctcagctttattgtggctccaattctggcagtggacaagaattgtcatatctcacatttaaaggtgacatcactttatataatttagttttttttttttcattttctcttcatttttattgagaaaagggacagtgagagagaaatgtggaaagaagatatagagtagaagcaggcatttgaaaatttcacatctgatataagctgtttcccgttcttcaaatcatgcctctgctgctgctactgtcataaatttaactggcttacctttaatcacagggaatggtaggctactgaaacatacattttccaaaataatccacaaaatccaaaatacacaaaaataaatattgagatgagttaggctcaaaatgtgatccagtctttcccaatagtttgtttaaccagcagggtcatttcaggcaactcagatgaaaggattcatttagcaattgaaaatgagcatccattagcagttacaaaaatttaaattctaacatttactcatcaaaataaaacaaaaactccaatataatcatgtcacattattatatacaaattttgtcactaatcatggggtcaaaagttagaaagtgttgcaatctttaaaatattcccatcagtttgagattatgggttttttttccctcatctcctgcataaaattattcctaggcaacttttaagtcactgtataactggtaccaacagtgttgatacaattctttagttaaagtcattaagtctgttttggaatatctgattccaaggacctaaatcaaggggtgaaaatgaaaaaatgcaaacatgcggctgattagaaaaatggttataataggccttactgctgttattattgaatgtacaagtgaaataaccattagcctgctttaaccactgaaaaacaccctatggtggtacttgagtgatttgatgcatttttgtacacaattgctgtgctaacagagcagacatttaccccataacaaaggaaatctcaaatgtaagccttagggtttacagcaattccagaataccaaaccactactaaggattttaaatgaaacccctgctgatctgtttactgattaaaccctttgtctcctcaaaacagtaacatcattcacaggacaaattattgataaattgcagaatgtcaaacaaagataagcaggaaattaaaaatccataacagacattagctttaggaaatgcacttaacagaatatgatcattggtctagattcacttttttctttgtgtattttaagatataaaggtctgcgagaggctcctattatcactgtatacagaagaacagaactgcttcagctatggaaagaatgagatgagccaagcactcttttgattgttgaggataatctataaacacaagacacaaagttgaccctgaaagtgatctcctctcacctcctcacaagggatggcaagctagcagtatcgttacagggcacaaaacagcgtttaggaaaggttcctaaaggaaatcattcttccatgcaaccatgttgccatggcaaccaaaccaatcaagcttcttcacaaaggcttttatgtcaagttctgttagcaaactcatatagaaagtataactcaactaaattaacactacatttgttaccctgttagagatggaagaaaggtacaaatcctttaaaaattagagaaataggcactctttccatatcaacatgttaaattactcaagttcagtctttttacataaacaaaagcctcttgaagtctcttctttaggaatagaagaagaaagggaattttacctagcagtacaagccctttccaaaaatagattctttcctcaccttctaaggaatacaacaacagaattcttgcatcttgctgaatcttttattgtcatttctttgcaaacctgtgcttcagatacatctgtgttataagtgtaacttacacggaagaaatcctagcatttaccactcagcatttttaaggcaagtagaataagtgaatcaacaatatgaacccctttgattaaagaatatttttccttcggtatagcatgatgaagctgtaatatcaattacggccttaaatttgaaggccattttatgttactgacatagtttcacactagggcaactccatttctatgacatttctcatgctagttaaattcacttcttaaaagcaaaacaacagctatgagcaagagctttaatgaaccttagtaatctgacactcagctccagagccaatggattttataagaaatggacaccatatcatgttgaataaatctttcatattcctatctttaattttatttagaaatagtaaaagaagttctatgttctcaagagtaaaagttttataatttagatgtagagaaaacacacccagcctggacaacatagtgacaccctgtcattacaaaacaaattgtttttctttttttaattagctgggtatagtagtgtgcacctgtagtgccagccagctccttgggaggctgaggtacaaagattgcttgagctcaggagttcaagaatgcagtgagctgtgatcacaccactgtcctccaccctgggtgacacagcaagcccctgtctctaaagtaaaataaaataaaacaaaacaaaacaaaataaaatataccttctatcaatttcatagaatggtaaaatccataaaatacctaataagcatactgattatgggagttggtagtgtgtctagcctctgtcctaacaaccatcttaaatttcaagtaggtttcttcttcttggacttcttggtagaatttcaagattcctgatgaccagattttgctccaaaacatttgacaactaagactgggttggaaataataaccaagataaatttggatcaaataaaactacagttagttgctcaggggtttttaaaaggcaaagcatcatcaataccattaaacataaattttacaacctgagcttccaaattgcctgttataactcacggcttagtgggaatattttcagggcattttagatagagttaaattgtaactcttgaatttcaattgaactacaattaagagcatctgaaacactgtataaatcaagattatccattttaatttctaggtgtttgatacatcagaagccaaaggtttaaagctttggaaaatatcactttaattgactttaaacataaaattgtatacctcatcctaattaaatgatagcattttacatttgtgtggccactggaaaatttacaatctatattctctgcctcaccttatttgattctctctacagttttagcggataggcagagagataaaagaagaaaatagggttaatttggtttaataacttatttataatactgcctttaacaataataatagtaagattaatcatttagtaaacacttacaggccaggtagtgtcctaagagctttcttcctcattgctaatgtcatgatcatatacaaatgtcttcaattctcacagtaattaaggtgaggttattctcattttacagattaaaacactgagactcagaaaggttaagcaatctggcaaaagccacatagtcaaaaagttaagtctccagaatgcaaaatcatacctactgaattagtattatattcatttgcctaagaacagaccaaatacttagatgtgcttcttacaagagcactgcttcttacgcacatatttaattgttactaattaatatttattgcatttataaaatttcaaataatttggctttggtaatcacgattttgaatttcaaatcatttggccatttttgatatcaacataaattcagccattctgaacacatagctgtttgttcgtacaacagatttaaacaattactcccgaagagttccccggtaacatttggaagaatagagaatctggtaactaaccaggaaaacgacatagcactctagtccactactagttgcaatgttcgactactgggttaaatacaaaatattgccatgtcagaaaaaggcataaaatgctagaaaatgatggtttaacaagagatcaactttcaaaattaaaaacataaaaatgtatccttaacgttgttaggatcaaaggaaatcactatctttggtgataaattaaacaccaagcacttactctgtgtcttgagtattccattattaagtggaaacaattactattatcaaagtttgtgacttacttgacatgcttgaataaataaaacatataaactatataaaagctcattctaatacaacatatgtgaggtagactgatctgtttcatattcatatattaacttatattttattttattatatttctctaatataaaagctctttggggcccagcacagtggctcacacctgtaatcccagcactttgggaggctgaagcaggcagatcacctgaggtcaggattcaagatcagcctggccaacatggcgaaacccgtctctaataaaaatacaaaaattaaccaggcgaggtggcacatgcctgtagtcccagctacttgagaggctgaggcaagagaatcacttgaaccttggaggcagaggttgcagtgagccaagattgagccactgcactccagcctgggcaacagagcaagactctggatcaaaaaaaaagctctttgtgaaacttggggcaattattaactttctacattacattttaggcactttcaataaaatgtgggagattgttagttaaagtcagattcctttgtgacacagcatcgtgaagttgttgatagccggaattaaccagataattccttcaactgacatacaatcagagagcacaaaacgagctgaaagatcacactggggctctcctgtgtcttgttctccttgtccacacaatcatatgctcaggaagctaagtattataaaagtatgacatcccctgacaattgagttgagtgcccttgtttcaacattcttaaagtagccattcacagcagacggcatcacttttgaggcaacatttcagacattctgaaatttcattctctgtttgtaagagcagagaaaaagatataaatcagaatatgtaacaataacataggaaactatttgctaacactttctatatatacatatatgtttatattcttaaaatatatgcatatctgtagctttaatataaccacaaataatacaggtgcaattctgatgtctactgcacagatgtgaaaactgaggcacacatagattaagtaatttaatgaaaggtcactcagctagttaagtggcagagctacttactgtactaggcaatctagctccataagccatcttttcaacctaaatttaatatgaggaagagagtctctgctctcataacagctttttattgaagagagtatatttaaatatacagaatatatttataattttaataaagcctgatcatattcattagttaattataaaatgtcagaaaaaatattaagaaagtaagtgtttggtgtttcatttaccatcaaagacagtgatttcctttaatcctatcaaggttaaggatacatttttatgtttttagttttgaaagttcaactcttgttaaaccatcattttctagcattttatgcctttttctggcatggtaatattttgtatttaaagaaatcaatttctcagcgaacgcctccttgaaattaaaatatatacatactacacaccacacacacacacacactttttgtgtatgtatatatgtctctggactcacacaagactcaaagagtagagtcacagaatacctctatattatgttccactatccctttacaattgcttaatggtgaaagttcttttctactccctacacgacaagtcaaggagtctacttatttttctaactcttaataatatgatgtcatacaatcattttaagttatcaaacacagtcccaattcagaaattagagtgcccagttcagcatattagtcgcacttgaaactttcaacttatagccacctccctttcccagctagggttggctatagaccagcatcagaaaataagtgaaaaaaggtatgatcagccccttcttctcctttttcacctcctctgatccctctgctcctcttgataggtattttcttgaactatggggtttaagtagtgagaaaaaggaaacaatgggaataagaaaattcttagatgatcacagttggtagctggccacatacatgctctctgggtttggcccatgtttacagccacctctctctctctctgtctctctctctctctcacatggtaagctcatggcttcttcagaaggcactcactcctggactcctgttacctgctgtgctgaatgtgggtgccatagtctaccccacgcatcactcactccttctacaacccctaggaattcaaggtaacttctactgcggtttgtttctttctcttagcagctccttggataaggcccaagagggcatccactcttgtctgcaagaaacatttagaaatccccctttcccctaagagtggaggccaatcccaatgcagtcacctcttctttcctccactttgtgagaaacaactaactggcctggctcttgactgttttagactttctaagtagaaataacaacatccatccaataagttccttcaacttcaggaaacagagtctcgctctgttgcccaggctggattgcagtggcacaatctcggctcacggcaacctccgcctcccaggttcaagcaattctctgcctcagcctcccgagtagctgggattacaggcaactgccaccatgccccactaatttttgtatttttagtagagacggggtttcaccatcttggccaggctggtatcgaactcctgacctcgtgatccacccacctcggtctctcaaagcactgggattacaggcgtgagccacccatctggcctgaaaactaactctttaacaaggcaaaagtctttaaatattctgtgatcatagacagttacaggatttgttgccaccactttggcaaacatgaaagtcactgtgaaagcagaaaacacatttttagtggttttggttttggttttgttttgcttagtaagcatttttcagtctccattatttcataaatgcacaaggggctacacccttcttatgtttcttactctgtaccaagttgagtcactgaaagtttcccccagtgatttagtatatctggtctctttgatttttgcccctggaacattcatccatgcccaggtaatgtctgccttagaaagggctctagtaccctaactgctatcaaagcaaactcagatagagaaataaaaggctataagaactggaaataaaatgttaaagtacaaaccaatataatcatgtgttctgacagagaaagtatactttaaattgtgcacagccaggcgctcactacaatttggaaattctcccagagagagtagaactgttacatttataccttggttggaaagttaaggacatggttgttgaaggctaatgttaaaacgctaccacaggagaagggatgattcactgagataaagtaattatggaagtcaaacacatgcttacaagtacagtatcaataacaatattattgaggacttatttgtgttatgcattatacctcacagccttcggttggggctattatttttatacccaaattagacataggaaaccaaagctaacagagattaagcaatttgcccaaggtcccgcagctgacaatggaacagaactggaatccaattctgttaaacttcaaccccctcccatcccccaaaaccaccagtgctgcagtcatttacttaagctacggcaatttaacaggttagaaagcagaaaggattaacagatttccattcctccaaactaagcccagtgttcacacagcccacactggaatctttcgaaaataacatttctggtcaagtcagtcctcggtatgaaatcttccaatgctttcccatctacagctgaagaaagtacagaggatctagtaagacatttaatactcagggttctgtttccattttactcaacagcccacaccccacagcctcttcttgaagccctcttctctcccggtattctactctactttaatatcctagttttcttcttaccacttgggcctgttctttctcaggctccttagaagtttcaccccctttgcctgacctctaaatgttcagtgttccactgaaccccttcttaaaattcctggatgatttcatcccttcccacaaagctttaattgccatctttggtttcaatgattcacaaacttttaactcaacagcaattgtacctttgaactacagaatcatgtaatacatagcccttccccaccttgcatgcttcatggaaaccttaaaccaatagtttccaagctgatttccttatccgccagcaagtttatatgccagccttccccatctcaagaaatcacaccttagctgggtgtggtggtggcgcgtgcctgtaagtcccagcagctcgagaggctaaggcgggaagatcacctgggccagggaggtcgagactgcagtgagctgtgatcacaccactgcactccagcctggggaaacagagtgagaccctgtttcaaaaaagggaagggaaagggaaaaggaaagggaaaggaaagggaaaggaaaggaaaggcggaaggaaggaaaccattttgttacaggaaaggagtcttgatccagaccctaagggagggttattggattttgcgcgagaaaagattaacggtgagtttgcagtgcaaagtgaaagcaagttcattaaaaaagtaaaagaataaaagaatggctactttatagacagagtagtcccaagggctgctggttgcccatttttatggttatttcttgatgatatgctaaacaaggggtggattattcatgtcttccctttttagattgtatagggtaacttcctgatgttgccatggcatttgtaaactgtcatggtgctggtgggagtgtagcagtgaagacaaccagaggtcactcttgtcgccactttggtgttggtgggttttggctggctcctttactgttaccttttattagcaaggttttcatggcctgtattttgtgctgaccttttatcttatcctgtgacttagaatgccttaatcgtctgggaatgcagcccagtgggtcctagcctcattttacccagcttttatttaagatggagttgctgtggttagcacacctttgacatttcccctctcccttttataagagaacctttgatcctaagggttgcccagggacaaagatctattttttgtaacttttttaggccaaataggggcgatgatattttggcctaactatgggggtctcttgcattcacggtagagaagagcttcgttagaaagtgttagtatggtaaggtttatttataacttttgagttttgacaaaaggtggtatctgtaagattagttaactgtttaataaaacattcagtaagcttgttttgtattcttatacaaagagtataacagtaatatatttcacaagagtaaagcaaaataagttattttaagtaaactaaattagaaggctttttatgaactgggcaactgttggaactaagctgataccgggttgtcagctgattgtaatgtgcccagaattagaatactgatccagatttttacattacttattccttttggttttttttgagcagcagttagagatcactggttggttcacaggaataagcagggtttgctgaaattgcagaaataagcttagaaacaactaatgagactagaatttaataacaagtatagtatagttcttgaaacgtagtatttttcccagttttccattttcactaaagataaattatggtaagactgatttgctttattatacttggcctgattatttgtataaagtgcagtaagaataattattttttacataggctttttaaaaattggctttgatggaactttgtttcatagaaggaattttagataagacttttttaaagctgagccctgccatgagtttgtacctttaaatatttatgagttgggtaaatttctttctttttgaggtcccaagataacttgtggtttctggacctgttagaaagtgatattttttatttggcacaggttagaaaccctgtatagggactgttttaggcaaggtatgtggccagttttctaaagggtttttattggctttacaagttaagtttgataacttaaaggaaagtacaccattttagttaaagccttggtaaaataaccaatttttaaaattgtgtcctgtgacaaaagaaaacagatgtttattgcactcatgtaaataactatattgtcataagaatgcttacaactagtttttaaaattctgaaaaaatgaggtagagagaaataaatatgctctaaatttttttataggagtacacttaactgttaaaagctgtaatagcttaaaagaaaaggttccttgactttgaaaaataaaagattagcaacgttttaagcaaagtttaaaagagagggttcttggattttggcaagaaagaattcatggtgagttcgcagtgtaaagtgaaagtaagtttattaagaaagtaaagaaataaaagaatggctactttatagacagagcagccatgagggctgctggttgcccattgttatggttatttcttgaagaaatgctaaacaaggggtggattattcatgcctcccctttctagaccatatagagtaacttccgacattcccatggcatttgcaaactgtcatggcgccagtgagagtgtagcagcaaggatgagcagatgccacaattgttgccattttggtgttggtgggttttggccagctcctactgtaacctgttttatcaacaaggattttatggcctgtattttgtactgaccttttatcttatcctgtgacttagaatgccttgtctgggaaggcagcacagtagatcttagcctcattttacccagcttttaagatggagttgctctggttcacaggcctctgacaattcacagataaaggcctgtatctgtcctcaatttcttcccaatcttcctcctcctccacacccttaactcaatcagttggaaatcctgtagtcattgccaccaccatctctcatccagactacctataatagcttcctaaatggccttcctatttctactcttgttacctcccaatctattccttacaaagcatccagaataatttatatattttttaaatccattgtttcacccctcagcctacaatccctcccatggtctcctattgtgccttaaatgaaatccaatctcattaccaaagccctgagccatcagacctcctgaccatttttctccaatcttaatcacttttgactcacccagtccaccaccctccagccctgctggcctcccttccgttcaccacacagttatttcctgccttttatccttcatacgtgctgataccagctacccatatccaactgattccttctcatccttcaggtctttacttaaatgtacaagaccaagattccaagactgcaggcaccatctttttttttttttctatatagtgcttatccaatttgcaattgtgtattcatccattattttactctcctgctggacggtaagccccttaatggcaagcatagtatctcttctgatcaccagtaaatgcccagtgtttagcatgatgcctgacaaacagaagaaattctacaaatattaaaatttagagccttgcgtggtctggtctctgacaacttctcccaactctctaaccccacacactggttctcatcatatctttaaaaaagcttatgggatacccaatgagcacgattccttgacacatgtttctccttctgcctgggatgctctttctccccttgtttaaactggcagatttcttctcactctttcagtcaaactctagtgtctttctacccctacacacacacatataacacacacacacactacacacaccctcatggttcagagtagacttgattaattcctcttctctaggctcactacacttctgataaaatattatcatactaaattgctaaaaaatctgtcctcctatcaatctcctttaatagactaactaagctcactgagggtaaggacaacttctaattcatatttcagtcccccaaacctagggaaatctatggtaaatagatacgtgactcaacccatcaatctatttgttattgaaaaaattttagttttagaccaggtgaggtggctcatgcctgtaatcccagcactttgggaggccaaggtgggtggatcacctgaggtcaagggttcaaaaccagcctgggcaacatggtgaaaccccatctctactaaaaatacaaaaattagccaggtatggtggcgcacccctgtaatttcagctactcaggaggctgaggcacaagaatcacttgaacccaggaggcagaggctgcagtgagccaagattgggccaccacactccagcctgggcaatagagtgagactctgtctcaaacaaacaaaaaaaattaggtttttgccacagaaagtaaccaaattcctttttttcccctcataaagtaatcagctcatcatttatatttcaaagcagagcatgcctttaacctatagggtatttatcatgtctcatcactcaaagatttattattgtttactagtgattattaaaatttatgaattaaactaaatatggatgtaatccaattaagacatagctaaatgaacttgaataggacctattgaaaagaacaggcctgaaatcatgtggatgagtatcttctctgaaatatctacatttttatattaatataatatctcaaagcacatttaattagtacttatcaccatcccctaaacaataagataataatatattcaatactgtgttgggcactgtttaatctgtttggcttatatgtatattattttaaaaaggaagtaaatcccataaaagtctacaggttatacaatccacagatgaagagctggatgcaatgattatgaagtacacagagcttgatggaaagagaatcatttctgtcttccaatggctaatttgaaactggtgatactcaaagacttgtgtttaaacatgactatgcacaatggactaaatgtttgtatctccctaaattcatatgctgaagctctaatactcaatgtgatggtattagaaggtgagcctttgagaggtaattaggtcatgagggtggatcccttgtgaacaggaatagtgctcttataagaagaaacatcacagaaatgacttctcactgccatgtgaggacaaagcaagaaggcacctgtctgtgaaccaggaaaaagaccccaaacaggaaccaaatcacctgacaccttgatcttggacttctggcctccagaactgtgagaaataatgtttgttgtttaagccaccctatctaggatattttgttgcagtagctcaaagagactaagatgttatgcttgttagtagtactctaaggcaggcagaaccccaaattatgagttgctgctgaattgataccaggttctgtagcagttgaagaactagttatcaaaaagtgagaaggtaactgagagtactattatctacgcatctctaaaaaacatatataataaattgttaagtccatgttttttctggattcattataaagctttaactttgcaacagaataacattaaatactccctataaaatttgtgaaattctcctctccatgtaaactcagacaattcaagccatggcagatttgttattattttaaaataacttagggtgcgttcatcttcacagcatatgtggacaacagtgttccataaaatgcagtacttgaaaaagaaacacatattcttggaaatactctatcacactgtgccagcaatgccatctatcatatgcatccattttaaatttactgttgagagctttccaaattaaatagataatcactactaatgtttccttaattgtccatgtaaattattttatttttataattgaagtatagcttatataagtgaattgcccgggttttaggtgcagctggatgacatttaacaaatgttatgtctacataacccacatccttatcaagatatacaacatttccatcaccccagaaagcttgttcatgtccttatccagtcatcctcctcttccctcactcccagctcccttccatcctatgccaaggcaatcactgtcatgatttttgtcactatagattagttttacctaaaaaatcacagagggaatcatacagtttgtacccttttgtttctggcttctttcacacaatatactgttctcgagatttatcattttgtgcatacatcagttcattacttttgtattggtgagtagctctgcattgtgcatttaaaacgtgacttttttggaaggttattataatcctatggaaatctttatcataacacacatcacactgggttagaatttcttggtgaactggacttttccccctgacttgcacacaggttgttgtccagcacttgacagagcatcaactacctcctgggagctcggttactaggaagatagtacacattaatgcatcatcctctagagatatattttgacagcacagaacaatgaaacaaccatagaatcagctgactggggacaaacagctcagtctaccactaataaccataatcttcagcaggtcatttacccttcctgaccttcacttttataatctgtaaaatggaaataacaataacatatcagaaaactagtatgaagattaaatgctattacttgtatgaaacctcttcattaactatataattctataaaacattattataatgtagctgagacaacagacctttcagaaaatatttactgggtaataccagtaaacaaaatttgaagattaaataccaaagtttgaatctgagtctttactgtgttggaatcaggcattgttctagtctccttacatttattaactcttttaatgttttaagcatcactatagcataggtactgttattatgttcattttacagatgagaaaatgaggcaaagcacataaaatgacctgctcaaggtctcacagcttacaaggggagagcctgaggtattaactcaagcacttgggttccacagtccaaactcttaagtgttttgttttaccccttttctacagcttgcttagtataaatttgcaaagattattttgaactctagcacttgagggaaaataatcaaaggattaaaagatatgagataaattttatagaaattgtaagacttctgggcactctcaaaagtccacaagaaacaaaaaatcttgatattaagaaacaagagggtaaacaagaaaggaaagtggagaatgggcttcagtcatcgaatcatggacagatgagaggtttcaagcacaattaagtgctctgtgaccaaacagaaaagtgaggaccatgatcatctcaaaactccttcaactccccccagtgaggagtgtgcagcgacacagtgtccaccctatcatgagggggcatgttcctcccagtcaatacccagcaaaggggaagcagacactacttcgctgaaaggaagactttttaaaaagagaaaacaagtgcaaatggtcattcgcacgcaaggatattcacaatcaaatccgtaatttggggaaagggcatacgtgatggtgaaatcattgcttaaagaaatcccaaaaccctactagagtgtaaactgttgcctcatttttctaacaattctcttcaattgattaattattagtgaaaccattataaggcttaatcagcaagtgatatatcagcatttagtatgaagtttatatttttaataacaaatatgctttagaatactcaaggactagtttttctgaggaattttgatgatccagcttcacctaagataggcacttagaaaatctgtggacttagaagggacatttggcatcactgaatccagctcctacacttcgcagacaagatgactgagactcaggaaaagggttttgtttttctgatacttgacagtaagagggagggttgcggaatggtttttattaaagactcccctccaaaactgtcatgaattcattcctgcacttgtttcagacattctcttttctgatgattatctttgttaggtctacctcttgaatcctaggagaatgtcaagaaatgtttaaaggtgagttggttaaaaatttaaaacaatctcgcttactctgtatcaaaatacacttggcttgcttccattacaccattatgaaactgcattaggagaccggactacacattatacagtctacatacaattaaatacattatataacatgctcagagaccagactacacattatacagtctacatacaattaaaaagcaaatcccaatccaattcaataaaaccagtcatttcaaatagaaagagaaacaactgggtgagcaatattaaagcttgttaaactttcctacaaatgtataataaaccctttaaaatgtaatgtcctgaatgaaacatatcatcttcaaatattaaaaaagaactcacatacaatctgtctctttcagccacagttagaatgaattttatcattctgaaaattctctgctattggtttcaacactgtatcacttttgtgagtcaactacattgtaaacactgcaaaacctcagagaaagtttcacaaaacaaagacgatttacatatactaatttgacaaaaactgcttccaaatcacaacgttttatgaagtccatattctatttctcctttagtgctttttttgacagttggaaatgggtacaagttgtaatttacttgtatccatttcctactttagtagtgtccaggaaaattatttgaacagcatgacagataaaaggcaacaatgaaaagtgtttgcaaccttctgagagctataatgtgcactgaatgcaaacagtagccggtgatttaaatatgtatgtgtatatgtgtgtgtgtgtgtgtgtgtgtgtgtgtgtatgatctatacatatgtctgatgactaccaagacagtacctaaatatatttaagaatcctgcaataaaaacgttatgccaaatggtgtgcattgatccagtaatccccaaagctcctggtctcaacctttaatttatcctaacagataactgctttgagaaaaacaatgaagaaaacagtgaagactgacagtgggtaacagtgtatttttgtaatcatgaaagcagaaaaacaaaaagatgtcaaatgtaaagcaaggggcagctaaaatcatctttttttttttttttttttgtcaaataacacttcacaatgtgaaaattatggggaaaataggcaatgaattacaagtaagagaaaaagtcaattatggcaattaccaaaacagccacacaacatttcagacatgcccaactgaacgaggtcacaatatacttcaagttatgagaaagagaaaattaaccagtgtttgcacccactatgtgtgttttgttaacaaagtgattttgattaagtttgtggtcacactgcaggatcacaagacttcacaaagaggattattttaaatgtgaaatctttcaactgtaaaactaatcatttctgaaggaggctggatattcaatatttctctaaattggagttctctctctctctctctctggctcttgctctctctgtatttctctttttcagattgcatgaggcttcattttttcataaacgcatacccccaaagaacaaaaaataatatctgaaatgaaaacaaatgcaacctttcacttcatgttagttgtctcataaatttaatatctactcttcattacctagaaagctgtaacatgaaagacattttctttcctattcttactttgcagatgaaaaaaaaatcagcaatacaactgacttgatatcttctgtgtgcgacccagaaatcttaataacagcattggcacatccagttcatacacaggccacagcaacagtgcttacagagagaaagaaaaaacatgagctttagaggttgagctgggaagtttacagcttttctcttctgactcattgtataggaagaccttgctaatgaaataaccatattggacagtattctactaccccttagttcccaagaggttattagcattgatttgagcatgtgacttttgaaacatcttcaggatgtttgagcacagctacttttgataagcctgatatataaaaagtaacaggcagagaaatgagaaagaatagagtccagtaagtagagatatgtattttaaatggtaacatttaattatctaagtttattcatcgctttagtagatgttacatatatattctaattagcctctagatttcaaagcaaatattcaggctgtaacataatttccaattttctttttttcatttttttttctcacttgttagggctggatctatgtatgacctggtccatttttcatattgaaaaaaattaaaactctactcagtgaatgatgcaatcttaataacaggcaccattcacaacattataaagttgaatgaaaactctctcctctctctctctctatatatatatatatacacacacacacacacacacacacacacacacgattctatatatattatatatatgtatgatttaataactgttaaaatttaggctttgaaaaacaactgtatttccagactggttgcttggtttccacctctctttaaagaaaaatgacagctatatactgtaccatttacaaaaattaaccaacttatggataaatgtattaaaaacaccgggcattttaagaagttacttcagatttttaaaaattcacctaacaggtagacatttagtagaattctaaatttttataatttctcacataattacacaaaccgttcagaaagcacaataatgcctagtctttttcactctcatttccagaaggaatcctggtagaaatataatgaatttcttcccttcatagtcacctactttcatttatttactattacactagaatgattcacagtagttgaattcaatagttcaagggaaaaagcctgtttttttccatgatattaaataattataacagacaaggaagctttcttacgtagatttatttttagatagatttttaaaacctaggtattaaaaactggttttattttgaaaattttcatatatcatatgaagtgtaaaaatctgatgattcacatgatagtgtttcttttttatagataaaatgttttaaaaattcagcacctatacaaaaatagtctcttttataacctgtttttgtttatttcataaaaaatgttattaacaactacttgttcacacatttaattcccaaaactgttctataaagggaggaattacggcaaaggtattaatactgacagcattaatactaataaaaattgattttttgactatcccatgtgtcaggcatactagtctttaaaagcattatctcatttaatgttcacagcaatagtatgaggtaggtaggtactcatattgttcctatttcagagacaaagaaagtgaggatcaaggagaccacacatcaggaatttaaaaaactgtttgacccacagaccaaaacaatgagctggaacatgtaaagacaatgatttgtaacaaacaccccaatgggttctccctctgtggctctgggcaaaatatataaacttgccatttcccagacttttcctatatacagtcagagcagaaaagcaagtgaaaaagagctttacgcaggcagcttagtgagtaactcctggggttattcagagcaaataataactcacagcatggctggtgcttttgcctaaagaggttggcatgactgaactgaggaatctaactgcatgaaaagagtacccaccatctgggtcaggcaaggaccccaggttaaagtcagtaatcagtaaagacagtggcatggattcaactgggccccatgcatcagaatcagagagtcagcaaagcaaagcatggggtggacgaagaaacgaaatgaccccagctcctggcatagctagacatcacctgagtttatgggtaccagctatagtcaagatgagaccaaagatcacagatggatctggctctgcatttcaggtgcgtgggcacagagaatgggatatgtctagaatggtagtctctacaaacacagctgaggagaaaatttgcttttcaaaagagttgaataacgcacccaagcaccaagcaccaaggtctctactaaactcttcttgcccagagagtcggcttcttagagtctcccttgaccacattaattaaagcaacagtgattcaacctcaccgcatacactgatagactgatttccttacagccctttgccctgacaagttttacttttgttttgttgttgttgctgttgagacaggtctcactctgtcactcaagctggagtgcagtggcacaatcatggttcactgcagcctcaacctcccaggctcaagtgatcctcccacctcagcctcctgagtagctggaaccacaggtgtgtgtcacacatccagctaatttatttttacttttattttttgtagagacgagggtctctctatgctgcccaggctggtcttgaactcctgggctcaagtgatcctccctcctcagactcccaaagtgctgggaccataggcatgagccacttcacctggcaattttattcttcataatactcaccattatggattcattttacatattattatatatctctttaacaacactctcccattagaatggaagcttcctaaggaagtaactttatatttggatggcctgctgcatcctcagtgcctggatccacgtctgtaacacagtaggaacttcataaatattggtttaattaatgcatacatatataccggtttaattaatgcataaatttcagagcaacatcgtccgaatgccactttttatgtcctagagttttgcgttttatgtgctgctgtatgctctattatacaaataaagaggtggctaaattggaaaataacaatataatataaccaaagttagtgaccttgaaacttgtgaattaattcaggcgtaaatactgctcaaaatgtaaaatttgagtgttttgatagtctaagagaacattgacaaagcaaactacaagatatgctctatttcacaaagaaagagagcccttggcacatctctaaaataccagagatactggttaatcactgaaaaacaatactcttcttggattgttttctcctgcctaaaaataaaaaagtttttaacattaggacatctactcgacaactgattatattctaagtataccaacaaaatccatcctaacaaaaaatagtggggttaattttaaaactctgacctttgatacacattttttaaagtaattttaggtcttaagttcagagtattaataaaaaccttttttttttttttttttttttttttttaagacggagtctcgctctgttgccaggctggaatgcagtggcacgatctcggctcactgcagcctctgcctcccaggttcaagcgattctcctgcctcagcctcctgagtagctgggactacaagcgcatgccaccatgtccagctaattttttgtatttttattagagatggggtttcaccatgttggccaggatggtcttgatctcctgacctcgtgatccacccaacagctgattagactagtagcagactcctccctagaaaagtaaacaacctttagaactagctctcttctaagaccaagtcccatctcaagctaaccccccaatacctaccattaataacccacccatccccccaccatttggggaagagtctagattacaggcgtgagccaccacacccagcttttttttttttttttttgagatggagtctcgctgtgtcacccaggctggagtgcagtggtacgatctccgctcactccaacctccgccttccaggttcaagtgattctcctgccttagcctccctagtagctgggattacaccatgaccagctaatttttgtattttcagtagagacagagtttcattatgttgcctaggctggtctcaaactcctggcctcaagtgatctgcccgccttggcctcccgaagtgctgggattacaggcgtgagccactgcgcctgacaagaacttattttaaaaacaagagatagcaaagatacaggaaacatgaggcatataaagattgtttttcctccagctagaaaataaattgagacaagattttggaattacaaaaactaaattttaattaaagtcaaaataggcattctcacatcagaagactaatctccttttctcttcctttttttgttttgttttgttttgttttgagaagaggtctcactctgttgcccagactggagtacagtagcacaatcgtggtgagcctcaactgcccaagctcaagtgattcttccaccttagcctctcaagtagctggtattacaggtgcataccaccatgcctcgctaaacttttatttttattttttgtaaaggtgagatcttgctatgttgcccaggctggtctcaaacttctagactcaagtgattctcctgtctcagcctcccaaagtgttgggattacaagtgtgagccaccgcagccagcctgatattccctttaaaacaaaatgaaactgtgccatttaaaacaaagtggtttcctttgtttgcctgttttataagagaaaagaagagatttcccagtataataaaagttgactacaattaaattatatgtaatatgcccacttcttagaacatgagtaagccccatgttttgtgaaaatatgaattaaggcttcttggtttcttattgaaaatgtaagagtcaactgaagttcatgtcaatgaataaacacaagaaagcaccaaagaaaaatctctaagaaaatcttaagggagaggggtccagcataataaaactccaataattgaaaggttatgatgactgacttaatcacagatgtataaaaaaattaagaagagcaagcaaaccagatacccatgaacagaaaccagaaacagatcttaaaacacataacgacttcaaattaaaaaaaaaagagtactgcaaatacttgggggaaggaaggacagttcggtgcatcgtttggggataaggaagtgacaaatttggaaaaaaaaattatttagaaccttgccttataccacaaccatatatcactagatgatttaaagggaaaaaattcacaatacattcctcttcttcaaatcattcatctgcttggaagtgtttcaattctaaaatcaactaacatactttttaaattcaactcaaaattaacttattggaggtatttcactgaactttgtaatattttctaataaactgcttgaaactgaaaaataaaagagagaaaacaacttattgattaaataacaggttatttagtttgacagattttttttttacattctatgtgtatataactcttggttgtgaatttattatatggtttagttggactttcttctggcaaaagagtaggtagtttgcaggataaaaataaatataatgatatttcatggtcagtgaatactttcagatacttcacctaaataagtttgaggatcatgtgactgaagaatggatataaaacagtaatgagagaaacaaaacaccaaaaacaaaatcagattgaaatcataggaaagaaaataaccttctaattctaaacataaaatgaataataagagagaaaaaaaaccatcaacagatttgactatataaaatgatgaataaagatcctgtatgttaaaaaatcattaaagtaagactcataaatgtaccaagacattttcagcaccttgtaacgaactgcaaagtttgttacatttgttatcaatatgactacagtcaatatgcctaatatataaagaacatgaactaatgaataaaaacccttaggcaaaggaaatatagagatttaattcatataacagaaataattacttcaagcaaacataagggaaaaattatcacttcagtaattaaagaaattcatattaaaccaataatgagaaagtgttttgcctattaaatgaacaaaacctagatgataattttcagattgaccaaggggattttatttatttatttatttatttatttatttatttatttatttgagatggagtctcgctctgtcacccaggctggagcgctgtggcgcgatcttggctcactgcagcctctgcctccaggttcaagcaattctcctgcctcagccacccgaacagctgggactacaggcgggcaccaccatccctggctaatttttgtatttttagtagagatgaggtttcatcatgttggccaggctagtctcgaattcctgacctcaagtgatccacccaccttggcctcccaaagtgctgggattacaggaatgagccaccacgcccggctgaaactagtattctcaatcattactggtagcattatgagcataatcagcatacttctacataacaaccctaaaaagaaataatgcaaaatatagaaaaagctacctctattaaactgttcctcaaagctttgtattgataacagtgggagaaatgggaagaagggaacaatgcccaacaaaagacaaacagacacatctagttcatgaaatattcggcagccattaaaagcagcagttatgatgaggcaaggttgtaaaaaatacatttatggtaaaatgataactgatgtactgaatagcaaattcaccatacagtacaaaggatcacaaaaattactcgagttagaacagtgtgttgttttcagataaaaggattatgagcaaaaggactataagcaacatatttttcctgtttctaaatattctataatgagattatattacttttatggctttgaaatagatgaataaaagttacggtatagaacggtaacatcagtatccctttacaacagtattagagcagtacacattagtagaactacctttggtttaaatttgatatggtttggctatgtccccacccaaatctcatcttgaattccacgtgttgtaggagatacctggtgggaggtaatcgaatcatgagggcaggtttttcccatgctgttctcgtgatagcaaataaatgtcacaagatttgatggttttaaaaagaagagttcccctgcacaaactctctttgcctgctgcgatccatgtaagaagtagcttgctcctccttgccttctgccatgattgtgaggccttcccaaccacatggaattgcaagtctattaaacctttttcctgtataaattacccagtttggggtatgtctttattagcagtgtgaaagcggactaatacaatattttctttcaaatgaccccattgttaatgcaagctatctcttcttactccaccacctgttgaacatattcaaatgggatgatttatatttctatgcctttccggtttttaatcagaatgtgaactaccactggggcttagtatgtaattcggtgggcctacagttacataaatttcaaacaccacatctctctgaaaaaatatcatgcccattcttaattttttttttacacataattaaatgattgaaaatgactgatcgccctttcagtgggacttagcaaggttttggcaccaattctatcaattaactacaatactgtactggctctggtactgcatcttctacagtgcatgtaacgatatgtacaagggacttctatcaacaaaggtcagtgtcatgtgtgaatcaccgggtttccttaactgagagtccccagtctcttttcctataatgacaatttcaagttctgtgttatgacctggagtgctgtaagccatggctacagagtggtgaggatgagaagatggactattaaatctttctggggtaaaatgtgtggctgtttcattacaactcctgccctatcataatactcctgtgaccatcaagatttagatctgtaattacaagaaggaacttgattttcaccctgattaccaatggagctggtatacataagcacaattaaaaaaccaagacttgaaaaatgagtgtcttcaagaggtgaatgttccacgcttttgtggattaacaggttcaaagtaaaccctctacttttccactttgttacaaggtgctgaaaatgtcaccaagcataggcacttctgtccttgcaatcaatcacctctggtaagaaaataaatgttataaacaaatagaaacaagctttattttttttaattaaaaaatgttgtgtgggggaagagtggacacagttcatgattctgagcaaacatgagattattatgtgccaaaatgccctcagcattgtataaatacaatcccctaccccaacagagatcttttgttaaagctataaacactgcttaatacacaaatgtattgtattcttaatcaactgcctttaaaaacccctacctttcagaaacctgtttttgtttattttgattataaaactggaggtacatacttagagtctcagaagtgacttaaaaaaaaaatgacatcagcctggcacggtggctcactcctgtaatcccagcactttgggaggccaaggcgggtggatcatttgaggtcaagagttcaagaccagcctggccaacatggtgaaccccatctctactaaaaatacaaaaattagccaggtgtggtggcggacaccggtaatcccagctactcgggaggctgaggcaggagaatcagatgagcccaggaagcagaggttgcagtgagcagagatggccccactgcactccagcctgggcaatagagcgagacacagtctcaaaaaaaaaaaatccaactattgctgcatactttctgaagtatttttttaaacaaaaataacttcttgtataacaatgagaatgaaaaaacaacaaaaaacaaaaacctacctaaaacaaaatgcaaaaaaaactgcaataaaaaataccagaacctgtgacgctccctgtaggaggtgacagaaatttataatgtgaaagaaaaagagaaaggcatttggaaacaattttctcaagttctgtgaccaaatgagagaccaggtaggagaaagggcgactatgttttcagataaaaggattatgagcaaaaggattatcagcaacatattttttttctgtttctaaatatcttataatgagattatattacttttatggctttgaaatagatgaataaaagttagggtatacaagggtaacatcagtatccctttacaactgtattagagcagtacattagtacattagtagaactacctttggtttgtatttgatatggctgttccattacatctctctagaaaccttatacttaactctcacctagtggtagggagactgtggagaggtagggggttaaagtgttaggctcagtactgtctctactactctgtctctcattcccaccaaactgtcaggggtggagtctggaagtcactcatctggccctagatttctttcagtgacttctagcaggttgttctgagatgtgcttgtcagcattaattacatgtgacattggattggcctgatctgtgacaaaattcaaacgcactataataaagcaaaagagcaggaggaaagatgccaaggggagactttgacggtgtttcacatccccaggatacccttcacatctccctcctgctccgtcggccatcctaacaaagacacacttgctctgcgctgcacatggagctttaagacagatctatctgctttggacagcccagtctacacctgttgacccattaagaacatccccattcactctcacagcatcctatttagatgttaaattacataatcaccctactgagccccctcttccaactatattgccactccttaattcctcccatacagctatgcagtcacaatggctgaagacaaaaatcacttggaaagcaacagaaaagactccctgggaaatctgagaggaaaggtggaactgatagtactatatttgttcctttatttgatttccatggaagtgtacttcacatcgggctggtacaaaatcaaagagtttgtctgtcattaggcaaaatgcacagaatctgttatcaattcactttccttgagaaggtatttttgaaacacagtatctttcacttacatctttcctgctagagtcaacgagtattctaactacataaatgctgtacaccttgattttattacatctgtaaccttgaaaagatcaaatgatgtttcagaatgatctggtagactagggctgtctaatacaacttagtgcaacacgggaaacgttctatgtcggtgctggttctatatcatggccactagctacatgtggttattaaccacttcaaatgtagctagcatgaatgtggttttaattacatttaattttaattaagtaaaaaggacaatgggtttcttaagttggaatactgggataaaaaagatctgcctcccgttctcatctcctgagttttgatgagaaatgtcactagaatcctcatcaaggcagatactgtctactatgggatcttcctccctcaaagagcaagcaaagggttggcaaggaccccatttctgcagtgtaacaaagacagtgtcaagcccagaaaggactggccttaggttccaaagaccaagatggagaggtcagctggagtaagaaagcctcttcaatttttgggatcttaggttcctcagcaaaacaacatgaggtttactctcaggtcctttccagcaccttttgaaaatttctaattggtatctgaaaaatggtcatcacccatgatgaagaagccagcatggcacattttacaagcagaaatgtgtttggttctctctcatccagacgtatggaaacataatgtaatctgtcactctagtacctaaatattccaaaagaagagttttatgcttaaaacatctaaaaggtcatttatttcccctttatctacattatacataataccatgttcatataggcttgtggatacaatcttttatctatggatttgcttacatcattatttctctcaacactagttgcaaagaacattattactgtaaagccctaccacatccatggtgtgtctttccttctgtataatgaaaagattattttgaaagattttcacaatcagaaaaggtaacaggcctcttaatatattttaaaaaattgttaatcacatttacattccttttactaagcatattttttatttaatatgaacaatagtcactgagcagtttggtatactttttaaaggtttctatcatttttaaaagccttgaaataaaatatcactcaaaatgaggccaagattatgcatattttaaaaaatttctcatagaaactaaccatctgtacaataatccattgtctgctctaccaaggtgatttattaaggataatgaagcatatgatttaatagctgccacaaatcctttttcaaggaagatgggtataaataatacaaaaagatggtccaataatagccaaatcccaagctaagagctattctatatgctaggtcacaggaaattacatgagctcaattaactgtggagcaaagtgaagtgtggctaggcagctaaggctctaacccccatctcctactttggtagttggtgttattatttaatgaaaccagtaagctctactatcatggtggaatttgagtagcttttttccacatgacaacataaagctctccaattaaaaatggacattaccggcacaagttttctaaaatcttaaaaatccagatctctaaaatttgtcagtgcaaattatacttgcactgacaagtataatagtgctttactcagccttatattcccacagtactttgcatttagcatagtttaatgtctggtgctttaaagaatggatgtataaatgggaacacaagtgagtgagtgaataaaatgaggtctctaaaatccttgcaggaaaaaaaaacaaaaacaaaaaaaaacacacaattctgtgttcctctgagacctggtcctaacagttaacaccacttatacttttgaaaaagtttgcaaggccagttgtcaagaggttatctcctttgatggcaaagctttccttcagtcagtgtcctataaagaaaaaaagtcgccaaatcgtacatgtcatttgaatacagtatttaaatattagctcttggttgcaacctgacatactcctctcctggctagctctggcgatattcaagactttacaaggccctgtgaaatcagtgaggcaaatttctaacaataggaaatacaagccatcaaatatgccagctgtttggcatgaaagacagcctggctgtgccttacaggcatggcacagccattcactgataagctggcacagccaatcctgtcccatgccacccagcaagtacatcaaaaacaagattagatactgcaaatcctagtgtctaagtaacactgggtttcagaaaatgtccacagctcaacataaacaagaggcccatgtgtgagacatacgtcactttcccccaaaaaaagtgtgtgcttcaccaggcacatttaccaccagcatattttcccactgcagttcctacggctcttgctcttgtgagtctggcttgccagaaccgagatcaattttattagataccattagtctctgttagggcggtcatttgaataacaacagattggcaagtataaaaccaaggcacctgttgtacatttggcagcctggatgaggccccttaaaacgaaaacaaataagaactataatcatgccaggcaattgcttttggttcaataatggccatgtgtcagaattaagtgcatctgggaattgctaccacagccagatgtaaaggcagatttgtcttgtctagtggcatatgagtagatacacacactctactgagatttggctttgtcctggtttggtaaggaactaggtaaatgaaacttcactcaaaataatataaaattaaaattaattacagaggagcaatagacaataccatcgtaaactgtagaacctaaacagatgggttgtaagatttgggccgtgaactaattcacctctgagttttctgggcacactaatttgtttacagaatactcaacgataacatcccaatattactattgcaccgagccaggccatgtagtaggagctggagatgtcactgggaataagacatggacattggcttccaggtactcctaataaaacagagtaaaaataagcaattacaatgcattatgatagacactatatgtagaatttattcggtattcttttagtgcccagagaaaggtacccagacttgggaggagggaaattttctaggaagagttgtcagctaagctatgccctgaaggaagaaaaaaatcaggcaaaaatggaagggttggggacattccaaatggaagagagagagcatgctcaaaattacagtagaaagagtcaatgtggtacatctgggaaacagcaaatactttagtatggctcaagtgtgtgtgtgttagggatggaaggagtggggaagagaaaatgaatatgagtatggcaaggtggcaagagacaaagcagaggaaaggacatcaaaggccaggtgccttttggtaaggaatatttcatgctttttacagacagaaacagggagccactgaaatatttgaaagcaaggaatgacgtgatcagatttgagtttcttaaagatcatgctggctgcagagcacagaagcaactacggtgaggtcaaaaccaaacacaaggagactgcaccccaagcatgagaagatgggggcctttcaacagatgatacctaataacatgaaaagacagtgaataatttggtggaaaggaagttagtatctattttggtatcctcgatataatacaagtgtaactgagagaaaacagattttgaatgataaaattcaaaattgaaattaatattttcctaaaatattttttttttggtacatataaatcaaattcaggtcgagtctgttaaatagtaaaagtcggattaaaataaacataagcagtcctttcttaaatcagtaactgaatatacataacagtatttattaaacttatcattcttaatttataagtattattttaaaatgtgtattgataacctaactataaaaaaaacccttgctacatattacctaaaaaagtacaccctgcttcatgcttctaggaagttatgtttatagattaactggtagaaaaacatatggctaaataggccagtgtatgcatgtgagaagcattttagaaacctgggcaaagaagacttaattgttcagatatcatgaaagccataaaagaccgagtaattttccatgtaactttattttatgtatcatgtctgatttaaaacttcggggtaccttcttgtcagagaaaaaataattttccaaatcatcaaacaaatataagatcctgtattttattatttataaaatcataatcagaaatagttctctgaggacttacagacaaggagaagaggctaaactattataaaataggttaaatggaaaaaataatcaaatcatccacccttattgataatgaaactaacgggtgaaatgaaaacaagagtattttagaagacattataattaacaaaagtttctcagataaaatggtatagggcaggctgccaataagcagaatgcatatataacagtcacttggcataattccatttctttgatgggtgactgctcttcagatatccctgctggatcgatagttctctttataaaaatgcttctgatttcttacctgttgggcagctatgaaaatggcagcctttttgattttaagaactattcttggtggaaatatttcatttaaacacttctgctccaggactgaccccagagctctggcagttgtatcactggcagaataggataaaattttagagctggaggccatctgcagaaaaaaaaggtcatcgaatcaaaacccctttggtaaaaaaatgtttttttcaatgcctccagtcccaagcagagaaaggaacagaagatactcttcagaaacggtagagaggcaacgtacttattaatgcttaagatttttcctttttttttttttttttttttttttagttttttgctttttgagacagagtcttgctctgttatacagactagaatgcagtggcacgatcccagctcactgcagccttgatctcctggacttaagtgatcctcccatctcagcttcccaagtagctgagaccacaagtgcacaccaccgtatctggcaaatattttttttttttttttttttggtagagacagggtcttgctatgttgcccaggctggtcttaaactcctgggctcaagtaatcctcctgtcttggcctccaacatagatttttcttgaatttgagtcaagaaagcaccatgtcattgggcgtacttgcctggacgatgtgagataaatattttttttaaaatcatgtcatatacaagagtgaggaggttaagagtgagtgaaacagataaaagttgggatgcttgacttaaaatcttgaccctatgttccatctttattacttttatctatgcaaccttgggcaaattacttaatctctccatggatcaaccctcttctgtgaaatgatgataataaaaccatctgacttacacagaatgttattttagacattaaacataatactaaaggtgaggtactgagcagaatgcctggcatataataaatgctcagtaagttttagaaataatcactattacaactattacatatcaaccactatgctatagctgtaaatttgagaaaattaatgaaatttttccccataaaggaattttaatttttacctatctcagggtcctgagcattgtgagaggtttctaatgaataattattcttcacattttatggtttcaattctactcaactcaaaaaaaaattttttttttttttttttttttgagacggagtctcgctttgtcccccaggctggagtgcattggtgtaatctcagttcactgcaagctccgcctctcgggttcatgccattctcctgcctcagtctcccgagtagctgggactataggcaagtgccaccatgtccagataatttttgtatttttagctgggactacaggcgcccaccaccacgcccagcttattttttgtatttttagtggagacggggtttcaccatgttagccagaatggtctcgatctcctgacctcgtgatccaccggcctcggcctcccaaagtgctgggattacaggcgtgagccaccgcgcctggtccataattctttagttcaactcaattcaacgaaaaggaatagcacttgaactgagcattagaaaatgagagaataataggatttcaatggatacaagtgaggacagctggtaagagaaaggagattccaggaacagtattggtagaactaaagaggtgcccaaaagcacagcctcctcaatgactgcagggaatgtgatactgcacaagggcagagtatcacagggctatggtgagggagaaggctagacatgcaatttgggagcagactgcaaagggctctgatggctgtgttgagtattgagcacttgatcaagtagacttgagcaagtttgcctttcataaagcaaaaattaggaagactcaaagaggagaaatgagaaaacacaaaaaccacctaagaagctgcgtatggagtgcagaacacataggaaaggtagaaatggaaaggaaataaagtgaaaagattacaggaggagaatctacaaaattgcctgaggataagaacaaaaggaagaaaagagatagggatgacaccaaggtttctgatcaagggataactcagatgaagtatgaagaaaagagaaatagatatggatggaagatagtattttgggtttacaaaatacaatgtttgggatacaggagagcctcccatttcccagtcatgtaacaagcagatagaaatgcacgtctggaactccagagacaagcgaggaaatttattttgaaggttatctatgtagaaattattgtttctatgagaagtggatagacatatggcaggagacagtacagatagccacctgaaaggggatatagataaaatgaaaataaaagagtttagaatggagatggagacatagatgccaaacatcaaatggagacagagttccatgttgatgaagaaagtgaatgtcaaagaagtaactgacaaagaacaacttccatccatggcatatttccaatggaagatgcttccaatattttattcctctagaaaaacatagttgcctcttttcttccccctccccgagaaaagcaaaaatggttacctggccagtaagtagatttagaatatttaagatacatccaacaaactactcttatttctagctagccaaataatcttgatagatctttttaaaataagacataaatcaatgtatctacaaaatcataatgagctatttcaaccagagaagtctgaattggtttttctctcaaaattctctaataatatttcagttaagttactactacaagtagttggaatgtgttttcacagggaggccaggatctacttgtgtagtaagaaatcattagagcatactcaaaatgtccctttagatgggatgggccaggaggaaggaagacggagaaaatttttattttaaacattgaaaacatatgtcttgttgacctataagcagacactggatcagcatttgatgtgtctagtctaatttctccctgtaaaattgtactggtgaatcttagggagacagaaggcagtaaattccttgcctccatcaatacatttgacctcagagcaaaccccacaactggctacaggcacccaccatccatcattgctcttgaaacctgatacttcagggaaggacagctgcactgggcaaaagtctaagcagctttctaagatgcactaccattaaagaaaaaaaaaaaaaggcacttattctgcttcagtattttaattaactgcttttctaaacatttcttcccccaaactgaaactccaaatcaaatatccccaggaatatattaataaaatttagactttagagagaaacgctctctttgtgcattctaggtaaaattatttctagcttttgctttaaatgctttctaagataaacaacataccgtgccatgctaatatgtacagactttaataaatgtgctaagcagaaaaagagagttctagcaactacactaattatagcagtacacacagagtgccaacaggaaaaacgtacacaaaacatccgtatccaacagatcttaatttttaagtcaagtggcaatcacttttaacaaatagctgaagacaacagaactctatcataggaactagtgttcttgaatatggtatgttcattacgtgacttctacattcgagaattatgtaaatttaaaatacaaaataagataaatttgtatgatcaaactggatattcattacatgtatggttattcattccctccattttacagatgatgaaactaagattctgaaatgttttatcatttcctccgagagctcacagataataagtggcagaactgaggcataaatttagttcttcctataagaactgaatgttcttttcactgtagcctaaaaagaaaggaacctgggtcgagattttgcaattctttagcatcatcttaatatgtattacatgcacgcatggttaaatgagaattaacaataactgatatccaaccatttatgaaatcattactaatacaacccttttagttaataaatgaaatccatctactaacggtttaaaaaaaaaaagatgtctcttgttacttgtgatccaatcattacagaggatcactttatgtatttgaaagtacaatttctccaaaccccaaagcagtactgagaaatgctgttttctaaatacaattcccaaatctcaatttagttagctactgctacattaaagaacatagctcaagggatgttgttaataaaaaaagaaaaagaaaaagacaattgagaatttataaatttaatcaatctcatgcaactggcagagttacgagagttaaatctagtaaatagccatgtggcaaaggtcactatgctcctgacattgttatctgaatgtcaaggaagaagcaaacttagcctttctggtcaatgaattcaaagaactaagagaaagccttgactcagatggctgctttggctcttacattttgttgtaaatgctggaggagccaaagtggggacctgccacgtaaaagcagccatttacaaaggaaagcaaggtttgctcgtcgcaggtgaagagggaagaacataagttgtctcaatactacttgcctgctggtatacatgacctactagcttacagacagaatgagctgtcttagctctccaaactgtcatctttttcatttagtttacttatctatgacacatagggatttgatttgaaggacagcagaggttaaaaagccatcaaaaagctcagttttgctgtctctctcttttttcccccttttggtaattttcaaaatgtcataggccaactgagtagtattaatatggtcctgttaaatgtattagcatcaaactaaaaataattaacaggaagatacagaattaatcattttgtgagggaggagggaggcactgcaggcattgttttagtccatttttttccctgtgagttgcttcgaggagcgtggcagtacacacggatgtaatacgtaaagtacataatgtctaagtcctaaaaatattttataaataaactgttaagagaaaaaaatgcaaactgttgatttcttgaaagcaaatgggtaatttattaagggggaaatgagagacacaggtcttcagtgtaatcttttgaactatgtttcgtaagaattctaattcattaattctccagtctagcaccattgtgatggcattattatttaggttacattaagtcagactgctgtaacatataagcatttgctctttgaccttcctaagacttatgacgcaaagaaaatgctgaacttttacatctgaggctataatttcatataatgaacaatcaggaagcacaagtcacatattcttttagctatctttcttaagggcttaattgtggagagttgaaatccatttttatttttttaaaaaagggagagaatttggacactttgtggaaacagatgtaagccaagcatgacattttaataagtgtcaccagctaccaattagaagcaaatgagattacccatatagaaaatgtatcccaaacaaacctatcctttggtagaaatgtcactgtgccatgaaattacagaagcttaaacaagtgatgcttgttcaaatgaaatttactgacaaattccttctaagcaatcttcttccacattatcagatttcttcagttgatgtgttacataggaattctcaatcttgtagttcacagagagaataactcttctctttgctctttcttggcaaatcactgataatataaaaaagaatgttttaaaacactggttttgcttgaggcagtaagctgcctctttgccatcacaagtaagcagctttcctaaaagatattttcaaagaaactgaacagtagaaagatgaaataacaacaaaaaaaggtaaataactccataaaaccaaaagagattcagactaaatttggtttaaatcacatgtaactattatcactttaagaaaataggaaaaagtaaagcattttttgaatactctgggaaaactggataattatatctatatttagcacttcatatatctgggcatgtaatacaaatcctgtatatttcgtgaccactaagttgagtacactacataaaacgtaaagtttattttcgagattcctagaaacttttgggaattaaaaaggtaccatgattaaaggctttctgcatagatattttaagtgtaaacctaagtctgatgctcctaggatcacaagttagagcacaagagcacacacacacttgactcttatactgcctgcaaatacacaatgaaactaaagaagggttgttttaaaataaaaggtaaactaaggaaggatagttttaaaatgaagtcatctttgaaatattcacctttcttgaaatgacacttttcatatgtgattgtgttaatgaattcttaattatgcatagaatccttttaaaaatagaattgtccaatggtttgataaatcaagtttggtctgaaggaaatctaatatgcaaatacttacagtgtactcttttacaaacagtcacccttgtcagtttgaaaaattgaaaatcaacgaaagaacagtttaagtatacttgacctcactgcctaatgtctctcaagattgccatggctggtcgatttcaaatctgtgaaactgacacttaaaaatgtatagtgcgtcttcagtccaggtccctcaagtgctaactaaactgtggtcacagcctcagattttctttccatacaaacttgtacagcgcttacaaagctactttaatcacatcatcaatctatgcctatacttcccttaaagtaattctgcttcatttatcttttaaccctacattatgcaaataacatccttatcagtccaataaagaaaagttattaatgttccttcttgtttatctttgtcatacactgagaactggaatcacatatgaatttgcaccaataccttttctcttttctatttttcacactctatatggaaaatcatagtgccagagaagccctaaataaaattcttgaaatagtcttcaatcattgtctataactagtatcagaatatgagttaatgtattaaaaaggaaaaaacaaaaacttgggggaatgcctacttgaatttttttttttttttaatgtctctctaggaagggtttgcatatgccataccaggatacctcctggatataagaacagttatacaggcccctagtggcttagcaaatagcagcagatgaggggattccaattcttagttccagactttgagatattctggatttaaataagtgtcaatcttaaaaggcaaatcaaatcactgtatttaatactttaagcagttttacatctatggttatctactctaacgcacatatattaaaataaattgctgcatttcattacttgagtaactgcacaactgctctggcccaagaagaatctgtgttacataacctacacaataaaatgtttaattcatccacctttttacatgtcatgcaaaaataatacattactcaactatattaaaatatatttgagagagacagtgttcctatttgaatcttattcctattatatattactgagggctataagaacagatgatttctatgcaaagtactatttaaaataagatacagataaaaattgaatgccacttttacaggagtaaaaatctaaacgtatttcccagtaacagccagtgatacaactcacattggagtccatctatttttaaagatctacaattaataacacccattaatcccccatccccttgctgtccttccttcacaaaagaaaattccaggcaggcacatttacagcttttagcaatttttaactggacacaatctgacagctgaattcatgaaactgaccagcttgtcaatttcacactttgaaagtacaataatagctgatagcatgagggtgaatttaagaaatctgccacagaattgctagctccattgaaaagcaaagtacagtacataattatggaatgtgggaggtagggaaaattttattgtccatttaggatgtctgtttccataagtcagacacggaacattgaaaatgtgttctctttttgctatagtgtctgtagcataaagcagaatatatgttcaaagtaagtaagatactaagccttttactgggtattattatattacatatacaacttaatcttaagttattatctctacagatccctttacatcagaatgtttcaagttttggtatatcatccttgttttactcaagttgagtggttggtgtgtgcactttgaaacagagaaaaaaatactgaaaatggtcagaagtatctatggttgaactaagtccccagagatgcgctacaggatggttagaaaagaatacaccaaaggataaagtccacatttgtagctcagtaaatttaacagcaaacctatttcaagtcataagcagttactagcctctgagaggttcaaactgtgtgagctacactctgttaagtcactggcactgtgtctttgcacatgtaaatatatatatataactttaagaggaaatacaaggagaacgagccctcaggaatcttcctagatacttaaggtgcaaactgtagatgaggctgggggattactctgagaattttagaaaacggaggagacatttggcaagtagcgtactgggaggcgaactggaaacaataaaagtggattgtgatagtcctggttttggagaatggaactactatctggaatcctggaacaccaaattaatgaaagccaagctcacacttggtgttcaagatttttttaagcataagacttaaaaactgacttcacttgctagtgcttttaaatgaaaatcaacgtccagagaagcaatgcaagttttctacacacccacataaaagctacaataaatctatgggaaagcaaataatctttggtttgttcgtggctttctttttaaattgtttcttacaactttgactcttcattataaaagatgcgttcccttccctacggaatgaatgtgtgtgttaagtacaccagattcccgcagctgaactacgagctttgattctgccacgggaaggtctcccaaacaatccccctcctctatggcagctgcgtagactttgattcctgctatttctccttctccccactagttcagaggaaagaaagaaaaagaaatcgccccctcaccgtagtcagccctccttaaaacagtaatccctgcctttaaaaaaggcggtggcaggatccctgggtaagggtggattgccccaccgctccaccatttgcccccaatactacgcccaccctaggaggagagagcgggggtcgcacaaatacacatacccggacacccccattctctagagtcgcctctctcccgggtctgaggtttcaggcgagaagtgaacccagcaggagaggacctctgcccgaggaggtccagaggagcaaactgtgcgctccggtgcccgggcgccgggctcgcggaaacgcgagcgtgtcgctctggctcgggaggcgccggcagccggagccgggcgcagggcgattccggagcagcaagaggggaagacaccgcggggcggacggggtcagttccagggactcacctggtcatgttggccccgggcagccgccgccaccgcctcccgcgccgccgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagcccagtccagagcgaggaagtggaagagagtcagcgagtgagtccaaaaacccgaaatccagcatccaaggcagcgcgtccccccgccctccctccacccctacccccttttcctcctcctccgcctcctcctcctcttcccgggccgtcctcttggcccttctgagcccgcggcttccgcggcggtttctcctcctcccgctcctcctgctcgccctgcgcccgcttctctcgctgccgccgccgccgctgtttgtctcctccccctcctcctcctcctcctcttcctcctcctcccgctcctcgatgctccgccgctcgcggctggggggtccggggccgcgtctcctctcctccctccgcctctcctctttcctccttcctgctgcctcttcttttaaagcggattctttggccacaaatagcaactcggctgcccccctcggtgcctccctccccttctcttcttccccccaaaagtgaagcgcacgcgaggtaaccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggcccgctgcgcccgctggcgaatccctgaatctggaccactgacccactgaaagggccagagagccggataaaggaggggcaggcaggagaggtgggtgaaggaggcaacacacacacacacacacacacacacacacacatacacacacacagacacacagacacacacacaccagaggagggggcggggtgacgtcactccccagcatccatccaccaggccagaaaagaccctctccaacagattcactcatctcctaagagatgcacacccgggcgcttcctgctctgcgtcccagcgcaaaggaggaaaaaatgctggtcgcgccctattgacagcagtgataatactatagggagcgtgctttgatgagacacagtttgtgtccgccccagttcaccttggcagcctccttcggggatgcttgtaggatccgctttgaaggcaacgaggaagactgggaagtactgaaccaaaatcttagtgtgataacttgttttgctttcatgccacttgcttttatgttgttggaaatgcagtgctcctcagcttctctgaaggacactataacacctcttccctagacaagcatccagttgttgggctatgcactcttcatccacacaacccaaggtgactaaggtgcactgtgtgtattgttagctaagagatggattttaaccttcttcactactcatagggtctccagcatgtggaaaaagtcggcagctggaagccaccattggcagttggcccatcaaaatttattagaaacttggtcagaaaggttaaataaagtaaagctagagctcaccagccacctccattgctcattctgtgttcaggccagcacatacacacaatacttatccctgcagactccgggctgtctttgaaagagcaaaggtaaacagacacccttagatttgacttaatgatccagcatgctgactgctgtctcaagctgcccatttgtttccaccatctgcatgctgtgctcctgaaagccaccgaaggattggtcagtaatcctctgccccctatgtactccaaaaataagtcacatattttttaaaggaatctctctaaacgaagtttagttttccagcaatttgggggtgggggaggagcatccctgcatgattgtctcttggctttttggttttgcttttttatggttagggtcatagtgaaaatcaggaagaaatcaattcttgtgcaagccttcaaacgaggtttaccctccaatcattctgatttcacaggagctgaaaagctgtgcagggatgatggacccttgccccctgtgacctaaggatggatccagaaatctcagcctccccataggtgattccacccaagatgtaaactcctacttggctttgtcattgccacatgtgcccccataaactggcaatcccactttcctcatccaaagttgcatgttagagaaacagaaagttttaaaacccctaatattcctttgctgttacttttgtgggaaatgtatcactctgcctgcagatctgacctcatttaagaagaacccagctggtaaatctgactgctatctgggaacatagttgaggatatatcatcttacaccactggtagtgatttaaactagcaagtagaaaagggacccagaaatcaggggatacagaggacagtacaagtaaatggcataagcccaacttttctgacactgtgaagtcctagatgttcttgtctctactacaaccaaacatcaaacatcttagagaaagaagtagggatgggtcaaggtgactggagagtctgagttattattataccaatgagactgagaattattcagggtgatgctgctgaaaaacgggagatacagcaaatagagaagccaaagtttctctgcacatctgagtagtaatggaagtgagactgcagcctgctacactcatgttaatatattcagagcagattggcaacaaaagagtgtcctaatgctgcagcatctagtaaacttctggactggtttaccatttggaaattttaagtcaaagaacatcagaagcaggctaatcttttgttgaaattacctcgtttttacaggtaaagaaacgaagaccctgagaatttaaaatcatccaactatttggtgccagaagcaggacaagaactcagacatcatgatccagtgccctccatcccaccagctattcatcatcacctccacattctggatcaaagaagccagttttccaacttatcaatgagcaatacatatagaatatttttaaaactccaaatacttttatgaaggaaaaatgaagcaataggacaagacattttcttcgtttccttccagctctaacattctgtgataaatagcacacaggagctttgctatagcactaccccctctagtgcataattcagcatacgatgagtatgagtctgttttggaccccatccaaaggagttagttcctagaagtacttggaagatttattctcatttatcatgaggcatcctaacaggagactaaaaataatcacgatgacaataatagtaatcagttgttacacttgtattatgtactaagcatcgtgctaagcatgttaaagttcacctgtttttgaaaaggcacttcatgaccttatgtgggttgcgaatctagtgggtcataaacaatttctgaaatgaaagaaaagtaggaaaaaacacagagtgcattatacatactaagttgttttattttttatttttttattttttttgcaaaacttcctttttgatcatgtggctagtgattaaaagtttggaagcactgcctcgtttccaatcttaactgccttgctagttaagtattattagccccattatataagtgaggaaacaggacgagagaggataagtaatttggccaagctgacacagtgagtggccaagctagaattttgaacctagatctgtttgacttcaaatccaatattttcacttctatagtgatgataaattattgaccaaggtatggaataaattgttgctaatcatgttttctttgtgaggactactggggtttttattaaatccagctaaatggagaaacacagcatagattcaagtgacatgttcggaagagagtgaggaatttcataaaacactaaatctaatatctaagaccttttcctgtaggtgttagcttatgtctaatacactttattgacttactgctaaatacataaatgaaacaataatagtttcagtcctcaaataacaatattcacttctacgtgtgtttctatttttatttcagagagtatttttcaaatttaagttatacagcatttctcagtagcttgctttggccaaacacagaactagcacataagaaagctaaaaggccaggcactgtggctcacacctgtaatcccagcacttttggaggccaaggcaggcagatcacttgaggtcaggagtttgaaatcagcctggccaacatggtgaaacccgtctctactaaaaatacaaaaattatctgggcgtggtggcacgtgtctgtaatcccagctactcgggaggctgagacaggagaattgcttgaacccaggaggtggaggttgaagtgagccgagatcacgccattgcactccagactgggcaacagagccagactctgtctcaagaataaattaaaaagcagccagacaaccctatcattcaaattcaattgtaaagaagaaaagaagatattaattaaggtgccatgctaaattttttgacccatgtagttctatggattctaccagtaacattgcatgcttaggtgtcattactcccattctgcagatttgaaagctcaaactcagaactagctgatgattgaaatcacctgttctgattccactacccaaagattctttacaaacaagtgggcttccagtagaaaaggaggcagctggagattttgagacatgttgtgcaatcatttatgctttctttttccacgtgaaaaaaatacactttccttttcttcaaggcagcatctcttcttgctgttaggcagcactgtcctctttaagaaaagaaatccacatcttcatggatgaaattggaaaccatcattctcagtaaactatcgcaagaacaaaaaagcaaacaccgcatattctcactcataggtgggaattgaacagtgagatcacatggacacaggaaggggaacatcacactctggggacggttgtggggtggtgggggggagggagagcatcgggagatatacctaatgctagatgacgcgttagtgggtgcagcgcaccagcatggcacatgtatacgtatgtaactaacctgcacaatgtgtacatgtaccctaaaacttaaagtataataataataaaaaaaagaaatccacatctttcataaagaaaggcctagaaaagccatacctcctccactgactgctctgttcagctgctgcacttcaccctcacctgcagtgtgtagaggacgttatggtacaatgctatttgctactggctctgctactggagattacagcatgcgactgtgacaatactggctctgctactggagatcacagcatgcgactgtgacaaatggatattcccattaaattctttagtagactggggcattccattaaccattggcactatcccaacccaagtgaaacactgggtcatttttttcttgtgagcaagaagtgaagggagaaaacaaaggatatactctaattacctttcctatttcttttttgttgcatgcattatgataactgtatattacacttatttataattaatatatgacaagctgtcagctaaaatttaacaggtgatttgtcaagaaggcccattaatgcatacattaagcagtggatttcagtgtttcctaacaaaattgtgtattggttttgttttttcattctatttagtataaacattttgaggccacctatctttacattttgcagcatttttaaaaaataaaactattgctaacataaatgggtgcattgttagttatatgaggtataaacacatttctgtcaccttaacctctaaatttgtttcactgaggaaacaaattgcctagtgtttattttaaagttttaactttcatgggttttgatacattttttaaattatatcttcagtaggaaaggcagagctgattagggaggaaagcaactgcagttacttatgttccatttagtgtttgtatcttaggtaagaaaattctgaaatgaaggaatattttaaaatacagaaaaagattaagaagtcaccagaaagctagtagttaatcattgaataaaggaacactctacagagaccaaaaactgatgaaacaggctccatcttgctgaatggcgcaagaatgggaaacacaatggaaatgaatcacagatagttgtgaggaggattctttgaaagaaggaaaactctgtttctctatctgtaggatgtcaaatcatgggacataacctgaaaaggaagttaaattttgaacttcaatattattatttccatggtcaaccaaaatttgtactgtttaagagaaagatacaaaagtactgcagcatttgtttaaaatttcatttgcacaagcctgactcttatctctcaagactcggacatgcttcaggcagttaatgactcacaatccactactctagagggtgctgaatctccttaatgaaagaatgtgctttaagattcaatggttaggaagagagaaataaacgagagtaaaacacgaagcacagcagtttttcaaagctagtaagacttctgcgtccaccaaccaactttagctcttacatttttagaaagaaagcactaacacagaaccatgaaattatttttaaaggttctttctaacagggtttcagaggatggtttccaaaaaactcactcagaagtgaaataccacacgttgattttcacgttgcagggagcgcattcctatgcagttcagggattataaatgaccagtggcaagttggtcattgtatcctgggccaggatctcactgtctccagatcttgctttgttttccatatgcagcagagtccccatgagtaactgggggtgtttccttgtgcattcagtaacagttttcaaaacagtgaatatagcaaggcatcaagactactatatttctgccacttttctaatgttttctctttgtcttatacttctgttcttgtcttacacttgtattaaaaacacaataaagaaaacagctttgtacaagctagtattttggccataattatacttttctctgtcttctcaatgaataagaaaattttgggccaggtatctgcacaaagcgtgatagaaataggataaaacagcacatcatctagcatgtagcctacatttatgtaaatctggttgatgtaaagtctgttctgttatcactttttaaaaataaatctatcattctttctttaatcataatacaaaccatccagggacagtccaaatttttcagaaagaacaaatttttcagtacaggaggcagcatttgccagtacaacaagaaaccagaaaacaagaatctgtgttggatcatttaatttctacttggtgtacatactcaatgtaatgttttcacagttgtttgagagcaggattcatgtctgattggaacccagagctcctgtcatagggctttaagcacaataggcatttcataaatatttcagaaagtaaaggaagggaaggatagaaataggaaatgaactggttgtcaggtgcacatcttacatgatacatcactgtctttataaagcctcccgtatagtccactaaatagaatgaatttcccctgctcctgggctctcattcttttccttttcttcttttttcctatctctctgtatttttattgtgtataatttcaccctattaaattgtgagcgtcttcacactcttctcatcaccaccaagcccagaacctgcactagaagcagatctcaaaaaaggtctgctgcaaaatatgatagcatgtgcttagataccactgtggcctggttagatgtcacgttaatattgcctcttattgagactgtgctgaaaggtacaacgacctagagtttggtcagagttaggcctcactaatcacaacacacaccaaaatgtcccagacaaagaataataatagagtctaacgggagtggatggattcgtagttccacggaacttttgatgagaatgattataaagtttcatgctttcctacaagaagtcaaaagaatttgatcagttcagtggacaaaaaatcctttatacttctaactggtgttgacattttcatttttaacttggtatattcttagatgaacagagcattcatttgcctgtaaacattatttcctataggaacatatattactggaagttatcctgattttcaaaactcattggccacatctccaaaattactagtaacactgaacaagtcttggagagatttaaaaggcaaaccaaaactattctttcccaactgtgtgattactttacatagtctattcatgttagtgcttgttttataaatgtagaagcaccattcctgcttggttatttatttgtgttcagttctttaagatcatgttttctttccttttcttaccaccaaaagcccatctttctaacacaagtatctctactgttctctggactaatacaataataatcttttgcatattcttctgctcccattgttttcctgattggccccaatctatgccccaacgtgctgcccaattaaccttaataaaacacaagttgattatgtaactcccatgctaaaaaaaacctcagtggttcatgattaagtacgtactttataactaagtgcaaatgttctaccagcattcgacatctaccacaaatggaatgctgcctgagcccatttttccattctaatctttacctcttttctaccaatagcctaaattccagcattgtctggataaaactatccatatttcttactcagccagaaagttttcttatgatcacctacatgttgaatacttatctatccgttaagaatcatctcatcaagtcagtttttttttcctgattcctctaccacatatgaatactacttccattagaatatctgattctttgaatctctcttgtactgaatattctactgaaattggataaaagataatagaaagcactaacctccaagatatatttaatgaccagttcgatccattaattggagtggcaaaatgttataagcggggagtagatggagttagtgggaatttatgcaaacttatgtttaatcacatattgaaaggcctctttatttaatcacatcttgcaagttcttgtgtcagataattgtgtttgggaagggaacaaaaaaattccaaagattctgagttaagaccaatatgaagaacaacagatgacggacactcttaatatctctccttccctccctcccttcttctctttcttccttctttcttccttctctccttttgttctcctccctttctttccttctctcagctttgttcattatccatgcaaggagatgaaatgaccctgactattaagtctttgtcctggagaagcacaaaagcaaatcaagtgaggcagatgttctgctctgccctcccccttggcaaagacacaagggtccagcagtctagaagcagactgttctgaaaagaacagttggcactcatgctttttacttttcctccctcagagagacctcctgctaggtgagtcccaggctctaagaaatatcctaccttaaatcaagcggaggtaagaaggaacaggacaactgttttattttttccttttcctttttaatccttgcacccaccgttctcttaaaaaacaggtcgtgttctaagacgatggatatcaaaactgctcagttttcagatatgtgctgggtagtgatgagaaattagagcaaatgctgaaagcaataatatttcatctgtgattcaatcttacctgtgccattcatagcacacctgccttttattaaagttatatttatacttgtttttctctttttctttctatgcttctgccataggccaaccttgtaaaatctttatggaaaacaatgggccttaatcttctgtgtatcccttgtgcacctgcagaatgtcctatcataagagtgtataatagaaccctgtataattgaatttttctagattacattgttgttgttgaacttaatgaaaactttatagggcacaagcacatcccattttttccagtttaatatattctatcatattgtctacagggagcatacttgtatttatcagatcaggagtccaaatgtttggacttgcaaacccgtagaatgatggttcaccaccctggttgtgcattagaatctgtaccaccttttaaaacatatgtgcccagcccacgcatactagctgaactggattctctgggagtgaagttctagcatctatattttaattcatttatttgtttatattttgagacagagtctcctctgtaccctaggctggagtagagtggcacgatctcagctactgcaacctctgcctcccaggttcaagtgattctcgtgcctcagcctcccgagtagctgggattaggggcatgtaccaccacacctaactaatttttttttgtatttttagtagagaagggggtgtcactatgttggccaggctggtctcgaaatcctggcctcaagtgatccactagccttggcctcccaaagtgctgggattacaggcatgagccactgtgcccagcctagcatctatattttaaaaatcttcccagtgactcaaatgtttagccaaagttggagcaactttgctttgtagctctagagagcacaattcgaaaatcactagactagattatctttaaagttgtttcttttttttctcccagctctaggattctttgtgaaagtgcttttattttatagatgaaaaagaaatgatcctttggctgaattccatttttaagtagtaactacaaatgagatgcagtccaaattttatatatgcctgtggtgctttcagcatatcttattgcttagttttcatgtatgcccattcatcccgctgctcattcaatcaaacctccactgtgtgtgaggtatgtgaactatgcactatcaagtcattctaagaatgtgggctatgagcaaggcacacatatgaaggaaaaccctttttatccaaatacaatacaaacatcctctaatgatttttattctttgcagtccaattaaaataggaagccatgccatcaaactagcctaaattccaaccaccctacctccaaataaatctgtgattaaaacaagaagagaaacaaaaaaagaaagaattggaaagattaaaactccctccttggaagcaaattgaaactagtcttgattcttgatgcctttgtgttattttcagaattaaatcaggaacaacaaaactactacttctgagagagaaagatattgcttgtaatttttggcttaaggaattcattttcttgagaagaaagtattcttggtgaactctaagaatagaaaactatcaatttacaactaggacacatggatttctccaagagttaacataatgcctaacaaataagaggtacagtatccacactctattagttaaatgttaacatttgtatggtactttataagtcacagagaaccttaagagatatcttttaaggctcctaataattttgtaagtggcaaaacactgattttatggctgacccagactcattgattgatccagaccctgaatcagaaactctgggccagctcccaggagtcagaattgttggcaagcttctcaggtaattctgaaaaccaccatgataactcaattcaaatttattgatttgttttattgctcccaggaaaatgatccagtgagcagattctggcatttcctaagaagctagcggcctttttccaggatttgcctttttctttcttctgtacttcttaaaaggaaaaaaaaaaaaaaaatcacaggtggcaccattttacctaaatctacaagctatgtaattctgctctgcacagctggtttattcttacagtcagttgtccctgctctgaagaaagcctctagctgctggcactggtaggaggtttgaatcctacccactacccttctggccataactaaggtcctaacagcctgcagagaacacaggcttccttcagcagtcagctgtaattacacgaaatttgtaccggacattgtagtacaaacccagcaacctgctgggacatttcaggggctttagcatttagttgggaaccactagttctagctgtcatactcagggagagaattggtcatgagctatttgtgttggtatatatctctttccatcagttaaaaaaaaaaaaaaaaggtttaaacgtaaaagacacagtcttaggtagctatcccctgccctttaaattatattagaacagcataatagctactttggaaatgccatctcatatataacatgaaaaaaagacagtcaaacagacccctcaaaataaccttttgtagaataaaactacagattttaagggaggagacaatgttgttttaaccttgtaattactcctaatccacacagagactggagagaagagtattttgattttatgtctggaatgaaatacacttgactagaattgaagatgcaagggggaaaaaaccctcaaaattaaaggaaaaggaaagtgtgtgtgtcaaccaccccatcttgctgtttctcaaactttccaaattcttttggttcaccaccccaaccttagtaatgccctcgtgtgtaacaaccctccaactattctggttacagttgctgggaaatttgtctgtcaaaagacgagaggttccaaagagttgggcacttttcttctcaggcaatagaaaacagggttataagacacagacatgaaacacacacacacacacacacacacacacacacacacacacacgggagttcagcacaccatgatgtgctggctcttttggccttaaggaagcattgcaggaggaggaagggtggaaccctcagatcacctgacctaaatggcccctctggctctctcagaactttaccctctgtcctgatagcgcttcaaagcgaacgggatattgggaaaaggacacaggcagtttgccgtatccttgggcatccaaaagggtagaaaggctttatgccttttattccctgcctgctgagaagaaaaagcagacatcccgtttgagaccactaggtgccccctcctttccctgttttctgtcttatactctttaaaccttcaaataagtacacgtgttgctaggttcataattaaagcgttggcaatgcccgctcccttgctttcaatttcatttgtacaaatgttcccatcattctttttaaaagccctgggcatatgttcaaaacatacaaccaaaacaaataaactgcataacctaagccaaacccaccaacaactggaacatccttcctatttgggaagactactctaaaaagctacttaattgcagtatattctgtgaatgaaagttcacggagctgaaaaatggaagtatttatgttagcatctgatcactaaggaaatgtggggcatacacataggccctagaatcagctacttaagattcaatggagtaaattttaccttgagtaacatctttagaaaatgaaatatttaggaaggaacagagttcctgtgggaaattttatggtagagttagacttcagcagactttataatttgcatgtgctgaggaagagtttatatttagaaccaagttcttgatcttatccagtgactgacttttcatgacctttggaagtaactttgatagcaaaattcctctctgtcatttacccctaaagctgacatgatcatagcagtgggagctgctatgtaaaaggccatgataagagtgaaaactttaccaatgagaaagactccaacgtgtaggcaaaagacaaaatttatgacaaattgattttaccttggtacagcaataataataataataatagcttaacttaattcaaaatttcgtgtgacatttctccaaaacagaataaaaagaactgcccaaatccactgtttgaagcagaaaggaaatgaagatatttggctgtagccagtatgtaattcagattggcatcattgtactggggcaccactgagaagaaatgtgtcctctgcaagccagcagcctgtggaaaccagccgcaatgcaatcaatcaacattgagggccaaaagctattgcttccctttctctcatagaacaaacagctcaagacccctataaagtaggcttatagctccaacaaaaactgaaaagtttataacaagtggtaccacctgtgcttatgtctcagcgtagccaaaataatttcctctcctgggtctcctatggcaaagggtgaggaatgtgacagtgagaatgcaaagaggaagaggtgccaacaaggagcctgtagagtgagtggattatctttgtgctagcagagagatcagcaagtctgtctcctttactctggagcaactgtgtgtgatatgatctcccatcccctatcaaaaaggctctgtcttcagaaaaacaaaagacttctctgctcaatgttgttctctcacatgattgagtatttttttgttaacaatgttgtattattacaatcctgtgtaaaactgggaatatggagcttgtattaaaaacacaataaagaaaacagctttgtacaagctagtattttggccataattatacttttctctgtcttctcaatgaataagaaaattttgggccaggtatctgcacaaagcgtgatagaactaggataaaatagcacatcctctagcatgtagcctacatttatgtaaatctggttgatgtaaagtctgttctgttatcactttttaaaaataaatctatcattctttctttcttatctttaatcataataaaaaccatctagggacagtccaaatttttcagaaagaacaaatttttcagtacaggaggcggcatttgccagtacaacaagaaaccagccaagttgctttggaggagttaagcaagtacatttcaataaggacccaaacaatccctggcaaccaattagaaaaacaagtcatcattgcattaagaaagccctcaaatatgagtgctgtcggtggaaaatagagttactcaccaactgaaaatgtttacttgaagtgagaattattttatggaaaccactgtgagttttggaatacttacaatctgttcaaattggtcactgtgtacagtgttactgcagcgatatgccctgagacttctaatctgtctgcctaatggagcaggtggtgagactctccactgagctgtcggctcctggagggcagggactatgtcttattcatcttacatcttgcacagtacccagctcttcaaagacagtcaataaatattgaatgaaggaatctttatatacatggcctcacttcttgaccccttggcatgaaatatcactaccccttcatctctatcctattgccctgcttaatttttcttctgagtgattattaccagctgtcgtgttgtatgtggttgttttaattatttctttaatatcttctttttccccaatcagaatataagctccccaagggtagggattgaagaggattgatttcccgtatacccctagtttctaggatgatacctggcacataacaggtcaattataaatatgtgttaactttatttttttttaaccaagttccctaagagctagaaagttttgacttttgaatgagtgctaaataaatagttttctctatctcttttttaaatttccttttcactgtcatctatttcatcttaatgaaggctggaaattatactctgagctttaatcaatagtgacaaaaagagagtttctttattatgtaagtggttgattttaaagaatgaaagcattgggggactaggtctcgttggtgtcaggcacgtaggtctgcaaccctgcagagaaatatgagtgacaggaaatgaagagagggaggtaagacaccaaatagtctcctggaggccattgagggtagactccatactaactgacaggctgtcccatgtgaatagtaatggtgcatttgtgcaccattttctagactatgtgtgtgcacctggtcattaaaacataatacggagtctctatcatactggacagaacacttgtgtccttccagactttgaggggcaaaactacatctaaaagattaatacataacttttgaacttagggtaaaaatttaataaaacaatgtaacacttgtttgccttgggcatttctacattgtccctatatgtgaatgaataacaattcccagccattatgaatagtttcattttactacccacatttaacggtaatgaaactgatggcccatggttcagtgacttgcccataacttgcatggtgactctgccaaatatgcacccttcaactgtaaactcagattttatttttcttttcaaaccaagatagaccaggacattctttgttcctcgtagatgttcatcaagtgtgactacagttgaacggactgttttttttgcaatttcccaacgtgggtatcaccaaatgaacctgggagagacaggaaagtggcctagttgcagagtctaattctgggaaaaacaaatgactgggaaaggtctgtcattggccttcccaatattgttccttctcttcactctgcacctcccctgagcatctcatactcttcaccctcatctcaatccccttggtgcctctggccagccaagtacttggttaccttgttctcctaatgactcttatctcttccctaatttatcataatggaaattgcattggagttgagagaacataatccctaattctgttaatagctgcatgtcatggaatgagctgttaaaacctccagagtcctgtttctttatctgcaaaagagagataattatatttgtttcatactgtgattgtgcagagcatggcaaatcacttacttgaaaccaccatgcggagcctggctcctaggaaatgtttgataaatgtgtgagacaatgtctagatatttattctgacctaagttggtggttccaatgaaactttcaagacagaaaaatgaagaacatttttctggtggatgcagaggagattcactcaggtggagcaagggaggcatagaagagaagtcaaaaatatagggctgtgctcatcagtggtagagtcttcaacctgcacaaccatacatggatgcattaaagagagtcacccatttataaaatggagataaaactaatccccctttaaagttttggggatgattaaatgaaagagtagactgacaatcactgatgtgttaaagttaattatgataaataacataattgcttatcactgtagctctttctcatggtgatgagaaagctctctggaagttctaggacaggcgtggtagcccatgcctataatttcagcacttcgggaggccgaggtaggaggatcccgtgagcccaggagttcgagagcctgggcaacagaatgagactgatctctacaaaaataattttttttttaattagccagacatagtggcacattcctgtagtcccagctacaaaccaggaaattctagtataatcacaatacacttaactcaagactagcagaataacattaggaattctttgtttggttcctttgtgcttcagttcatccgatacctaagaaattacaactatttataaccttatttcaagcataaggtaaacatctcaatgagtatttacaaaagaatatagcagaaacaggaagttgacagttataagataagcagatttagttgtatggatgctcttgtatattattatgctcaataataagcatcacctcatgtccttagataatgctaaacatctacaatgtataatatttcatgattttagagtggttagaggaacaagctttagacttagtaagagtgggctgaaatcctggctcagctacttaactgagtagctttgtgcatatgccttaacttctctgagccctgctttcctcatgaaggaggaaaaacagatccacttcttccagttgttttgtgacatggaaagatggaaaaacacacacacaaacattctttatgatgccgagacactgaattcaccaatcctgtagccctatgcctggaattcttacaacatagtgtctttattaagtaacattttgttggatttttctcttacttagaccttatcatatcctaactgataaatctctgcttttcaacacatcagtaaatgagcatataattaagataatagagcatagaattggcctgattttgtgtttccaccagttttgttctaatattctgtaccaggttaatccaaaccaagagagcctatctgagtatgtgtgtgtgtgttgttgttgttgttgtttaaacagctcatgagacatagctgtaaaaatttactcagactgttttttttaaatactacacttggggtatatattaggaatagtcatcaaaccaaataagctgatgaaaagcctataatatactaaatgccagtttacctttccttttaaacactggaaatagaccaggaatgtgattttctgtgggaaaaaatgtcatgagttctgaaaactccacatgcctataaacctcctttgtaatgctcatgcactatagtattccagggtaatcactttactacagtatcctcagaagaatttggagcttcgtcatttcctggttaaaggtttcattatttgctcctggcagaaatctattcaagaagaattcataggttcgtaagtctaagttaatatactctgatcatttaaatctaggaaatttaattgcaaaataactcagaacatttaatgttctttatgactgcagtaaaactttaccaagtgaccaggtaccctttgcaaataagaacttgttttccatatttgaattaaaaatgcaagtaagtttgcaaatgtctttaaaagttacacagttcaagaccatggtctgatattagggaaagtaaattgtgtttcaaatgtgtcctttaaaatgtatcctccttggccctttcctttaccaccctgtttttcttttttctttttctttatttttttttgagaggaagtctctctctgtccccaggctggactgcagtggcgcgatctcagctcacagcaacctctgccccccgggttcaagtgcttctcctgcctcagcctcccgagtagctgggactatggacaagtgccaccatgtccagataatttttgtatttttagtagagatggggtttcgctatgttggccaggatggtctccatctcctgacctcgtgatccaccagtctcagcctcccaaaatgctgggattaaaggcgtgaaccaccgcgcccagcctgttttacgttttaaatcatttgtatgagccaaattagaagaagaaacgtaatctgggctttattccaaaaactccaacatgaataacccagggtaatgtctatgtcaaattaatagtttattaaacgttgtttaatctacctgaataggtaaacaccttatttttacctgtgtttagaattttatgagacaccaatatctaggggacttttatagtgacagtttactttcataccgtgaaggaattcagagcaataataaattaacttattaaaaataaatagattctaatattttagtgagcatattatctttttgttattttggtcttttgatgtttcttattttctggcaataggtcaacttataaaagttcatatttgcttctatttacaaaatgatagaagtttatcaggaaaaaaatgcaaaagaactttcagatctccattaaacttgacacatttttcagcaacattttctaagaatgataaccttcagtgacattttacactcataaatgagacaggccaatagacaaagttaccagagtcatgattttgtcctttacccttttcccatttaaacactataaacaagtgtctgaggctcttctcagacaatccaattctccctttcttaaacatgaagcccatgaaggatgctgggtagaaatcgaggtgtctatgggcataactctaggaaagtgttgctcatgacccacttgaaatagcatggaaagaaagagggttgactctttccttggctgttgacaatcctagtcttaaggaggttgtcattctaccctcaagtatacactttatataattgagtttgaagataaagtgctttacagcccttagaagtggtttgtattaatcctctggaagataatagtttacattgccagatattacttatttctcaggaagtcatttgaaggaactgtatgaaacactgtgtcttagtgttcccaggagcttgatcattcgtaggagattggaaagcaggggaattggtccacaacatgtccttctgtgtaattcttcattccgggcacagacaatacttggagggaaataaaatgactactgtacccattgtgctctcagctgcctctgtaactagccagacaaattaaagagacagaaccagtaagtggggctaaggtgggggatggtggggaacaaaaatggaagaataaaagtaagtaagaaggggtggcatatgcttaaggagaaaagagaagtgctctgttgattattatcaacagaagtgctctgattcttctttctttcttttcttttttttttgttttcttttgagacagagtctcactgtgtagactagcctcgagtgcagcagtgtgatcaatagctcatcgtggtctcaaacttccaggctcaagcagtcctcccacctcagcctcctgagtagctggaattacaggcacatgctaccatgcccagataacttgttttttatttttatttttagaagagacgaggtcttgccctgctggtcttgaatgcctggactcaagcaattctcccaccttggcctcccaaagttattgggaagggattacagcataagttatcacacccagcctctgctgatttaattatctgtgctttataatcccttttggggtgcatagcataagaaagaatggccatagctataccctggtgactctggttagatgtcagtcctacacctcacccaagctacagttggttgcatttctgtgttcaccaggctttcctggtcagtaacatgaacttttactctgttgatactgtggaacacttattttactctgggtgagaatggaatagtaggcctaagttacacgcattcacacttcctttaaacagtacacctttctgtattccagagagaggcctgggtccccaagtatctataggcgtatgttgtcttttcttgggcccagcatgagctcaggaaaataagatctgttagctgagagatgggtgatcgagacactgatgggaaatctccttcaaagctatttcattgttcctgttatcctggtttcacagaaaataaatgtgctgagcattagtggagagggtcagtaatgagtactgaccatacaatgtgattgggcccaataggcttggctctgcattcattttttcattcattcattcatacttttctccatgtatttactcaaatgtccactgagcttggtaggcactgcaaaacactagaagcacaatgatgagaaaacaaagacacagtcagatcgctggcccattatcatggagctcattggccagtggcagtgagtcctggttgttattttagtattggaggtccctttatgattaatgtctactccctatcccaattgtgaattatagatttatcaaaatatcttaaacgttttggagggaagaatactatttaattttaatgatttgaaacagaatcctggatcttagcgttcctgctaactgctttccatttggcataacaatcttgcattgggaaagctcattagggtttgcctcaactttactcatagaaacacaaacggagagaggctggaccaaatctggaagccaagtgtccagtcatccatttcctgagactgctctaagcaccccacacgtgtttctaggtacactaaaatgtgtaaggagagaagagtgatccttccagttcacagaaaaggagcaacctcttggcagaaagtgagcctttttcgtctccctccctgactccttaagtcagagttttcaatttaaacatttcaaccatctacttgttaccctgtttacagaaaaacatacatcctatgtttgctgtggggtctgaaatgtagcctttcaaataacagctcagggattcctgggtgaaaagtagctaaaccataagaaacaaaggtggcatttttttctcagtcatagccctgagaaaacccacaatatattctgccagttatttacctagtgatatttgatataagctgggagggtagccatgtttataatcactgaataaacagcatataaatggcaactgtctgagagataagaagggattgtaaatcctctctcaagttggtttttctgaggaaggcttcaatgctaggtctggcgcatcctcccttagtgttacctgtggatatctacaggcacttgcttctaccttttctctttctttcacgaagatgatgatgaagcacagcatacgatcaactcctccttactgattttaacgccattatttttattgagtaaaattctaaatgttcagagctaactattactgtttaatctgagggtgcctattgggagtaatgaaataacattacattactgcaaagacaagcaaacaagcaaatagaccaggtatactgcaccttttttttccctttgccaactcatgctgttattcctcatcttagagcatgagcaagaagcgattattcatatgtataacaacacatttatccaagcacaaataaatagaattaaaatattttaatgtagttggtttcatttgcctataatattatctctatggtgttttcttttttatttcttgagacagtgtctgactctgtcatccaggctggagtgcagtggtgcaatcttggctcacagcagcctcaacttcctgggctcaagccatcctcccacatgcacactaccatgcccggcttattaaaaatatatgtatatattttttgtagagacagggtttcgccatgttcctcaagctggtgtcgaactcctgaggtgaagtaatccacccacctcggcctcccaaagtgctagaattataggtgtgagccaccgtacctggcctcaaaggtaatttctgatatgcagcagggatttttaattcttcatttcttctgtcatttatacattctgcctataatatttattaagcacttactgtattccaggcactgtggatacaatgggaaagaaatcaaatgtatttgttccctgatctcacagaactaacagtctagtgacagatattattcctaaaaagttgtatatcagtcaaatctttataaattcccattaataaccaataggaaaacttagtcttaaaagaagttttccatgaatatttttgtaaggaactcacttctaatatatccatttggttaggtcagacatattaggctttattcaagttacgtacatttttcctctcaaacatgagaatatcttccttttacaagatttctgtaaataattacaatgtagtatacagttagttctttctgtaatggaaggggtttactatacatcacaatgtactgatatatttacagtggtataagtttaagtaaaagacaggcatacagacaactaaccataattcaacgtacgtgtttttctaaaagtgtggaagcatagtatagtggaaagagtgagaggtggggccattggagacagagtttttaaaagcttttaagacctgcattttaaggacaaacagaattgaccagagaatggaagaagcagcggagaaaaagaatgacagtcacagagatctaaaaactcatccagccatagttttctctgtagcagttttgtcattcctctaatggagagagatcctcagttacctttctagacattcttctggattcttaatgagcttcttcctgtcttcttactcggaggaaagaaaggagaaggaaggtgccatttagctttctcaccaagaaccatgttttttcctgctgggtgggattgggctgactgttgtcaaacaggctggtagaaaaataagtggagaagagaagagctctggagtcctgaggatcatgtctcagaagtcaaccagagagcagataaaagcagtctggaaaaagtgtgttagagcaagaaccaacaaggtcttctcttttttcctttttccctttatagcatctagaagaatgaacacccaaagaaatactgtcgactcattgactaaaaacagagtggtgttcctttcatttcatttctcctggattagatttatttttatattgatcttatagtatctcactttaaacttacagctttggaaaggatcttaaaaatggtccaatccaatcttcttgttttacagattgcaaaattacagatccaagcggtgaagtaatttgttgtagaccacagttttgtaggcagggaaagctgagaccagaagccaggtcttctgatcctcacaaaagtagagaaatagatgagaaaatgtgtgaaaagtacctagcagagaaccagaatctttataggttcagaacctttatagctactcacatttgtagcatctttctcctcctatggccaacagaaaccaaactgagggactgtgattaagatattttagagggccatgtgtggtggctcatgcctgtaatcccagcactttgggaggctgaggtgggtggatcatttgagtccaggagtttgagaccagcctggccgacatagtgaaaccccgcctctactaaaaatataaaaattagccgagcatggtggtgggtgcctgcagtctcaactactcaggatgctgaggcaggagaatcaggtgaagccaggaggtgtaggttgccgtaagccgagatcacaccactacactccagcctgggtgacggagcaaggctctgtctcaaaaaaaaaaaaggtattttagagcatgacttctgaagtcaatctaaagtaataggcgctattaatggaagatacatgtgaaaattggtcaaaatcatacatgcacacttgcacatacattgcatacccacacatacttttttccccccacagtgaatactggtctgctgtttgaaattcctgtcaaatgccttaataataccaattatattaataatcagtaccactaattgagcatctactatgtgtcaggtattgtgccaattggattacacatattaattctaattccacaacaatcttgcagagcactgcacaaatgataataccaatggccatggtggttaaataatgttaaccatgggctaacaactatgatagcaactatcgtaagggtctagatgaaagctatagaatattttcaactcctagatttgttctgtgtggagtaagtagagagaggtgatttctttcttaaaatccttctcagcacaaatgcctagacacttaagccagcagctgttctccttagacattcattggccagtgttgttagacttaatcagtcaggaccataaacttgggtaatttgaaaattgaacaaagggcacagatgacaatttcttccaaacacacacctgctgggaactatgagtaactatccctaaggtcagacttaattggatttagatctaaatgcactctgacatgttgattattcactgcttgaaagtggaaggaagaaaaatgctgaggtgagaggtcaggagtgtaagctttcctctttctcccctgtgcttctgaagagaccccgttgaggactttcttttatacaggtcttgtattttcatttttcaaatcacttgcaccacctgaatgctttggtcctaatcccattcccaacccagatctaacagagtggacctctgtatcccttctggagccggtccagtaatggatattagagcctaccaaaggcagagcaaaatatctggggatatacattcaagaatcttcacaattattttctcccacagaattttaagaaagtgaagagagacactattagaaatgataagagtattgggacgaatgggagtgaatgaattttcatgggcaagctttatgttgcctcatttattttccataattcttattcccattttatcacaagtaaaattcttatccccattttaccaaaggagtaattgaggttcgggaatatgaaagcagtcatttaatgtcatgctgcagtaaacgcagtacttattcaaaacctagctccatctgattccttcagccagcactgagagaatggctatactgagactgtcatggcaggttaaacattggatgagacctattagggcaaactgggagaaggtgagtcctgagttgcaagacagagaaggaaaaggatgatgctcgattgcctgttgctgtttagtctaacttctgagactgcaggcattgggaagcctggaagcaggagtacaacttggttgaagtggaaggcacaggaaaatgagtaacccagaaggtagaataaggtgaagagaaaaatctaaataattcaagagaatgttctttgagtttggagctggactaagtgatgagactagacatggctggtggaggcctcaacatagcagaagagcaaccagggaaccaaaaggcactatggagccagagagtgggagggagcagactagactagctattccgaaagtttctgttctggaaaggaaatatagctagttgacttctgaaagatagtaagcaatgtttctgcagtaggcaaattgaaatccacaatagaaaggtgagtttgtagcaaagagaagggctacattttgatgtttactggactgatttgccataactcacctgtagttttctattctttgtttatgaaccattcattcatttcacaagtatctgtggagggcccactatgtgttgggcttgctgtgggcactggaggttacatactgcacatctggattatagaaatatatcaagtctccatggtaggaaacaaaaagttatctcctggattccagtgaggatgatgtaaagctcatgaccatcagtgagggggaatacaacgtagaaatttagtgcttttgagaatgggatggaatcaattagcatgactatgatagtgcaagtgaagtgctgattgtgttgaataaaatagaaacagacaagcctgtgctctgagaggaaacagaataggaaatgtgaatgagattgataatgatgataatagttcccatttggagaccctactcttcttggctgtgctaggtcctttacttattcaccattctgcagtaaaactctgcgaggaagttattattaccctcattttatagatgaggattagggtgaccaatcatccattttcctgggactaaggggtttctcagggcatgggatgtttagggataaaactgggagagtccctggcaaactaagatgattggttaccatagaagaaattaaggctcacaatgccacaagtaaaggacagaatctgaactcatgttcaagattttctgatgccaatacatgtgtctttccattataccacacagcctctttttttttttttttttttttttctgagaccaagtctcgctcttgtcacccaggctggagtgcaatggtgggatctcggctcactgaaacctctgccttccaggttcaagcaattctcatgcctcagcttccctagtagctgggattatgggtgcctgccaccacacccggttaatttttgtatttttagtagagatggggtttcaccatattggccaggctggtcttgaactcctgatctcaggcgaaccacccaccttggtctcccaatgtgctgggattatcagcgtgacccaccgtgcccggcctgcctctgtctttagaaaacctgaatgtacccatgtcagatcaaatgctttctataattatgaacatagagaacattttatttctagagccaaattatttccacgcgcttaattgtgttaagtttttcactgccacattcttaacaacttgcatccatatacgacctagcagatttttgatgaattgcatccttcaacagaagaaaaatatttactatgacacacctttatggtttttagtaatttggttataatcccaaaggtgattggtaggaaagaactcaaaaagagatttgtgtctacaagacaccaacatctggaagaaaacgaaatgaaaaacttaagtccagctgatttgttcataagccagacatattgatatttggggacatctggagggctgattgaaatttttgattttcatacagatgttcagtgtcatatagacacagggataactacacatgaaaagatatgcttaatggtatttcactaactatgtaattgccatagttatgaaagggaaccctttcataatgctaatgtctgtgcacagcatggagactcaccttattggcctatgctgttatataaattatattttatagcatatggttattatgttccaggacatagattttgacccagatagccatgtcatgatatagatgttatggattttgaaattaattaccttatagctctttttgttttaagttctagttggttaaatgcagttaggaagaatggggacatttacttgatttctcgagttttcttaaataacaaacatttaaaatgcatggtttaaataattcaagttttaaaatgatgtcacattctaactaaatatagtcctagggctgaattttttctgcagtcagcaccccctaccccttgactgttgtgtgaagcagctgcattatctacattttgccaagtaaacaaactctgcaccgtgcaatagtgtttgttgtttgctaatgtgctggtggttaaaaaatgcttaaaaactctaattatacatttccatataatacagaggcgttgtcaggccatgcttcattcctggaagatatacacacacaaactgcatttctattttgttcggttcatggtagataccgaataaatattttgtaaatgactaaaaaataatatgaagcttaactgattacttcctaggcactggacattgggctaagcatttaaagcatatggcattactcaatccacaaaatcatcttctgaagtgactttcttatccccattttacatgtgagttaactgaggtacagaaatattcagtaagtgacttgcccaaggccacatcatctagtacatataaggcaaaagtggcttttgaacccaggtttgtcagactccataacgcatgctattaaccattattttctgctgcctcttcttaaagtgagtatctcacggcagagacctaggtggttgagacccccaagactggtttaaggccactgtcaaacacagacatgcacagatcattttattcctatttcattaaaaaccatcgtggcagtgagatgctggctcctgcacatagatggaagaagtaacaatttttatacaaaccccacttgtacagatccaaaatgattcagtcactgggtgagcaaaagttgttttaagccaaatgacacctgtaaagggaagttatgtcaccactctttccttttaaatctgaacttcttacttactggcctggtctgttgcaaacatcaatgtgtcataaaaaatacgttgccctataaatcacatctctcctgtaggagattacaacatttttttattgcccatctaaagctcttgaagttttgtttcttcaaaacctatcctagttacaaagagatgagatttttacttcaaaggaagcagtaatgaaatctacacttgcagaacacaaaactacctctttaagagttttcaattgttgatatgtcactcagttttgcaattgccatttaaaactttagaatacacagaagtgtccaccttctatgattatttccccgccactttcagcaatgtatgcaaacacatcagcgctttgatgtcaagtcttatgtttcctcactggaacttacaggaagaaccatctcaattcttggaaaaccacagcttccagtgcatttaacatgaaacacattaggaaattcattatatatacccacaaacgtggggattttaaatcaaatagctgcgtttttcaatgtgaaaatttaaaaggaagaataattactctcactctttaacagaataatcaagtggtattagtttccttttgctttcgttaaagagtgctcatcactccatgacatacacaaaatgacaagcatacaatggaacttacaagtgagatcatcttacttctgaaaagtggaaaaacaacaaaacaagagtgctcatcaagtactatgtgaaagtctatgtttatgtaccaacatagtaataccgttcatttacatggctatttatagttttaaaagtgcttttacatttattatataattgggtgatataatctggatacttgaaagcataccagatataccttcacccaatggttttcttaccactaaattcaaggtagatatgcttttcaggcattgccttgactaaaaaggtaacatgaaataaactcctctagtcccatatagattttagacaaagaaaacaaaaagatgacaaacattgtctccctcgtgtgaaaccaaaattcataagaggggcttttatgaaaggtttcccaacagtaccagactacaacctaacaattcactcttccaagattaagtgcttcaccttgagggttatttttatggctgcttctaactgtggtgcttcaccttagccataaaatatcacctcagagggatgagctaatggtgtgtgtgaagatgtttctcctgggaaccgtcatgagtgagaaacacaatcagggaatagcatgttgcatgcaaagcatgtgacagaggagtggagagaacacagactttggagtccaactatcttgcatccaaaccaaggttattgtacttattaacttgaaggcccagagcagcttatgtaacaaccctgagctttattttccttatctgtataatggaggcagtaatatcctttccttataaggttattgggaagatgaactgtaatattgaatgtaaaatatttatttgttgctcaagatattaaataataaggatattcattgcccatctattattagacctgtgtccctcctattgcagttttccaggcagaaacccaagagggtataaaccaaggaattcattgcagggaaatgaagaggaggagaaagctttagtctaggatggcttcccagattctgacttgggcatctggatgattttgaagatgatatttactaaaaccagaaatacagagagatggtagaatgagagtgagaaagagaatgagagagagtagagagagaaagagagagaaattgcgtaatatgtatgtcttgttcacccctgaattctcagctcctagcaaagttcctggcacatagtaggcaatataatagatatgtgttaataaataaatgaataatgagcaaatcatacactgagatcacccagcctaattcagggcccatatatatttaaaattttttattttatttcagtaatgtttggggaacaggtggtttttggctacatggataagttcgttagtgatgattttggagactttggtgaactcatcacctgagcagtgtacactgtgctcaatgtgtagtcttttatccctgatcccccacccacccttcccccaagtccccaaagttcattgtatcattcttatgcctttgcatactcatagcttagctcctacttaaaagtgagaacataagatatttggtttcccattcctgagttacttcacttagaataatggtctctaactcaatccaggttgcgtgaatgtcattatttcatttgttttatggctgagtagtattccatggtgtatatataccacattttctttatccacttgttggttgataggcatttgggttggttccatatttttgcaattgcaaattgtgctgctataaacatgcatgtgcaagtgtctctttcatataatgactccttttcctctgggtagatacccagtagtgggattgctggatcaaatggtaattctgctttcagttatttaaggaacctccacactgttttccatagtggttgtactagtttgcattccctccagtagtgtaaaagtgttcccttttcacagtgcctatatttgaattagatatatgatcaaaataaatatatgtcagaatattctcatcaaaaatatataaatatctaacttggcatgtatgccctttatcaagggctacaataaaagacttgcatagcaattcaaatgaaatggattgagaatgaaaaatacagaagggtaacattacctagatacatcaggaaacagtttcttttccaggcttaatgtgctaggaagtaagagatactactgttttccatctcacatttctatctggatgtgtacaagtgtaagaaactattggcctcaggcaagaatcttgtcacctctcataaattcatagtgcttccccttgtctccgcctgaagacttgcaagtgacacagaaccattcaccagctagacttcatcttttgggtcaggactgaatcaatgtggttagaaaaagtgtatgttaaacaaaaggtagcctggacctttgcatggaaagatctttattttaatgtacttattagacagctattttcagattcccttaaatatatccattcctagaacaaattttcttcctattttgtggtatattttacttttctctcctttgagagagtcttgtcttccataccactgtaggcaagcagataatctatctgctatttatacagtacatctatttttccaaaagcattggtctctaggaagcaaggtgctattataattgcctattttcatttgttacttcatcatgaaagcaggctaaaaatgagggcgtgagaaggccacgttcagcagctgcctgtctcaaagaggaaatgggcaaaagaggccttttcagtcatagaccaggttcagctgccttttaggattactgatgaggtaagctttatcattttaaagtgtaagtaagtcatggggtttttgaagtgaattgtatcactttaaaaataaggatcaaggtctttggaaaatcaattagcccctgtatttgaacagatgggatacatacacctctctcagaacttctgtgctttgaattaatctaattttttttttttttgagactgagtctccctctgttacccaggctggagtgcagtggtgcgatctccactcactgcaagctccgcctcccgggttcaggccatcctcctgcctcagcctcccgagtagctgggactacaggcacccgccaccacgcctggctaatttttgtatttttagtagagacggagtttcaccgtgttagccaggatggtctcaatctcctgacctcgtgatccgcccgcctcggcctcccaaagtgctgggattacaggcgtgagacaccgtgcctggtcaatctaatttttttttttttttaaggtaagcgttctttaacatacgtggaaaagagtgatctttaaaaaacaatgctaatacattaaagagccatttgttatatgcacaagttagcagcgtacaatttgatacaaaattagcaactgataattctgaaaaacagcaatttcttcttactaggaaagccacacaatggcctgaattcttctccctgcaatggacgcagcgatggaggcaggatatactcatacacctgacatggcaaaattgggccaagtagtatgttaatggtgccctttgtcatgagtaaatgcattgaaaacatttattaggaattgccacagagttctaggaaccactggaagcaaaataaagtcattctgtgactgcttaaaatcaccttgggaatcccagcagtcgtggagttgggcagatttaggtgatctaaatcaacgtctatgtctcttgtataagacttaattttatctctgcttttctgagtgggctaaaaatccttgtgattatcttccccttcttaacgtccccttatgaatgcttgttttcttcttattcgttcacatactctcccctttctactccctcccttcctgcttttcttttctctgtgcttgaggtttgggagatgaaaggaaagaaacagaattccactccgggcttcttctgatcctctgctgaccccagccctaacagcatgggagagttcagtatgactaactcctccatccacgctgcttttcctcagcttgtgatggaaattttgttcagaccagtgtagaactccttggattctggcatatgacttctctagcagggagtaggccatttgtgccgatggatatggggagtcagtgcaggaggaaagaggacctttcttcatcatcacagactctgaaccactatgttagaactggaagggactccacagaaatccttgcccaatttatttattcatgccacaaacattttccaagaatctgtgttaagcactggggatgcagaaatataaatcctttagaatctctcttattatggataaatataataataatacaaagttgaatatatatatatgtgtgtgtatatatatgtgtgtatatatgtgtgtatatatgtgtgtatatatatgtgtgtatatatatgtgtatatatatgtgtgtatatatatgtgtatatatatgtgtgtatatatatgtgtatatatatgagtgtatatatatgtgtatatatatatgagtgtatatatatatatgtgtgcgtatatgtgtatatatatatatatgtatgtatatatatagacaaagttctacggaagctcagaagaaagaaccactagttccaaggttgagaggagggaagattttaccaagtagtggacatgcaaaggcccagagaaataaaagcacacagataattcactgaaggaaggaagtgtgagagtataggcatgaagtctatggaagtgaaataagataaagacaataaagtgagtcatgaaattaagatgtcattgataatcttgacgtccatgttggtggaatagttgaatccaactatagtgagacatcaggatatgagaagaaaaactaagttttctaagaagtttgatggtggataagagatgaacagtttagacatttaattaggatgctgagtaaaggaaaaaaatatatatgatagaagacatttgaagagttttgttttgttttgcaaataggaacggaccaagagagaaaaaaatctgatgggacaagagaggttaaaacagaagcatgttcctggagataataaggaaaagatgtgaacagattatcatttaatggattagcattgtattgggcagcagccacctttcattatcaggagacagaaagagataaaaatctgtgttgccacctgcaaaatacgaagggagagtagagaagggagctgagtgtggaaaacaaaaggcttgtagagaaacagaaagcgaagtgaccaagaaaggaccatgatgctcaagctcaacatttccagtaatcagagaaacaccatttcactctcagaaaattgacaaaacccaacaatccgcaagcaaacaaatagcaatctgacaatttcaagtgttggcaagtgtgtggagcagtgagagctcttatggctttttgctacacctgctttgagagcactttggcacaatgtggtaaagatgcaatcatacttccaggtatgcagtgggggacctcttatgcatgtgcacaaggaagatataacctaagtggccatcaataagatacacatttgaaaatgtggtatattaattgggccactcttcagaagttaaaatggactagggatgcatctatcaaagtggaaacacatttatgacacaatgttgagggaagaaaagctcgctgtagaatggtatgaatggtaaggaactatttatgaaaaattcaaatcccacagaacaattttatatatcattaatgaatacatctgcatatgtggaagtaaaaaaaaatagacaagaaaagatatacagctcaaacatattgtatctctcacattgtattttgtaaagcacacccgaagatacgcacacaatggaatatcaggcagcaataagaataaccaatctaggccaggtgcggtggctcatgcctgtaatcccagcacttttggaggccaaggcgggtggatcacctgaggtcaggagtttgagactagcctggctaatgtggtaaaaccctgtttctactaaaaatacaaaaaaatagccaggtgtggtaatgcgtgcctgtaatcccagctactcaggaggctgaggcaggattattgcttgaacctgggaggcagaggtttcagtgagccaacatcaccccactgcattctagcttgggcaacaagagtgagactccatctcaaaaaaaaaaaaaaaaaaaagtctgcaactgcatgcgactgtatggataaaccttgcaaatataaggttgggcaaatgaaaccagacactgacaaatacatattgcatgatttatataaaaacaaaagtccatgtatcctgataggagtcagaatgtgggggttggggggtgcttagaaactgtaagtgggtatagatgtggtcatacatgatgcttgtaatgtcctatatttttatctaatttttggttgcacaggtgttttcaacttatgaaaagtcattaaactgtacacttagtaaatatttagtaaactgaacgtatgctatattgcaacaaagtgtgtgaaaatgccatttgaaaaaggaaagtagttttggggtaaaacggcgtattaacatttatttactcttggttgatgggcttatagttgtttttatgatatgtccttgttgttaatttagaatatttcatcacaaaaaaggaacacaggaaccaacttaaattaagaattacaaatagtagatggcaccaatcaacagagagagagacaacacacaatttggagcccagagagcccaagagatctgcttgtggcaaaaccgaaaaaggaatcaagtctcttcacttctcactgcaatgcagtgctgtcttttgcatatatattgtcacaagctttatcttttcactttttactttggaaactgattcaacttctgcctttaagtcttgtgcagtactcttacactgtgttagtaactatattaattaccaattaaagaactttgcaaccctcctagcagctgtagatatttttaaacatggggatttgagctagttgaaagaatgacaatgtttccttttctgcttttcagactttccccaaagcctctatgagactattttataagatacaccaggataagatcaaagcccttccaagagggtctggcattctctatctttttggttgccaaaataaaaacataagtcaaattcaacactattaatggataatatgttcccactctctctgtccttttgaaaaagagactgagagttttactttggaaattcagtgatagtgagtttgattttaaatacaccaaagagttggaaactatcttttagataatagaactttcaaacagtgtggaagatttttcagggaagtccaacagacttcaactcactatgaataaataaaatcgagaataaaatgtcctttgtagcatgctttctcctctccccgatatgtgtgcaattcctgtgccctgcattcgctttttaatgctcagataatcccaggtttttaatccatgtcacttcagcatgtcacacttgattgcagaatttggggaagacaatgagtgctgctgaaatgtgagacactcctccagactttagtttactgtgtaaagacaggtaggaagagccttctagatttaactctcatatatcataaagctaaagcaacgagaaaactatacatttcacattaaagttgggcatttctcttcagagagaagttgagccgaatagcacttgttaattccgaggttcagcacactcctaggagcctgttaatatttgctgccccctgtagtttgctcttgtaaaaatccttaaaaaatcaagagagctatttaaaactccagttgctcttttaaatctgacacacttgtggaatttcatttcctatcttttttcagtccaactccacacatcagagtgttgacatggggcaagacaagggaatactactgtgagcagtagtgatttcatttaagtgaataaactgggggaaatgattgccttttaaacatgcagactatattgcacggagaaagcctgctcacataaatataattttctttaaaaaggcagaggaagcttctgttaattgaactactttctcaatttcctattgccttcagaattggttatggacatgatttccattgtctccaatcacaatagcttctaataacattaagcttaaaataatacagaagaacaggacagacttgtggtttgttcatttgctgaaactaatatagatggcagaaattttacccaagcttaaaatagcataaaatagcatatagaacacaaaagtcaacactggctcaatgatgaatgaaatttcattataaagaatcacaacctaacatctaattttagtaaaaattttggaactagttattgccacaaacaaatgctggggcagaagataataaaactgtttactttatcaatagattaatgaagaggagtaggtaattctgagataatatcatcccatagtctgtgtgacttgaatagtttcaggtttaatttcatgattcaattggcctgcatatacgtaactcccagaaagattatagatgagtgcaattaatttgtacagtgctaaagcttcccacaggcacataaaacattccctttagttcctttagagttaatattacagattcaggttatttttcatcagaaatgaatcccaaagttgataattccaatcaaattggtaaaaataaaagcatacctacagttgctttgagatcaagaaagagaactgtagattagttctaattttatataggtaactgaagtgaataaatgcctctttctaaaaagataaaaacaaattaaaggcttttgataggagaaactttaatatatctacaatactgtgaaatacatcaggataaattatgtttgctgatgatcattttcattatgaaactcttacaatatagccataatatttcattttgttgaggtagagacagaggccaaaatctatcaatcaaggaatatttattaaatgcctgtgggttccctgctgaagggaatatcgaacaagcgtaagttgtagacactcatctcaaggtacatgcagactgactcatagctaaatgagtgaaaagacaataagcataagagaagtttacaaagagatgtttttttttcgtagcatggtcagaaggtatggattgagctgggctggaatttagataagaagacagatgtgcaggttgaagggatcagaaagtgcttctgagggttgatacactaagtgaagctttgaggtaagctaccacatagtgatggtgtctggctaaaagcagacacagagaatgtgtggaagattttgaacctggacctagagagttttgatatccccagagagggccttcgccatgagctgtctgcaccagtaaaacaacacagacaaggatttcttagtgggacatacctccaggggaacccaggactcagtaccaacctgaacaatgctttcagggtaccctgatggaaagacctggccagaagtaaagagcctcctctgggaatctggtaaagacgttggcaacctgagatatggggggcacacagctggaaagaatgctgagttggataaacatttgattccttgtcactttcttactgtgtgaacttcaggattggcaccaaacttctctggcactccaactctttatttacagagtgaggattagtaacaccccatctgcctatatcatggaaccttagcgaaaagcaaatgagataatatggcaaaagtactttgtaaactgtaagatgctacataattaaagatttgcatcaacattcatgacacattttctctgattcattagctgaaatatggtcaccattaaccttcttccactcttccctattaattcatttccatttctcacttctctgccctagacactctctttcctgaaagtttcccctcctcatcccttgtcagtcttctcatgccctcaactcttatgtatgatttgtaggacattatccatttttactcatattctcttttatataaggatgtgtgcctctcagtggcattatcaactctgagagaaaatgaacttttttttttcttttaaaataactatctgagagccccaggaatctcctatacttggaagcaaagagttggggatagaggggaaggagaagaaaactgaaagtttggtgatggtggcagaggaaaacctaagtacaaactgaccccatcccaggtagcctgactgttctctcattctactcttggtgattatttatacaatgtaggtggcaatccagatttctattttatatggattgaattgaataactacaaaataataatgagttaataaaagtattgcattacattttacatatataaaatagcattcaaaaactaaattaaaatacagaggttgagtgagattttatattttctacatcaactactttaattgagtatctaatccataagacttggcacgaataagatctcaatgcaacttttttcaaacctcaggaaacagcttaatttttcccccactgatgacaaatattgttcaattattactaacactggtatgatgggacagaatttggaggaccatgcatatcagacagagaagtcatctgtgaaaggtcatattaagtaggggaaataaagtgatagattttattttttaacaagacatgtttgttttatatataaaaagactattttcatgtttcaatcaactcactgacaaaagcaaaaatataactaggaaggcaaataggcaataatggaacataagtggagtattttaataaaagtgacttcatgaaaatttgtcattttggattatctgcatcagtgatccacctatcaaatgtctcccttcataaatttctgtatcagataattttttctctcttaaagagagctgcagagctaacggagaaccaggcaagataaaaaaaagattgtttatctgctgggcagggcttataaagccatcttgcatttgctacagaggcctaatccaagagcaccgtaattatcatttctgaacctgggtccctcaactggcatttctcctttgacttacaacacctgaaaactaaaggtagcatgccctctttaacaaaagtgagttgaacataatggactctgtgttcccgtatttttaaaattgactgtgttctcaaacattaattcaagcagttgcacaattcaagggatgggattgtgtctccgcatttttgttgttcaactagagatcggcatatctcccagctatgagtatgcataaacagcaactgcaggtaatacttggatggtgtcagaaaggtctcaaagcagaaattttctggaaaagtgcactaaacagattgtttccatttttgctccccccatcctgcaagtggtagctgtttcatggcaaggagcagttgtgggaaggttgttgagggtggttttaaaggaaacagcctgtgtttagactggagtagttgcctggaacccacaaaagtgaacgtttctcctttcacttgcatttgcaatgtgtcacaatggggattgctaaatttcgcccagatgctagtatatgcatgttttaggtatccttgtgggtgagtgcttggcagtcggcatgttgcctttgagagtagagtaaaatgagagaagttcatccggttaaaatctagacattcaaagagcaacaagtatttgttaaagtttttagaatgggagcagataaacgatttggaaacatgaatctttgtggaaaaacaaatccaaattattccaaacatgcttgaacacatcttctttttgagatcatttttctttcttaaattttttactaaaatctttggtcagtgtagatgtgtatcaaaactgcattgtcaagctgagtaatggactattctattcaacgactgttggtcatttttaaggccgtgagcggacttatatgacatactatataaataatttgttaaaatgatatttcataaaataattaggttcaaaggtattaccttggtgaaaaagcaccattagaaagtaatacaaatatcccttttaatgtatcaaaatgtatgtttaaaggaggcaacaggttatcataccattaaaatatttgtgcacaggaatgaagatattgacatttaaagaacatgatggcaaaataatgttttggattttgctagagttttcaagagttttaattgctcatctaaaaactgtaataaaatggcacaatcataaacaataaagaacaaacccaaattttgtattgtaaatggagtgaatggtccaaactgttcattttcagaactacactattattaattttaaaataatcagtccttgggtcaggtcactgtttgcccagaatttgaccctgcatggtggtgctccaccaattttccttttggattacattgatatatttaagtaggttggggatggtcatgatgctgtagtaatgatagtatagcagtatgagtgacataaggtctttctgtagaatcttcaaaatgctgagaaagacagtcttgtttgtagtgaataaaccaaattagcactgaacacacattaaatgtgggggaaaatggtcccaaagaatttaggattgcagttgtaaaacaaatgcttggtttagcataagatttcagcaatgctttttagtaggcatattgatataatatttttggctttgaaagccaaaactgacagctttatagaattccatccaactttaattttcatttttcaaaagtaataaatgtcttgctgacctaagtacaggtaagtacatgatgatagcattgatatcagtaggctttatcagattggaaaaggggatatagaaaaaaggaggaaaaggacagtatcaggacacatgcaagaagggcatttgaacagttactaagaaagggcaaaacacaaggaacagaaaaaggagaagccaaagagttttcagtgagcttcatgggttcattggagctcaacagctctgcacatatcctgcagtgtataccacgacacaaatctaacatttgcatcttctgtactctgattgtttctgatgggtaagagtctgagctcagaaagccacctaaactggctgggaaaagttccagaagagaaagaaacaagccaatggcaaaattccctttcctcaattatgacagtgaactatttccatcaatatgaatgactagtcataaatattaatgataatggtaaaaatgatacatttgtagagcactgttaattttgcacatgtgtttacatctattgcctcacaacagcagcatgcgataagtagggcaacacttcttatctccatttcacagatgaaaaacaaatgcaaaatgctccatgaagtttaagtaacttatccaagctctcagcagtaaagtagtgacagagcagaggctggaacgtaggtctcctgattgccagcacttagctgttccccttctttctctggctactcccaattaattagccatgctagtgtatcctaaatcagaaaataaattacttgaaatgagtgtaattgcatcacattattcattgtttcagatgagcatattctctttctagatctcattgctgtccttggtctgactttataatttccttttgttctctaacaaaaatagtcatactaatgattttcatacatataagatgatgaaatccttctctgaaattccagacacaggcataggaacaagtaccagctctctggctttgtgtcaacaattctggataaatctattaaattctctgaatcttaattttcttacttgaaaaataagggattcagatagagtgttccagtcagcctttttctacacaattgcacatacacacacagatatcccatatgcataatctctattcagttatttatgagtctattactgtattatcatatactatgcacatattgacataatattaatctcatttaggcttccaccagagtttctaggtatatgtgtgtttatgacactgtcatgtgacagaaactgttgctactcaaagtgttgttggtagaacagcaacttcactgtgaccttagagatgattagcaatgcacacctcatgacccaacccagatttattcaactggaattggcatttttcttttcttttctttctttttctttttttttttttttgagactgagtcttactctgttgcccaggctggagtgcagaggtgtgatcttggctaactgtaacctccgcctcctgggttcaagtgattctcctgcctcagcctgccaagtagctaggactacaggcaatgtgccaccacacctggctaattttttgtatttttagtagagacagggtttcatcatgttggccaggctggtgttgaattcctcatctcaagtgattcacctccctcagcctcccaaagtgctgggattacaggcatgagccaccacgcccagcctggaatctgcatttttaacaagatgtttgatgatttgtatatactttaaagtttaagaaacagcaccatagatcataagcttgtaggaaaaaagaaaaataagccttggcaaatctgtccaacacatggtatacggtggttaaaaaatctatttgaattttcaaaatgccatttgaaatctttacaatttcagtcttcaaaatcatcattcgaaggtaatcataatttctatttctgttaagatttttcagaaggttaatagtagtaatgaagggcttaggtgctttattgtttgttttgttgtttagtgaaggcttcacaagtttttgggaagtaaggaaaatgaatttagaatgaagataaaaatcttattttgttcaaattatcttgaataatgaaacatcaaatagtgaaaatctcaccacgtttaggaatccaaatctgttgtgaaacttgcttaaggccacgtaataaataagtggcttagggatctatcttattctttttttttttaattcaaattttattttagattcacaggtacatgtggacgtttgttacctgggcatactgcatgacgccgaggcttgggatatgaatcatctcatctcccaggtactgagcatagtactcgactattagtttttcagcctagccacatgctattacactaagcaactgactgactcaggaacatattcaaagaaaaggtccatgattggtagaaaaagtgtgaagccaacttttagtcatccattagcatcattatcctgtctttaaagtattaccattcctgctaatgtttatttttccaggttgtatgtcctcctggaggaggtatgcatttggattaaatcaatcactttcaaaagcttcaaatcagtaggtttgacaaaaattttcaacaacaaggatgaatgttgttgcactgtaagtaacaattttgacatgaagtatccccaaactattttgtaaacctccttaaaataaaaacgaataaaaatatttcaatgctacatattaatgaattatagtaagtaattatcttctgtgggctttagtttccttatcagtaaaactaacaaactgttctgattctctacctttaaaaaattatgggaaatttgattactatttaaaagactactctgtaaagcaatatcctacaagtgaattgcataaagttcatggtaataatggttgacttaaatattgttttatgttccacatatttacatatttatatccctccaatttattttgaaaaatggctcaaggcagtgtctcatagtagatttgtaaagcaagaagtctaaacgtgttcacttacatgtggaatatattatgatattatgattcgattatttattttttcaacttcttattctgaaaaatttcaaatttacaaaaaagttgcaataatgctacagtgaacactgacattctcttcaccaattgtgaataatttgcaacaaatggtttattgctatttattttctttctttcctaaaacatttgtgagttagttttagtcatcgtggcactttacctttaagtaatttagcatttatctcctaagaactactaggacattctttcgtataaccacaataaagttttagaactcagtaaatttaagattgatatgatgctcttatgtaatatatatccatattcaaatttcctgtaaaaattgtatagctgcttatttctcaaacttggatccaatcaaaagtcacacattaggccagatgcagtggctcatgcctttaattcaagcattttgagagactgaggtgggcagatcacctaaggtcaggagttcgagaccagcctggccaacacagtaaaaccctgtctctactaaaaacacaaaaattagccagctatggtggcgcatgcctgtagtcccagctactctggaggctgaggcatgggaatcgcttgaacccgggaggcaaaagttgcagtgagctgagatcacaccactgcactccagcctgggtagcagagggagactcttaaaaaaaaaaaaaaaaagctacacattacatttagttggtcatgttaaatattatttgcaaaacacataatcgtatattactgtggtctgtagatatttttctaaaataacaaatgtacttgggaaaatcttatatttgattgtacactcataatgcatgttttcatataattgaggtaaaaatcaactcaactaaatttcatgtttctgatatataaaaacacacacacatttttccactgaaatgagcatgtttggacatttttggtttgcatacacattaaaattggccgaagatgtaaacttgaaacttggcaagattgtaagaaaataaggccagagttagaagaaaaacacttcaagatttaaatgacacaaatgattagaattatgagtatacaaaaatgaaagagaacattgtctacctttaaggtcattctcaccagtcatctctgattgggtggctaaaagtcaagatgaagctaaaggatttatgtaacatgcaaatcaatccaatgtttatgtttcagaaaaatcaagcagttccaaagtaaagcattctgtgatgattttaatttggccatggtttgcatttctgttcctgttttcatagatatgtataaacttggcctttcccttggccttcttcccgtaggctctcagtggttgccctcggaagtgctattttctttctgtgtacattatggccctccagatgcactgcacttcctttgaatgtgcaaaaaagatgaggactataagcacacatcagaggataaagaattagccagccggacgtcgtggctcacatctgtaatcccaatacattgggaggttgaggcgggcggattacctgaggtcaggcattcaagaccagcctggccaatgtggtgaaaccccttctctactaaaaatacaaaaattagttgggcatggtggcgagtgcctgtaatctcaactactcaagaggctgagtcaggagaatcacttgaaccagggagaccgaggttgcagtgagccggaatcacgccactgcattccagcctgggagacagagtgagactccctcgcaaaaaaaaaaaaaaaaatggagagagagaaaagaattagcctacccttcttccattgtaggctagcttggaataatttgtcttgacacaggatatttcccaatccaacgagtttattcacaatgatcctaaggaaacaaatcatgtctgtgttgctaacttatactacacattaccaaatgcaaaaataaatatcaccatagaccagcttcatttggaatgccaaagtttaagttttccaagtttagtcttaagtgagcatagtttagctttacatttcattttcatatgtgtagataaatctgtacgtccaaagctcagagagacacatggcaaatatttcttgaatgcaatgaatgcaacacaaacataatgaattaaatatttgtaaggacctatgccctgagtttggaaattttcctgactagatgataattttatccttttgagtgccattaaaacaaacatctttttttcctccttatagtcatggtttatagaagtttaaaagtttgatagcaaggagctaagcactgtttttttaagcacttgtttgagcaaattaactctaccttgttccaaattcttttacaattagtttgagtgacttaagaagagagtgcactgtagatagattctgactttgtcatttttcatcagtgtaactttggggaagttactttgtcttgatatagttcagttttctcacctgtaaaacagaaattaattatctacctcaagaggtgatcaaagaagtaaatgagataatgctatgatacactgacgtactacattgtaagaaatatttaaaaattaagacatcatcctatacaaaaatgtaaaaagtaaccacttgcaaaggatttacttgtaaaaagtgctgaaattccactaatagtgggaatctgtggcattaatgcctggggttcctcccatttgtccctgctcccttccaccttcctctgcttgtcactaagacaattctattatgttggggagctctcccaacagcagctctcttagcctaaattgtggtcttttcggcagactatatgactatccagacgtttaacagggagatccgaaaaatgagagcaccatggaaggtcttgctaaactctacacatccccggctgactgcaagctcacacaaaggcagaggagacttgagagggcccaaactttccatccatcactgattgcctggaaagctgtgcatatgcaaggggaacctggaagggcccagtggaaagtaaaagttaggacagaattgaaaactgccgaaattttgcatatgtttctcaacccacatatgtatctatcagcagatgacatcatcaggcatgctagcaactgcatactacaatagagatagattctgcaaattaaatccaggaaaaatacttataaacacaccaaataaacaacaaaaaataatagaaacaattatagctctcaggaaaaaaaaatccaatccagagctgccacaatatgttatctaaaatgtgaatttgtcaacataaaattagggataggcaaagaaacaagacaatatgaattctattcaggaaaaatagctatcattataaacatgttcaaggaataaaatagtatttaaagaaacggagaaattagctaggcatggtggtggtcacctgtaatcccagctactcgggaggctgaggcaggagaatgatgtgaacctgggaggcggaggttgcagtgagctgagatcgtgctactgcactccagccaaggtaacagagtgagactccgtctcaaaaaaaaaaaaaaaaatatatatatatatatatataaagaagaaaaatacacagcattgaatcaacaaatggggaatacagataaagcaactattaaaaacaactagatggaaatttttgtgtttaatggtacaataacaaagatgagaaatttactacatggacttaatatataataagacgtgtaagaaggaagagtcagtgattctaaaaagagatcaacagaaaatattcaatcttaagagcagagaataaaagattgaagagaaatgagtatagctccagggacctgtgagataaagcaagtgtattaatatacatgtaatatgagtcccagaagaaaaatacataaaaggagcagaaaaaattgaagaagtaatagctgaaactttatgattttgatgaaaactatcaacagatccaggaagctcaagtacccacaagtagaacaagcactaagagagtctcatctagaaacagtatggtcacacagttgaaatcttaaaaataaagagaaaatcttgaaagcaggaagagaaaaatgactcaccacatacaaggaagcagcagcacaattaatagctgactttttattacaaacaatgggggccagaagacagcagaatgttgtaatgaaactgctgaaaaaatgtctaccaagacatcaatattcagcaaaactgtctttcaaaaatgaaagcaaaataaagacattctaaaataaggaaagactaagatgtttgttgctagcagacttgcactgtaagaaacactaaaggaatttcatcaggctgaaagaaaatgacattaatgagtagctaaaattcacaggagaaaataaagttattaaattcaaaagaattgaaaccattcaaagtatgttgttttattataattaaataagaaatcaacaacagaaaaaaattgggagatacccaaatatacagaaattaaacagcacatttttaaataacccatggggtaaagaagaaatttaaaaaagaaattagaaaatactttgaactgaatgaaaataacaacacaacatacaaaacacttaggaggcagctaaagtaatgttggaggctgatttatagctataaacatctatattagaaaaggagaaaagtctcaaatcaataacctaagcctccatcttaagaaactataaaaagaagaacaaattaaaccccaaaacaaacataagaaagtaaattgtaaagatcagcttggaaattaaagaaatataaaaataataaagaaaattattctttggaagcagtaagaaaactgataaacctttaactcgattatccaagaataaaagggagaaagtaattactaaaatcaactacagaaagaagacctatcattattaatgctacagcctcataattaaaaggctcataatttgacatgaatatgaaaataaattatatataataattatgtataattacatatgatataaaatatataattatggaaaactttaaaacaaattatgcaacttagatgaaaaagacaaacttcaagcaagatacccagtagcaaaactgactcaaaaagaaaaacttgaatagacctacaaaaagaaaataaattcagctgggaattaaaaatcttctcataaagataagcccaagatcacattgtttccctagtgaattatatcaattcaccatttttacataaactccttcagaaaatagaagacagaacactcccaaactcattctatgatgctggcattatgctgataccagaaccaaacaaagacatcacataaaaataaaactttaaagcaatattgcttgtggacatagacacaacaatttttcacaaaatattagcaacctaaatctacccacataaaaatgaattatatatattgatcgagtgaaatttaacatacaaggttggtttaattttctatattcaattaatgtagtaagccttgacagacaaaagggcaaagccatatgatcatttcaataagtatgaaagaagttttgacaaatcaaacacccattccagatacaaactttcaacaaactaagcaaataaggatttcatcaacctgaaacaggacatctacaaaaattctacagctagcataatacataatgatgaaaacggaatgcttttctcctaagattgaaaagaagcaaagacgtcttttattcaagattattctggaaccatgtaaacatcaaataaggtggaagacatagagatagagatagagacagagatagagatagagatagagatagacagagatagagacagagatagagatagggatgggaacaggaaagggagatggagagagagatattaaaggcaaaaaaaaaaaaaaagaaagaaaaagaaaaattggaagtaacactgtctttatttatagatgacatgatctggcatgtagaacatcttagagaatctaccagaaaattttatgctatagtttaaacagttgtcctctccaaaacttatgtagaaatttatttatttattatttatttatttatttattttgagatggagtctcgctctgttgtccaggctggagtgcagtggctcaatctcggctcactgcaagctctgccacccaggttcacacccttctcctgccccagcctcccgagtagctgggactacaggcgcccacaaccacgcctagctagtttttgtatttttagtagagacgggatttcaccgtgttagccaggatggtctcgatctcctgacctcgtgatccgcccacctcagcctcccaaagtgctgggattacaggtgtgagccaccgcacctggcctttatgtagaaatttaatccccaatgtggcagtattgagagtggggcctttaagaggtgattgggtcatgaaggatctgtactcgcaaatggattaatccactaattaataattgggttaatggatttatgagttatcaccatgtggaactggtggctttacaagagaggaagagagacctgagctagcatgctcagcccctcaccatgtgataccctgcactgccttgggactctgcaggaggtccccaccagcaagaaggctttcagcaaatgtgctccctcaaccttgaacttcccagcctccagaactgtaagaaataaatttcatttcttatcaattactcagtttcagatattctgttataagcaaaagaaaatggactaagataatctactagaactagaaaacaaatttatcaagattacgtaatataaaatcaagatacaaaaattaattttatttctatgcattagcaatgaacaatccaaaagtgaaactaagtaaaaattatgttcataataggataaaaacactcagaaataaattgaacaaaagaagcgcaagccttgtacacagaagactacaaaacattgctgaaagatattaagaacatataaattaatggagagacattccatattcatcgattaaagacactattattaaaatggtcattctcgttcaaacttatctgtagattcaacacaatctgaatcaaaatgctggcacagcatttcaacacagtcaaaatgctggcaggcatgtttttgtacaattttaaaatttatatgaattcaaaggatctaaaatagccaaaaaattgaaaaagaacaacaaagttgaaggattttcattattgatttaagaacttgctataaacaatgtggtattgtcctgagaagagacatatagaccattagaaccgaagtgagactccagaaataaaccctcgtatttaaggtcaattgatttttgacaaaagtgccaaggcaattcagttgggaaaagatggtcctttcaataaatgggttgggagaactggatgcccatgtgtgtgtctgtgtgtgtgtgtgtgttgtgtgtgtgtgtgtgtgtgtgtgtgagagagagagagagacaaagagagaatgaatgacaacacttttgatacttacctcaaactccacacaaaaattaactcaaaataaatcatagacccaaatgtaagagctaaatctatactatttttagaaggaaacacaagagaaaatgtttgtgatcatagattaggtaaagatttcttacatatgatgccaaaaacatgatccataaaaatttttaaaaagcaataggtgaacttgagcaaaatttaattttttttctgtttaaagggtggcattaagaaagtgaaaaatgacccacaaatgaagaaaatatttgcaaattatatttctgatagaggaattatatccaaaagatataaataactcataaacttcaataagataaacaactcaattaaaaatgagcaaaaggcttgaacagacattttatcaaagaagatatatgaatgattaataaaaaaattctcgcttcgttagtcattagataaatgcccattaaaactgcaatgcgatacaaccctagtcccactagaatgactatattcaaaaagactaacagtaacaagtactggtaaggatgtggagagagtggaatactcatacattactagtggtagtgaaaaataacataccacttcagaaaaacattttgacaattctgtaaaatgttaaacatagatttggcagatgacccaggaattccactcttaggtgtttacccaagagaaataaaaatatatgtccatgtaaaaatatgtatgcaaatgttcatagtagcattattctttatagacccaacgggaaccaaaccaaatgtccatcagttggtgaatggataaacaatgttatatatacttggaatggagtaataacgagcaatgaaaagaaacaaaccattgataaaccctaaaacatggatgaacttcagaaacatgagaagtgaaagaagtcagacacaaacaaaatactacacattgtatgactcagtttatatgaactttacagaaaggacaaacctacggagacagaaaacagatctgaggttgtctgggaccaggttgagaatgggaactgactgaaaacaggaacttttggggtggtgggaatgctacaaagcctgattgtggtaatagatacaaaaaacattgaattgtacacttataatggttagattgtatggtatgtgaattatacccctataaagctattaaaattagagaaaaggttttactaaaaataaagacaatggattaattcaggaaatgtataattttttaaaaaatatattcattgtttagttaaataaaatggaaattaagtgtggagctaaattatctgagttgaacttttggcttgttgaatttctgtagaaccctggtaaagttgccacagctaaacctcaggttcctaaatggtagaaacagaggtgtaaatacctatgtccctatttgaagtcactgttgtacagctcaaatgagatatgaaactgctttgtgaggcataaaaaactacacaaatgttaattataatgatgatgattcttcccattaatctattttgaaaagtcttttaggttcttaagcttaacgatttatgaatttataccccgccattttgagaagttcaataatatcacctttgtaattctcttttcttctcttcaacataaataccacagaattttctttaaaaaaaaactttatgaacatgacttgaacattacctggcacatgtagtaaactttaccttgtgtgtgtttgcaataattggcaatgggataaaaaagaaaataccatgtatttcataaatatttgaaaggtaaaatgtgagtattccttgttgtaagataaaacgtgagtattccttgcctttggagttactatttttagaatccgcctttgtaagacatattactgaagacatctctctgttggatattcacaaacatatcaaaggtaaaaacctacataaaaaataaataaagcattttgcaacatccatttgtttatatcaagcctcaaaaatcaagcaaagtatattatttacagatgaggggttctattctgagtctgcatacatctggcatagctcatatttttttcttaatttaaataaaaaagtattataatgagtgacttccatttaattgctatacattggtattctgacctaaatttaggaatgcgttttgcaagaatgagcttcttattaaggcaaactttccctaccccattccccatactttcccttacctttcctgtcttccaaatgaagagtgactagaaagagtgaagaaattcatgctatcaatattctgcaaataaacgtatacttattggtggacaatgaagatgagactggaagtcagtgaggtattgtgattatgacctgctttgggggtagatagtcttggattaaatcctggaccatctaagtattacctgttcatttatttgtctattcaacaaatatttactaagtactcacttcatgctagcattgtgctaggttctgccaatgcaatggtgagtgaaaagatacatggtgctgttattctcagagaacggtcagtttggtcatggattcagagattaattatacaatcagactaatgaatacgtactaaaattgaaagtcagtgctctgaagaaaagaagcatgattcatgcagtggcatgtctagggatttgacctctagagtggatgattttaacacctttctcttctatatgacaaaattgttttcaataattttaatgtaataatgattaacaattactattttaattattctttaattttaaaataaataaggaagaatgcatttgaattttgaagatattactcaaattaagcaaaatattttgtgtgaactaaaatttgttcttaccaaataacaatattacactttgccatttgttctgttttgccatttgaacttttaaacagaaataaaaactccaggtggtcataaaggattgcagaactgaagcaagtcaaattatttctttcacttacaactactgcactatgattgtttatttaaaacttactctttaagctcagaaatatgtagagtgataggggtcgagataaatctggacctgaagcaagctgtaatgattgggaactgttatagaattataacagtttgaacatatttgaacaaatatgtgtagctgagtccatgttgagggctgacaatgtaactaggagttctacaaattaacttccacatagaatataatgcttacgaaagcataattttaaacaatttgaagtgtacgtgaatattgaaactcaatagtttagaatttagaccaacaaaagatttattcaggagagacaccatttagaattgatgatttaaggtaccaataaaaagcagactaacatttactggattttattattgtttttagatcctctgcagacaacacacccctttattgcttacaccctggcagactacttctaccatcctgtccttagtataccagatatgtgatgaaagcatgtgaataacaaaaggaactaaatcacaaaacatgtgccagaaccctgtacgagaacacatgttcaaggaactataaaacatctagtgtggtcagtgctaagaaagctctctaagagaggaaaatatgaaagcagtttgaagacatatatacacaaaactatccagagtctcatatgtcatgctcaggattttcatttttatcctaaaaacaatagaaagcctttgcaagtttcatgatgaagaaaagggtgtgtgtgacgaggaggcatcataatgagatcaacgttttgaagaatccacttccactagccacagagaatagtttagatgaaaaccagtgtcaatgaaggtcgaagatgctacaacactaatataagtaaaagacagaactctggtggtgaccattgaatttaggtgatgtgatttacaacaagaggcatatatagaaagtaagatcaacggggattgtggaccactgcatgtattagtgggggttctccagaagatcggaacaatgtgatatgtgtgtgtgtgtgcacattcgtgtgtgtgtatatatacaaacatatttacaagtatacacacacacacatatatgtgcatatacatatgtatcccaagagctacagctggcaagctagagacctaggtgagctgatgcggcagctgtagcctgaatgtcagcaggattgagaccaaggaagagatgatgtttcaactcaagtccgaaggcagaaaaaaatccaatgtcccagctccaggcaatcaggcaggaaaaaatttcctcttagttgagaaagggtctacttaggctttcaagtgattggatgaggcacatccacattaggaagagcaagctgccaattcaaatgttagcttcatctaataaaaacacccttagagattcaccctgaataatgtttgacccaatatctgggcatccggtggcccagttaagttgacatacataattaatcatcactttggacacaggaatgaaggagaagaaggtgtttagaaagatccctgtctttctgatgtgaacaacttgatagctggtggttacattcactaagctggagaacactaaggaagcccaaggttttatatcaaagatcagaaattttatcctggattttctgagtttgtgatgactcagtgacatctaagtggaattatcaatggatatacagtctgggactcagaagagaagtttggtttagaaagaataatgtgggagtcaacagcatgtagatgttaatggaagccatcagcacaggtagagagggaaggaagaagggggttactgtagaggagagagagagagagaagtcctaaaattaatcattggacaattatgacatttattatgacaattatgactggatcagaaacatgaccctgccaacaaatctgaaaatcacagtcagaaagtagtggatacactatgagaatattgtataataagcctaaggagaggatggggtaagtgggggcactgaaataaggggtgttccctagaatatggaataggtggaagagtaaattagtgacgatgaactggaggtagtgtgtagagaggccttttagaaaagtttgactatgaaatagaacagagatttagagttgtagattataaaattctcagtgatatagttgtaaaattatccttctttactaaacccagtgaaatctgcttaatataatcaaaagtagcaaggtagctcacatagtgctcaaaaaatgcatttgaatgaatacttccttgaatgcctgacatcattccctctagaaaaccattcacaactcatgactttacattttttgtttcaaattggaaacaacgagctataaaatgaattctattaaatgtagtgaattacaagaaatatttacatatatcaatgcatgtagcacatgactaaatctttctcataaaacctcctgtggtatcaaatatccaaagcaaacagtgcacataaaccacagggttcaagcaaattctgcatataatcgtgttctctttatgaggcctcatgggataaatgcctctcttttctctctgcacaaagacttgtttttgacattttctttcttttttttttttttttacaatccccattgtataggcaatgagaatcacataatagattatttcttcttcttcttcttcttcttttttttttttttagacaaagtctcccttttgcccaggctgaagtgcagtggtgtgctctcggctcgctgcaacctctgcttcctaggttcaagtgattctcctgcctcagcctcccgagtagctgggattacaggtgcccaccaccagcccagctaatttttttttttttttgtatttttagttgagacagcgtttcaccattttggccaggctggtctccaactcctgacctctggtgatccaccacctcggcctcccaaagtgctgggattacaagtgtgagccaccgcgcccggcctacataacagattgtttctattttcctctttgctctggggcaaggaagcacaggtctaagctgtggtctacttgtaacaatcagaaacaggaaactcagagcacggtttgtctacatatctcatctctggtttctttttacttttctctcctttctttttaatcacccctattttctcagccaatctggagaactcttgttgtcctctgtatttttgcaatatgctctaatttttctgaatataatggactataaatataaacaaacaatcctagcagtctatacaattctgaaggatgcacctataaatgtgttgcactgctttattccagaacataattaaatggaacatttgctaaaatggcatgattcagacctcaaggtttattgctagagaccatttgatggaaaggcagtaaaggatttgcagtttcactttaaaagtttatttttcatgtgtgtgcatgtgcatgcccattctcccaccacacctgtgtaactgttaagcaagtttctctcttcaaggatgggaggtgtatttttaacaagcaagagacattaagggggatttcgggcctcagaatcaacagcgtcacaacaagctttcaattaaggggacatctgttgggaatacaggggaacctctacccaaagtcagttgctaatcacactcacctgctcgagcagccagacagccctatgcactgagaaaggttgcttatttcctccatgctcaatcacactgcattaagtggccacctgggcaatgtgttagtgcacacctgctgaccgacccagtctaacaaaacatactgaaatcaaactcttaaaatagagagaaagcagatcctctcttggcctagaaagggagacagaacaagcaaagtagaaaaggcccaagactggaagtacacaatgaattgtcagaaaattagccttacctttggaactttttgttagcatggtgcactgttttttaaacagtggatttgagggatttttagcagtaaaaaaaattcagccctttcacttttagaacatcagcatttaaatgatatcagaccaaataacagcctcatctgtagagggtgatactgagcagcactacgagagagagagtgtgtgtgtatgtgcgtgtgtgtgtatgtgtgtatgcatgcatatatagtgattacttgtagcctatgttagaaaacatattgcacactttccttctctggatgcataaaaggtgcttttcctaaaacgtacaattttgcttaactagatgccaactgttgggaagaaatattgtatatttcagatatttctattcggatactttaaaggaatcacccaaaggctagtttatgacacaatattgtggaccaaactttctctaacacaacagattgtattactatggccatttgcacgggctaatttctatctagtacaagtcatatttgttgctttttgtttgcttgatttttgtttttaattaggaatggtctgttaacaaacctcagaacacctacaaagttcgactgaaaaagaccacacatcgtagggaacataagtttatttctgaggatttctaaacccacagtggatgtatgcagatcctttttaccactttattatgctcttctctataatactgcaaagtcaagaaggatgagagctgttatctaactgcagtttaataaatttcaacctgtaatcccagcactttaggaggctaaggtgggtggatcacccgaggtcaggagttcaagaccagcctggtcaacatggcgaaatcctgtctctagtaaaaatacaaaaattagctgggcgtggtggtgcacacctgtagtcccagtgactagggaggctgaggcaggagaatcgcttgaacctggggggtggaggtgcagtgagccgaggctatgccactggattccagcctgtgggacagagtgagaccctgtctcaaaaaaaaaaaaaaaaattcaaccagatttatctaatttctgttggccaaactccatgcaatatttttttctctagtttatttttcttgtttagatacagacttgctctattattatagttttcattctaaaaattagcttagcaaaacctgctgattaatgagggcattgtgtgcactgagaatgctgtgtcatgcagaaacatctcacttttcctattttttccatatacagatgttcatcttaggtataatcacatttatagtgttttggaatcactaatgtgtatatatttatacatgcatgtatacacgtatccaactgcagtcacgcatgcatgcacacacatacatgtatacatgcatgcatgcatccatgtatatgcacatctatgcacaatacatacacatgcaagtgcacatacatgcacccatacatgcatacatacgtgcatgtatcatgcatacatagatgtacatgcatgtatcatgcatacatagatgtacatgcatgtatgcataagtggatgcatgtgcatgcatgtatgcatgtacacatgtatgtatacgtgtgtatgcatgtattgtcttgttacaatcaggagtatatatatataatgttaacaagatgacatatatatgtgtatacatatatattttaaaaatgaggctgggtgcagtggctcacagctgtaatcctagcactttgggagaccgaggtggtcagattgcctgagctgaggagtgtgagaccaccccgggcaacacggcaaattcccatctctactaacataccaaaaattagctgggtgtggtggcaaacacctgtagtcctagctacttggggggctgaggcaggagaattgcttgaacccaggaggcagaggttgcagtgagccaagattgcaccactgtacttcagcctgggtgacagagtgagactccaaaaaaaaatattaagacaatattttttcttaaatactaaggaggcaatgtatttggaatgaggaaaaacattgaaaatatctatcttggtcatatttttatagtttgatcaaaatgattaataaacaaacccagcccttcctctaagccaggggtatccaatcttttggcttccctgggccacactggaagaagaattgtcttgggtcacacataaaatacactaacactaatgatagctgatgagctaaaacaaaaaattgcaaaaaaatctcataatgttttaagaaagtttacaaatttgtgttgggccacattcaaagccatcctagaccaatgggctgcggcccatgggccgtgggttggacaagcttgttctaagcatttacacgcaattgatataagacagaatactaaaacatgacacaacagagtctattattcctaagaagcttctccattttcttatttatttatttatttattattttattttgagacagagtctccctctgttgcccaggctgcagtgcagtggtgcaatctcggctcaccacaacctctgccgcacaggatcaagcgattctcctgcctcagcctcctgcgtagctgggattacagacgcacgcccccacgccaggcttacttttgtatttttagtcgagacagggtatcaccatgttggccaggctggtcttgaattcctgacctctggcaatccgcgcgcctcggcctcccaaagtgttgggattacaggcgtgaaccaccgcgtctggccgaagttattcttttctgtctcaaaccaggaaggtctagaaaacctgccactggaatctgtgaggctattcattgacacattagaagatagttgtacattcaaagtaggaacagaactattatctataccagaaacatgaacttgattctattttaggcagtgattcttcctgtgttaaagcttcctgaacttgctctcactcctctctcacacacagacatacctcacacacatgactatccaatgattattgtgcatatctgctcatcagactcacttgggaggctaaaggctaattcccagtaccagtttctggacttattaaatctgagcatgaggatgtggggcttatgaatatgtattttttcaaaagttttcgcattttttttttcttttttgagacagagtctcactctgtcgcccaggctggagtgctgtggcacgatcttggctcactgcaacctctgcctccctggttaaagtgattctcccaacttaacctcctgagtagctgggattacaggtgtgtgccaccacactcagctaatttttgtatttttagtagagacagggtttcaccatgttggccaggctagtctcgaactcccgacctcaagtgatccacccaccttgacctcccaaagtgttgggattacaggagtgagccaccacagctagcctcccaataaattttgatgtggtaagtccagcataatcttgggggagccattgcaattaatatatcagctttggtaaatttaaataaacagtccaaagtgcattggaatggatgagtgagatctaaaactggacacagaagaagaggaggcaaaataaaaacaataaaagggaaagttggcaaggaacaaagacagatagaatcccagtctctcttcacaaaggagaagttattacgctagtgagaagggattagtggttaacatcaaattcatactgttaacaggcagagaattcgtgtgtagtttattcttttaaatcttcatgttaatacttattaaaaggattaaaaggatgtattttgtgcctttgtatttttctcagcaaattttcttgactttgttttttttctctattaagtccagtgttaatatatatttttgttacagaaatttttctgaaatgggtggacccaactgataattttcatcaataccaggactttcagaagagagctcactaggatattacttacacaatcactcctgatgaggaataggcattttttatgccaaatatctacacatgcacatatacacacatcatgctaaatgaaccattactccatggtcgtatcccttacctcctacgaatatgagaatacaaaggtcatcagggaaattcttactttcttaacaatagtcataataacattccatgtcttagatggctcttgtttattgtctttgccatccaactgcgtaggaactgattcagaggcctaataggcagggatgcagtttgatttagaatgaccacttccatgtagttttttaacttcttctaattttattttttttgagacagagtctcgctctgtccctctgatgctctgtctgcactggagtgcagtggcgcgatctcagctcaccgcaacatccgcctcccgggttcaagcaattctcctgcctcagcctcccgagtagctgggactacaggcgtgtgccatcacgcccggctaatttttttttttttttgtatttttgtatttttagtagagatggggtttcatcatcttagctgggatggtctcgatctcctgaccttgtgatccacccacctcagcctccctaagtgttgggattacagtcatgagccactgcacctggcccaaagatttttcctttcttttcttctctcgtttctttttctcttcttcctttgtttctttttctctctttttgtctgtctttttttttgttgtttttgagactgagtctcgctctgtcatccaggctggagcgcaatggtgtggtctcggttcactgaaacctccgcctcctgggttcaagtgagtctcctgcctcagcctcctaagtagctgggattacaggcgcctgccaccacgcccagctaatttttgtatttttagtagagacagggtttcaccatgttggccaggctggtctcgaactcctgaccttaggtgatccgcctgcttctgcctccctaagtgctgggattacaggcatgagccaccgcgcctggccagcttctacgtacttcttattttagaagttactcagcaccgagagcaagcaataaaacgagtcataccaaaaagctacattcctgtctcctaagccccaaccacactccactcctgtggcccgtggtccaaacagaaaataactggagaagatgaggaggtcaaaggatcagggaactaagtaagcattatgtgaattcaccagcaagacgtacagaatgcttgtgtttacattgtttttatggaactagcagaataaaactgacctattttaaaaatgcaaaaaaaagttactcagagccctttaaataataagtttaacaatcttaaatctctttaaaaaataacaaaacttaggtaaactctccaagtattgtccatttcgttgatattctgtttataaacacatgctacctaccaaacggcaatgaacaccaggacatgtggctctacgtgccagatggaggtaacacacctcgagtgtaatggctttgaaacaatgcagtgagtcatatgtgattttaagctctgcctttttgagcaaagcattgtaaaaattggaaaatgcagtctatatttgaagcttccaattgttttaattaaaaaatcctttaaactgtattataccatttacatagctaaaaagattgaactgctttgcaagccattatcatttacaaaaagaaggcagtcattttctaaatttagaatgaagaaatattttaattttattattatgtctactatttgtcttcataaggcgcagtcccaggggcctaagctacgattaaatccagcactcactcatcacacctatgattcagtgcttctgagaaagggagtttaaataagtctacagtactgaaaaaggatcaacattggcaaagtatcaacccaaaatttttaattctttaatgcaaaaatattcttgatatttttccttaacaagcactatttcaatcaggtatttattgaattctcaatagttcctcagctctcttcttggtacaaggagaggtaggaagaaaaatacaaaacctagtccttggtgggatagaaagagaaaccactgagtacttgcaacatgtcaaattcactcttaggtgctcttggcatgttgcatcaatttgcggaatttagagtttatttggggaggcaaatattcttcttgtaacaatcagggaatcaaagtggtacctgaatttcacagaagctgtcaactcctttgtcttgtcttagcatctccccacctcacctccctagacagatgagtccatggaggcctctccatcattagcaaactcgccaactcctcacttctacttgcagaactgatcttgtctgtagaaggaaactgttaatgactctgcagcgctgtctcatcatccctacccccatcaatttctggccattcagtagggcttggcatgagtcagccacccagatgtgaactaggctagaacatatatttcttggaatatttctctgatttgcttttcttgaaatgtgacagtgcttagaattcatgaaatttcaaaaagctgggtaatcagaataagcctatgaagccatcatttacaacatggttgccatttgcttatgctgctgatgattgtggtggaaatgaacatcatgacttgcttggtcccatatgttatattccgtaaatactttgagaagtcctgagagctcaggcaataaaactagagcaattcttcctgctctttttacagccatttaaatgttggtactctcccaggtttctgtcctttgtccgattctcttcttacattatatttcctctgtgtaatctaatctactccctgactctaattactccctatgtgatgatgcagccaacgtcttgactccagcctgagcatttttctgggtacttgtgtccttttatgcagctacttattggtcaccttcctacattaaagggtgctcttataggcagggatggtgtaggatggctccgaggcaggggatgcaggggaaggtacattctccactatatagtctcccaggtttaaaataatgcaactctaagaaaggtgaaaaatgtcaaaagcaagtaagtcacctacataatttctgaaacataagacacagctgtgtttgttctgacaggaaaaaaatttcaattccccgaaacagaaaaacaaaacaaagaaaacaaacaaaaaaaaccaactacaagttgctaagctgtgcccacccccaccacccccgccaaccaagatatttttcatctgatgaggatggttacctctgcatggagatcctcaaaagactacatcaacgtgatataaatagtctaagccagtatcttggatgccatcctcaacttttcctttacgccacacctctaggcaccgagtactgttctgttcagctataaacacctcttgtctcctttctccccctgacactcactgttagagaactgctgtaattagttcaaggagaacttaattcaacgcctcctcaatttgtcagctggactattgcaatatttttttttttttttttttactgatctcttgctttcaagtttgtccttattaattaagtacattttccattctattgagttaatatttctcttgtttacaatccttcatcaattctctccttttcaaaccagaacccaaactacttaaaatgacatgaaatggactttaggtctagccctggtatttatagaaagtaccacctcttgccatgcctcatcacacgatttctagtcattcccaagcttcttgcaggcccttaacatgacgtgccctcttccatcatactccatttgcccaaactgcatcctctgactggaataccttttcattttcctgctgccaaggttttatcaactcagcttctacttatccttcaaaacttatttcagatgttaccacctctgggaagccttccttgatcaacccaatctgtataggttgcctattacacaatccattgcagtatcttatgcttacctcaataaaaatgacaataggagtaaaatataataatatttattgggtaaacactaggtcctaggcactgtgatagcattttagtaaattttatctcgtagagttttctaatactttatggtaagcgtctgtccacttcatggtttctcctatgtgaccctgaactctagaaaggaaagttctgtgttttaactgaaaatttcttattcacagagcccaactcagtgccttgttcactgaatggtttaaagtctggaaaggctgggactgtatgttctccatggaaaattccctgattctttccactggaaataatcattcccatgtctgaattctattctgtcaggatttgtatttcttccttgctcacattaaatatttttatgtatataacttggctgcccttcaggcaggctgtgcacttactgagtgatctcttcttgataattctttctgaaaacatctctaagcatcttctaaaccatttgaaattcaacttgtaaagactattcaaatcttccctttcttatatttaaatgttttaagtattaagacaatctaaggcagaaaacatcatttgagcccagggaataatgatgagtcagtttacatttctttcttttagagtgtggaatttttgagctcaaagggaactacaaaatcatgtcatccaattgcaaccttttgacagaggaggaaactgaggtccagacattgaatgatttgtttaaggtcacagagcaagttagtagctacatttttactagctcttaagaacataaaaaaaaggcaaaattctaatttaacagcttgaaataagagtcctacctctacaccttctcttttctaagacatgcttcaacattgactgtttttctcatatttatttatttatttttattatactttaagttctgggatacatgtgcagaatgtgcaggcttgtaacataggcatacatgtgtcatggtggtgtgctgcacccatcaacccatcatctacattaggtatttctcctaatgctattccccaacatgacaggccctggtgtgtgacgttcccctccctgtgtccatgtgttctcattgttcaactcccacttatgagtgagaacatgtggtgtttggtttcctgttcctgtgttagtttgctgagaatgatggtttccagcttcatccatgttcctgcaaagaacatgagctcatcctttttttggctgcatagtattccatggtgtatatatgccacattttctttatccagtctatcattgatgggcacttgggttggttccaagtctttgctattgtgaacagtgctgcaataaacatatgtgtgcatgtgtctttatagcagaatgatttataatcctttgggtatatacccagaaatgggattgctgggtcaaatggtatttctgtttctagatccttgaggaattgccacactgacttccacaatggttgaactaatttacacttctaccaacagtgtaaaagcattcctatttctctacatcctctccagcatctgttgtttcctgactttttaatgattgccattctaactggcatgacatggtatctcattgtggttttgatttgcatttctctaatgaccagtgatgatgagctttttttcatatttgttggccacataaatgtcttcttttgaggagcgtctgttcatatccttcgcccactttttgatgaggttgtcttttccttgtaaatttgttaaaattatttgcagattctggatatttgccctttgtcagatggatagattgcaaaaattttctcccattctgtaggttgactgtttactctgacgatagtttcttttgctgttcagaagctctttagtttaaataaatcccatttgtcaattatggcttttgttgccattgcttttgatattttagtcatgaagtctttgcccatgcctatgtcctgaaaaggattgcctaggttttcttctagggtttttatggttttaggtctaacatttaagtctttaatccatctttcattaatttttgtataaggtgtaaggaaggggtccagtttcagttttctgcatatggctagccagttttcccaacaccatttattaaacagggaatcctttccccattgctttttttggtcaggtttgtcaaagatcagatggttgtagatgtgtggcattatttctgaggcctctgttctggtccgttggtctatatctctgttttggtaccagttggttactctagccttgtagtatagtttgaagtcaggtagcatgatgcctctggctttgttctttttgcttagtattatcttggctatatgggctctttttttgttccatatgaaatttaaagtagctttttctaattctgtgaagaaggtcaatggtagtttcatggggaaagcactgaatctataaattacttgaggtaatatggccattttcatgatattgattcttcctatccatgaggatggaatgtttttccatttgtttgtgtcctctcttatttccttgagcagtggtttgcagttctgcctgaagaagtccttcgcatccctcgtaagttgtattcctaggtattttattctctttgtagcaattgtgaatgagagttcactcatgatttgactctctgtctattattggtgtataggaatgcctgtgattttttgcatgttgattttgtatcctgagactttgctgaagttgcttatcagcttgcagaaattttgggctgagacgatggggttttctaaatatacaatcatgtcatctgctaacagagacaatttgacttcctcctttcctaactgaacacacttgatttctttcccttgcctgattgccctggccagaacttccaacactatgtttaatagaagtagtgagggagggcatccttgtcttgtgccggttttcaaagggaatcctttcagctttggccgattcagtatgatattggctgtgggtttgtcatgaatacctcttattattttgaggtacattccatcaatacctagtttattgagagtttttagcatgaagttgtgttgaattttatcaaaggccttttctgcatctatggagataatcatgtggttttggtcattggctctgtttatgtgatggattacatttattgatttgcgtatgttgaacctgccttgcatcccaagtatgaagccgacttgatcgtggtagataagctttttgatgtgctgctggattcggtttgccagtattttattgaggatttttgcatcgatgttcatcagggctattgggctgaaattttctttttttgtgtgtctctgccaggttttcttttatatatgtgtatatatatatgtgtatatatatatgtgtatatatatatgtgtatatatatgtgtatatatatatgtatatatatgtgtatatatatgggtgtgtatatatgtgtgtgtatatatgtgtatatatatgtgtatatatatgtgtatatatatgtgtgtatatatatgtgtatatacatgtgtgtgtatatatgtgtgtgtatatatatgtgtatatatatgtgtgtgtatatatatatgtgtatatatatatgtgtgtgtgtgtatatatatatataactattattatactttaagttctaggatacatgtgcacaacgtgcaggtttgttacatatgtatacatgtaccatgttggtgtgctgcacccattaactcgtcatttacattaggtatatctcctaatgctatccctcccacccccccccacaccacaacaggccccagtgtgtgatgttccccttcctgtgtccaagtgttcttattgttcaattcccacctatgagtgagaacatgtggtgtttggtttttttgtccttgcgatagtttgctgagaatgatggtttccagcttcatccatgtccctacaaaggacatgaactcatcctttttaatggctgcatagtattccatggtgtatatgtgccacattttcttaatccagtctatcattgttggacatctgggttggttccaagtctttgctattgtgaatagtgccacaataaacatatgtgtgcatgtgtctttatagtagaattatttataatcctttgggtatatacccagtaatgggatggctgggtcaaatggtatttctagttctagatcccggaggaatcgccacactgtcttccacaatggttgaactagtttacagtcccaccaacagtgtaaaagtgttcctgttttcccacatcctctccagcacctgttgtttcctgactttttaatgatcaccattctaactggtgtgagatggtatctcattgcagcttgatttgcatttctctgatggccagtgatgatgagcattttttcatgtgtcttttggctgcattaatgtcttcttttgagaagtgtctgttcatatcctttgcccactttttgatggggttgtttgtttttttcttgtaaatttgtttgagttctttgtagattctggatattagccctttgtcagatgagtagattgcaaaaatgttctcccattctgtaggtcgcctgtccactctgatggtagtttcttttgctgtgcagaagctctttagtttaatgagatcccatttgtcaattttggcttttgttgccattgctttgggtgttttagacatgaagtccttgcccatgcctatgtcctgaatggtattgcctaggttttcttctacggtttttatgggtttaggtctgacatttaagtctttaatccatcttgaattaatttttgtataaggtgtaaggaagggatccagtttcagctttctacatatgcctagccagttttcccagcaccatttgttaaatagggaatcctttccccatttcttgtttttgtcaggtttgtcaaagatcagatagttgtagatgtgtggtattatttttgagggctctgttctgttccattggtctatatctgtgttttggtaccagtaccatgctgttttggtttctctagccttgtagtatagtttgaagtcaggtagcgggatgcctccagctttgttcttttggcttaggattgacttggtaatgcgggctcttttttggttccgtatgaactttaaagtagttttttccaattctgtgaagaaagtcattagtagcttgatggggatggcattgaatctataaattaccttgggcagtatggcccttttcacgatattgattcttcctatccatgagcatggaatgttcttccatttgtttgtatcctcttttatttcattgagcagccaggtttacgtatcacgatgatgcatgtctcatgaaatgagttagggaggagtctctctttttctattgtttggagtagtttcagaaggaatgttaccagctcctctttgtacctctggtaaaattcggctatgaatctgtctggtcctggtttttttttggttggtaggctattgactactgcctcaatttcagaacttgttattggcttattcagggattcgacttcttcttggtttagccttgagaggttgtatgtgtcccaatttatccatttcttctagatgttctcatttatttgcatagaggtatttatagtattctctgatggtagtttgtatttctttgggatcagtggtgatatctcctttataattttttagtgtgtccatttgattcttctctcttttcttctttagtagtctggctagtggtctattttgttaatcttttcagaaaacccgctcctggattcgttgattttttgaagggtttttcgtgtctgtatctccttcagttctgctctgatcttaagtgtttcttgccttctgctagcttttgaatttgtttgctcttgcctctctagttcttttaattgtgatgttagggtgtcgactttagatctttcccattttctcctgtgggcatttagcgcaataatttttcctctaaacactgctttagctgtgtcccagagattctggtacgttgtgtctttgttctcattggtttcaaacaatatctttgtttctgccttcatttcattatttacccagtagtcattcaggagcaggttgttcagtttccatgtagttgtgcgcccacagctaccctttcccccaggtgctctgtcgcagggagatgggagtttgatccataagtccctgactgtggctgctgcctttctttcagagatggcctgcccagagaggaggaatctggagattcagtctggctacaacagctttgccaagttgtggtgggctctgcccagtctgaacttcccagcggctttgtttacactgtgaggggaaaaccacctactcaaacctcagtaaaggtggaccccccctccccactaagctcgagcatcccaggttgacttcagactgctgtgctggcagagagaatttcaagccagtggatcttagcttgctgggctccgtgggcgtggaatctgctgagctagaccacttggctccctggcttccgtcgcctttccaggggaatgaaaggttctgtcttgctggtgttccaggcaccactgaggtatgaaaaactcctgcagctagcttggtgtctgcctaaatggctgcccagttttgtgcttgaaacccagggccctggtggtgtaggcaccagagagaatctcctggtctacaggttgcgaagaccatgggaaaagcatagtatctggaccagagtgcaccgttcctcatggcacagtccttcatggctccccttagctaggggagggagttccccgaccccttgtgcttcctgggtgaggtgacgccccaccctgcttctgctcgcccttcatgggctgcacccactctctaaccagttccaatgagatgagcagggtacatcagttggaaatgaaaaaatcatctgtcttcttcattggtatcgctgggagttgcagaccagagctgttcctatttggccatcttgccagccacaaccttgaggtttttttttttttttttttttttacataaaaggactctagtataacatacagataataatttatccctttcttataccaagtttaagcattttttctgaatgattttaaagggattggctgtagcttacatgagtacattttatcttggataccaataacatgcttctcaagtccacagacaaagaatgacttgaatcagttttctaatgcatgtgactgattttcattcagtgagctaatggatacttgatatatttattctaacctaatacagtttttcaagtgactataaagtattttaatgcttctaactatagaaatatttgactcaatgtcatcacctgatatactacctcttagtctttcagccaagtctattttggggttcaaatgacatcagaaaattccagaggggtatggagggacaaaaacacgtttggtagcattttgaccatctttaataataaaaatcatgatgcaagattatatcttaatcttttctactattaatggtcaaaagtttaacagactttaataaatcacaaatctagtattccttctggcaagttctccatatagaactcctttcccagtaccaaaacatatttcccaaccccagaatatatttccttttggggctgggaaaggaaatgaaagattgggctctaaaacttcagatgcttaaggaaggtaactaattctattcctcaggactcttttggcctcagtcaccatctagcttccttctctcacctccagatgtgcaaatggctaatgctgaactgataagagagaaagagagaattggtaacaaataaacacttgttgattgagaagatgagataatatggaaaaaaagaatggaaagataggaagtgatttggtacctaaacaatttacatgaaaataacataaaattaagtgaaggcccatcctcctaaattcagttccaacttgaactaccgaaatcaagccctgcagacaccaggtgtagctggtacctacattccccttcccagctttatagaggtgtaattgacaaatactaattatgtgtgtgtgtgtgtgtgtgtgtgtgtgtatatatatatataaatatatatataaatttatatatatataaatatatatatataaatatatatatatataaatatatatataaatatatatatataaatatatatatatatgggaaaccataagatgtcttgatatacattgtgaaatgattaccagcatcaagctaattaatatatccattacctcacatagtttgtggtgagaatgtttaagatctactctcttatttctagtataccctagagtattattaactatagtcgccatgctatacatgagattttcagaatgtattcatcctgcataacggaaactttttatccttctactaacatctccctgtctctcccactctctagcccctggcaaccaccatcgtactctctgcatctgtatgttcagctttttggattccatacgtaagtgagattaagtagtatttgtctttctgtgcctgtcttatttcacttagcataatgtcctccagtttcatccatgtagtcacacatgacaggattttcttccttttttaaagctgaataatattccactgtgtgtatacatatgtctttctgtgtatatatacttatatatacacacacagagagatatatgtatcacattttctttatccatttatctgttgataaacacagactgatttcatatattggctattgtgaataatgctgcagtgaacataggtacacagatatcttgaaaaggaagaagtaaaattgcctctgtttgcatatgacaccatcttacatatagaataccctaaagacttcaccaaaaaactgttggaagtaataaaaaaattcagtaaagttgcagaatacaaaatcagtattaaaaatcaattgcatttctatatactagcaattatttaaaaaagaaattaagaaagcaatctatttacaatagcatctcaagaacaaacaaacaaacaatacaaccttaaggataaatttaaccagtgaatcgaaagatctgtacatagaaaacactgtggtgcctacctttaaagtaagtgctttggggatttaaaataccagcaaacaagagattcttaaaatatcatccaaagagaaagtctacttactaccttttttcatgccttcacaaacatactaaatagatcccgaggaagcctaacgaatgaatgcttcattcacataactagttttatctttactagaagccctggaggagaaggcatctgaacgtgtgcagtttgcttcactggggaaggccccccacagtgggaaattacatgaggcttaatgcagtatgaaatgagaaagcagaaaaagatatttttcaaaaggccttccaaagaacaggatagtgattcttactatgagtaatttcattctcttctcataatccccctttccctttccatccaagagtgagtatacagtttccttttggggttacatcaccaatttgaaaaagattcacaatccttgtgtctccaaatattgctggaagtcccatgcatgaagtgaatcttgaacctttttcctcagttttaatatagctttggtgggggctagggtgctcttggctacatggcttgacattttttccatcaacctccaaagacgtgtttgtttcctctactctgacacattatctcggataacagaagacatcttcaaatcaattgatggaagattgagagaaagagaacttcaggtccaggtgctgtggctcatgcctgtaatcccagcactttgggtgactgaggtaagtggatcgcttgagctcaggggtttgagaccagcctgggcaacgtaggaacaccccatctctacaaaaaatacaaagattagccaggtgtggtggcatatgcctgtagttccagctcctgggggttggcagggggtggtgcgaggtgggaggattgcttgagcctgggaggcagaggttgcggcagtgagcctagattgcaccactgcactccagcctaggcaacagagcaagaccctgcctccaaaaaaaaaaaaaaaaaaaaaaagaagatgaaaaataacttcatctaatttttgagctacccaatccttattgtgaaagacaagcgatttagtgtttgctatatgcagcaactataattggtttagttttcagtagttcatctctaaggcagccttgctttgaggaactggaaacttcaactgactatttacagggaatagaaacaatcactacataggaatgaaaatgctaagcttagtttgcctgtggtaaaacattcgtaatcatttgatatcattggcttaattttataagcctgttctaccactgagtgattctgttttcttactggattttggctatcataaatgtattgctagatattgaaaggataaaggtttatatggtgaacatgggataattcaaaatggtttcttatacagaattcactttgagatttacatgaatcaaatgcaatagaaaaataataatattactgagtaatttggattttacttactaatccattcttatcaactcatctagtaagaggagcacttttttggtttatttgtttttggtaacaagtaagaaataaagtatttggatagatgttacagacattaccactttctgatggcgtgtgttccttctaatattagagaatagaaatggtagtttttttaccgcatcataatgtattgactacctgagaaaaatgttgattagctatattgtgttgagtaacgttttcttaaaaagtctccaaacaatttgagacagtcacggtgacattactattatcacctgatgagcatcacaggaggcatgaaaatatagataagacagtcaggaatcaaagaacgtgcatgggatttacagttagtcacatacagagaaatgtttaatttcacatcagttcacatcagattccctttcttataaagccacattttcagaatcacagttgagtatggtgaaaataagcagagattagggtttcaaattacctataatctgcattcataagtgctctagttcacccagaaagaaaacacttggatgactgtcataaatcagttccaatgttgttcatcatgcctctccattctctcctctgtgcaccccgcagtctagcattttagcaatcttagtccctcagagaggccctattccttttcacctctacagctttgcattgcagcttggaatgtttttctctaaccttgactttttcacccttgctcatcattcaagattcaaagtgcaatatacaaatgcttgaactttggagccttcctcctccttcttacaaaagcttacaattaaacaactgtgtgcttttctttaatctttggcattttattctatccattattattttagaacactcagagaggagaattaaagggtcaagaatcttgtggctacattttgttaactgattccctgattcaaagtataaactgaaatatgtattttcactgaaaattaggtcaatatgcaatctgcttttattcatttattcctgagttcccactatgtgtcaatttctgtgatggcactagaaaataaatacaatttagtcttactaaatagacctagttttatatggttctcaacaagtttacagtttagaaaagggaggcagacaaatgaacaattttaataacatgaagtattgcaaaaggaactactgtaggcaaggaggttttgtaataatttacaaaagtacagggtaaccaatttgttgatggcaagatgctgtgaagtatgtggatggtagagctattaaaagtgcattatctataggagttggcaattgattggattttaggggagagaaacagagaggggagaagaggagaagagaggagatgagaagagaggagggagaagagagaagaggagagaacacaagatgacagaaatgaattcaaaacacagctacggtttctgagctgagtgaaaatgccatttaatgtaagagatgtgacatataatcacataataaatatagcaatcatacggccaaaatataccccattaatccgccttgctggctcctgagcatctttgagcttgtcagggtgtgtgccttgatttctggtttgggaatacatttaccataatatttagtatagcacatagagtatttaggttcacacctcctcataattgcaggtcggtaaaatgccactgttcaatctgatagcatttaatagaaggacacaaatgaaggctcctggtgacctttcttagggaacaaattcttttagtacaaagggtccactaagaggccaagaaaaaaaaaaagtcagtaccattactctgaagattctaacctttccccaagacactgtctttgtggacacattttctacaaagcaaatttgagctaagcttccctaagctttcagtaaagacattagcttagttagcatattaattaagacaagttcaaatgccctcttcccttcattgccatgtaataattatatgctcagcatttgtccagctcagttccattacgtaaaagctgtctgtctgtctgagcttgctggcactcatagtcctgccctaaaattactgaagtatgttaatgttaaggattcctggacatcggatgttttatttattttttatactatgtaattgaattttgaatgtacattatctgattaaggatttagaataccgcaaggtctttcagaatctcttaatgagaatgataatgtcatattattcatgctgataatttaagtctattgtttattgccactgaaactctttctcacccccttagaatggagatactttccattactaccactgatgtttatttgaacagctcatttaaattctatgttctgaattgcttgcaaggaagaaaatacctagaacatttttaaagactctggaatcactctaaagtctttttggattgagatggggaataagtacataaaacatacagacagacagatgcatactcttaacttcattttgaaagatacaaagttctgtaacatttactgtgactctataatttattagaataaagtattattttttctccaccaaagaactatgtaaataaaatgtatagcattgctgcagacaatatttattttagcttttcatctatgtgtatgttgatatatacataacacacacacacacatcagcttatttccaaatgtgctctgcactgcaaatctttccaaatctaacttaaaaggcaatctgaaaaagaatatctttaactatttctttccttttataaagggttttgggagacagctaaggatatttttatctttccttctaaagtgttaaactatttgaacaggttaaatagaaactaaagcaaatcaatgtaataaatactgatgataatacagacatggatgttcacttagtgttgtacttggtgatagttttcttaaactctttatttattctttattttttatttatttatttttcaaaactaaagttttctttagaaaaacataaattaacatgtatatttttggtctctttaaactcagttaatctttttttaaccagagtagcaaggaataaaattagaataggttcaaatattatcattttaattgtagattatttctgtatttaactacaaataagtttggaaaaaaaaaaaagaagacttacatgcttgtgaaggcaaaggttttcagactgtagaatgtcctatatttcagtctgtcaagacctgagaggctctgaactcagtcttcaggctacatggttcaatccctgataccgtgtttgcacctgctaaattctttccccagaagactaaattgactaaggcatttcacacatctctctctctctctctccttttttttttttttttttttgagatggagtcttcctctgtcacccaggctggagtgcagtggcgcaatcttggcccactgcaacctctgcctcctgggttcaagtgattctcctgcctcagcctcccgagaagctgggattacaggctcctatcaccactcccagctttttttttttttttttggtatttttaatagagacagggtttcaccatgttggccaggctggttttgaactcctgacctcaggtgatccacctgcccttggcctcccaaagtactgggattacaggtgtgagccaccgcacccagcctgcacatctcttaaaaaggttatacctaatacatcaatatctgaccctaaattaggaattttacctcccacctgggaactttctaatgtaatggttgacctgctggttggagacactctccatctttcccaagccaataattctctgaaatacatttgacttcactacccctttcagtactgttccttgggtagatcctattctcttctcaaaactaccattgcaaaacattagtgatgatgatgatgatgatgatgatgatgatgttcacaaggccaaccatacctttcagactcattttatgcctagatttttcatgccttgagcccaagttgcaccacttaaaagacttagttcaaagcaagaaattgaaatgaatgcttatagactaaaggcatggcttccatcttgaagatttagacattatcatggcacagcagtaataacccatcaggaactcctgataaacccatctcaagaaatcatttgtgatatttttcctgaccctcccaccaagtcaggtaaatgaactttatgctctctttgctcataaacacatctattattctaaaatcaagtttaaaaagtaaaataaaatttaaaaatgggtaaatgtatctcctcaaccttgtgaaatcaataaggaagcatttactaaaatgcttactaaaacactaaagtaaaagctttactaaacaagaggagtgtatttgcaactagtttcaggcagtttatcaacaaaattacacacgtatgtgaaatacacatatacactatatataattttgaattgtatgtatataattttataacatatgtgtgtgtgtatatatatagtgattttaaaaatatttctcagaaaaagagcagtatatgggtcctggctccactaatcctagctgtgagaccttgggtaagtaacttaacctcacttaatagcctactttccttttttataagacaaggaaatagttccttggagtattgttgggtggagtttaaatatgcacatgtaaatttaaagtactacatccatgaaaaataaaaatattatatttcacaaagttaaaacaactttgagagaaagctgtcagtgagttaaagtggctgaaacagatctcacaaaaatccagcaaaaatacgactttcatcaagggcttttaagtagttggttaacgtaaaacagataataaaggtcttgtttgtttgtttgtttgtttgtttgttttgagatggagttacactctttttgcctaggctggagtgcaatggcaccgtcttggctcactgcaacctccgcctcccgggttcaagcgattctcttgcctcagcctcccaagtagctgggattacaggcgcccactaccatgcccagctaatttttgtatttttactagagatggggtttcaccatgttggctaggctggtctccaattcatgacctcaggtgatccatctgcctcagccttccaaagtgctggaattacaggcgtgagccactgcgcctggcctataataaaggtcttaatgcaacctgctagcatgattttgatcatttgctgaaattagagtctggtcgatactttacccattgccagcaactatttttttcttttttttgcccccctgtctatcatcttgtaactagcaagcactttaacaatatacttttttctggtgcaattgttaggtttaaattcttttattaagctgttctaaaataaaaaacatgcaagttatcacttttggccagttccactgcttcccgttttacgtgatgaggtgtactgtttcacctcgtagttgacatggccattacaattagatctggtgcacaggagagaggaaaacaaaatgaacttcatcagcaactggacttgcagttagtgatgagatcaaacacttcactgagtgtggccagggaaaaaatcctactcaaagagaaattaaaataacagcagttaagggttaacgctggaggaaggcaaggtaagaaattccattgcagttattaaaagacttccaatttgattaaacatgacaacaacatacaggggtcaaagctaattttttttttgaaagggaagaaaaaaacatcagaatgcaatgggcttggatgactctgatttcctttctatgcttgttcttgatcagcttgtttatttgaattctgggcttcagctttattataaataattcctcagtcacaattttttaaaaaaaatttctttgcagaagaagccaaattatccttgtttgcagatggtattatcttacacttggagaaacctaaagactccaccaaaaaattattaaataagtttagattgataaacaaattcagtaaagttgcaggatagaaaatcaacatgcaaaaattagtagcacttctatatgccaatagcaaataatctgaaaaagaaatcaagaaagtaaccttatttacaacagttacaaataaaatatgtaggaattaaccaaagaaatgaaaaatctctacaatgaaaactataaaatgctgatgcaagaaactgaagaggacacaaaaaatggaaagatattctatgttcatggattgaaagtatcaatgttgttaaaatgtccatactacccaaaacaatctaaagattcaatctctatcaaaataccaattatattcttcatagaaatagaaaaataatcctaaaatttttatggaacacaaaagactcagagtagccaaacctaccctgagcaaaaagaagaaaattagaagaatcaaataacctgacttcaaattatactacagagctatactagccaaaacagcatggttctgagataaaaagagacaaataggtcaatggaacagaacagagaacccagaaataaatccatacatctacagtgaacttatttttgacaacggtgccaagaacatacactgtggaaaggacagtttcttcaataaataataaattatttttaataattttatttattttatttattgattttttaaccaattatatttaataatttatttttaaccatttattctgggaaataataaattattttccagattatttcccagaataaatggttctgggaaaactagatatccacatgcagaagaatgaaactagaaccctatctcttgccattaaaaaaatcaaatctaaattggttaaaaacttaaatctaagacttcaaactatgaaaccactaaaaaaaatggaagaaactcaaagacattggactgagtaaagatttcttgattaatactccaaaagcacaagcaaccaaaacaaaaaagggcaactaggatcacatcacattaaaaagcttctgcacagcaaagggaacaatcaacaaaatgaagagacaacacatggaatgggagaaaacatttgcaaactattcatctgaaaaggattaataaccagaatatgtaaggagctcaaacaactaagtaggaaaaaaaaatctagtaatctgattcaaaaatgggcaaaagatctgaataggtggttctcaaaaaaagacacaaatggcaaaaaggaatatggaaagatgctcaacatcactgatcatcagagaaatgtaaatcaacactacaatgagatatcatctcactccagttaaaatggcttttatccaaaatacaggcaatagtgaatgctggcgaggatgtggagaaaggggaatgctcatacactgctggtatgattgtaaattagtatactcactagggacaacagtatggagattcctgaaaaaattaaacatagaactatcatatgatccagcaattccagtgctaagtatatactccaaagaaaggaaatcagtatatcaaagaaatatctgcactcccatgtttactgcagcactacacaaaatatccaagatttggaagcaacctacgtgtccatcgacagatgaatggataaagaaaatgtcgtacatatacgccatgaagtactattcagccataaatgagaatgagatcctgtcatttgcaacaaggatggaactaaacaacattatattatgtgaaataagcctgccacagaaagatacattttgcatgttcacactcatttgtgagaggtaaaagttaaaacaattaaattcatggagataggatgacggttaccagaggctgggaagaatagtggggttggggtgaaataaggatgattaatgggtacaaaaatatacttagatagaattaataagatctagtatttgatagcacaccagaatgactacagtcagcgataatttgttgtacattttcaaataattgagggagtataatacaattggaatgttcgtaacacaaagaaatgataaatgcttcaggtggtagataccccctttactctgatgtgattatgacacattgtatacctctcaaaatatcttatgtcccccataaacatatgtacttactatgtactcatgaaaatttaaaaattttttaaaaagaaaattacaaaaagggaaagaaaaccacagcaatctaaaatcagggaaacaatttactttgctaaatcaaattttaaggttgaactctggatcggtttgtgttactgtaatctctcttgaatttatcaaacagaaaatcattcatggtaacttaattatgatggaactggaaggcatagatacttgtgaatctcccacttaaggcctgaattattaataggtttctttatttagaataaaatatatatttggaaaaaaatctctttccttcattgactctcacctcccgcctgtaacagagcagtcaccaagacttgttcatcttttcacttttccgtttttactctatttcaaattcttttcttcctcttcatttctactgctgtcctcactttattactttgcacctggctatctactgcaattcatcttgctcgctagaatcctcctaaagcattccataaagatactcctacagagtatctttatgatactctcttgaaaaaagacacaataaacccttcactggcaattgattcagattcatgctctacaccctggtattcaaggcctctctcagtttacctcactgtctttttcctgttttatcattgattatttggtaatggattccacaattccatctacactagcatctatacataccacactcatctttgcctgtgtacctttggatatacagtcccatctagctaagatgcatcctcctttccatcagctaaaccaaattctatacttccttcaagtctcagtttaaaacccaattccttcaggaaaccttccttaaataagccagtcaacaattacaggtttacattaaagtcatattcaagttcttaattcctgtaatatattctcctcacctagaaacacttcagggtttctcaaacttgttcccctaggaaagtcctcctaagccatgttactcttgtagaaagagcatgagatattgatttaattcactcatacaaaactaggaacatccttgctagcaaaatgtaaatacatacctgtctattacacaatataaaatggtaaccaagagcatttgtgttcaagaaaaagataaccagttattaacatcacttgatagccattcctaaatttttacattgacaattacttgtttttttgttccttcattttagtgtcagtttgtattctatgagaaaactgatagtagtcatcatggcttgagataaaattaatcaaaagtcttaaaacggagaccacccccccaccaccccaaggaggcagcagtatataggtttcgagggttttgttggagtactggctcttctttgtgtgcttggaaagttactttacctctaccagcctcattttatttatgggagtaatacgaggttaataatactggacctgggaaaggattaagtgatatatgaaaatcccttattagttagcatactcttggtagctgtagctgatgggctttagcagaagcgcacaggtctctgttcaacactcttgcattcttctatccccaaggaagtggagtactgctaatgggggattcttctttgtctgatgtaagggccaaggaccagggagtgcagtctctttgttttcttttatcttcctttagagtcaaatgttaacagatccccaggttgctctctttcaggagcctggagaaggaaagtatcatgcagggtcttctcatccctgtctcttgctcaattactgtgaccctttgtccctttttttccccccataatttctattttcataattttctctttgtctctatcctatttcttaagtctctctctttttctattggtctctttctttctgtctctaactgtgtctctttattgtctgtctgcctctgcatctctcttcctatttctgcctatctttttttttctttctcaagctttctatctctgtctctctgtatttttttttcttttctttttttttttttgtgtgtgtgtctcgatcttcctccggttttatttatctcttactcctttaaatgttctttattatattatttgttattctcttctactctttcctaatttcaatgcagctttattttatttttaaaaattactatggtaggttgggcgtggtggctcacgcctgtaatcctagcactttgggaggccaaggtgggtggatcatgaggtcaggagatcaagaccatcctggctaacatggtgaaaacctgtctctactaaaaatacaaaaagttagctgggcatagtggtgtgcacctgtagtcccagctattcgggagactgaggcaggagaatcttctgaacccgggaggcagagcttgctgtgagctgagatcatgccactgaattccagcctggatgacagagcgagactctgtctcaaaaaaaaaaaaaaaaagaaaaaagaaaaaaaaaagttactatggtaaggtctgagtgttaggtttagccttagaaaaagtaaccagtagtagtgatgttcatcctcctatgtttcaaggacattcactctgcccttggataggaaataaattcttcttagggtccagatgaactcctagagttctgtgcttttgttttgttttgttttgtttctgttgatgggtaggtggtacaatatctcagcaaataattcatttttggtttgctttatgtacatgttctgtattccttccatggatctcaagaaaagattactactgtgacaggatacaacagacgtatttttggcaaaataatggtgatagcttatatttatgaaacaaaatgtgccagacactattttaagtattctccttttattggctcatctaatcctcacaaatacatcacgaattggtattactagtatcattgcatcgaggttcagtgtgttgcctaacatcatacactagtaagttatgtccagaccttatacccagagtctgggctctctctctctttttttttttttttttgagacggagtctcactctgtcgccaggctggagtgcagtggtgtgatctctgctcactgcaacctctgcctcctgggttcgagcgattctcctgcctcagtttcccgagtagctgggactacaggtgcatgccaccacacccagctaatgtttgtatttttagtaaggatggggtttcaccatgttggccaggatagtctccatctcttgaccttgtgatctgcctgcctcagcctcccaaagtgctgggattaccggcgtgagccaccgctcccagctgagtttgggctcttaaccactatgcccatgcatcttcaatagtatttattggttgttaggttgttattggtatgtccattgggtttaaaatatatatatatatatatttatatatatatttacatatatatatatttatatatatatttacatatatatatatttatatatatatttatatatatatttatatatatatatttatatatatatttatatatatatttatatatatttatatatatttatatatatatatacacacacacacacaatgaaacgacatagctgttatttaattttaagagtgggacattttcagatttactttatagaatacctccgtagtgatacaaattaagttataaaatatgatatcttttaataataggacacgtaatttttttatccgtcacaattcctgctagattagatgcttcctacttatggagtgagtgactcaagaaacacaaaaggatggatgaagccataattctggaatatttggaaggtaacagatgatgtgatagaagtaatttaggccacagaagattgactagacaagtgttcccagttatttttttctcagtctgaacacggttgtaagaatagtatagtaagatttgtttctattggccaggtgtggtggctcacgcctgtagtcccagcactttggcaggcagatcacctgagtttaggagtttgagaccagcctgactaacatggtgaaaccccgtctcttctaaaaatacaaaaattagctgggtgtagtggcgggcacctgtaatcccagctactcaggaggctgaggcaggagaatcgcttgaacccgggaggtggagggtgcagtgagccaagatcatgccattgcactccagcctgggcaacagagcgagactccatctcaaaaaaagaaaaaaaagaaaaaagtattgtttctatcatgaaataaaactaattggtagataaaacatgtgaagagtggtagaaataatttatgatatgaaatattgtcttattatttttaaagacaacattttacctaaaaataacttcctttcacttacatgaacacagtgtcatctttactgcttggttcatagcttaatctgcatgaaaacccttagtaggaaaaacagtaaaaatgcagctggattagtcataaataataatcacttccatttacataacgcctttgaaaggtccctagaaactcgctaacttttgaagtcatgcatcagattacaaaagcaaaacgttttgctaatgtgatgttgaggttacaaatttaaatacattgaggtcaccaaatgcaagaggtttggttctcattatgacatctcatccacataaacatgctattgttcttaatattctttatttaataattcaactgctactgaaaatattttgtctatctaagtatttagcacaacaaaattgaaacattgtgggattgttgtcttctacgtgttgctttttaaaattatagcataaactcggtccaatttgaattttgattgttgcctacagttatgaatgaaatgaaaatgctgatccagaagacaaatagaaattttatctgctcacttcagttacttttatttgcctattccctgcattcaagaatgaagaaggcacagaagggagagtagtacagggagattgtctatcatgtttgaaatattgtgttaggtgctttgcccatgttaattcatcaatcgtgttgcaattctacaaaataggtattggaatgtctattttacaagtgagaaaatgtctatttacaagtgacttggccaacatgaaaatactaagggaatgcaaatctaaatttgttagtttctaatgttgtctgccactcctctcactagatggggtagggggaacaacctactaagtatctctacctactgcctgccaatttctggaatcagggttgtaatttagaaattatgcatggttgtgagataggtcatagagaaaatgcaagggcaaaattttaagtgcaaagttaaaattttccaacatattcctcacaattgacatccaacattttaatttaggaacatatggagaagggtatgtgagtccagttgagaagaaagctgtggggcaaaaccatctgcttatatgcaccaattcagtcaccttctgaaaaaaaaaaaaaagcatgatgcagtttatccaacaagttcacatagcactgggttaagaaggtttctcaaataacagagctctctgtaatgaaaacatattttcagatgtcataacattgtatacaataatatataggactctgtatataatggagcaagtatccattttttccaatagatagaacttcccagaatcctatacactattaacacttagaattatgtttttctttttttttttttaaatagagcttgaaagaatctaagagcgattcctgacccactctgaaccttccagaaatgtgaacactaaggccagagaggttagttgaatggttaagctactacatgtcagagccaagactagaacctgggtctacctactctacttgttcagattttattgccagtttctgaccacggcaaatatactgtgcaaggctatttcagagttccagcatgctttacaatagaaaaatatttcagaaacgttttgatagttgaatcctatttgggataagctggaagagttcattatttaaagatatgtttttggaatccttttagtaagtaaagagttttacataatgtgaatattatctttcttattttaaggctaaaagtttatgtggttgtgttaaggcatttgtttaggaaaaagagtgtgtgtgtgtgtgtgtgtaagagagagagagagaggaagaggagaaacagaaagcaattaatggtagacatcaactacttgaagcagttttccactgtctttctggtatactacacttctctattttttttcttaccacatggaccactccttcttaattatttctctgctggatcctccttttttttttttttttttcagtcccgtaaacatagaaatgtgccagggctcaggcttcagtctttcttctctttcctccttaacatgtaggttatctaattgaagccaatataatctgtaggctgttaacttcaagcactgaactttctactgaaatctagattcatgtagctgacaatatacttgatttttctactttgttacctagtagctgttttacgttcagcatatcacaaccaaattcttgatcttccatctcccatctcctatgtctaatgttctttattgcactgctagtcacccagttactcaggccagaaacctttaaattattctggactccattctttcattcaggcagttagggaatcttgtctgatttactttcagatacagtacatccagggtctaacttcccaacactatcaccacagcacccaagttcaccccaagttcttgtgtggaaaatgacaagaatcattttgtttctctaattccacatttgtcctgcactctccattcacacagcagtgaaaattttctcctgctcaaaattctccagtgcgtttctaaaccacacttgaaatgaattccaaagaacttactatggtgtacaatgctgcttccctaattcattcttcggtctctgctcaattgatttctgaaaggccattcatgaatatacataatatatatacacatatataaaaatatatatgatagagtagtcttcccttacttgactataactatttaccttatttctctctgattaatgttctctgtatataattccgaattgcctcccccactaaaataatgtgagtttcatgagggcagggactttgttttgcttacttttttgctttgttttgttcacttctacacattaattaccaacctctaatagatatttgttgaagaaacaaactgataattaatgtatgttcttacatgtcaaatctcatggaccttggaacacacagataaaaattcagcatattaatataagtaattgtcatcaacgtactgcattttatttgcactattctataaaggaatgcacagggcaatttttcttgaattagcaacacaatctgtatgttttacctttacccttaaaccatatcaactaaacataactataaatgttgggctgattttaacatgtgcgtagatacacatagtcacacattatcccaaattaaggagcatggggaaatgaagatttctttgatcccagtggcttccgaataactttaaatggtaaagatggagattctataatccaggagcttcaagaaaactaattcaacaggttgtaggtaaccaatcaagcagggggcagaggtatctttacaggaagaaaaaatattatttatttggctcttaacggtattgaaaaattaagattttcatgaaagattgaattctaggtagaagtgatcatgtggtaaaaaataataaaaaggtgaaagaaagaaaaggaatttaaacagttgaagaattttttttgctcactctcaatatgatataacctgaagtcccaagattcatataagcaatgaaagcataacaaagaagaatcaattgatctttcactggcttctgtccaagcaactttcagtatatgttaggttatacctactgcaataaaatgtttgcaggcccagaaatctgtggctgtttatcttgttcctccattccaacaattttataatataaagcaacgaattatattttagaatagtttttttttttagataaaatatatgcttttggttactgtaggagatgtgcaggatgctatgggaactcataacaagggtgactaagcagtttcctgtggcacatttgtgcaaaagtgtgagtgaaatgtggagtttcagaaaggtatatcccaggagaagggtcgctacagctgagaaatgagaaatgcccagatagataactggctgtccatatgcagaagaatggctatccatatgcagaagaatgaaactggatctctacctatcattatgagcaaaaattaactaaggatggattaaagacctcaaactataaacatcttcacacagaacctaggaaataaatacccttcttgatatcagccttggcaaagaatttgtagctaagccctcaaaagcaatggcaacaaaaacaaaaattgataagtggggacctaattaaagagcttctgcacagcaagagaaattatcaagggagtaaacagacaacctacagagtgggagaagatgttcacaaactatgcatctcttcaaaggtctaatatccagaatgtataaggaacttaaataaatcaaaaagtcaaaaacaaataacccagtgaaaatataggcaaaagatatgaacagacacttcttaacagaagacatacaagcaacccacaaacatatgaaaaaatgttccacatcactaatcatcagagaaatgcaaatcaaaaccacaatgatatgccatctcacaccagtcagaatggcttttattaaaaagtgaaaaataacagatattggcaaggctgcaaagaaaaggggacacttatacactggtgggaatgtaattagtcctgccactgcggaaagcagtttggggatttcttagagaacttaaaacagtgctataattcaacccaggaatcccgttactagttatatacccaaagtaaaagaaatcattctaccaaaaggacacatgcactcatatgttcattgcagtgctattcacaataggaaaaacttggaatcaatccaggcacccattcacaatggactggctaaagaaaatgcagtacatatatatcatggaatacaatgcagacattaaaaagaacaaaatcatattctttgcagcaacatgcatgcagcttaaggccattatcctaagtgaactaaagcagaaacagaaaaccaaatactacatgttctcacttataggtgggagttaatcactaagtacacatgaacataaaaaaaggagcaaaagacgctggggactactacatgggagaaaggcaggaggcaagggctgaaaacctacctattgggtattatgcttactacctgggttacaatttcaatcacatcccaaacttcagcatcacaaaatatacctttgtaacaaacctgtgcatattctccacaattctaaggtaaaagtcaaaaaagagagaaagaagaaagtggtaaacatggaaaaaaaaaggcatagtacaataatgcaaaacagcaaaaacaaaaaaccactcagctaaagagcctgagtagtgggcttgggctgtggagagctgttccaatgagaagtaacaggatgactttcaaaaccaacatattagtttgtatgcaaagaagtccctgggtccagttttgatttcattgctttctgttttcttgggcatttagatacatgatcatggttttctctttaggtatacaatgtagataaaaacaatggactcaaggtctcaatgtaaagattgcattgaagaaaaataaacaatttgagtaaatattgaaaataatctgtgcaaaaactatagcttatcttaaagaaatctaccaaagttggttatcactacagatgcaaaatatagacaaccatgttctttctcagattcatcttctgtagtcttgtgaaatgtctgtccactccaggctgttgtacttttaaaatgatattgaaaaattaggcagcatctaagaaaaaagcaataaattgatggagaggaaacttgacataagattaaagagtttacattatttggtctggaagagagagagctgaagtgggatataataatactcttaaaaaatatgaagagctaatattaggaaaatgtaggccagctgttctttagctccagtgaggtcagaatatgaaaaagttggctgggtttgttgaaacatttgagagaaagccttgaaagtaaaggttacttatggattcctggagacaggagataggctgtcttcttaacaggagatcttcagataccatctgcttggatagatagagatagtcctactcagaggtgtccctttgtgctcagactataagctcgtagactcaattattctggtatcacagctatcaataattggtaaaggacagggggagagctcatttggaagacaatcaccagcataaatgctctgctctcagggaaatggaagtgccctttcctgagttccctctatggtgtgctcttcgttataagcttcccttgagcctttcacagaatgaggcttcctctgagaggctatttctgttttttattttttattttttatttttttattattatcttccatagaagcttattttcaaaacacaaggcaaaaagaagtctttaaaattctttgtcacattttgaaacatcggaatttgaaatctaaaatgtatgccttttaattaaaaaaagtctttcacacacatctaactcctgtaacatatatagtgctaactcattaaatcatcttaaatgtaactgtcctttgctaaagaagaaaagaaactcatgcgttcgacctacatatagcattcatttgcatatccatgcatatacacacacaccttattttacattaaatctgtctccatactatttatatttatacccatttgctgagtccaaatatatctggccatttttgaattccatcaagtatcctttagaaagtattcttaagaagttatacttggtaagactttgcaacaaagctgaattatggtggaaatcctatacaaatgctcaatctttccagcagcaataaattacaatgtcagaaacataaggtgctgacctcccagtgtgaacaaagagtgtggggtgagtgaaagggataaaactcttgattagaaatatttttcttgaagaatacagcatttatgcagagaaacagccatgaataaagtctatcacctcctgatgtttatccatataaagcacaaagtgatttttcttcaaggaaagaaaaaagaaaaataaaaaccatccactttggactaatacttaacattattcatgtttaatacacctgatgactataattttacattgtcttttttcctgtaaacaaatgaagacataatctatttttctttttctttctttctttcttttttttgttttaacaaagaagaagcaaatgaacaatcctttgagtgagaaaatgttctgtaagtttagaatacagacgtgactagtgggctatgtgtaaatttctttgaaaaacaacagcacactgcttgtgctggattgtatttttaaaagtcaggatcaaggattggagctatgtaacatgcttcacaacaggggagcagttatcaagctcctgaactccaccaaccacgacagaagcagaacatttatttcattctgttcctgcctccctccctctaaaaaatcccaataaaatatacctgcaataggagaggattttcacagaaactgaacccaccatcatctatctcagtgaatcttaacccttgatgcagtttgcttttataaactaccaatcacccaggccccactcaagactaattatttgggaggcctaaacattgctattttttgaaactctgcagatgattctaatgtgaagccaggcttgggaactcttttgacacccactttcatgtccctgcgttaatggcagtaaggataactcagtgatgtaagctaactatttaaatcctgttgtgagattcttctcttcctttaccactgaatagtccctttactacatcagtagtcaaatcctttccttgacaaagctgcactatgacaatagatgaatcttgactctctcctggctaggtttcatcacacacagggattttcctttcatataactttcacgtaactttcatccttttattatctaaatatagtccccaaattttctggggctacctactcctccagaaaaacactcagatttttaaaatagagcattctaggccctctgtaatctggcttagagtttctttccaagttgagaatgctttattccacagcatggatcttcatttttttttatagccttgtctacattcagtatttccttactgaacgccttactgaagcctactttctttaatttttccttctgttctgtttttgaaatgctgactctgctcagccaaaatcaaaccctgtccactataagtcaaccatgcaagcaccctctcatcaaatcactgtctttagtatttattttgcggcaccatacaatttgcatttattgcacgattccttgtatctttaatcagttttgctcctcatgctattgtaagctcttcaaagacaagatgtacatctcatctgcagctgaaagcacctggcacagtgtctcacacatagtaggcactcaatactcatttgttaaaggaatataaagtgattaaatggcacagagcttacatgatctcatatcttagtggcctaatgctgagtatgcaagtgctgggaagtgctgtctgaattccagtgccagaattatatttatgaggacatatggaggacaaaacagaaaagaatgctatagtcccaaatgaaaaaaaaaatatcattctcagaaaaagaagaccattctttaccttagagtgcatttagatcttcagaagatcacaaagaagtgatgaaaagtaataccttagcaggggaagaaccattagttacatgctccttaaaacgtaatgctaatcatttgttctgtaaatgaaacttcaataatctttattttaattccagcaccctgagagaccagtcaagatccctccatcctgcaggtgctaaatgtgtgcttttaaatatgagacgggtgccagaatttgctctcaaaatggaagaagttatgtatctggagactcatgatgcctcatttgcttctttgtgtcctgcttgccacttctctctctgtctgaacaaggaagatgtggggacacaaatgttccatatacttcttctccctaataaggaaaatttctactttcctcctagaatgaatttagattttgatacagcatctgattgaattttgatgtttagccttttcaaaaaaatcaaagggcatgagcataatattggtgcagttttgagaagatgatagtggtggaccttttgccctaatctctggccatttagaattcagcaatgtgatggcccagaagaagacccaggaaaccagtcatgataaacccattatctacatcaatgattgactcagaaaccaaggactaagccaataaagcttccgaaatgacagtaaatatttgagaaacggacacatagttggatttgagccaataaggtacagaaggaattgagcctagttatttctaaaacaagtgtttttcctttttccaaacttttataagaatttcagaagagaaagagtctctcagcatttctcactggacatgcctgaagaagcatgtagtcttaattgctactgacatcatcccataaccacaatggaaaaggactggagatattgtctgagaggtaagataatagagaacagccattggatcaaattccctgaaagtccacacctccttctagtcttcctactatgtgagccaatgaattttgttttaagttagtttgagttgattttcttatcacattcagcccaatgtaccttatatgatcatggcaactgagacaggtcctcgaggaagcacgtatctgattccaaatgccaaacacactcactaagccaagacatacttgctttcatattatcttattgtgacaatggctattgacacaacactggctttaacacaggaatgccttcattcattcatttatcaaatattcattgagcacccatcatgtgtaagacacagtgaaagatggcagaagatgaaccctggaaaagtttttatgagtgctatgagtgtttggaaggacagcaggatgctatggaaacataatggggaaacaacttacagtgagggctcaggagaggggatctctgagaaactgacttttacttcaagatttgatatatgagttgaggagagccaggaaaatagtggggaaagaagaaataatacatgtaagtcctggacaaaaaatggagtgtaatattttggagaatttgaagagctcaagtggagagagagtgagaggaggagagcagcgatcagaaatcaaaagccttgagaatcatcatggtaggcattttgggcttcatccaaagtcttgaaacatcacaagtgcaagtatcagatgatatatcagaagattaacatgattttaaccatttgcatttagtagttgtttaaaataaagtctatatttagatgcagtaagttgggaattaattttaatgaaagaatcattgagtatatcctttggaaagcagctatatttcttatcaaatcctccactaagccagatggataaagtttcatgatcttgaaaacttttgagtgctttagaatatttaaaaacaagtatttttctccagggcatgtagacggagttgctaaaacattctcagttttataaaattagttaaattagagcttgggcatgaaaatgttattccaacagtattcatcgagtacctcacctatcatgtgacaagtgtacaacatcatctttctttccccagtcacactgtgcacatgttcattcatttaccaagtataacggttgattttacagaaatttaccaatattgtagggttaaaggcatgctttcagaaattagatgccttttagttcatattcccttggaaatttactagctgtgtcacctgggacaagtcacataacttctctaagcctcaatttccttctttgtacaatggtgatagtattagttctaggtcatgagttttgtcgtcaggaacagataaggtagtacttattgaatactatgtgtggaacaaggcaaacactgagaaatattagttattatcattagttatcatgattgctaattcataatacagttagaaatgtgtggagctgcagtgtaatggtagaataactgggctgccatacttaggaacctctggtatattcagagagagaagtggtcccagtaacagggacgtgtactaggacattgtgctttgcgtaggcagcaagatcagtaaaagaaatccaggccaaattctgacatgggtacccagaaatctgacatccaaggttcaaagtgcagttggaagatagaagaagatgtcgtgcattaaaaacagagctgaagatcaaatattgaagtattgaagaaagcattctagctgccctagctccattttaaagatctgttagtcctgaggcagtgactcttcagtctgtgggagaaataaaggctcaacatagactctggctgaagccagagacctactttctagcttaatcctgacattcataaactattgaagctggcaaattatgtgtcattttgatgattcagtttcctaatcagtaaaatggtgataattataagtggtttgtgtaccacacagcattgttgggttattaaatgaggtaatggataagaaagcacttagaaaattccaaggtactatatgaaatcattaataaatctattcattaatatttatgaagttttatcttgttcctgggattgcaatacaaagatgaaaagaaaaattctattgctttaaggcactcattgtctactagggagtcaaatatcaacaatcaattacaattaatatataataagtagtttataatataatgaaataccagctgccacaaagacatgcataaggttcagtaaaatccaaagtggaaggaacacctaagttgcctagggggacaggggaagacttcagagaggagctacattgcaagcttatatttgatttatgactgcgagctttccaggtggacaaggaaaagaaaggatgttccagggacaaagggcagatgtacataaaacacaatggtatctttgtggattgaattagaaacaaaagttgcaagtaaatcaagccaaaggccacttgaggtcttacattctttccccgtgtcatcatggtcatttcagttgcagaacatgttgggaaatgactgaccttgatcctggaatactcctcccatttggcctggttctgcacttctttccactaggtcagagttagccttgcacccgcaaatatcactgtctctagtagtcaacagtgagcatgccctgtgctctgacttccaccaggcacatgttttacattcatcaaggcagttcttctgcatcaaggttgaggacattaactgagcaaccactgtggctgatttcatcatttgtgccccatagctgaacagaaggttttagtttccactgcctgctaggctacttaacccttctaagcagaaatattcagacaaagaagcccaactgttactataattttgtcgatgtaaagacatctgcatatgacttcacagcatctggcactgtttgaaacacagaatccaggactgcagtttccatttctctaagtaccccatgtgacagtttagaaaacattcactcaccatgacagcatgaaaaccccacttccaaacaaagcaaaataagaaaaagtatgtattctgcagcaataattatataggaatatatatgaaatttactgtatgtggaaaaatccagtcaatgcgatgtcatttcatgtatttttaaatcatctcccctttatgtcaacatgggttctcataaagtatcttttacattggagcatgtaaaaagagccatttcttctttctaatgcatttaacaaacttttatttagctcttgttatgtgctaaccatcctgttggacaatgggaacaaagatatgagactccttcaaggaaggtaagacgtaagtgaaaaaataattacttggtgagaacaagtcatatacacacgcaggcatcatttcctttgcagagccactgtgtgtggttttgatgaggtggtcagtctaggtgctctgccctctgaacaaccctgacagagaaagcacatgattcagagaggctaatatgtgccaccttgggactttcctatgaaaacatgcaggacagattgtctcttttcacatggattggaaggtgggaagatggtactttggatgtgattttggcagtcatcttccctaccaaatgactaaagataagacatgggggagggaataaaaaaggagaaaaggaagaagagagaaagagagagagagagagagcgagagcactcttaggacatcatttaagctttgtatcaagggtgtccatgtaaaaaattgatttatcacttaattacaaatttgtttctttgatatctgaatgtggggtactaaaattaccatattctaaaataacaaattagctgagtcaaggagggctgaagagaaaattcatctcttttatggggaatttggttaggatgaagaaaagaaactggttaatctacatgtattacgttttaggactcaagctaccaaaggtaaagctttgaaaaactattacaggcatttcttgaaaacagtatggaatcatctgataacactgaggtgatatgaatactcctttaaccggcaatgtggctcttaggaactgatgggcatgcacatcaggatatacacaaaagatttcccagcagcactgtttgtaatagccttgagctagaaacaataaatgtccaccaagagtaaaatgtataaaatatacaatggaataccagacatcaatgaaaatgaataaactataacaacatttacatggtagccttactgtcataatgttgaaagatagaagctagacataggaaatgcataaaatatgattccattcatttacagtataaaaaaggaaaactgagacttgtaatttgggaatacttgatgaaagtaaagagaagcaaggaaatgattatcagaaaagctaggatatagttacttttcagaggacattagtggtttggaatcaggaagtaatacatgggaggattttaggtattattatagcaaggtttaattttcaactgggtggtaatacgggtgttcacatagagttactcatggaattacatttatacatgttttatgcattttgtatgtgttatatttcacagaaaaaaacataaacaaaacatgtagggatgttggattctatcaaaaactttttccatgtctattgagatgaccatatggtttttgttttttaattctgtttatgtggtgaatcacatttattgatttgaatatgttgaacaatcttgcatcccagaaataaagcctacatgatcacaattaactttttttttttgagacatggtcttgcactgttgcccagtctgaagttcagtggtgccaacatggcttgctgcagcctcagcctcctgggctcaagtcatcctcccacctcagccttctgagtagctgggctacaggcacacatcactatacttggctaattattttttgtagagatggggtcttcctatgttgcccaagctggtctcaaattcctgggttcaaggagtcctcctgcctcggtcttccaaagtgctaggattacaggcatgagccattgcacccagcctaaattaactttttgatgtgctgttgagtttggtttgcttgtattttgttgaggatttttgtgtctatgtttatcagggatgttggcctgtagttttcttttttgttgtttctttgccaggttttcatatcagggtgatgctggcttcatagaatgagtcatagaggagtccctcctccttgatttcaatttttggaatagtttcagtagaattggtactagctcttctttgtacatctggtggaatttggctgtgaatctatctagttcagggctgtgtttttttttttttttttttttttttgctgattcaattttggaacttgatgttggtctgttcagtgtttcaaattcttcctaattcaatcttgggagattgtgtgtttccaggaatttataaatttcctccctattttctacttcatgtccatagagttgttcataatagtttctgaggatattgtctatttctgtgggatcagttgtaatgtcactgttgttgtttctgattgtgcttatttagatcttctctttttgtcattgttaatctagttagtagcctattgatcctgtttatccttttaaagaaccaatttttggtttcattgattctttttatggatttttggtctcaattttattcagtttagctcaattttagttatttctttcattcttctagtttggagttggttttgtcttgtttttctggttcttccagatatgatgctgaatcattaatttgagatctctctgactttttgaagcaggcatttagaactataaactttcctcttaccactgcttttgctgcatcccagagattttgttttgttgtgtctctgttttcacttacttcaaataattttatttctaccttgatttcattgtttatccaaaagtcattcagaaaaaattaatttgcatataattgtgtggctttgagaaatctttttggtattgatttctatttttatttcactgttgtccaagagtatggatggtataattttgattttttaaaaagtttattgagacttgctttatgaccaagcatgtggttgatcttggggtaattccttgtgaagatgagaatatatattctatggtgatgggtgcatgtagatgtctattaagtccagttggtcaagtgtcaagtttaagttcaggattcctttgttaggccaggcacagtggttcatgtctgtaatcccagcactttgggaggccgaggcaggcagattacctgaggtcaggagttcgagaccagcctggccaacatgatgaaaccccttctctactaaaagcacaaaaaaataattagccagttgtggtggcacatgcctatctcagctactagggaggctgaggcaggagaatcagttgaacccgggaggcggaggttgcagtgagctgagatcgtgctactgcactccagcctgggtgacagagcaatactctgcttcagaaaaaaaaaaaaaaaaattcttagttttctgcctcactgatctgtcagtgaagtgttgaagtcccccacttttattgtgtggctaagtctttttgtacttctagaaatacttattttatgaatctgggagctccaatgttatttgtgtatatatttaggatagttaagtcttcttgttgatatgaatcctttaccattatgtaatgcccttctttgtcctttttgctgttgttggtttaaagtaaggaagattccttaaaatcgtaagtgtcatctatgacaaacccacagttaacattataccaaatgggcaaaaactggaagcattccccttgagaactggaagaaaacaaggatgcccattctcatcatctctatctaacatagcatcagaagttctagccagagcaattaggcaagataaagaaataaaaggcatccaaataggaaaagaataagtcaaattatttctcttcactgacaatatgatcctatagttagaaaaccctaaggactctgacaaaagactatgagaactgataaacaattttagcaaggtttcagaatacaaaatcaatgtacaaaaacaagcaacatttctatacaccaataatgatgaagctaagagaaatcaagaatacaatcccatttataatagctgcacatgcacaaaaatacctagggatacatataaccaaggaggtgaaattgaagaacttcagaatactgctaaaaggcatcataaatgacacaaataacagtccatgcatatggattggaagactcaatattactaaaagcaatctatagattcaatgctattcctatcaaatttccaacatcatttttcacataattggaaaaaaactgctaatattcatattgaaaaacaaagatcccaaatagccaaagcaatcctaagcaaaaagaaccaaaccaaaggcatctcattacctgacttcaaactatactataagtctacagtaaccaaaacagcatggtactggcacaaaaacagacacatagaccagtggaagagaaaaaaaaaagcaacaaaaaacagaaataaagtcacacacctacatccatctgatattcgacaaagttatcaaaaataaccagtggggaaaggactccttctttaataaatggtattgagacaactggccagccatatccagaagaatgaaactagacccctatatactatatacaaaaattaactcaagatggattaaagatttaaatgtaagacctcaaactataagaatcctagaaaaaaacctaggaaatacccttctcaacatcagccttggaaaagaatttattactaagtcctcaaaaacaattgcaacaaaaccaaaacatgacaaattagacctattgaactaaagagcttatgcacagcaaaagaaactatcaacagagtaaacagacaacctacagaaggggaaaaaatattcacaaactgtgcatccgacaaagatctaatatccagaatctataaggaacttaaacaattgaacaagcaaaaacaaacaaacaaacaaacaacaaaacaacaaacaaacaaaataaataagcccatgaaaaaatggaccatagacatgaacagacacttcttaaaagaagacacacaggtggccaataaacacataaaaaaatgctatcatcactaacataagagaaaggcaaatcaaaaccacagtgagatactatctcacactagtcagaatgacaattattaaagtaaaaaaaaaaaacaatagatgttggtgaggttgtggaaaaaagggaatgcttatacactgttggtgggaatgtaaattagtcctgccactatggaaagcagtttggagattcctcaaagaacttaaagcagaattgctatatgactcagcaatcccattatttgattggatatgaaatgaaaacaaatcatcctactaaatggaaagaaatcatcctaccaaaaagacacatgcacttgcatgttcactgtggcactatccacaatggcaaaaacatgggatcagcacagatgccccattaacagtgggctggataaagaaaatgtggtacatatataccatggaatactacatagccataaaaaaataaaaaccatgtcctttgcaacaacatagatgaagctggaggccattatcctaagcgaattaacacaccaaatcaatcttggaggtcaataactaagaacgtggtatcaaaaaacaatagaaaattaatgagtcacttagtatatggtattgaaaatgattcataacatgcaaaaaataaaactgaattcttactgaaatatacgtatgttatttatcataacagcaacatttatacaatgctcagtatgtacaggcaggcactttttttaaattaaagttttagggtacaagtgcacaacgtgcaggtgtgttacatatgtatacctgtgccatgttggtgtgctgcatccattaactcgtcatttagcattaggtatatctcctaaagctatccctcctccctccctccaccccacgagaggccccggtgtgtgatgttccccttcctgtgtccaagtgttctcattgttcaattcctacctatgagtgagaacatgtggtgtttggtttttttttccctgcgatagtttgctgagaatgatggtttccagcttcatccatgtccctacaaaggacatgaactcatccctttttatggctgcatagtattccacggtgtatatgtgccacattttcttaatccagtctatcattgttggacatttgggttggttccaagtctttgctattgtgaatagtgctgcaataaacatacgtgtgcatgtgtctttacagcagcatgatttataatcctttgggtatatacccagtaatgggatggctgggtcaaatggtatttctagttctaggtccttaaggaattgccacactgtcttccacaatggttgaactagtttacagtcccaccaacagtgtaaaagtgttcctatttctccacatcctctccagcacctgttgtttcctgactttttaatgatcgccgttctaactggtgtgagatggtatctcattgtggttttgatttgcatttctctgatcgccagtgatgataagcattttttcatgtgtcaggcaggcacttttctcagtgttatttatgtattacctcattcagttcttaccataatcttattgggttcattagtactaccaaccccattttacacacaaaggaaaagttatttaaaggttaagttatccaaattcactggattagtaagtgaaggagccaagactgtgaatccaaatagtgtgatttcagtatcccttgtcttaattactatactgtcaatgcaaaattataaattaaacagtaagtttgtgtgacatagatatgagaaagtaccttccaaacaaaatccaaaaagcaagatcattgagacaaagaaagaatggattttgtaaaataagaattaaagatttttattcactgaagattgaatggaaaaagttcacaaaaatcagatgatagcttggtagagaaaatttaatttgtagtgtctaaaactgacaagagatttataattagattattaagcaagtccgattaattaagaagaagatagcaactcgattaaaaaataagcaaacataatggacatttaataaacaaaaggaaccactcctcctcctcatcccattcctccctctaaaaccatttataatgaaatgatgcccaaattcatatcgttagagaaacagaaactaaaacactgacatcacttttcactcatggtattaacgaaaattaaaaagccgaatcgtgccaagtgttggcagggttacaggtgccctcatcaaattcctgtagatgttatagactgagacaaccatcttggagaatgatctggcagtcctttggcaaattcagaacatgcacagactatgaccatcaaagccactcctgagcatatattccatataaacttttcctcaaatatgaaaggattcatatgcacagaagttcattagtacattgtttgtgttattgaagagttagagcttgctaggtaaatgtaatagtttcatattatacaagactataaatcagatcaaagcaaaggtaacatacatccagcaatatggatgaaatttcaaaacaatgctgaacaaaaataagatacagaatgagttctatgttttataaaaaagtatgcaaataaaacttattagaatattggctattaggggagagaaatgggaatggggaatgaagaaaaaagagaataaataaatggatggatcgatgggtaaataaaactgaccaatattgatagtgagccatcagaatgaggagtatgatctcatacctttgcccctagggtcaagaaaagtataaaaaagtaataagaaagcaaaatcaacaaaagacccagactttttatagagtttacattctaaagcaggagatagatatccaactactaattacaacattgccttttaaattactattttgattagtgtcatcatagatgaaagcatggtgtgttatgagaatgtaataaggtgtaaaagaagattagtatttatctcaagtagaaaccactagatgagtgtttgtgagatacaggaaattggactaggagttaggtacttattccacccaattttaaaactaaagggtatgtggagttgccatgtgttcagtttataactagaaattctagactcgtttattatttttgtctagaaacaatatatattaggcaaatttgagcatgagtgttcttgctcattctctaggctagtgctatgggcttatcagcataatttacatattaaataaaagagcataagccatatcatctgtatatctgcagaaacactatgacagccctacacagtagagctgaaaatagcatcttttcaaaaatagtgagttctaaataatctctgtttaaagatgaataaccagaaagaaacttggtcttgacttgtgaaaaaattctgcaaaaccaaagaaagagtccatcatccaaaagattataaaaagtcaaccatctaaaacttgtttatttaaggaaacagcagaaaattatttttaaaagtgataatcaaatacaagaattcatgaattctatgagacagcaaaaagagacaaggaaacaataagctattaaaaaagacatagaagtggagaaaagaaaaaaccactaaaaaccccaaattacaactaaaaatctgcttcagagcacataaaattgacattacaaaaactcaaatcagtgaggtcaacaccttagaaactctttcaaaaccaacctaacaaacagaaaatctaagttcaagcaaaattttcagttgtttttgataaagcaggacaaaataaaaccaaaacacatggaagaaaactaaaagatgcaatacaggtagctcatctgaagacatacttctgagttgaagagagctttgagtgtgcattttacaaaacaaaacaaaacaaaacaaaacaaaacaacaacaaaaaccaaacaaaaaacacagaattaaccggagatatgttctaatgaaatctttaagttataaaagtttttaaaaagcctaaaagcattttcatagaaattcaggatatcaacaaagaaacaaatatcaaactgtcacaattcttttcttctataactttaaaatgttagaaaacaattcttcaaatgtgtcacattatttgcaaatatatgtaattttcaacgaacattttaacccaagtaatttatattgagtcaaattgttattatatacaaaaacaagaaatactttattagatataagttaacttagaatttatgtctttactgaatatcatgagccaaagacatactttagctggccaagatatagacacatataatccacaattgagaaaaatgagaaattaaaaaaaaccccaaaaccttcctgcctgttcaaagtcaatataatacagtggttaaatactggcttgagcttgagttcacagcctggctcctgtaattacttgatttctttgtatttcattttctttatctgtgagatgggaaggacagttatgcctaattcacaaagttattgtgaatattaaatgaattgatataggtaagtgtttaggatgaggtctgctacatagttaaagttcaatgaacatgatctataattacatgtttagattctagtggcaaactattgaagtttcctcttttgtaaaatttgtatggggaaatcatcctatctaacgagatgacagacaatgaagtcaaacaataataatattaataataattaaatatttattgaacaattaatatgtggcaagaattatatatatattactttatttaatcctgataataaatctgaaaagtaactactattattattctcattttataaataagaaaaataaggccagaagaataagccatttctaaaatcacacagcttgcaagtggcagagctaggataattcattaaagtatattattcatattttcctacaccagatttgaatcaagctatactatctcattgcatacctcttttactttaaatactcttatcacaaaatttaaattatttaaaatagcatacaattctgtggcaggctagttcagagggaaaaagatatttaaatggcctaacatgaaagaactcaatccaggagacagttctgatagcattacctcacccaatgaccaactaacctcacatatgcatctatgatattataccttaccatatgcgttcttgatatgtctctctttctctttcagtagactaatacgggactggtgtttaataaatgcatgttaaattttagttgagagccactgataacatttcctaaagaaacttttcaataactctattagacatgaataaaatacaaaagaatgacaaaaatatcgcaaagaagacgttaacacatcctgattcaaaggatttttccccaaaagtcacatttaacatttccccaaaagtgacatttaaatgaatcaaacatacatactaattgtcttagaatacatttacaattaggaagaattagtgtagaagaaaaagaagaaagggaagaggagagggaaggagggaaggaaaggagataggaagggaagaatgaaagaaaagaacaaattaaatggaagtgaatatttattgaggactgttagtcaataaccttgatattaatatgcattatctcatttaattcttataaaaacacttcacggatgcaaaggatttcctttttcagtaagaaaactgaaaaccaagacaggttgaaaacttcctagtgatgcttataaccaagtacagacttttgttttaatctacatttttcccaagaacatttaatgaatggaaatctaccaaggtttgcaagctgtcctgagacataaatatgtgccatagataaatggtgacaacattcaactaggaaacacattcctattctagttaacttgtttttgagtggatcaatgttttagagacgtttaatagactagtagataaaatttaagtttctttctgctttcatttgcaggcatattactcttcattgactgcccccagggagaaaaaaaaaaaacactttcatagctgaaagatattattgagaagtatgtgcattatgattcaaattaaagaaattgccttttaaaaatattcagctttgattttagacacaggtgtcaaatgtatagatttgttagatgaatatattggacccagggtgtgagcataatactcaataggtagtttttcaacccactccctcctccttctctcctccctctaatcaactgccaagtctatttttttccatatttatgtccctgcgcgctcaatgtttagctcccatttatagacggacacacaggatttagttttctgtttctccattaatttgcttaggataatgacccctagctttaaccatgttgctgcaaaggacatgatttcattcttttttatggctgcgtagtattccacagtacatatgtatcacattttctttatccaatccaccgttgataggtacctaggttgattccatgtctttgccattatgaattgtgttgcaatgaacatatgagtgcatgtgtctttttagtataatgatctatattcctttgggtatatactcagtaatggggttgctaggttgaatggtagctctgttttaagttctttgagaaatctccaaaatgctttctacagtggctgaactaattaacattcccaccaacagtgtataagcattcccatttctctgtagcctctccagcatttgctgttttttgacttttaataatcaccattctgagtgatgtgaaatggcatctcattgtggttttgatttgtatttctctgatgattagtgatgtagagcattttttcatgtgtttgttggctgcttgtatgtcttcttttaagaaatacttctttgtgtcttttgcccacttttaatagggttgttttttgcttgtttaattgtttacatttcttatagattctagacattagacctttgtcagattcattgaaagtatgttctcccatactgtaggtggtctgcttactctgtccatagtttcttttgttttgcagaagtgctttaggtcccatttgccaacttttgtttttgttgcaattacttttggggacttgtccataaattctttgccaaggtcgatgttgagaagggtatttcctaggttttcctttaggatttttatagttcgaggtcttacatttaaatctttaacccattctgagttaatttttgtacgtagtgaaaggtaaagatctaatttcattcttctgcatgtggctagccagttatcccagcaccatttattgaatagggaatctttttcttattgcttgtttttgtcagaaattgcctttaaaaaaattacagttctactagtgtaccaactcttgggtatactcctttttaattttattttatttattatactttaaattctgggatacatgtgcagaacatgcagctttgttacataggtatacatgcgccatggtggtttgctgtacccatcaacccatcatctaggatatgctccttttaatgtgctacttttcgaaggccaaggagctattttcaggatggcatctgttgccatcagtagaggaatggccatttcccttcactggattatctgaattgaccatgtatactgcttacgtttattaatcctctttaagcctttgcttactctatgtcatctataaccgactttagaatcacattaaaagaataaagatgcagacagtaatagtatatactattagtatataatagtatataccactaatatacattaacataccctatgcaccaagaaagatatttgggccaggtgtggtggctcacacctttaatcccagcactttgggaggctgaggcgggtggatcacctgaagtcaggagttcgagaccagcctggccaacatcgtgaaaccccgtctgtactaaaaatataaaaattacctaggtgtggtggcgggtgcctatattcctagctacttgggaggctgaggcaggagaatcacttgaacctgggaagtggagattgcagtgagccaagttcctgccattgcactccagcctgggtgacaagagcaaaactctgtctcaaaaaaaaaaaaaaaaagattttcagagactgtttatcaaagtagtttgataacatgatgaagggaatggatacatattgaatatattcttgtgtgtaaataaacttctactttacccatgtaaacaattttagtcattaggagataccaaaaagtaaaaatactgatgatgttattgattcctaatgataattaaacaatcactttgtttcaagaacatttctatgtactcctaactctgcttttcagttgaagaaactgaggcctaggaagattaggtaacttgtgtgaagctggtaatatattattccattgaaaagaaataattgattcatttaatctctatgtacatataattacaaaaggaagatctaccttgtctatttaattacatggtatatagtaaaaatattcaaaatgtttagatatgttttttgaaatctgaaattaatgttatattaatgacaatttcaggaaaggactgagttttttcctatctgcaaagaataaacattgaactatgagtaagcctcataaaattacttatcttgatgtatgtatttattcagtgtaataaacattttggataaatatgtaactctgatactttttagatatattaaaacattttaaatctcacatatttcctgcagaaaagatggaaattacagaaaactatattgagaaaccatatatatatatatttgtatatatatatacacatccaaaattgatattaaatgataaattttctctatgctagctttcttacttagcattatatcatgacagcatttgtacttcaaaaacatgattttcattggttgcttaataatatatagatatgttgtaattaatttaagtaatccctcatagttgtacatttaatttgcttccactttgccattactgtaaaacatctgtaagatgatacgtttttgccttcactttgaaatatttcctcaggatacaactaagtatttttctggggagtcctaataaatgcaggatttacgtgaatgtcattatatctcacttcacttcccttctttttctgcacccttgctatcttttgccctatctggggaaagttcaccatattgtttgtgtttaaactatttgatagttagggtaatcactactgttagttttgaatctttctctggtaattagtacagtgttttgcacatagttattaagaaatgtttgtggaataagtgacctagttcatgatagaactaggacctaattaatacttccaaatatgacttggtaaccactatcaaacactaggcttcatatgttcttttgctgtgccaagttaataagcaaaaggattatctgagtgataataattagaagtccattttagcaactcttctagtaaataaaatggaaaaacatatataaagtttgtgcttccacagccaatacaagtatttgtttaatctggactacatcaagtatttcctagacttaaaacaattgcataagattgtcagtgtaaagaaaagttttgtctaattcaattttggccttgtgttctttctttttctgtactgggaaatctaaccattgataacatttgattcatattttccttacatcctctctacagtctgatttttaagagccaaatgtgaattttaaatattttcctctcagagtaacgtaattggagagtattcctaaatggaggtggatattgttgattttttggagtggttaaagcagtacactgtacttgcctgttaaggtgaaggaaaagatgctgttttttctacgaggatgatgttcctatttttatctctaaccctgacttttcttcaaagcttcagttctacttctccatttgtctgttggacatttctaccaagatggccatttggctctgcaaaaaagagccatccaaaaatgaactctttaaatcacttcccaaacttgcttctcctgagatatcttctgttacgcatcctcttaaccatccatcaatgatcagttaccaagtcctgtcgattctgtgctggtaatatctctgatatctattctctttcctctattttcccagcaacttcaaaaattcgggcctctattagtctctgctggtttaactgactaatttaccgtcttcaaattttaaccttttgcaaaatttatcccactaagtcttgccagattcacaatttcaaagcataacttggatcctatcatccctaatcaaaatactttaaaggcttccaagatctcttaaagtcctgacctgggatattctcccctctatgatctggttctatttagtatttctaaattatcttgttctagctctcttcatacattagttaacctatgcctcatttaaactaaattattggctgtttcccataagggctctatgtgctgttattgaaactatcaattctttatgaaaagttccctttcattctatcttgtcatacagtcatcatcttgaaccctcgaggttttgtttaaatgtcatcccaaggaaattttactctctattttaataattcataaaaatttatctatactattctgtaacaaggagaatttttttttttttttttgctagtcctcagttgtccctttgtttagaagaatcccctggtacacaacttagagatagaaagtgaggtgccaagggcatatcttggaaggagacagtaaagagagttttaaattaacttatcaaagaaatgaggagatatttagggctgggaaagactgagggaggtagaaaatgtaatggaaaaacgtaatatagcaggtcttacagagaaaggtggccagtaaaatactctcagttacaaatatccaatattcaattttaaattgtttatactgttgtcttttacatgcataaatgccttggggtgtttcattttgtttggatttaaagtaatccaagcaaagtgttggcagggagaagaaagaagaaaagcattctaggagatgagacaagtaggagatgaaattccaaggaaacagaaactggaagccagagtgaatttgaatccataagccttaagtaattaacgtaaattttggggaagggaggtccttgccattcccacacaatgtggaataagaagcctaagctggatttatctcagtctcaaagggtagcaaggcctcagctgatgcatggacaacattcttcatcgccaacttactttctgctggcattatggttgttactgtgtaagtcccttatcagttctgctggagtacaaatgctctgcactaagtacccaccgttgtactttgtaaagcttagcctggtagttttcacatattgggctctcaataaatatccacggaatgaactattgggaaactatgaggaagatttaggtacatggagtcagcattattagggtgcctctatgcaaaattgagaaaggcgccctctttaggcagactcagacctatcagagttagctggtgaaatgaccaagtgcacgcagccttgaatcagggtaagggtttcgtggatgcagcataagctggagctgaaacttactccccaccaccccacttctccaccttggcttgtgccaggcacaagtataacctacatagccttggacggcaatactgctttggagggagagacacaaggaacaatggaggaaatagtagttgccacatggagtcttaagtaatgctgctaagtgaggctcagaaaacgaaaaggacctgattttagagaagcaaaagctactatatcttacctgcttcactttactgctaatgattcctgaaaacgtctaacactttgcaaggcaatgcacatgtagttatttagagttgactttgaacgacattcatttgaatccaatgaggctgccatctttattctttttttaatgtttacagtcatggttactttaaagagtcttgtgaagttgaaaaatctcaactttggcaacagacccaaacttgtaattcatttcttgtatgtttctttttaaaggttaaaagcagttcagttccttatgtacaggcacacaccaggcaagcctgaagttgtttaaattcaaaagattatttttcaaatttagataattttagataattcttaaaagcatttatagctaacaaaattattatgaaatattcagaagttctctgaagtattcctaaaaaactgaacaataaacctaacagataataatatcatgatataaaagtctattggacattgggcttggcaatggttttttttggatatcacaccaaaggctcaggctacaaaagcaaaaataaatgaaactacatcgaactcagaagtttcttcacaacaaagaaaataatcaccaaatgaagtggtaacctatgaagtggaaaaaagtatttttaaaccacatatctgataagggactactatccaaaatttataaagaactcttacaatgcaatagaataaaaacaaatgactccacttaaaaatgggcaaaggacttgaacagacatttctccaaaggagacataaaactggccaacaattatatgaaaagttgctcaacatcactaattatcagggaaatgcaaattaaaaccagtatcagatattacctcacaaccataaggatggcttttatcagtaagacaagagataacaaatgttggtgactggagaaaaaggaacattagtacactgttcatgggaatagagattggtacagccattatggaaaaaagtatgaaccttcctaaacaaattacagcaattcctcttttggacatatacccaaagaagatgaaatcaccactttgaaaagatatctgagctcccatgttcactgcagtaatattcatagtagccaaagtatggaaacaacgtaaatgtctgtagatgagcaaatggatacagaaaatgtggtgtgtgtacacacacacacacatacacactggaatattattcagcctcaaaaaaagaaggaaatcctgccatttgccataacttggatggacctaaaggacattgcattaagtgaaataagccagacacataaataaaaatattgcatgatctcacatatgtgaatttttttaaaaaaagaagtcaaatacacagagatagagagtgaaaccatgtttatcatcagtgggggtgggggcgaggaaattaggagctgtgggacaaaggatacaatgtagcagatatgtagatgaacaagtttagagatttaatttacaacatgtggactaaagttaataaaattgtattatattagggatttaaaaaaataagtagattttagctgcttttgtcataaaaacagaaactacgtaagatgatagatatgttaatctgcttcactatagtaacattttactatctatatgtatccataataatgtattgcaaaccttaaatacatacaataaaatttatttttaaaaagtctattggaaaataacattaggtttctagaaattttatcaacattctcaaggatattaaagttatctcagaaaattccccaaggacaaactgagagttacattttcctaaacagatggaatttttccattagagaaatgactctggcattccattaggaagagactgaacaatgtgatcataaatatatgtagccccaaatccctaccttgaatgatagaggctaaactttccaaaagtgaattctgtgcttatagctatttctcaaagccaatccctggggacttacggtgtacatttatgaatcatgtagggcaaagggtggttccaaacaggaaataaaagagaccatgaacggataacatatgcattttttcaggccaaaattccattgtttagatttgcatgaagataatgggtataaaactgacattgacatcagcctcagcattatgagtatgggcctcctaggagttgaagctgaaagctccccataatctttgagcagcatgctgaattacttgtctccggcacctcgctaacggaatttcttatctttcttttattttcaaaagctcagtgctttcaggatgctgatctaatattggggttatttgtcaccaaaatcagtttataaaatgtattttgttcttcaatgaaaacacatctgctgtatacctaataaagagctcagcatagagattaaaaaaaaagaagctagtactacttatttcactgcttttattagtgggatcataattatttttaggaaaagtttttaatttaaggggatgtctacacactaaataaaggattgttaatatgctagaaattattccaaaacatatgttgccatttgattcagttctttagtctgatttttttttaagtaggtatcgtttagtaaagtcaagtgtttacactgaagggagttccatggagccactggatttggattttcaataagttgaaaagaatcatgaaaacatttgcaaatcatctacttggctaggaatctttgtggagtgaaagtggtgcaactgtatgtggcaacccagtgcttattttttctgttaatacaataaataatagctaatctagaaaaaaaatgtatgagcaaaaaaggagactgggctgggcacacagaattccatttctgaacttcaatttctttttctcctccttataggatttttttttgaggactaaatgagataatatatgtgactatacataatataattgcaaaatactatgcaaaaaggcaatgtgattatttggctttctaattttctacaaatttggaaaataaaattctcttgctagaaggaagaaatagaatggcaaaataatgttaaaaatcatttgtctttttgttgtttggaatctcttttctgttgattttccactgactctctaggatgatttaatctcgccagagcaaaaggtagatcactttttaaaagacttactataaatgaaagttaaggtatgggtaagaaaatttgtaacttaatagggacaaaagtaagaaaaaggtcaagaagtgaatggcagtgaaaatagaggtatttcaaagtgaaattaacacactgaatttaataatttcacattgttaaaagaggaaaatattactacacaattatcaaattacacatgtgatctgattgacttagtactgaatggtatttcattgaaatgcacgtattccaatggctcattgtagaaattatataaactctccttccattgtatgctctgggtttgttccaaagaccatgcgttagcttcttttagggcataaactttatagattttaaacttcatttatttccctctataagtctcataagggaagtctttctctctgttttcccaacaagaataactttttatcttaagcgaatgcttccccagcaattcaatactgaaatcagcattttaatcactgtaaatggattcttccacatttgtaccatagtgttcaaatatggcatctaagtatgaatcttacttaaaaaaaaaaaaagagaatgaaaatatgacctaaagggaaaggacagaaaaaaaaataaaaaactccacaatcatcatcttataaatttgtttttataacttctgggataaagggtttctaaaatacttctatctcacctatctagttcattcctatctgcaagttcactattttctttttctagattatcaattcatatttagcaacctgcatgtctttagaatataaatatagctaaatattatttattttccttatttttacaatattcagaactgcttatattcagaagctcctttttgagactattcacatgtaaatcactacccagcaaacattatgtttttggctaataatgtagcttccataagataatgtggtctctctgcatagggatacactctagggctgacatttgagattgttgaagtggatcatcaattaacctcacttaacaatgagttgaatcataccatgttctattactctttaatgtactgtggaaaaaaatctatttgatgggatacactttttctttttttcataaatcattttttctttagtctgttttcatcatgagttatttaacattttagtggcttttcatcacactagtaatattgtgattagcaataattagaatggccaaaattaacctacctggatgtgaatgaaatcaaccttctttatatcatgaaaatttcattgagttattctagcttgaagagatacagatgaaaataaaatgcttcactagaaattatattagatgacaatgtcaaataagtagggaaaaaaacctctgatgccagtcaaaaatatactcaatttataattttccacccttacctcttatgttttcctgtagtaatagcaagagtctcaacccgagttagtgttcaatacgttttctcttaagtgacttttttgtgtttaggaaatgtgttatttattttatacattttcttccccctccccccgcttttgttttggagaaaaagtctcactctctggcccaggctggagtgtaatcacacatcactgcaaccttgaacttctgggctcaagcaatcctcctgcctcagcctccagggaagctaggactgcatgtgtgctccaccatgcctggctaatttttttttcttttttactttttgtagagacagggtctcattatgttgccaaggctgagctcaaactcctggccttaaagatcctcccacctccacctcccaaagcactgggattacaggcatgagtgcccagccaattttatatactttcttaatctcatctttactataactatctaatctaggtattatcattgcttttttacatgtgaaaaagaggttcaaagaaattaattcatatttttagtaagttttatatctgagtcatacactcagatcaaaagaccaatattttaaaattccaaatgaacttcttacactgcaaatatatttctaaatagtggcaatttctatactataacgtatatttagtatgtgtgttttctacttaatatagaacatcatttaaaaactacatgtgtatattggaagagcctattttttaagtcctaattgcagtgacatcataaaaacaatacaaagacatgtaatttttattgagtgagatattaaatgtattaaatacagtttttattaaagttaaaattttaatttatcaatctactttcaaacattttataaatttttagtacaattactggcatttaatgaaacctggatcataaaatgtgccctaagcggaaaggtaaagaacagaaatgaattgttttttaaaaaataaataagtacgatgaatctttaataacaagaacctccaattttgatagttatgcttcctctccacatatatcaatataaaaaaatttaaattatttgaagcttaacacaaaattataaagcatcatactgatggaaattgaaacctaaattatgagctgttctgaaacatacaataaattccttgggatgagacgacttctagaagcacaagcaaggaagcagtggtaaaatccatttttcttctgacttctcaggcacattaggctaattccagaaatagattcagtcagttggcaagttaacctctcactcttgtcacagaagtcatctgcagccttgagtttaactgttttctttcttcctggtcttggtcctttatgtagtagcccagtatttatggtgccacttgggaaatttatctatgataagaatgtacctctgaaaagcatttattttacaaagcttggatgtgggaatcatatattacataaaatctctttaattcttttaacatggattcctttttctaccatggagtacactaagtcactcatttgatggttttgtgtttacaatcttatttgctcaggacccattttatttgggctttggaaatgattgaatcaagttggaggaaaatttacttttgatccatttaattctaacctttcttgcaagctcaatttttagaatctagttcaatgggctgaaagaaaaacatctcgcaacagacagtttatttcttgtgcgatcagaaatgctaacagtaaatatgagcatatttactttaaaaatttagatttgaaatacatattgtttagaatttcagaagtttttaggagaacaactatcttacataccaaggatatactaggcatatgtatgcatttataaatgttgttgataaatactattttgtggcagaactagatgattggatgctttattcaatataaaaatttttatgtctcatatactgtaatgaagctacaacttatttaaaacacattctgatacttaacctttaataaattattgaataaccacgaccaacatagatccattaatacaggttgtaatagctaaaagcaatgacaggtaacattcgtgtggaatttactgtgggtcctacttcattctgaaaacctggcttatttaaagagtttaatcttccaacaattctaaatacagtatggttgagcaatttgctcaagattatacacgcagggatagtcactcagtggttccttccttggacatgtaaataaaatttgtgtgccttttacaaaaaaaaaaaaaaagattctacaggtgttaggtggtaaagctgggatacatttcctgctgtttccagaacccaacgtctatgagaagttatatatgctttgattaaatttcctattttccacaatatattgtgcacctatagcctgaggttaatgaagttattgaatgcctcttttaaataaaatactggttagaagattatgttcatgcacacctaattaaagcaaactctcatgaaaatatccactgaaaaacaaaattacttttcttcttttccattagctaaaatatacatttttgctctatcatttccattatttctttcaatctactgtgttcatcaaatattagctataaaagcttttttacagtagttgatttaaattataaaactaactttttgagtctgttggaaaaagcttggaaggaccttgataattcagttatgcatggattagtgtgcagtaataccaaccttcagtgcaagctctgcacttaaactagattttatagcatgagttgggtgcagaacagtttttgattttgctacaggtatctgtttctcaactgtctatgaactctccagaagaaatccaaacattattgttttttgatggttcatatccacactttgacttcatttccaatctaaatagatattattttttatttatggaagtgatgtagaatcattgcagaagggttaaaaatgtagagaagaaaacagaaccactaaaatacaaatcaagagttaacagttgttttcattttgtataattttttgtgttttaaaatatatatattatatgcatatatgtcatatttttttcttattttatatacctcataaatagtttagtatctttacttttcattcaacagtttatcataaaaatctacttttgttaatttaaaataaatatatagagttatacagtatcccttcttatgttttgacaatttttaatacttagaaccattcctatatttagccctcataaataattgcggtgaacatcttagaacacaaattttgtaaaaactttgaaaaatatatgctcactttttagcctgattaactagattgggaagtgccagatacaaatgtgtaagcattttaaatgtttttgcatgctaatatcaaacgaattatttctactggcagagtttgagagtgcccatctcaagccactcttgcagttattgaagttttttttcagtcatcattatttggtgtttgaaagtgatgtactactttaacaattgtctgtctctgaggactaaggaggctgaatatttttatgtgtgtattacatattaaaatttcttttcctgtgaattgcttgcttcctggtttatatttgttatttgcaacccaaagatggtcactaataaataaaccataaacacatgtctcttagaaggttaagacatcactggaattcatccacctgtagcatgttgtcaaaataacctaagcttgaagtgtattccccatttactaaaaggactatcacaggaaagatatttattatatatttatttgtcattagtagcattaggtttctgctgacatgtttcaccagatgtgagacgattggccagggtgaaaggtatgtgtgagtgtgtgggtgggtatgtgtggtgggtggagaatgaacctcattagggttcaggatttcggctttcttaacagcatcttttaacacaaatatttccagcaggagcatgcgttgcagtacattaacacaatgattactatgctaatgcagctccatcttagctttcctcattcctttttgcagttttagaacaggcataaagacaataggtggtggtaatcatttggagagaagagaaagaaaagtgctgtgttcatgtgtgttttacccaatcaccaaaatttttgatcacatgatatgtgccaggtgaaatattaagtgctaatgtgtgaatgcgtttgtgggtctttatgtatgtgtgtgcttatgtggactagtggtttagatttggggtgatatatacaataacacaatgaatgtggaagtcatttaacacgggtagcaccacatcagcctttaagaatgaagttgaatgaagttgaaattgtgcaacagagagaagttgaaaggaagaagataaacaaaatttaaatggctgtgataaatatatttagttggaaatgtctaatataaaggaaagacaggtaaatcaggactgaaggtctaatttgggaatcctcagtttgaaggcaatagttaaagctataaggctgaatgacccttgtaaagagtactgtggagaggaacaggtagctgaagatggagcaataatggtagaaatatgagggaagtggagtgaaagcaaaagggagagagaggccgggggagatgtaaggaggaagttggggagagagagagagattagaaatgtagatgcttcccaagaatagtacaggtatatgacagctaagataggaaggcatttcaaggaggtagttgtagttcatattataaaataaaaatcaaagatagtacccacaccctcctcttggactgaagaaagtgtgactattggtggctgagtaaaggcataaaaaacccaatttcaggtcatttaatatctaaataaaatgattaacttaccgttggccatgcataattgtatttaagatgtttaaataaagaaatatggagtccaattaatctgtttctttaactcccatcaattgttgcagtgacatctattagggctatttttctttaagaaaaaccgtaagaaatcctggctttaataatcaaagctatggatggtatctttgattagtgttcattatttagggtcagataataaaatgcttgatttaataactttatttgttgatgtgacctgaaattttatgttactggagataaaaacaggttttagcagttcctctgttgatgggctttatttccaaaaagaaatctcttctattaatttacatagaaatgatttaacagtgtaatccctccattttcattaacattacgatttttttaggctctccttcaacacattgttttatgggaagaattaaattttgctcctgtgtctctttcattacacgaagtttgttttcatttgtctgtgttgtggtgttagttggaaatttaatgtgcttttctcttgaaaacaaggagacaccaatcttttcttctacacagaattgttccagagaagtaatgtcagtccttagagatatcattcagaagaaaattggcatgaatgaatgtaaattgacgcattcagaattgggaaagctagattcagtttattctttactatacaaatgtttacataagttcttttaataatattccgatgaatttcataattaatattagtagttgttttgagtcacactcaggatttcaactacctatgtctcagtttttttattattgctatatgatagttgtatatatttttggggggcacatgtgatattttgatacctgtacacaatgtgtaatgatcaaatcagggtagggatattcatcacctcaaacatttatcttttctttatgttggaatcattgcaattctcttctacttgttttgaaatatacaacacactactttaactataacttccctactctactattgaatactagaactgatcccctctaactgtattttcataccccttaaccaatttctcttcattcctccttccgcttttgcttctcagcctctagtaatcaccaatctattctctatctctatgaaatctattttagctcccacatatgagtgagaatatgtgatatttgttttactgtgcctggtttatttcacttactataatgacctccagttccgtcaatgttcctggaaatgacaagatttaattcctcctatggctgaataatattccattgtgtatatataccacattttccttatacattcatccaatgacagtcactgaatctcggttttttcatctgtaaaattatgtgactaaatcccaccctgattttaaagggtttggaaaggcatgaccaatatttaagatatagaaagttcactctttaaaaaaattataagcgattcttacttatgtctttatttgttttatgctcaaaagatagataacgtgctcctaagaattaagaggcacagtgccagaaaccgtgaagctttgcaaaaagaaacattaaggaaattaaaaagaaatcatgatttaatcttaaaatgaaataaaattgcccatataagtttacgtctacattttaaattacaatatttactcagacagttctctttataagggctataaagaaacttatttgaaaatgaactatcataaaaccataataatctagacctcatttaatcagaatttgggataacatggatacatttggacttgtcttttcccattatttgtgaagaaggtatttgttaagcaaacttaacagtgccacaaaactttaatatctccaagtacttccatgcacactaagagtacaagtttacatggaaaatctgtgtccacattcaactggcctctggacttaaagatctactgaaagaagagagattgcaacacactaaaggagcaagggtcccacttagaaatagccattgttaaatgattctgcatcagttacgtggaatatggtgagatataatccatttggtgaaaaagttcataggtttacagaatatgtgcatctgcttgtaccgaacatgtaattcacagagagcagggactgaacttatcaactgtgtaggtagcacatagtaggttgttggggctcagaaaacaaaataccaaagtgaaagcctcagaagtggcctcagaagctctttctctctgaccctcccctgccctcctgtccctggcccctcattctgccccatggcaagtcacagaaacaagaatacctcttccctcaggtgagtcatagaaactagaactccttttccccaaagccagccaaaaaaactaaaaatattattctcgccttcccctgcctttctgtgtaggagatggccataaagaaattgatgtaccttgtttgatagtagtcataagacccccattctggagagaggctgccccatacccaggaggaaggaatgcttcagagaaaggccaggaagaatctgaacagagaagcctttctgggtttcctaagtcagtctactgccgtaagattatactcttttggtccaagcacattgctacatggctgcctatacttcattgaacctaagcataaaaacggattgataggccaggcacagtggctcatgtctgtagtcccaacactttgggaggtcaaggcgggaggaccacttgaggctaggagtttgcgaccagcctggccaacatggtgaaacctcatctctaccaaaaataaaaaaaaaaattagccaggcatgttggtgcatgcctgtagtcccagctactcgggaggctgaggcaggagaatcacttgaacacgggaggtggaggctgcagtgagctgagatggcgccattgcactccagcctgggtgacagagtgacactctgtctcaaaaaaaaaaaaaaaaaaagttggttgatagttttccctgggtcatttgatcttcatcctgaaagctcccatgtcacataaaactaggattaaataaatttgttgtgcttttctcttgttaacctatcttttgttataggagtgtcagctgtgacccttgtaatgggtaagactttcttttcaccccctacaaggtgctcagtaaatatttttatgaataaatcccttgccttatttaatttccgttaactctaatctattaatgtttattgaggacttgtttagcaccagataccctcagtcctgtatgaaggacttgtgtatctacatattcctagttcatttgtgtgggagtaagatgaaaaacacaggtaaatagaggcttagatttgccacaaaatggatcaggaaaactattttccttaatttttttctaattgaaaggctttgagtaacacattagttctgtgcaatttgcctcttagggtaattttaattagaaggtaagtttgccctgtccatcagatcaatagtatttttaaatagctaattatacatttgctagttcataattaagatttggaaatctgcctatatgtcttaattcagagaaatgctaaattaaatatgtccctcaatgcctaatttgttagaatacttctaaagaaatggcaattagctaggactaaacactaaattttaaagttatttttataagagacatttgccatagtaatatagaattgtggtgttcagaatgaaaaaaatgaagaaagaatgttctggaaagagtttgagagtgagaaggatggtgaatttatagcccaaattatcctatattccacatttaccttcctttaatagtctcctgtttggcggcccaaacaaggactctgatgtctgatgatactattatgacagacaaatttgctggtggaaataactatttaaccctgaatggctatagaaggaaagaaatattctaaaatgtcaagtgtaaacatatcaaactgtaagagtgacaccccaaattgacacccttctttctaaggaaagactttttcacactggtttctccattcttgaaatcttgctgataacttacattatactactaaaataaagagtgtgatcaacctttgttaaaagttaatttgtaccctggtgtgcagactggaggcaaggaatgggggttagctaacgtttgaagtactctaattgggactattcccagcaggatggttgctcagaggctctcactctagagagaatgtcactgtaagaccttcggctattctattttacttctcattaatactagaggtttggttatttagcacaacgaatattaggcatgaatttttatggtgagatagggttcaagatacatcgattactataaaataatatacggctactttgagtcttgaacaaactgtgctcaaaaatctagtgatctcaagagcctacacctttcaaaatattgcactggatttaggattttctaccagtcctttgcttaaatatttatcagaggattttgttagctggttctgactagagataaattatgccacgccttaagtgaaacttaagtgcaaggagcagttagagggactaaagggacagaaactgaagacctcatcaagcttggaggtaatatggctgtttccatgccagcattcctataaatatttgttggtgaggctgattttggtttgcaatttgctttcaaattacaacacactctataagattacagaagacaggacatacagttttgtcttcctgagccgttggaattctcttgactaactaccaaagatggctacagttgatcaaatagtgttacataatcttatctcagaaatcaatcagaggaagaataattatgttttatgtcatatgttttatgcacagatagggacttatttaaagtctcataggtatggagtaggggccattcccttggcccagagaacctggctctaaggttagaaccattgtcctctgtttacaagctgtgagccccaggacaggttgcttaactatttcctcatttgtagaatgagtttaataacagtatctatctcttactgttgttttggaaatttaaaggattaaaatatgtgaaaattttggcttataaggatgtatacagcaaactatagctactattatcacaaaatggacaccaatgtcttgtgctctccctactttgtgtagcgtttttcccattaacaattctgttgaaaatttgtttgtttctacttctttgtctgtctataatgtatgtatagtctgagcaatatgagccatatgatcaaatgactaatagaatgcaatgatatatttggatcaaaattttcctaaaattttcagggaaaatcaactaagatgattatatttttcctgagcttaaatggaagaaaatcttatgtatcttagaatttttgagttcagttctgttcaacacagtctactaattctattgctttgctttattcatgcaagtcctgatgaaggaagagtttctcagacttttcagcaaagaaatttttctttctttatgaaatgtttattaagcacctgttattacacactgggggacccgaagagttatacaacagctcatttataaaacctagcaggagggacacaatgtaaacatgagcaaatgacaataaaaatttcatttgaaataaatgtaatatttgataagtgttcaagacatttagaggagggagtcatcgttgcatcccaataattttgtgaacaagcactgaattggtacatgtggaaggattcaggaaacttttacccacaatgtaggatttaagcaacactttgaagaatacataagattcagaaagatgctgagtagaactagatggagagggagttcaatgaacttaaggatctctgttctagaaacatcttcccctctttctgtctcagtctccctccctcaaccaactcacttattgctttaaataacttgcttaatttgactttgcattcgtactgaaattctaccaaatagggatgcacttgaaaggaatgacatggtcagcttctcatactatgatgtgatttagttagttctttaatgacaattgccaggtctgtttgtagatagttccttcaacaatgcctagcacaatgcttagtaagcagtacatgtcaatgaaaacaggtttcttttatttggtttctttaatcaaatgaatttttactctaacaggttactgagatcaataggacaattattcaaataaaagagggaaacaaagagcaataaatttgagaatatgaaataattaagtggctagaaagcttagagggagaagaaaagggcagtgggaaaggattttgccaagaatggaagatcaggatagataagatggtgagcagaaattaagacaattacaattacggttggagggggggtgttgtttgtttttgtaatgagtgacacagtgagggaaggcaagggaaaaagcatgaataaagaagagtgaagaatttatgttgggtaatattgggagataaatttggaaaggtagcacaagcctgtgctgaactgtggaggatcatgctaaagaatttggatttcatcttatatgcaactaaaaatactcttagttgttctacttatatcctactgctcaaaattaagctaaagggaactttgcagatattctgcaacatttggggaaaaatggcagtgattggtgtaattttcaaatctccccaaatctgccctccttccatagttgaagcaagtaaaagacataagagcaagtaaaggaaacataggagacatgggggtagaaaaacctgttcaagaccagaagaatggaatgagagaagctctacatgaaaatttataaatttattagatatataactggcatttttttaaaaggaggagaaacttaatagatataacaaccaaatgcaatattttagacagtgaaatttggacctgtactaggaattaggtaacattaaataattactttattggttgtgataatggcattatgctatgtttaaaaatccttatctgttagaaatacacattgacctattcacaagtaaagtgatatgatgtctgaaatatactgtaaaagaatcacattttcctcatcctccaagttgatattaagaatataatattgcaatatattgataacattgaaactcgctgctgggatgctgactttcattattctctcttcttatggaggtgtttgaaaatttccacagtgggtcactattttacagtttgacacatgaaggtgtatggggctcttacagaactttaggatttgacaactctctctacaccctcttgaataagcattattcaagagaccatttccatatcaattaatgtccagaacattcatacagagagttgaaatcgggttcccctatcatagagagtgccactggcttctgctttcctaccagagaatcagagcagagctcattcacagaagtttcaggtttcacagtgttatatactggttcctaaaaattctatttaggatacacaatactagtttatattttaccatgttatgaagtataaaagtctatttccatgagctgaggggcaaactgacacaatgtgacattacagaaaaagttcaaagagcaaagtctcttccttttagtaaacgtacttctagtacaatatatctgtagcaattaataaatgatcataaggagttacagttgtcataatggaatgactgaaccataaaatattgctgatattaattcaaaataggaatgctattttgaaaaacagtttggcagtttcttataaaggtaaacatacactttatatgcaacttaaaaatgccactcccaaaactccaaggtatttacccaggaaagaagaaaacttaggttctcacaaaaacctatattcaaatgactacagcaactttaattcataatcactccaaactgtaaacaatccaaaattccttcaactggtgaatggataagtgaattgtggtacatccatacctggaatgcttttcagttaaaaaataaaaacaaaaatgaactactgatacacacaacaacatggtaggatgtcaaatgcaatacactaaatgaaagcagccagagtcaagggttacgtaatggatgattacatttatatgatgttctggaaaaagaaaaacgtaggggcagcaaacagagcagttgttgcctaatgatagaggtggagaaaggcattgactgcaaagaggaatgaagggatctgtggggtgccttaccccatttgggctactatagcaaaatatctcagactgggtagtttataaacagaaatttattgctcacagtaaggatgggaagtccaagaccaaggcaccagcagattcagtgtctggtgagggcctgttcctctcagacagcaccttctggctatgtcctcacatggcagaaggggtaaacaagctccttcaagcctcttttataaggacagtaattcctttagccaaacaggctgagcctcatggcctaatcacctccccaaggccctacctcttaatacttttacttaatacttttggggttagatttcaatatatgaattttgggggatataacatttggaccatagcagagggtgatggaatttttctatatcttgattgtgatattggttttatgattctatgtgtttgtcaatacacagaattacatgctaaaaagaatatattttatgtatgtaacttacacctcaatgaacctgactaaaaataggtttaaacaatctaaaagaattcttcctcagtttcctgcactagagtctcatttctttccttgtttctttatttgtgaaaaagctcaatggcagcataatattctatcatttggacaaactgtgactagcaaatattttttctatttgaacatttaagctatcttttaacttttcattattataaataaaagtcagatatacaggcacaccttgtattatggtgctttgttttttctgcttcacaaatattgtgtcttttacaaattgaaggtttgtggcagtccttcatcaagcaagtctatcgacaccattttctcaaaagtatgtgttcacttcatgtctctgtgtcacatttaggtaattttcacaatatttcaaactctttcattattagcatatctgttatagtctgcgatcactgatctctgatgttactcttgttatctagttgttgtggggcaccacaaaccaagttcataagagacagtgagtttaactgacaaatgtgagtgtgcgttctgaatgctccaccaaccggccattctcccatctctctgcctcttcttgcacctccctgttcgctgaaacacaacaatattgaaattatgcccattaataacctataatggcctcaaagtgttcaagtgaaaggaagagtcacacatctttcactttaagtcaaaagctagaaatgattaggcttgatgaggaaggaatgtgaaacacccagatagctgaaatctaggcctcttgtgccaaaaagctagtcaaactgtgaatgcaaaggaaaaattcttgaaggaaattaaaagtctactccagtgaatacacaaatgataagaaagtgaaacagccttattgctgatatggagaaagcttcaatagtctggatagaagatcaaaccagccacatttcctcaatactaatccagaccacagccctaactctctttaattctatgaagtctgagagaggcaaggaagctgcagaagaaaagttggaatctagcagaagttggttcatgagttttaaaaaaaaagctgtctccataacataatagtgcaaggtaaagcagcaagtgctgatgtacaagctgcagcatgttagctggaagatttagctaaaataattgatgaaggtggctacattacacaacagattcaatgcagacaaacaggcttctattggaagaagatacatctagggctttcaaagctagagagaagtcaatgcctggcttcagttcttcaaaggataggctggttatcttgttaaggactaatgcaggtggtgacttttagtggaagacaatactcatttaccattccaaaaatctcagggcccttaagaattatgctaaatctaccctgcctgtgttctatgaatagaacaacaaagcctggatgagagcacatctgtttagcagcatgacttaccgtgaatattttaagcccattgttgagacctactgcttagaaaagaaaaatttctgtaaaaacattgctgctcattgacaagcacctagttacccaagagctctgatggaaatatgtaaggagattaacactgttttcatgcctgctaatacaacattcattttctagcctatggatcaagaagtaatatcaacacttaagtcttattatttaataaacacattttataaggctagagctgctatggatagtgattcctctgatggatctgagcaaagtaaatctaaaaccttctggaaagtattcactagtctacatgccattaagaacatttgggattcatgggttaaggccaaaatatcaacattaatagtttgaaagttaatggaatttggaagaagttgattccaatcctcacagatgactttgagaggttcaagacttcagtggaggaagtaactgcagatgtggtgaaaacagcaagagaactagaattagaagtggagcctgaagatgtgactgaattgctacagtcccatgataaagtttaatggatgagcagttgcattttatgcatgagccaagaaaatgattgcatgagacggaatctactcctgggaaagatgctgtgaacattgttgaaatgaaagaaaggatttataatattacacaagttagttggtaaagcagtggcaggatttaagcagattgactctagttttgaaagatattctaccatgggtataatgctatcaaacaccatcacacacaacagagaaatctttcatgaaaggaaaagtaaattgatgtgcaattgatgaagcaaacttcaccgttgtcttgttttaaaaaaccgcaacagccaccccaaccttccacaacccccagcctgatcagtcagcagtcataagcatggaggaacaaccctgcactagcaaaaagattatgacttgctgaaggctcagatgattgttagcatattttagcaataaactatttttaattaagatatgtacattgttttttaagacaatgctatcaaacacttaatagactacaatagactgtgaacagaacttttatatgctctaggaaccaaaaaattcatgtgacttgctcttttgtgatattgctttattgcggtggtctggaactgaacctttaatatctccgaggtatgcttttaaaaataaataatcagtattatttcctctacagatgtgttaacatggctgggaatatttcgatagtcctttgtaactgatattgctactttgtttttccaccagagccaggcctggtggattctacagaaacaagaaaaatatgctcaaaacaatcttaattttcagaaatgtagatttctattttgatgaccgcagtctgtagattgagctttgtggaacagggggatggggtgttgacagataaagaaaaataaatcctctcaacaattttctaaaagcctggctaaactagggtcaaagtatctgagaagcagtgtaaatattccaatgagtttcatttcctgatcagacatattagtttccatatgccagagtcctggtggcaaatttacactctgtccaaatgctgcttttatgggtaactggaggctctgtgtgtagcttcagcatctgtaataatggttttgcacaagagatgtgtctaacaaagttgaaagtatagataatttcattgattgctttaaattccaccattggcgctgcatgtggagctgcgttctgaatcactccagatgcacatccttttagaacggcagtcctgctaccatccaagtacccataaaggtctttaattaggtaatctccaaatagcaacagcaccatcctctgactttattaacataaaatctctcttttgcaaagctctttcaatgtgcaataggggagaattcctggatgaagatgggcaggtaagagtaaagagagaagacagaaatggaaatgacaaaacagataaaagcagagtaatattgtggttcatcttgaggtgcttgttataacttcactttaagaaactttaacctattaacctttttaaaaaacttggcctctgctaaggatctgcatcactaacaagaacatttatttattaagactctctgtgtctaagcatttttaatgacccccattgccatggcaccatctggacacctgacattttaaaaacaaacatttcagcataattgatgaattctaccttagatggctattatgcacatctgactgctaaaaaacaggcagctctcattccaccaaattaaacctcgccaagcagaaatatcacatagaacaatttaatatgggtgtattatgaagaaagcttaacctgaagagaccctctataacaataaaggtgatggattcacaaaaaacaaaccacaagaaataaccaggtggattttggccagagtatactcacaatggagaggtagcagggagatgtcagtattgcacctgagtcataccttaaccatacaaacagctacagcaaagcacgcacagccagcaaatgacccatccatcgaacagccatgattatcctgccttccactataagaggacataccctttgctaatactctctcaaatttctgttgattgtggagaaaggtaggggaattaattaaaaaaggcaccggttactaatgaagcacttttgattcatgcatccatttatttaacataatcaacagaaacgaatttatatatgaagtactgttctaggtcctggggttgcagcaataaacaagaaaatttccccacatgtttacacttaagatccccttggagcctggggaaggtttagcaggagcctttgagctatctgtgcatttgtgaattaaatattacttttcgtcttgtatggatcagggaaccaagactctgacagattgagttacctgtacaagtttacataactagtaggttacagaaatagccctaggatttaggaccccaacatagctcagttttgcacaatcaggaagcttgcttcaggtaaacaccttctgcctcatttccttcaggcacctctagataaatggcaccacaggcttctttaggttcaatacttaaagctctggatcgggttcaaaaatcagagttttaagagaagttggtggaactcagggctcagaggttcttcatttaatttcagctaggttaggactttgagaggttttttggactaccattgtgagctacattgctgctctaggaaaaatacatccagagttctaaatgagtgacttacaaatcaacttttggagcctactaacccgctcttttgacttttaactctctgatttctaacatctacttttccatgcaagtttccagctcatgccatcctaaataaagtagaaactaggcacatatttttcttctttgattcttcctatttctttcagaattgttctcatgcaataagcacctatctagtttctgcccacctggcttccaatatgcaataattgattactaccactagctccctgtgtgtgtgtgtgtgtttggggggttggtgtcgggggtgggggggtgttgggagttcaagcccttatattacagcattctgaaactctaatcaaatcactctaatcatcgtaacaaaagattttttccctgttttacaagaatttttaacatagcctgattcataataccttataccatatattatctagaagataggatatttatctccagagaaatggtaaggtaaagagagaaacaaaatattcaatataaaaaactatttacccaagatttttcagaaaaatcacacttgtagatcttaatattaatgaggcactgaagtatattaagaaatgcaacgtacaaattaacataatgaaaagaattaaaagaaagctaagtaatgatcaagtcattaggcagcccatactaaagaacaatttgcagaatcaaaattcaacagacggatacaccactattagtgaaaaaattgattattctattatataaacttacttttgccatttttagaagttatgcctgtttcttttataattaattatgtgcctataatggtagagaatttatagtttagataaacctatacaaatagaattctccacaccaacaataaggccctttatgatgtctaatttatattacttgatattttatatgtaactagatttcttttttccagtcttaacaacttactttttggcctcaatctggttactgggcttccgcctacttctttgcacccaaatttgtgtcttagaaatttgcttaatatcctaatccctctaggaattgaggaagttgttcttgcttgaccagctctttccaggagattggagccctgctcattgcacccatcaagtaagggtcaccacaatgtaccaacgcttccttgtgctatctccctccttagattttactttcagtggtatgttggaccaagctcttactggcttgcaatagcctgttgttaaatgttcaacaattttgtgagtgggactactgctggaaattaatcaccgtagaagtatttaacccaaagaaatcatgaaatgcttttaatgcctggagagctgacttatcaacaaacacaccactggatcatcgcccctttcagaatacgttaggtaactctgtttggatcccctgaccattaactattattgaaaggtttattttatataacattctactggactttgtcccagtactttcagctggccttacttgaaagtaactgcctcaccctagtaagacagtgtggttctggattctggttccttcagtttttcctctattgttctatgagcaactaagacatgaacagctgaatctaaatccctaacgctctgaatactctaggcagtctggctgttgcatctgagcctgtccttttgttacccaaagcctccctctgctggccccaactattaaaatatgcctacttgtgttctaccctctcaaatgcctattctcctttagtatagacacattttgaatatggttttagaaatacagactccaagagaggtgagctaagacatgactggtctatgatggtgattgttggctggatctcagtgttcattttggatgtcctaatttaatgccagttaaacagtcatctaactctagcataaaggctttttagcaataggcagtaagtagattgtgaatgacaggctgagctgggctttgatatcattagcaagcatgttggttgcttacttgctgcttcaaatctattctccttaatgcccattctgtgttttcgaactggcctgtgatagctggaaaaaggctcttctcttcttactaagattgttaaagacttagctctgttagtaaaatcagaaaactcgcaatctgtaaatgcctgataacgtcactacacataggaacatgacaatgcatcaactttcatgtgatttgttgtcttttaaacaaattgtctacttcttagtcttatggccattgcattcctaaacgaactcaatctctggactaggtctcatctcactataaatcatttgctgcattgcaaagaccaatactgagtattcttgtgcttatgtttctcctttagataaatctttttgtgttctcacagactctaaccccttatagactacagttttgttgtttgaaagaatttaaggtaaacagcttttgtcaatcagaactcctcaaattattgtatgttttgatattcagtatcatttttagtggtataatctgtaatttaggaagcatccacattatttcaactcattttaaattttaagaatatgccacaaaaagatttgaaatatctccaaggtatatataaaatattttaaacaaattatcatataaaatataaacctcatacccttattctcttcctacatttcaaccatctcaacacaattatttttggaactatataatcatgtcagtttaaaatcacctatatagtataaactctctggaattcgaaaattttggcacataacactctgtggctgtttttttttacttggctcttgttggctaagatgatcaagatccggaatgattgcatcccatttaattcttcccaaatgtttctcttcctgacattctttagccatatggatcattcccattttcaaaaggtgaaaaagtaccaggaaaaattaatttatgtttggatgatataaccaccctgcaaataaagagaatgagggcaaaactgcctgcggagggcaaaactgcctgtataccagaggtaggactgaaaatcaaacctcccctagagcccataaaactcatgtcttttggtatagcaagagcagaggaactagtaagtgtacagcactgagccatagctcagattcaaaacacgtgtgtataggaaaaacaaacaaaacaaaacaaaactccaaactgggcttattttcagtgtaagttttgttcaattgaccagggcacggggaagccaaaaatgagctaattttcagtgtcatttgcattatccgccaggtgttaaactcattataggccatagcatcatttgctggaaccagccattccttcattagccatgctctctttatgccctctagtgcatatattttgaatggaccttcaggggaaagatccaaatagttttgctatggctatagtctgtttccactggtagaaatggaagcaagctcaactagcttagaggagcttaataataagccaggcaacaacaggtattgacaactttctatctgatcagttcattgctaggcattttgaatgatatagaagaaatgcaaaactccatctgagtgacaatttgctcctcaataaaatgcagataaaacagcaaccaccttgcctgaatgttgtgaaaacaagaaatagcatgtgtaagtggaagtagcatggtgaatgctacatatgagatgcctaataaataatgactgttattaatgataattaatttataattctcatgagagaggaacatcatcatgaaataattgatgtgccaaacaaggaagtatgaaattaatctgcatcctgaatgaaccacccaactttcacagatcatttaaaaaggggcctgcaattacactcttctgatccttttggttaaaaggcattctataaaaacctaagtataagaagactaaaattctgctgctttcagctgtagaggatgatgaaattgtacccaagggtgccttttaataaagttcactttattattctctaatgcattttagcaagcttcactggctataaccatgactttcttaaatgagagatcctttttcttttcagacgaggaaatcaagatttcttatcataattggggatgtctggagggcagacttatactctgattgttcagtggctgggctactattctagaccagttaactggcttcactaacctataggacttgctatagaaaaataaagccatatatgtgatgattatttggaaaatatacagttctagaatttcctttaccagagagcttctggggctcctgtctgaatagcctggatttttttttaaattttcttatcataaattaaataattttgatattcatagaacaaaatgcatcaatgaacccataagatggctgttgtctggtttagaatgaagcacagtgcaactgattcattgaagacttctttcacttttgtgtctgaagcacatgaatttagctgttaaaagaaagattagaggtgtatccaaccgatgatgtaatgtgatttttcaacattaaagtctgactctattattctaggtcctcctatgttagatgggctatgagagcaaatataatggtgcataatttataaatttggattctcctcctcttttctttttgttcttcttcttgttctcaagaatgaacaaaacatatacttttaaaaagaaagtctatttatgttaaggaatagacaaggcacaaatcattcattcccttggtatttacaaatttaattttaaagactaacgttattctgaatagtcactgatccccagagttttatctctgtaagtgacttcttcttaaaatggagattgaactctaaatttgcaattcccattgggctgcaattaccatatttattcacataacctacctgttatttttactgtgaaattgggaaatgatattacgtaagcatctgcctgctggtctaaccataattttagggagtattactgatatcataaatcagtttccctgatattttaaaaaagtttcatactttggcatagtaagaaatctaagataaagattaattggagttcaaatgactccacagatatttttcaatatgttttttctttttttatagtatggaaaaaaactctatttaatgaagcagtacttgtccattaaagaaatgattttaaaaaatattggggggtcatatttacatttaatacagctagataaatgtagacagtaaatctaataactctttcttcctctgtcccaacctatagcaagatagggtagagaaaatggactatttgtaacatttaatgatttgcctatttatagcaagtaaaaagtaagttcagcttatcttaacttctgactgcttggttattttaaattataaaattaaaatactgtgtgtgctcccatccacacatcttaaggaaatcaaaatgaaaagctacattaaatttcatttcaaactgtgatgaggttatgagtagaggtatatgtagaaatatacagtaatctgttttaggaaaatataaaaatttaatttcgatagacttcttcactctacccttcaactctgaatcacttgattttgttttccatactagatgactttgtgctaactggtagcccaaagatggctaagggtgacaagaggaacaaggagggtgtagtctccattaccctccaaagcctctaaaattaataaaatctaagagaaaaaatgtgtttttgtacaactataccttcaatacaagtccctgaagaattttaaaaatatatttttttttatgtgcttgaccctattacttttttctaaaatactccaataaaccaaatacaaacctatcaatatttctttctaatcactccaaaacagctaaaactttccatcaattccattcctttctcagagaccatcatgcctttaccttcctacatcaatctggacctgttgctttagatacctatgtatagttatttttctgggaattccatttacccttctcccgtgtttgacctcctgttacttggatcctttttttttttttcattgtggtttacaccccccaaaggttgcttaagcatatctttcagttgtttctttctttttttttttacaccataaatatataatttttatttgtctgttatacttaaagctaaaaagatatgacccattttagaaaagtgttttttttttttgtttttgaaatttggcattttttttaaattttattattattatactttaagttttagggtacgtgtgcacaatgcgcaggttagttacatatgtatacatgtgccgtgctggtgcgctgtacccattaactcagaaatttaaaaaaatctgctttagaaaaacagatacgaaaattgataaagaaagatgacaagatggcggcttttcatgtttttaacttttaggatgtttacttatcctatgttctagccaagaaagccacagtccatgagagtctgttaggtaacacaggccttctccccttcattttatttatttatttatttatttatttatttatttatttttgagacagagtctcactctgttgcccaggctggagtccagtggccgatcttggctcactgcaagctccgcctccccagttcatgtcactctcctgcctcagcctcccgagtagctgggactacaggctcccgccaccacacccggctaattttttgtatttttattagagacggggtttcaccgtgttagccaggatggtctcatctcctgaccttgtgatccacccgtctcggcctcccaaagtcctgggattacaggcatgagccaccgcgcccggcctccccttcattatttagtgaaaacgcattctagtgtgtcaatctgacaattctatggaaaaaaaggatggagttaactttgtacctattatgctgctgacctttgtttttgatgcaagaaaggaagtgtgaagaaatcaaacagtagaattctgggttaaaatattccaactgctatttaacataattttggcatttgcaaagatttttaattcgtctccttagttattactgggatttgctggtaatatgattttaaatatactctgttactataactatttttgagaacccttgtaaaaccttatgtttttcctctctttaaccataatattaattaaggaagcatgtcaggtaaagcataaggacaattttgcttaagataaattttatatcattgagcttgttgtaaaaacaaggggaaaatctgatatcatataaatacacttaaatgaagaactaaagtagtgtttggcataacagcttcagatgaaatctatttgaaagacaaaacaaacaataacaacaaaacccatataatcaggctaatgtatgtataaaaatagtagaacttgctctaaaagtacaaatcattctctcattcacctaaaattttatttaggatttttttttccaatatctatctcaatattttgtttgatatttacaatgcactttatatacacagcatcaaaatcttaccaaaaattaccaggaatatgatatgcttaaggagagagaaattgagaattaataaaagttgactagttctaagtcatagaaaggctagacttaaccccaacagaattgaaatattgggttgcagagctttcacaatcctaaaggtagtgtctaaaggctccacaaatttcagcagttctttctattttattttattttattttattttaagttccagggtacatgtgaaggatgtgcaggtttgttacataggtaaatgtgtgccataggggttttcagcagttattttaatttaaaactggaaaggaggaaaagtatatgaagataagaagcaagttggtatggagaaaaaaaaattagaactgtaaaaatttttatgagtgcttagaaataagaaacaagtagaatgatgatttgtgttagagttaatataatttagatgtagatgacattggtgtatctgtggataaaactggaggatttcattctgtgatgtatgtgccaatttggaaatattctagctcacatctaggcataaagcattttttggatgctttggccacataacgagtataaggacagattgcaaaaatactagataataagctataatttatactaatcttcataaattctctccaaattttcactagcctgctttcaaggagttatgagaattttaggttgacttggtgcctctacggagggatcctgagtaattttttgctccgtacagttctcttaggccttccctttaaagggacttggagttacagaaatgtcctaaacatgaccagcctgacaaagatggaaatttttaggagttgccttaggggaaactacaattgtgaatggttagaaaatcattcaagatttcagcaattcctcctacaagtcccagatttctgaaaagaggccaaaatctgaacaaattcagtagatggttgatgcagtttctaaaacaatgttagaaagtaacagattcaacatatctttgaccaatattttccaagcctaaaagaaagtaagacacaatggatagaaatcagactatgaacaaaagttagaattttaatacaaatgggacaacattatccataagactttttgagttactgatgcacattgacatgctataggatattccattctcaccttttatccccctgctctgtgtctggtgagttcaacatttattgactgcatcagctaggctctcttgctttgtggcttcttgttagttcaggtaatgggaaataccagcagaatattagaagataaaaggaaagaggagttctgttatttatttccctggctctctatctgccagtgcacatgttttcacatgttgcttttctgcacttgaggttaggttcttactgagtggccctcttcaacagtgcagatctttctgggttctgataaccttatcaagccaaagtgtggaagttgcttccagttaacccaggatgatccttgatcctttcatcttgtccatccctctgtaaatagtcaatttattaagctctcctctattaagaacactctttttgagtgtgccatcagttgctgacaagatcttgggtgataaacatgcactggattgtcatgtgatcatttttacatgtgagatgggctagtgattggcagacaaatattatccgcttattgcacaacagccaccaagggcgtcctcacgaaagtatgaataaataccattatttttaaattttaatgattaatattgattattttggtacagaaaacatttcctatggcctaggattcatatgtagcatgctcataatttagattgccctagttaaaaatgctatgatatgtgtatcctggttaccttagagactgtgtctcctaagtagagagtggcaattctagtctgtaggggtgctcagaaatagtatctgtttttgaactccaggaagatacaaaagtggggggagtcttttcaggaatcatcagtcatagcttctcctcatttacatggtctcacgtatcccaacactctcttttttgggggaaatagcttataattcatctattattctcacatcctggaagactagtaagcctggagcttttcatttaaatatcatagaattaagtggttatttgagaaaacagacctatggataaatatatggtaaaatacatattaactgcagcatataattacataggatataaggatataattacctctgtggttgttataggccaaacaatagtagagaagtgaggtgtacattaagaaaaaactgtgttattcaaaggcctaagactcagaatgcagtagcaaagaaagagggtcacatgctattccctgccagagtagctaagaatacatccctattccctgaagattctgcctcttacaataggaaatgcccattgtacttcagtggtactttagtaaactagtataatgataactctacaccctacagctctttcaacaaatatttttcattttccttagtgagaacaaattaagatgttctttctctgatgtgattttcaattctagttcaaagttaggatttcagggaaggccctggcactggttcttttgatggtatctgttgtggcaaagagactctaaggtctttcctttggtctctttctcctggtgtccagattgtataatcctgtcccactgagtgtgggcaggacctgtgacatatttctaaccaatagaacttggtaaagatgataggattttactctcttgattatgaatcattatataagcctccaccttgctatcagtctggtaataggaagtgtccctttccctttctgactttaaagaagcaaggtaccatgttgtgagagggcctatggaaaaagctatagtcaaggaacttcaggcagctcctggagctgagagtagcctctagccaacagccaaagccaaagccctcagtcttacagccacaggaaatgaattctgccaacaacttgagtaaacttggaagagaatccatcaccagttaagcctccagatgagaaccaagccctggctgacacactgcattcttgcagaggacccaactaagacatttcctaccttaaagtgagagataataaatatattttgtgttaatctgctgagtttcttacaatcatagaacactaacaaacctgcccaatacgtacttagttaataaacattgactgagtgaggaccataagccaagcattattcaccatatttaagatgactgtagaagcaagaaatccatgcatgaaagggagttatgtaggcaaattccataggcggtataagtgtctaaaaatatcaaatgggtaagatgctttcctttcacatgcagacagggaaaactatttgcaatgtctaatgactgttctactttaagtggatgtgagaacaaaacagactttgaaggagatttacagaatagtattgaaatttttttatcaagttctatcaattaaagtttgatgccatatgtatgtatttttgccattctgccatccaggataagaaattgctattttctgccatatgagggtgtatattcttgccactatatcctgtaacatcaggcagagataaaacttcacaaaactcagcaatgctaaaagaaaatctgtgacttgcctttgtattcactatctactggcctacatctctagaaatctatatccaatttataccagacagttggtcacagtcttaggtgaaattttcagcaaaattttgagtgtctaaattttttgaatgaaaaaaataaacacaacagatgacactaacaggggcagaaagaaaagacgttaaagggggggatgcagatagcacagataatcttgtttgtttgcttgtttgttttttaagcaccaatgctatttgaaaattcttgctagctcttatttttttttctgttttttgttttttcaatatctgaggcattgggggtttacatcaaagtaacaaaagaatgactgaactccgatgaagcgtttctgaagcaataattaatatacgaggccaccgacactagaattaatcttgaaaaccactctcaaggtgatgggcaaaataaatgcgccatgggagtgcccccagaatgctgcactgacattgttgggtcctatcattgatcattgatgatagcaaagaagcgatcagtcacaaggcagaactaataatagacttcaaatatggaaggaaccttacttctatgtttggtaacagtccatgtttaacaaatagtgtttttttgtgtgtttgtttgttttcttttgctttgctttttcctgctccaatggacaaaagcaacaagtctctttctctttctttccgtgggataaaagaccttgctatattctctgtatatatgcattgcaggcagcattggagggcagttaattaactataatgaccaagtgtatgggcatttcattgcatacagaagcaactctgccctgattcaagcagccaagtcgactcaaaactcaggaaatgcttacgtataacaggtatggggatgtacccactgttttttccagtggtggtgaaggtgccattgtcaacattggtttaatccttggagtcccactaattaaaccatttctttctttcacaaaagggcctctactggcctgaaagtatcaacgtgcaaggtgaggttcccagataaaatggatcttttgttgggtgcatcttgcagtttaaccaatctcactataagactggactctgagtgctccctcactcttgaactcttggctgctgcatttttgtctacttgatatcttctgatgttcataataagtacttgttgtagataacaccatttttctataataagtaaatcgtaagctctatgtaatactcagagaggaatagtatctgtttttggaattaaagagcaaaatgaataactgtttggtccatgctattacctcgtttttttttgtttgtttgtttgttttttttttttttctggaagcatttatttgagtttcatgagcaaagctgatatctttgaataaaacttctccacgatctttcattctcacaatctgaacagaaatgtgcttatgttgtgtaaattagattccttttattgtgtaagactccaaagatttgtcaataatatttttgcttttagtcatgcccttaaaaatgtcacctaatagtacagctttttactttgaacttttctacatactaaattcagttttataaaagtgttaatatgaacgatacatatgtgattacctagagtgaataagatcacaatcaatccagaagaaagcattgtgtttgtctagagattccttgccaggaataatccgaagaggaaatatgtgtgtttatttatggtaataacaatacagctgtccagcaatcaagttaacttgactgtcatctttatcaagcagtatatttacatgggagacaatctgaggaaggagaaatctatattgtgtatgaacatgatgaaatgtatttctaaacacattgagcctctaatttctgaagtaagatgactacttaaaacacgatgtttagaaaggggtagattatacattgacacacttaagactcaatcatttcaacctttctccaaaatcactttttcaacattatttattctaaatatagaatacaatatttatttcattgaaaagggataaaagaccttgctatattctgtgtatacatgtatttataagtgtgtgtgtaggtatgtctgtgtacatgtgagtatatgtgtgtataaatgagtagagtaagaattacttatggatttaaaaaaatgttttaactatttaaaatcaatttgtgtaaaaaaagaataagccaggtttattttaactaaattaactagatagcttttaaaaaaattaaacaatcaatcaatcaatcatgaatgtgtcagaggcatttaaaccagagcaactccatcttgaatgggggctggtaaaacaatgttgagacctactgggctgtattctcagagggttaaggcattctaagtcacaggatgagataggaggtcaacacaagatacagatcataaagacgttgctgataaaataggttgcagtaaaggagctggccaaaacccaccaaaaccaagatggccacaagagtgacctctggtcgtcctcactgctacactcccaccagcgccatgacagtttacaaatgccatgggaatgccaggaagttaccctacattgtctgaaaaggggaggcatgaataatccactccttgtttagcatatcatcaagaaataaccataaaaatgggcaaccagctgccttcagggctgctctgtctatggagtagccattcttttatttcttcactttcctaataaatttgttttcactttactctatggacttgccctgaattctttcttgcatgagatgcaacaaccctctcttgggtggggtctggattgggacccctttgctgtaacaaaataatttattttcatttctttctaatgacttactttttcttaaagaagatgaagagaatggagcctcaaaaggactgttcaatgtacatttggatataataattaccatcttccctgacttcagcaagtatacgtagatcaaccaccaatttttgaccataaacagaaaatcaggggcacaaactttgttgttgttatggaggtgaggaatgccaataagtagaaagaaagtagagttgggtcttctctctgctaaatgatcataggaatgcagaagaattgggccttaaagcacaggcagcaggacttgaggaatttgctgttaactgccaaaggaggaaagagttgtaggattaaaaaacatgctcactaatactttcccacagagcttgtccaaggcacaactctgagactgccttactgcagcccctttcagcaggtgtcaccctccttgggaagcgaaattgcttttcctctccctcaaacatttgtcttttatattagatgttttctccacaccagtgtggataaaattactgtgacaattttcccccaaatagttgcactaaaaatactacatttcactgaggaaggcagtaaaatacatttgtaatatacatgggctgtggaacaagttctgggttccaattccaattctttctcttttctctttgtgttacctcagttatattactaaccctttatgagaatcatccaaaaatggggacaaacagatattccttagatgattgatttgagatttacatgagagaatatatgtaaaacaaaccagcctagtactggttaaaatcggggagatggtcctagttttattccattagaggaatataaggcacccacagcaggatattcttatgaggctacactccagatccagagcaatgaggctgatgactaaagcttcttaaatggtcgtttgacctaccccctaaatgacttaaaaaatgataatgttgaatcacaagtacaaacaactgtagcagtctttgcaaagtcatttgggtggcttcacttgcagggagctagaacccaagactccccagttatgtcatccagcaatgttgaccaagttcaaagtactttcagaatgacaacttgctcaaataccgtagcaatcctgtcactaggcagtattctcattttaaacatgaaaacattgaggagcaggaagataaagtggctcttaatggtggtgctgggattttactcagtattttggatttagagtcaatgggcgttttctcttttgcccccacagagctctactctatggttataaaaaacaatgtatggtggcctagtagtgatgtgtattatagataatgaatcataaataaccaaataattttctccaagacactgcgactattagtaagattatcatcgcaacaaagaccctttgttgcgatgataaatgattaatacataatagccacccaaacccatgaacaacagcaacaaccataaacgaacaaccatacttttccaagtgctgctaaaaaggaatttttacttgttttatctttatgccaatgaaaagaaaggtcatcttgctgaatttttatgattcattctttggatagaaaaactcaattctacaggttccttggtaaatctgtgtattacagttgagatcagcaccactgttaatctttcctttgccagcaaatagcaattacaggataactacagggtaattctagggctttgtgtctttgaacgccggagtaatttgaaccattctaactgtaaatttgaattgtttaacatatgctttccgcagagtataaatacattttaatgatttatttcacctccttaaatgcacaattttcagttttttagaatcaagtgatttcataaatatagaaagtttagaacactagtaaggaaacttgaaataaatcaagaaacattttcttcatttaaacatggcttaaattgagcataaaacaaggttctcagaaacatcgaataattgcatgatgactagaatttttttctttttcaatgaaatagataaaaatattcaaggcttctatttataaaccattcaagttgtagtttaaattacgtaaattgtcaaataagtgaaaaagcaaaaatttaaaatggaactttcttctacttttaccacttttttctttccctttctcttaggcactatttattgaatatcgtgtctctatatttagtttccagtctctacttactactttgtatttgttccacctctcttttgtttcttccaaatatttacaatgaagtgcaagtatatgtaatctatttgtttactctatttgtttatttttattttttgaagatctgtcgtctttcttctttattattttcagttcttcccttactcatttgctttccttttgactgcacttcacactttctctttcccaatccattaactgaagattccctcataaccatcccaacacatctcattccactattgggtggttgttgtattgttcatactctctggtgttaacagaatcatggttccacacgaggtggagtttggggaaatgaatcaactactcactgctcactaacctactccattgataggctagaggtcacactaagacaatttttaaataaaacggtatatcttataaaaatcatcgtgtaaaaattcagtctatagatgtgtatttgctcttccacataaaaacatacccattatttaggacttgaaatttcactccatctatatacataaagacataatatttttgtgtctgcctactacatacagaaaatttatgtatattttttaagactccaaataatttgaaagtgttgaacgttcacttttattccttatactccataataaaatttctaacaattttaagctacaacccacagtagtaaagaaacactattaagcaataaaataaataaaatgtgaaagccaggcacacaacccagtatgctttaaatcttacttgttctttagatcccacgggtgttcaccagacgtctccctaaacaaagaagaaatgtgacaacaattaaaatgtgaaaacgatgctattaaaatactgctcatttaggtgatgcatgtttatattacttagctagtggaaatgtcaaattccaacaagaagtgaaattgtttgtattttggcatttcctttcacacttattgttgtaaaaaagcaacttaaaatgttccttttaaagcaacaagaagcaaaacatgttatgattgttctggaaaaagaaatgatagttttaaaatatttaatgtatcccctaatcaaaattatatgtagtagaaaagaaataacatacagaaccatcaagtatcattcaataaaaacaaacttgtgctagaaaaacctatgaagaattcttacaaaagggagtatttcttgtgttgaaaacctttgttaagattttaattccttggtaaacatacagaaagcccattgagtttctttgaacaacatcacaggatttttattatagaaagacagaatctaccagactatgataataatgttatcaagaaagaaagaaaaagaaagaagaaagaaagaaagaaagaaagaaagaaagaaagaaagaaagaaagaaagaaagaacgaaagaaagaaagaaagaaagaatctgaattttaaaattaggctgagggcttattaaacttttaattatatacctcgaagtttggctgggtgcagtggctcatgcctgttatcccaggacttggggaggccaaggcaggcagatcacttaaggtcaggaattcaacaccagcctggccaacatggtgaaaccccatctctactcaaaatacaaataattagccaggcgtggtcgtgtgcatctgtaatcccagctactcaggaggctgaggcaggagaatcacttgaacccaggaggcggaggttgcggtgagccaaggctgtgccactgcactccatcccaggtgacagagtgacactccgtttcaaaacaacaacaacaacatggaagtttattattaatataattttttatcaacgttgagaaagatacaagtccatgaaagtgttgtagtgtttcgggagttttataatttataagtaactctaaaaactgggcaccgatgttggcattttctcagtgattttcattgaacttgttcactttttttttctttttggaagagtggaaatgaagaaattaacctggactctatgtgaatagctgaggcaagtggagacattaattcatttgtgtaaattcctagaaaataacaactgatcttgagttacataaagctgatcagtggtgctctgcagacatgggaggagaagagaagagggaggtattaaaagggccataaataaacttctggagctgacggatattattgttatcttgattgtgctcaagattttaaaggcatatacatgtgtctaaactcatcaaatggtatgctttaatgcatgcagtatattatatgataattataccttaataaagctctaaaaaagtggaaggatgtgaaatatatatttaatgtagagcatgaaatgcatgtataaaccattcaataaattaatgagagttggtactcttgcgatttttgttttaaaagattatctgtttgctgtgtgatgactagatggaggagacagtgattggaagcggaggtgaaattttgtaagaaagcttggaccaccataatgacagttgacataaaagatgctggattgattcatgatatagttagaaggtacaaagaaaaggctggttgaggcattgaatgtgaaggtaagacaaaataaggaaccaagaatgatggccaggtttgtggcttgaacaactgagtgcacgtgctgccattttctgaggtggtaaagactgagaatataataagatttaagtggaatacaagaattccattttgtacatattatatttgaaatgcctgtgagacaatcaaatggaaatgttaagttgggtaagtgtttctagaagccagaggataagtctgagttacacaactgattttgagaattgccagcatatatctaagagagtgagtggctgtcatgaagtggaagcaaaggtcattgaatgagaatagataaaagcacccagagtcaaggtgctagatgacgtatctactcggatgtatatatcctctaaataaccagaatgagagtgaaaagcggttctaggggccagaagctaattttaattatttcttatgtttttttagagactactttctaatccttacgtttgaatgttcacaatgtaggcaggacacaaaaacataatattttagcaattaacctaatgtgctgccaatttaacctttaaattatcctcaaaggtctctaaatgtctaattatttaagaggtattttaaatcacttcatctaaagtacatctcttaaataaacatatcttttgttacataaacaccttaaaaatcaaattagaaatgaagtacagttatgtgctgcataacatatcagtcagcaatggactgcatatatgacagtggtttcgtaagcttataacagagctgaaaaattcttatcatctagtgatgtgatagctgttgtaatgttatagcacagtgcattactcatagcacatacaattatgtatggtacatcatatttgattggtacaaaagtaattgcagtttttgccattaaaagtaatggcattagtacttgataataaatgatcaatggtattaatacttgataatcaatgactatgttactggtttatgtatttgccatactatgctatacttcatgtcattattttagagtgtactctttctacttaaaaaaaatgttaactacagaatggtctcaggtggtattccaaaataaggcattgctgtcgtaggagatgacagcttcatttgtgttattgcccctgaagatcttctagtgggacaagatgtagatgtggaagagagtgttactgatgactcttaccatgtgtaggcctagactaatgtgtgtgtttgtgtcttaatttttagtaaaaaaaagttttaagtacacaaaaaatttaaaaagaaaaaatgtatagaatgataatacaaagaaatatttttgtacagctgtacaatgtgtgctttaagctaagtgttattacaaaagagtcaaaaagttttaaaaagtttctaaagtaaaaaatcttagcttacaatgagaacacgtggacacagggaggggaacatcacacactgggacatgtagcggggtggggggcaaggggagggagaacattaagacaaatagctaatgcatgcggggcttaaaacctagatgaccggttcataggtgcagcagaccatcatggcacatgtatacctatgtaacaaacctgcacattctgcacatgtatcccagaacgtaaagtaaaataaaaataaaaataaaagatgtaaaaaaaaatgttagcttacagtaagctaaggttaactgattattgaagaaagaaaatattttaaaatgcatttaccgtagcctacgtgtgcagggtttataaagtctatagtaatgtgcagtcttgtccttgtcctccatattactcactgctcactcgttgattcacctagagcaacttccagtcctgaaagctccattcattgtaagtgtcctatgcaggtgtactattttttatcttttataccatatttttattgtaccttttccttgtttagttatatttagatacacatacactggccaatgtgttagagttgcttacagtattcagcacagtaacattctgtacaggtttgtggcttaagaacaataggctataccacataccataagtttgtagtaggttgagccatctaggtttctgtaagtatgttctgtgatgtttgcaccatgacaaaatcgcccaaggatgcatttctcagaacgtattcttgttaagtgatgcatgactgtatagagctttgctaagattttcaaagaagtcaacataatttgcagaacttgaacactttttctttgcaacatgtgcatggaatatgaagaagctgtaatatgatttgctgaaagtagctgcaaaatctatattggaatattcaaaaatggttgcttttacatattcgtagagatcagccacagaaacagagcaaacaatattggaattatagtgtattattatagaaggaaaataaaatgtagaaatttcatggctggcatgactggtatttttcaaagtaatgttcagcctgagaataaaccatggtagatttggttttgttggtttcccttggctttgaacattaggggatgtttggaagtcaacatcccagatttttgtttcttcttttgtaaagtggaacctatacaaataacttcatggggttttggtaggaataagtgggataaagtgcacacaaatgctttgtacagtgtaaagtactatagactgcacaaataacaccatcacaacagtaagtgagacatcatagctaaatgtgggacttgatattactcaaaagaaatattcagtgaactgaatttgtgtactgcatttaatttcatttagaattttccaagttgttactaaggcccagaaataaatatcaactcttcatatattgattaaataaatgtgcattacgtttttctttctttttactttgcacactttgctgaatatgaatttttggcacacatgataaacacaaaacgcctaggacctgctctttgtggattacttggaccgaaacacaattatgaaatatgatttttccatttccattcttctatttacacttagttgcttttatttaatcttaaatttcaacttttattttagatacaaggggtccatgtgcaggtttgttacaggggtatatcgcatccagctagtgagtatagtacccactaggcagcttttcagctcacatcccccgctctccctcccccgtctaataatccacagtgtctattactcccatgttcatgtccatgtgtgctcaatatttagctccacttataagtgagaaaatgaggtatttggtttcttgttcgtgagttagtctgcttaggattacggcctccatctccatccatgttgctgcaaaggacatgattattttacttgcttttttaatcttacaatttactttcttttcttcttttctctatttcctgtgatattgcacagctttctcattatctcatcttcggttaagattaagtcattaatcatcattttatacctttttctaaaaataatacaaatttttatttttgtaaaaataatttaatataatcaccattgaaatttacaaaatacattgaagaaaaaagacaaaaatgaaagtcattcaaaatcctaccactgagagacagctgctcttgacttttgggtatacagctacccagtctcttttctatgcattaatatatattttataagttcattaatagtgctatgttctcttttttacttactcttccatgagtatttttaaataatgtgaatgttttcctacaatttgtttagttagtgcatagttattttaaattttaattttatggatgaaacataatttgttagacctgtcgaaaaggctattgtcgattctttgtttttttttgtttgtttttttttttttcctgtataaacagccttgtgataaacatccttcaggctatatatttgcatgaatcatgattaattccttaggatgaattgctggatgcagtcaagcttgcatattaaattacaaaaattataatatctattgccaaattatactccaaaaaggtaataacatttatcactcctacaagcaagataggagagttccaacttctccacactgaagctaatagtagatattatcattttaaaatttttgccaatttgataaataaaattatatcttttattattttaatatgtgtttctttggttaccagttctgttgaaaagtttattttttcatttgtgtttattagtttctgaaatgctccttcatgtattgttgcctacttatctattagagcacatgtcttctataattacttgtaataactttttatatattaaggatattgattataaacataaagatttgatttaaaagaccaataatgagtttaacattttcagaattaacatatgccaagattcatcctaaaaaccaagggaaagtttaacagcttttttacttcaactagatgcaaaagtgattacaaatagatgaataaatttaagtaaagttttatgcttcatttttattaccccattttcattccaatttgaatcaatgttgcattcagtttatcgttgtttagtcccttgtaaattttttggattgtttacatagatatatttttattcactagtccatcagttatattttactttttcccttgaaagtgtgcaaacatttttcattgctttattattttatgactttatttttcctttattaccctgaaagagcaagatggtgggactaagtttttcttgacattttttctaaagagggaggctttactggtatggctaagattaagacaagagccagtctgcagtactatctttgtgaaagactttcctatgttctgataagctgaccaatgctttgtcttaatgttgatgtcattgtatagaatgtgacttctttgagctcagtagcaaaattgtgaatgtaatcttaagggaattcatgagcagatgtgtattcctgtgtatactcctctagactttgacttagacattcttattccctgataaaagactagaaaacccatggagcttcaaagattgtaaactagctaatattcactagtggttagtgaagtatgccacaccaacaatgaagagaactgaaataaaatatcttactttactataatgctttataatctgttcactatctcatgtaacactcacaataatttgggagcgggtaaggaagatattgtaatggaaaaagcatgagctttgaggacatattaatagtcacatgatcttggggaagtcaatctctcaaaaaagtcagtctccttttcagtaaaatagattaaaaaaagaaaataatacttatctttcataactgcgtgattagaaaaaaatgtaatggatatttagcacttaatatttacctcatcatttatttattcaacacacatatttgaacatctaccatgtgttcttttctagacactagaaattatagtccgctcagataaacattttatgctaatgggtaacaggtaataaatgacaaagaaagaaagaaagagaaagacagttggatggatggataatttcagtgagaactaagtgccatgaaaaaaataaaacagggtattgtggtagtgaatgggcagcactgggtaatgctacagaggatagtcaggaaggccttatagagatggctgataatttgagctgagatcttaacaaaagaaagaacagccatgccacaaggaaggggtaaagacctctagaaaaagcaataaatgtaaaggctctggcacagggaccagctttagtgcttgaagaacacaaatgtgtccagtgtggctgcagcatgttgaggcatgaaaagcctggtttaagacaggtaagagaggaggtgtaggccagatgttagattatgtaaggctttgtaagtcatggtaagttgaccatagtaaggtaacagagagctaccatgataataatgaggaagacaataaagatcaagcctattatctgttagacagtttaagaaactgggtctttctttgtctaaatgtgacacagcaaggtagtcatggagtctggtttcctgtccagggtttgttcagttttattttctgtatgttttgttgctgcctataatagtaatgttttttcatcttttaagcccgaagttcattcctgctcttgattttttttgtttctatttctttttaaaggtatttgccagttttctgcatcgacattaatgctgaagaagcatttacaagattcagtagctttatgtagggattagatctctgaaattcaaactgctttattttcataagaactatgattaacaaacacctttatagctttctcattctctaccgaccccattctccaaacctcttttctctaagctggactctcctactccgacattttagccttatcagccaaagaaagcaagtttcaattcacattccaggaaggaatctccccagccagagcttcatctcttaaacttacttttgtctgtttgagccttctgcttgagtgctgatttctttctcccagttatggcttttctccttcactggatactcccctctctatccttggctctggcacctgctatgtctggtgttccgcccattactatttcagattgtacttcagctttcttgcatgacatctggcatacattctgaattttgtccagctcatttactaccttccctctctgtttttccaggtggattttccaaatgtaacgataaaccaagaaagaatttgttcccccacaaggctctctgcctgcatttaaattagcaataatcttaattttaagaagaatagatagatatacaatgtatatatctgcatgttcagcttttatccatttgacaatagctgttaccatggaaaatgcacatgtacactatacaaacactgtaatttcgtttgtagtgataatggaagtttctaaaaatactgattgagtttaagaatctttctttttctaaattactctcataaatataaattttggattttagcatcaatattattaacaggaagagtatagtataatattaagtgttgatgtggggctttcaaccaaattaatttccctaattccagttattgtactgcatatttgtatcataaaaatcttcaggacctatctatcaagaggtcttaataaaatcagagtacatttgaaaagtcctatcacatatcattgaggtgttatgggttgtaatggggaacactcaggcttaaagggagaatagggtgtttagtgatggtgaagtttgttatctctaagtacagatttcatttattttacattttacataagatctgctttgtcaaacttatcctaaatttttatgttattgaatcatgcccttcaaactaactgccatttggtctactaacagttcttgtcatataaagtggtggtaacataaaagaatcccctgtgatgaaaaacatattagccacatttagtttttttagcctgtacacaaggactcatttctttaatctgtaattctctgagtgaaatctcatcaagggctccttgtgtaagtaaacatataccccaccattgcatttaccattccctgacaaagcatttgccacagcctttcaacacatccacagagtaactgcacaaaacctccctatcacaaactgatgttggttatcccttatcaaatcactttttccaacacgttcttttatcaaaacttctaaatatgtttctgagaattcttccatactgataagaaattcagacaatatttgttgaagctcactaaattatgtcttccgtaatactattatgctcaccatattcactatatttcagctatcaatattctcaccactccatatataaattgcagaactaaaattatagcaggtcacctgactttctatttagtttgtgttacttttacatttctgatatttcatttatccttctaaaacaggaatgtattacattttggaaaataaatctttactaaaacccagaaacctaaactaacaattaaatttgtgacagtacagtgtggtatcatagtaattgatatgtaagacttgattaataaagtctatttatttaatcctatagtaactccattttctcattactccatcaacaaatatttactctgtcttctctatgaaagacattatgctaagtgatatgaggtacagagagaagaattagtcttcaagatattggcagtctggctagggtgcagttctcatgcattaattacagaaagtagcacatgggaaatgccagctgagtggtacagctaatgcgtctcatgagatgaaatcatagtcttgtgatgactggggaagtttgcccaggcgagttagaatttaagtgagagagccttacatattattagtatttaattacgatcgaaggagaacagataaaaaaaagtagaagcataagcaaggaatgaaaatggggggcatagagtattttgtagagctgcgttgtccaatatggtagccactagtcacatatggctacagagcacttcaactgtggctagtaagaattgagatgtacaattgtgaagattcagtatgaaaaataatatgaaatatctcattcatattagtcattattatctattaaaatgagaatgttttagctatattgggtaaatataacaatattattaacactaacttcacatatttattgttacattttataatatgactactagaaaatttaaattatatacacggttcatatttgcgacttgcattatatttctattggacagtgtcaagctattgagtaactgttggaaggttgagattattaaatacgtatttttaagaaaaggaatcagactaaaaagtgctgattggttaggaggggctagagattagaaatttaaaaaatgataacctactcaaggcaccacacatgaggtgacaagggctagataaagcaggtggcaatgggaaaaattgggtagcagtgtacacttttttttgtgcctagctacttgcactaaaaaaaattattttaaattgttcctagtgccagagacattacaaaagaagactttcagaataattaacaccagtgactaggcatggagacaggaagagggagggttcaaatatgcctgagactgtaaactgaggaggcaaggagaatgatgatggaatttgatgagaaaacctctttggtgaggagagggttataagtcctggaatgtacggtagtggtggagagctgaggatgattcatctctcagtggaatgaagagtgtaaggaacaggtaggtggctgagtctgatataatggtgggacatccaggagaaaatgtacttaagacttcggtaaaatggatgtggagatcaggggaatggttaaattgatgaaagacatttgatgaccaccttggtagaattgaatgtggaattcaagggtgacagcacgatttcaggtggtgactcaatggcaattctttgatgcagagccaggaactgaaccatgggaaatactgacatttgatggttgaaaatggatgatctacaaagataaattgatcagtcaagaaaatgggaagagaacagtgtgggatcatggagcctaaggaagaaaaaatgccaacgagaaagaactagctaacaggaaatctatgaaaggatgtagatgacattttattatttagcatcaatatactacctgtcaggaatgcaaccctcaaccatgaaatctcagaaacagcagatgttccatgatttgtcttagtgcctttggatcacatgggccacacttgggcttttttttttttttttttttttttttttttttacagatatctttattcttttctcattcactagtaagtatacctatcaaataaactttcttctgaagaagctcagacttattgtttactgtagcatttaatacctgcgtcctcaatcaacacttaccacagacagactgatattatcttttttgtgtacataccaagtctcctaacttgaaagctatgtttttgtactccatctggctgcctctctaggattgcccttactgcttaaaatataccatgcataaaggaaacagagccaatagagaaagatttagggctaaggttagcaggaataattgatctgggctgtcaagagtcacggttctcccaagaatccatatgtcatcattgttttttttatttctccaccagtttttatccattgtttttctgtaggacctttattgttgttagagagtggaatccacctttattaattcaacaaggtgctaagatacttaaaaggttataaaaatgaatccaatatgtatcctgtatactctagattgcaatttatatacatgtttacatgtctattttccatacttaaatctaagatccttgaggaccttagattcattcatatggttcttattcatatgtagtggtggagttctgaggatgattcatctctcagtggaatgaagaatgtaaggaacaggtagatggctgagtctgatataatggtgggacatcaaggagtgaacgtacttaagactttggtaaaatggacgtggaaatagggggaatggttaaattgatgagagagacttgatgaccatcttggtagaattgaatgtggaactcaagggtgacagtaagatttcatgtggtgacttgttgatgggtctttgatgcagagccaggaaataaaccatataaatacttactagtattatattactaatgcctgaaaggtccttggcacctagtagactgtcaaatcacatttgtttaatgaatatagtcatgtgtcacttaatgacagcgatttattctgagaaacgcattgttaggcaattctgttgttgtgtgaacatcatagagtgtgcttatacaaacctagatagcatagcccactacacaactcggctatgcggtatagcctatagctcctaggtcacaacgtgtacagcacgttactgtattgaatactgtagtcaattgtaacagaatatttgtgtatctaaacatatataaccatagagaagggaatgtgttgcactatgacataatggtgactatgacattaggagagagaaaattttcagctctattataatcttaagggaccaccaataaatacgtggtccatcagtgactggaatgttgtatatataaattaatgaaagtgtgaatttcttcttgaaggagactgtagtgaagacaaaattcatgcacaaataatcagagtacaaataggaaagagacacctgacaaaagtactcagataaaaacatattaggagttaggtgaaagaacaaaaaatgcctcataggataaatgggacacggcttcctggacgtgctggcatttgagcaagggcagaaggatggtagaattggacagtcaaaaaatggggcattttactaaatggaagactacctattggtcttatctacagattttgattcttttatatttattaaggataatcacatatttttcatgtctggttaggttttatttgaactcctgtaatcttttttttcattataaaaagctttttttccataaaaaatttcttaaaatatgtagccacacagccgagttttattttaaggacaacagcatttttacctcctgttttgcgtgagggtctgtgggttgtaggagatgagaaaagagagttcccagctgctacagctcaacaaagcccctaaaaatgatgactgcatccatttccacccaacgccacattctgaaagtgatctttttgaaacgaggattgcaaatagctgcagcttctcaaaactgcaattgcttttcatggtgtggcattgctgtcttcatgctgacacagctctcagcactgacaccagcctgcctatgagccgttaaagatatttcacttccaacaataaatataaagagtattatacaaaaacagagaggccttgtttttaataagctgaaatggatgaaatgggcagtcatggagcaaaaataattatgagggaaggaaatggagacaaaaattaatgcctctccctcccttgcccccaaggactgcaggcaatgttctgtacctgtgggtcatgctctgaaaagatgcataaatagaggtgagaaattggtgctagaaaaaaaaaatatgattaaaaggatgtgacattttctgcatattcaatgtgctctgctgggaagaacttgtatagttcagacaaggtttgcatcccggctctggccctcaccagggttttatatttttccttggctaaattgcttaatctttccaagttcaagttcctgcaaatagagcttatattaatgacttcttagggttgcagtgaagatactgagacaatatctataaacctagctggtttgtacaaatatcttggcgtcttcccttccagccggccttcttgtcccttccccatgtgcactagggaaacctctctgtacgggactctcagaccagcagatacacttcatattattgaaatgtgggctacattatctttcactgcaaaaatggtactaatcacccaccatctgtagtgctcatgcatgtacttatcctttcctaatggagatgcgtttgtatgctgggatgggcagctgtactctttccctctgttctcccttgaccttcttttctcatttggctcactgggtatagtccatagacatgacacataatttggcagtaatcatatcagtgttttcccacagtgcatcccttttccaagaatgtgtgacagagttagaaacaccaaactttattgctggagaaggctttggaaaatatatgatccaaagtctcataaagaggaggaaacacaggcctaagaattagctgacttgcccaagacatgaggaaagttaatggctgggttcagactagaatccctatttccgctgctccactcagagctttccaatcattcccacatctcagaaaggggaattcttccagctttatcagaagaacatccaaccgcagtacatacaaatattaaatgcaaggctagccacatgagattctataaaaggattcatcattagatgattctgatggtgaatatcttttggaaaatactagagatagatacttcgaaaattatttttcccttttttgattggctgcaattctgaatgtgcctgtgtttaaaccaacctctctactgctctcccctccccttctctttctctgtctctctctatctctgttcttttattctctcttgggtttagttacttgcccaggtggtctcatttaatgattacactatctcaggcatgaaacaccatgactttttgctgttgggactgcagtatgtaaattgacttgagtcaattgtacctgattttctaaattgcctctggtataacaattctcccacccgtaataacccattgaaatcaaacaataggattgattaaacattcctcactcagggggaaactccattaattttacctgaataaaaactgcagaacagtgcccattttggggtaagtagtatacaaaattctccaggaagcacagtagaaataaacttgaaaggcttaaatattactctttagccacagggaatagaagcaaatggaattttatttacaagtcacatgaaggaaaacaaaggcatacttaagtgagtattgcacagtgcaccagatttggcaggactaacatttactctggcttttcttctgggacagagcagtagaatataggtgaatcctggaacctctagagctctgttaggaatccatatacagcgtatctgtctccaggttgggattttccaatttcatgccacaagtaaccacttgttatgagctctggaatggagtcccagctcttccactcactagctgtttgatggtggacaagttatttaaattgtgagtctgaggttttcaatgcctaacctgggtttaaaatacctgcactatgtgtctcccaaggttgttgtgaacatcaaatgaaactatgcaaaacaactgatttgaagacggttaagtgcattgtaaacatggggaataattcttatttgaggtagtctttttttactgagcttgtacataattctataagataaagagctcagccagtggtgacggccttttcttccaaatctaaattcatatgtagtggctgcagtgtagtcagactgtggagtcagattcacccgtgttcacatcacagctccccatttactagctctgtgtccagaggcgagttatccatctgcccagactcatctataaaatggggatagaaataacacctacctcacagggctgttgtgagactcagcaatgcagtgcatgggacaggaacaccactcaatgaatgctacttattaatagtagaaaataacttcaacatgcaggaatattcatatggtgcctttctctgaaccaatcaagaactttcagtgcctggtgcagtctgaaatcttggtctgagttattcagaattctcatctctttgcaggagggacttctggggacctgtaagagaactaaggtgatattgtggctcatagagtctggattcctagatggtgagcttttggagtgtgggattggattttttgcatctcactaaatatttgtattcatagtgtctagcatagagtctggcacatggtgtgtggtcctctgctcagtgaacacttttgcatgaatgaaaaaagaaatctttgcctagtgtaaggatgtaaaggaatgaaaaacaggaggcttaattcctcctgcttaaaataagagctattttcctttcctccctttttgtcagaacgtgtactgtagaaaacctgtatataaagtaccttctctgtctttttgaaatgtatctttctagacagtaaataagccttctgtcagctttattattgaggaatgtctttctcaaagacctgagagtcatctctttgaaatgtaaatatcaaaggggaaggtgcccccatcctacaattttccatgggaaggcaggagcctaacatcagcttgcgccatgctccaagttataaacctccctcccgtcatagggtgttccccccaccccaaccccacccgcttcctctctcctctggatacacccagttagctaacatagatggtcacctcaattaccaggtaaagttaagatagactttatgcccaatggtgctgtcaagtcctcttacttgaggactagttattgttcatcttgaaaatatgtgtgtaattgggtatatttgcttggctatataaaagggtgtgattttttttttctttctgtgcactttcttagtggagtggctgtaatgcacatgacagtctggtttaatgcttattcaacaataaaggtgtttctttctctactgcatttgtggagagaatttctgggttgggagaaacatattgaaacatatagaaagatatttgaagactaatgctagtagctgaagtgttaatgtttttaaatactaatgtgcttaatcattcttacctatttatttgtgtacctataagcattcaactaatgtgcctacctcttttgaaacttcactaggttatttttcaagtgtgtaagatttaagactttcaactgactgactcactaataaagattattctccttttgccatccaaggaaagtcttgcttcaataatcataaattcttattggcctctggataggattgccctcctcatttgcaaattttcagaaaattaaaaaaaaaaaaaaacttggcaggttgtatggaaactagggatttccagaacatttcctaaacaaaagagtaaataattagtgctcttctaagtagaggaagaatttaagacagcttacataaataaaataaaataagcaagtgaagacactgagacaaaaaggaagtgattgttaaaaatatagggtcttaattgtcatagccaacagcaacttaaggatacatgatattaaatataatgtaaatcctagatgggattctggaatagcaaaagggcattaagtaaaaattaagaaaatctgaatagaatatggactttagttaatcataatgtgtcaatagtagtttattaattgtattgtaataaaatgtaccattttaatgttagatgttaatagaggaaactgagtatgagttataaaggaactctatggcggagagggagaatagcttagacaaagatgctaggtgaaaattctaaaatgtattgtttatctttacatccataatattaagattatatttaatagtttccttcctcctctcctgtttgtccccatttcttacctctctcccctgatacatatatatcccaccctgttaatgagatctcagcatgcctcttggttgagcctgctcaagttttgacaggaacaaagcaacagaacacatccaacatcaacaactttgttcattctgtattttctcatagttcaatgaactgggatgcttccaactctccttaaaaatgaaagttaaattggtttgaacacaaatgcacaaaaacgtatgcttccacagtgcaatctacaaggttgggtactgggttaaaaataaaatttcatctacacaatggtatgtccatttaagaaacccgttaataacaggaagtaactcactccgtgcctggaatctggaattaaatctaggccaaactacagagcctaacaatgtgtatctcaggctaaaacaaatccagaatgtgggagttggaaaggattttagagataatttagtccaaatcctccattttatggtagggaaactgaagctcagggaggttccctgatttgtcaaaagtttcgcaaaatgtatgtttatatgtcactttaatcctataaagagtctgaggaaggactaaaatagaatgaacaaaggatatagagacaatagtttgtgttagcaaacctcaccttaatgtttcaaccattaagatgaccttctccagggtgaacttttcagcagtactaagctttataaatataatggatggcaaagatagtttgctctaggacagagcacgattacatggtaaaacttccgtgctgtgctctaaaaattactctctcaaccgctaattgaactctgaggattctttaccaggagagatcagttttattccataactaagggcttaaggtaaaagtacccttggaatgattctctttgtctttcccttctttacaagatttatcagatggtacagaaaggtgtccagcaaaaatggccacagggaaatccacagatcatcataggattaagcatttaagtaagctaggaagagtggaaaaagtaggcttttcaccagggccagattgttggagggtcttatttcagggcacctggaagcacagtgaaagccactgattttcactgtgctgactacgtgagcagggacttgggaagcaggaatgtgtggtttagcatctggtttgagccatgcaactctgggaaaactaattaacttttttgaaatttagttcatcatctataaaatgagaataacttcacagagttgggtagaagagtgaaattaataaaataaataaaatattgaaaacctacagcaaatgctaactacagatttgttcctttcccctttctacattcctactctctcttccatgtctggattcaaaatcctctaggatgtatatatatttccaaatagtcacacaatgtaagctgaataagaaatcaaaaaaaagattgtgggtgagcaggtggggagaaactgagaaggcaatgtatgtttgatagcacgttaaggagcatgagcccagatgggcagctgggacctaccacaggacagtttggtctaggctggctggtccatcgcctttccttcgtctcagatgtattcattttactttcttcagcaaaattccccccacttcgctgtacttctaaacacccccacatagaaataacagaggctgataatactgaacatgtacacgaacatgtatacaaacatgtacacaaactgagcatgtacacaaacacaattcttcactttaagtggggggctaatttaatatatgttcaatgtttgtgataacggtttttttttttttttttttgagatggagtttcgctcttgttgcccaggctggaaatcagtggtgtgatcttggctcactgaaacctccgcctctgggttcaagtgcttctcctgactcaacctcccaagtagctgggattacagatgcctaccaccacgcccagctaatttttttgtatttttagtagagatgggatttcaccatgttggccaggctggtcttgaactcctgacctcaagtgatcagtccgcctcggactcccacagtgttggcattacaggcgtgagccaccccgcccagcagataactatttttttttaatttaaaaatttttccctcccaggaaggttttttgttgtttgatatactgagtaccacttacttttgtaaaagcttttgctgtattttcatgagtattacttgtaaatagcatagggtggtggtgagcacccctatctcccacaaaatattaaagtagaaaataaaacaaggttgtgttttcagagttaagctatgaaacaaaaaaagaatttaagcatagctgtatacatttcatacaacaagctatacacatggatagctatacaaagctataccttaaacaggaagaatgacctccaggctaaggccaaacctggaatataattgaagttatttgtatttatgaagagaacttgtcaatcagaaggactgttagctagcaatggaaatatgagatgctgagaaacaaacattggtagcggaggaattcctaccccatttaagggatgggttcactagctttagaacccaggtatgaaatccatctgcagatctaattctgcagctaattagatctgcagtgaaggtaggtgtactccacatacttatctcgatgactctaatcatcgaacacagaggcctacaaactaaggccagtgggaccaaatccagcccaccatcctgcttttgtaaataaggttttttgtggaacacaaccattgccatttgtttacatgctgtctacacctttctgctacaagagttgatcagacacagttgtaatagaaactgcctggtctataaagccaaaaatatttactatctgtccctttacagaagtagttattgacccctgataattcagccaacttgccttgatttcatgctcacccaacaatattttgactcaatgttgtttgtttattcctgagaatattttgtactgggaaagtaagagcttgcagaacagtaataagccaatatattgaaagttgtatctttttaagtgatggtagaccttctgtgtagactaacaattacaatatctgagctcaaagctggtgggctgacctgttgactgtggtgcctacccccaatgtattgtcacctgggcctgtttggaggtcagcctattttctctgtgtaatgttggaacttcctgtgcatttttttttttctggcagcatttaaaaaattcctactttacagatgaggaagctacaattcagagaaaggaaaaataaaactaatatttattgaggatctactctgtgctaggctcacagatgttccttaagtaatgccatttaatctttacaagcccatgcaaggggaaagggctatgaaactcaagtttatgctttcactgatgtggaattggaggcttggaaaaggtaagaccacagtaatttgttagcaaaatcaggatttgaaagcaggtgctcagattcagatacttttacactatggtattttcacatgacatatactgcctggcagagtcttctggtgatgggcttaagaaagcaacaccatatgccttggtcttttcctcccaccaaggtgtactgttgttctttagtaaacatgaattaagttagaaaatcctagagattttaaaggtgtagaattttaaaacaaattctgcacatttatattggagtgtagaatcttagccaactaatttacatattcaaccgcactcttgcatagagaaattggtgccaccacagcctgtgttcataaataacagttcccgaagaattttttttttcataactggttttgtacttgaagtgatttaaatgttgtactttgaaatcattgtagcaagaacatattttagaatttctaaaagctgaacagaatggaaggttatctataacatgagcataatcacagtcataatatctgtttaaaataaaatgctgaagagaattaaatattcccttcaagccaaactcaaatttcaacacaaaatagattgtagacttgcagctaatgttgcttgctggggcccattctttaggagtttagagcctttgaaaagcttttgtttattattttttcagtgctaaagaagaaattccccagcttttagaaacagaactggtcctaccttctcacacaatgacttgtgcactgccctgagcttgatttgtaagtgttctacctgagtgcacttcttgtcttaactacactgaaaactttcagatgacaaattgtaggttgatggcactgaatttactgctatgtaaatgctatgactgtttcataaaaatatttgctgatgtattatattgttataagatagaactttaacaaaaattataaatgggggaatatatatgaaaatattaaaaaaatataactctcattcataaagacttccctttttctttaacttttattttaagctcaggggtacaggtgcgggtttgttatgcaggtaaacttgtgtcatgggggtttactgtacagattattttgtcactcaggtattaagcctagtacccattagttatttttcctgatcctctgcctctttccaccctccacgctctgataggctccagtgtgtgttgttcccctctatgtgtccatgtgttctcaccatttagctcctacttataagtaggaacatgcggtatttgattttctgttcctgggttagtttgctaaggataatggcctctagctccaaccatgttgcttcaaaggatatgatctcattctttttgatggctgcatagtaagaattccttttcttagtttcacccttcattttctttaataaggaaacagaactataccctgaggaggcgtgaactcaaatgagtaaatacattcacaattaggaattatttggaaaattctactcacagaaagttagcactggaaggcatctctaaaaccacctaactcaacccatgatccaaatggagtacataaatcttagaaacgtccagtgacatgctcgagctggaaggaacaactaggactcctaaatcccagctaatctcctactcaactgtactggctatctaggaaaaataaaagtttacatttcccttagaattatttgaacaagaagtctctaaaacacaagaagttaatttaggtctcctttgtcttggcagaaaacggacaatatatttcttagaagggtgatgatgtgacataaatccaattcattctggcttgagcatgaaaaggagtttattggttcctttaactgaactatgcatggtctggctattgtgactagacctagaaactgaaatgccattaggttctctctttccacaactctcttctttatgtattcttatacactggttttattctctctgaccggttgtctctgtgagtctgcaaccagagctttaggtaactctaggtgtcattcttactacctcatacctaaagaagaaagaaaatgcttccctaccagttttactgaagaaaatcctgaggggaaatgtggatgggttccggcaagatcaaataaacatctctaggtcaaccactatggctgcaagattgggactaggacaattccaactgggatcacgtgccaggaggcaggagaacagttagactggcaggtcaccttggagtcacatttgaagtatgagagatgcaggtctccccgaaaattggggttgtcaccagagaaaggagaaaagatgtgccaggcagggaaaacagcaggtgccagatgagaaattagagtcacttaagacttgttttgccctgagagaaaatactagccacttagcattttttcttttttttcttttctttttttttttttttggtctattcaacatctgagcctccttaggaggcttttagggaatcatgtatcttatgacctctggtggcagacataatccattttctactgaccatattctaaagaagttgaaaatgccagatacttggtttcccagcctcctttgtaagtagggcacaggaacatgacctagactcagctgatttcctggactttgagtcagggattattgataccaatattcagttcataggcaatggtagctgcagtatctggtctggggtggcaacagcagcagtagtgtaagttgggtatccgacactcatgggcagcaacagcagtgttctaacaggactggacttgtagtttgaagctgaaggcaatcttatctgttaccaaacttcatttgctcctgcacattttaaaacttggttctttatagttctcttggtgataccatgaactcccaataaatttacaacaaattagttctctgcttaatcaatctagagtgagttagtgtctgtggctcacaacaaagatacataaattttacatacttctgtatcctagcagaggaaagctctggcatcattctgtgttgttggaaaacttaattagtacatctcctctttaagaagttttgattaacatcttgtcttatattaactgtaggtcatttttaatacctgatgctacatcaacccacattaaagaattttaagagcacctttgttagtctataccacctacctgtagataggtgtcaccattattaaacaatacagggttcaatatttgtctagtatttcattatcaggatgacctcgaggtcaccataaccttttctgttttgtccttcagttctgctaagggaaagacgccaataaatagttcactttcaactaaaccatcatggagaaggtgccactctatctttaaaagaaaaatggtctgactttgaatgccttagaaaatgaaaggaaaatgagtaagtagaaaaactaggctgggcacagtggctcacacctgtaatcccagcactttgtgaggccaaggcaggcggatcacgtgaggccagatgtttgacaccagccttgccaagatgatgaaaccctgactctactaagaattcaaaaattagctggaggtggtggtttgtgcctgtagtcccagctacccaggaggctgaagcaggagaatcgcttgaacttgggaggcggaggttgcaaccagctgagatcgcaccactgtactccagcctgggtgacagagtgagaccctgtctcaaaaataaaataaaataaaataaaataaaataaaataaaataaaataaaataaaatgaaagtaaaataaaatagaaaaactaaaacttcagtgatagacttttaatgccaagtcagcattcaatttaaataagagctaatgttactcttaggaagtctgatgtattagtgttataactgtgtaccttaaacttccacaaagacaattaagttggaaaaagttatttttatatgacaacatgaacttccattctgtttttacagattcagatggaaaataaaatttagacttgcattgctaaggaatggcagaaaagtgttaaggctaaatatcatctgaaaacactcaacatgtcaccaaaggttttatgaatttatcttctctgagctttgtttgtttcaaaaaagaacacatatacacatatttgctatggatagatgtgattgaccactgtgagtggcccatgttaatctgctacaaatatttaaacatgctgcttgggcaggtcctactgaggacacttttgcagcaaactcagtaatatgagattcctcactgcctcctagcaatacatgaaccatagatgtgttggttgcttgctcattttgtgaacactaactagtttaggcatttctgtttcttccatggcaggggcaagtgtaaaaagagtggctgtctaactaaataacaatgacactgttaaataaaagctgcactttagagaaagcacatcctaacttggaatttatcaggacctatcaagtcaatacaaactgactatgctgggaacttgagtcattttctgcttaaggagaatatgcagtaattaccctttaaacattttctcccaacttcttcccttttaccttttttccatttatttttctggaaattaattaccatttagaaggaatgacaggtatttttgagccttgagagaaccaatgaaatagttaccttgaatatactgtcataatggtgtgtctagaagcacaacccaagacagcactagtcaggccatttgctgagaagcacttaggacaataattttgcttataaaacagaatcaagataatcaacagaaacaagaaacaaatgaatcaaattaaggttcttgatgacagaaactcagctaaaccattcaaaaatatgatgttaaagaaacatgattgtcatttccaaccaactaactagacgtgttctgttatggttcaaattaggagcatgaaatacactttacaacctaggggattttagagcacttagatgaattacaagtgacatatgggagctcattaaaggaaggtgacgttatgaatgcccagagagcttgctggaaatcagagcttttttcaaaaaggcttcaagggtcagtcatgttgattagaggatgctcttcattcttatggatgaaccatttctctttagcacttctcagttatcacagtgcttgagtgttggccattactgaaagtttctaagtcgtgagcatgtgggagggtgggggtaaggtgggtgaagggtcgggggttgtggtttgattttgacaggcaaacaataaaagctattgaagagtaagacctcagtgcagcctgtttctgctatttcacccaaacttcaaggtaacagttgaagttgcaggagcaagaacagcccatggttgcttctatgttatgaaggctgtgtctgtaagctgagctttgaatgacacattatttcctctgtgcaccccaatctattttctgcctgactaagcttataaaactctgcataaattctcctctcagactgttccataatcctgtgaacacattgtcttcctgttcattccttcagccagcaagcaccagctgttgggtcctggaaacattttatgttaaggaggaaaaaaaagtagatgatcagaaagctgtaaaaactgcaaaatgcttgagatatgcagactttttagggttgtgaatatttgacctgcataaaagaaatgattaggcttccatcaatcattcctctgctgaacactctgctgagatcggtttatccagatgcttctcagctgcctcggttctgcacagtttgtaaactaatccagttttgtttgttatgtgctagagaaaggataaactccaagctgaaaaatatggacaaagatataattatcttaacataacactcatgctttatttttatgtaaaatgtcagaaactttattatctatatctttcagcttccaaaagaaggtggaagtcacttgataatgtctttctaattgcttgaatgcacacttcatgcctcaactccacaggaaagctagttgttataattagaagttttataaagacatagtttatacaaattacagataattacttaactaaaactccagtctcttgccatcttagaagatatccagcaacatgtgatttaaacaataggttaaagtggaagatgtggtgattatattgggaaggatgctcaattgtttttataaaattttctttaaaaattggtagctgttatcgtgaactgaataagttctgtttccatttggagacttaattcaggatatatctggaaagacaaagcatatctacactccaaatagtttaaaaagaagagcatttatgcacattttgttactaacgtcttcctattccttttattgataatttttagggaggaatgaaaaccagtcaaataggtgatattactctatgataggggtcatataacttttttattaaaggaatagatagtaaatattttaggctttgcaagacatgaaatctcttctgtaatcatgcaggcaattttgttattgtatttgggaaagcaaccataggcaatacataaagcatgagcgttgatatgtatcagtatatctgtttacaacatacccttagctagtatcatactgaatgggaaaaactgaaagcctttcttctaagatctgtaacatgacaaggatgctcaattttaccactgttactcaacatagcactggaagtcttagctagagcaatcagacaagagaaagaaataaaaggcatccaaattggaatggaaaaagtcaaataatccttgcttgcagatggtatgatcttatatttggaaaaacctacagattccacaaaaagctattaaaactgataaattcagtaaagttgcagaatataaaattaacattaaaaatcggtagcatttctttatgccaacagtgtacaatctgaaaaagaaataaaaaaatactgtttataatagccacaaataaaattaaatacctaggaattaaccaaacaagtgaaaaatctctataatgaaaactataaaacactgatgaaagaaattgaagaagacaccaaacaatgaaaaaatattccatgtttatggattggaagaatcaatactcttaaaatgcgcatactacccaaagcaatctatagattcaatgcaatctctatcaaaataccaatgacattttttatataaatagaaaaataatcctaaaatttctttggaaccacaaaggaaccagaatagtcaaagctatcctaagcaaaaagaataaaactgacagaatcatattatctgatttcagactatactacagagctatagtaaccatcatagtactggcataaaaacagacacatagaccaatgcaacagaatagagaatccagaaacaaatctgaaaacctacagtgaactcatttttgacaaagatgccaagaacatatactggggaaaagacagtctcttcaataaatggtgctgggaaaactggatatccatatgcagaagaattaatctagacccatatctccaatcatatatgaaaatcatgacttaaatctaagacctcacactataaaactactaaaagaaaacattggagaagctctgcaggacattggtctgggcaaaaattttttgaggaatacccacaaaccaagcaaacaaagcagaaatggacaaattggatcacctcaggttaaaaaccattctcaaagcaaaggaaacaatcaaaaaagtgaaaagaaacctcacagaatgggagaaaatatttgcccaatcaaaaatgggcaaaatatttgaatagacatttctcaaaaaatgcatacacatggcaaacaggcataagaaaaggtgcttgacatcactgatcatcagagaaatgcaaattaaaactacaatgtgatatcttctcagccctagttagaagggctgatatccaaaagacaggcaataacaaatactggtgaggatgtgaataaaatggaacccgtgtacacttttggtggaactgtaaattagtacaatcattacagagagcagtttggaggttcctcaaaaaactaaaaatagagctaacacatgatccagcaatcctgctgctggggtatatacccaaaagaaaggaaatcagtgtattgaagagatatctgcactcctatttttattgtagcaccatttacaacagctaagatttaaaagcaacctaagtgtccatcaccagatggatggataaataaaatgtaagacatacacacaatggagtactattcagccataaaaacaaatgagatcttgtgatttgtgaaaacgtggatggaactggagattattatgatacatgaaataagccagacacagaaagactaacatcgtatgttctcacttatttgtgggacctaaacatcaaaacagttgaaatcatgaacatagagagtagaagaatggttaccgggggctaggaaaggtagtgggcagtggcagtggggcaggtggggaggtagggatggtctattttaaacagagtagaaagaatgaataagacctgctatttgatagcacaacagggtgactataatcaataataactgtaaatttaaaaataacttaaggagtgtaatagaattgtttgtaacacaaaggataaatgcttgagggtatagataccccattttccatgatgtgattattacacattgcatgtctgtatcaaaacatctcatgtaccccataaatatatgcatctactatgtacccagaaaattaaaagttaacaaaattttaaagtcacctatacaaaaataaaaataaatatgtttacaaaaatacatggcccacaggccagcacttgccatcccttgctatataccaagcatccaatgatctggaaagcaacactagtcattatcactgtcttcaagacattttaagttttttgcttccttgtaaaacctaaggtctagcagaccttctcaaggaacattctactgaagagttaagccttaaggcattcagtggaaggaatagggaattttcatcctgtgcctctagaatggaagaactgagaaaaatgttatcaagtcatttctgtaaggcttaattttctcatggaaccctagttggaaaatccaagaataggtgctttataaaaactgaattgcaaaaagtgcagttttggtgtagtttgtagtggctcaagttaaccaacctctttatttgaagacaggacaaaataaatataaatatttgtctttcacttctggttcacagatttgccatttcgctagatttaacagagatagtaaatgtagaaaacatgactatagagttgagcttatgggatgtggaggttgctaaggggaatagcatattttcaaaaagtcatttttttttagcaaaacgttccgatgtttatttgtaggtagttatgactatgaggagtgggcatttgaatagcagtgtagaggttgtggggttttaggtctatacctcaggaacttacatgcaggccctataccacagtagtaggagaacatctaataatactgagtggctgcattcatatttcagagcactctgtaatgatttgagtcctgccctggatgaatttaaaacaaccatcttattgttagaaatcatgactaccaatcattaacattacctccatttcaataaaatgaaaaagaccccaactttgagattagaaacaagtttgtaaagccacagtgacattaatggttcctgagtcacttcccattttgatctatgaggtagcaaggtgtggtgtgagtctttgcaatgggaaggtagtcacactgaactgggagcagaagacatggtttcctgccctagctccattacttatcatctatgtgtgcttgtgcaatttattgcccatgcaatttattgccgcacgaaacctctgttttcttatctccaaaggctataaaaatattgtcctgccacaggacagaggcataaatgacaaaatacattagaatactttttccctttaacattattttattgaattaaagcattgttcaatgtactgataaaactagtcgataaaactagtcatgacactgaaaagtatgcaatgcaatgaaggaagatgaaggcagtaaagttcagaaatgttacaccataaggcatggagaaaacgatagggcatggatttgaaccatggacgtttccctttccccattatattacatggtctctcaacaatcaaagacaatgtgttccctgtccctacatgccaagtataaaaacctcacccttttaaaatgcagtagtctccacttatctgaggtttcacttactgtggcttgtgttagctgaagtcacctgcagtttgaacatattaaatgaaaaaatctagcaataaaaattgtatacattttaaattgcatcactctgagtagagtgatgaaatctcagacagtcttgctccttcctacctgtgacatgatgcatccatgctatacatgctacctacctcttagtagctgtctaggttattacgttcactgttgcactattataacgcttgtgttcaagcactcattttatctttattaaagttcgttgttataattgttctattttattatcatttattattgttaatctcttactgtgcctaatatataaggtaagcttaatcctaggtatatatgtataggaaaaaacacaatagatatagggtttggtactatccacagtgtcaggcatccactggggtcttggaaagtatcccccatgaataactactgtactaaaacaaaaattagatcaattacgtatagttaatttgtgagcattactttttaattttttccaacaaagataatgtagccttctgcttcctaagtagggaatttttctaggctattatatagtcttccagctatcagtcattctctgtacatattctatatttaacaatataagtgagcaataaataaaattatagattttaaaaaatcatgtacaccacaaatatttacaattacatctgtcaattaaaaaatctaaaaaaattataaaatattatgaatatgcagcttaccagttttgtttgtttttaaacctgaaggtggttatttaaagtaggcccattttattaaatgtgatactttcaaattggccaacatgcattgcctgaaatgtttcattatgcagtacaacctatttattcaggtgaaagtatacagaatattgcatatctctacatgcattgatctaaatgcaaatgtagttaaatgtgaaatccaaccttggtgtcatttagtgttacattcagctatgaaaatttaggagcattctttcttcattttttaacatagaaatccagaaatcaacagcaatttcaggaaaaacttgcaaaaatgaggtagaacattttaaattcatatgcctaagccatttagaaagcatttttgcaggtataaaataagttaatgttaggttgtgacatggtcattaaaaaagaaggtttgatagcttctgtagaccatgttcacacagaatttaaaggtaagagaaaggcaaaggctttaggtttttatttcacccagttgtaggactgactaaggtgcttataccaaattcatttaaatcaaattgttcagggaaaatttctaatcctgcctggtcaaaattctatattcctagtctcattgctctattgctacaaaacaacatcataatgaatctaaaataaatgcagcaaatttgaaatctgggcatgggatttaaggcaactgttttacttatcttcatccatctggattgctataacaaaaataccatagactggatggcttaaacaacaaacatttatttctcatagttctggaggctgggatgtttaagatcaaggagccacacagactcagtgtggtgtggtgttgttacagccgccttcctggttcacagatggcaccttctcgctgtgctcccacatggcagaaggggcaagggagctcactagggtctattttattaggatacaatccattcatgagggttctgcccttattatctaatcacttcccaaaggcccccacctcctaatatcaacatcttgggtgttggaatttcaatatatgaatttggggaacataaagatttattcataacatcattgtatgaataagaatattggaatccagtaaggctaaatgacttatctgtgaccctaatagtagattgaatacaagatcagaacccattcctttgtgtcccatacatccttcctttaacattagttccttgaggtaaagtgttgttcaatgtatgagtaaaactatagggtcataacactgaaaggtatgttagtgcaatgaaggaaaatgaagaaggcagtgaagttcagaaatggtaagtcatacagttaagagaaaattataaggcctggacttgaaccatggactttccctctcccattctgttacatagcgtctcaacaatcaaaggcaattgttgatgttccaattcactggattatactgtccacataagtacaaagctgtaaagaagtcactgattcccaatggataactttacagtttgtaagctgcattaggaattttatgtcacttgaggcacttgtttttttcatggcaatacaaaataaaatcttctaggcagaataaagtagcattgaaagtgaatgggggcatcctagccaactgaatgtgcctgtcatctttccactaactatctacagcaaataattttacgtactgaaacattctggctaacttactcatgtgatgagctaaatgtcctctgaagtagttttagatggtgaatgacaatttccaattggaaaaatatagtatcagaattttttcctatagaacaataagctttatatcttagatataggggtataacctaagcatattcatttttgcttcctgaaaaatagtaacatgtattaggttgaatgtttgcaaaatgtttgaatatcagcagtttcataatgtttaacataatagtataacatagtggtttacattatgggatctgttcacagagggctcagagtccaagtttagttctaccacttaggaatatcacatgatattaatagggctattaagaaataatcattaaaaattttgaatccttttgttagtcatatgagtgctgaaaaatgctagttgttatgatggccaatgatgatgatgatgatgatgatgatattattgatgatgtctgctctatacaaataacccatcacggttgagtcaatgggtttgaagagctgatgtattttgaatttcctgaatacaatgactgtagaaaaaagaagatacttatacaaaattagcttaggaaggatcctaccatagagccttcagagagcacagcctggtggacaccttgatttttgacttcttgactccagaactgtgagatattaaattattaaatttctgttgctttaagtgaccaagtctgtggtactttttacaatagctctaggaaattagtatatatttaaataaatgttgtcaaataaaaatattagcctgggttgtagtgtgagtgaaaattggatgttattgaaaatgttgattagcaggctaggttttttggcagattaggtttagaaagtaattctaatgcacttatggtacaatcttttgttatggattgaagccaaaatctaaatggataactagacaattttcaaaaagaacatgagataagaaaatatcttttgttaattttcctattaaaagattccccctaaattaaggaccaatttggtaatatgagtgagaaaggagacaattttttccctttaagattaaagtcaaacaacaataacaatgataacaattaaagtcccatatcatgtattgagctcctggtccatgcaccaaatgtctcagacattgtgtgaagcatttgcctgcatcattgcatgtaatcctcacaacaatcctataaggcaagttctgttaccatctcaaccatctcaattttacatagtgcaaaattgggactcagaatagttaaatcacattctcatcaccacgaagttctcattgtcacgaataaatgaggaattcaatatattgagacacttgcgtcttgttcatgttttaagagtttagccaaaatttgtttcaaaacatctgagacttctctggaaagcttaaaattttttggtattattcagtgagtgcttcttcctgaataaatgaaacattgaaatagtagatataaaattatcatgacgtttaccagtaatatttatgatgattcctacatctagaccttcatgacttgctaaggtcaagcctctttggaaatacatggaaacagtctgtgctatggccaggaccacacaaggccaagggtgtgagggtcaattctgagattctcttatgccctgttactcaaaaatctccatgaaatgtgctccaaacctgttttgagcttggaactattcactattatatttttgctcacttaaacaaacattcattgatcatatactggtgtgtttgccattgttgtgtgatttggtaactcgaaggcaaacaagaatagatatcaacccttgatgagatcacagtcctgtaggtcaagtaggagagaaaacaaatgatttcaaaatactgttttatattctctgctagtgttgtgcaagggaacacaaagaagaagactggcaaaaatgtcctgagagagctaatccccaacctgagtcttgatatatgatcgggatgtctatataacatgatattcaaccccatctaccagtcacaaaaatctgaaaattaaggagttacatatttgcaaggactgaaacttgtcatacattgctggtgacagtagatattggtgcagctatatggaagagtaatttggcaatatccagtaaaactgctaatacaaataagtgacaatattttctagatgtaaacctagacaaaccctcatatgatatacaagaaaacatgtataaaggtattcattgcagcattgcttataagagccaccatcagaaaaaaacatgatgattatagttaacaatattttatgttcttgaaaaatactgagagtggatataaagtgtgctcaccacaaaaatgataaccatgtgaggtaatgaatatgttaattagttagatttagtcatttcacaatgcacatatacttcaaaaactatgttgaacatggtcagtacatacatctttgccagttaaaaatatatacgtaatgccagtctcatccaaaagtgccctcgtgaaaataccaagaataatgtttgactaaatatcccagcactatggcccagccaacttggcacataaaattagctatcacaagagtagacacaggagactagttaataaaaatggttgcaataattcaggctccaattcagggcctcaaaacgtagtaaaagttgagtatatatttgttaatttgagttgattcaacagtgactttaaaatgtgagaaatttgtgcatatgtacacataaatattttatatatattttatgtattttagatgtattttataactaacaatatataaatgcaacatactatctattaatatattttatatttaactagattaaatatttaatatatttaatgtatttatgtattatataaaatacatatgcattatatatgttatatatgtgctatgaacactagtctggtattctcaatgagttctcatcagctcattccaaagatattctgcacatggtttattctgctggacttctctatgtcatttgttttatgttctggtgaacagttttggttcataatgtctggcagaatatactagagtagttctggacttgccacaaaaaagactaattttgatagtaccaagtgaacattattgttgttttctagactattagttgttttctagacttctagacctcagtatttagaacaatctacgaagaagacaaaatcatctgttgagtctaccactgcattgactacaggagagctaactttacaaggaataatgcgtatgtgagaaaagatgaacatctattaatacatttatggatgatcagaaacatcaggtgcttaatcaggagaagtacataaaacatcttaacctgcatcctcaaatgaagcaaagaagccataaaaaacattttgagatagttatgcttgacctagatgatcagccctgcagtaacccgcatagcacagacctgatcagtgtgaagtaagtgctgaccacctaacctgcagttttgaattcctcatctgatcaagggaatgattagcatggtcattctcgaagtttattctccagtttcttcttaatgtggattaaattgacgttgatggtaaatttgtgccaatgagcattttaatctcataagaaaagagtggtttaagacttcctaggaccatttcactttcttactgggcagtaatggttttttgggattttaggctgaataaggttgtgcttataagccattcaacgacactaatcttctctaccaccaagtcttccatgtttggcgtaggcctgtacactttgctgcatttctttcttcactattatttggcacggaaaatatatttattaaatcatatttatatcagattatttttaagtgaacacatttctggtatgcatattagggatagaaaaaagaatccatcaggatgatgcttacattgagactgcaataatatttttcagaaagttctctgtgcaccaactctaccaattaggaacttgatgatcttgctagatcatttatgcttttgcagtctcatcttaatttttttctctttcctcaggggggatctgttatagggtggttgtgatgattaaatgcccatgagaagctcttcataaaccttaaatagctatacaaacatattaaatagttggcattatagataataatctgattgcaggaaacagaagatcaccttctctaatatataaagattatttttcactcagtaaatcaatgaacaagttaaaatacattcaaaagattactctgccacacaattaaaagcagtctattctttctagggactgtcagtcttggcaatgatatattttttttctaagaatcgaagtatatttgagctgaaaggggccttggagaatatccaattcaatgccctcaagccccacccatctccattttatcataatgtaaaatgtattatgaacataaattaaaactttttgggtggtttaaatggattttactttgaaaactatatgttaaaatggatttagattccactatgacaaaaatgaagcctgaaattttagatttaagaataagaatcacatttcctaaggattttttgttaaatgatgaatgaaaaaggattcagagagaaagttgatgggtagatctgacatgttaccgtaataatttctcgtaaagtacatccacataaataagatatatggccattatcaagtaatatgagaaaggtgtgagggtgagtaaagctgctgagaatgtagaaaacatcaatgagattcccaattcttggttatctatgagctttttgtgcataatttagatctttaattccaacattttcctactgccactaagcatgcttctgagtagctgttatcagtcaaggtatgtgcaaagaatggaaaataattataatattagcacaagacataattagaagtataaatattatataaaaataatcataggctacaatcattaagaagaaataaacagcttttactattcacaccttcttttgttataggatttcctgatatttataacgatttcaatactctattgtttagaaaggcaattctaaaatgagattataggaaaaaataattcacaggactccttaaacacttatttacttgaccatgtttggaaagagaagtcttccaaataaataagtatttaaatattgaagacagaatataaagagggaattagggcttgtacttacgactaggttttttagcaacacagcctatgatggagtcacaatttcacctatcaaccgagagaagtaagttggaataaagcagtgtcttatgcaatgtcacaacccatgaagcataaaaggagcagtgataatctgttttgcttctgatttgtgtgaatttggattggactggactggctaaatcccctgaagagctggcttagaagataaattctatgtataatagcaatattggtgagagaaatattatgagggttttttttttttttttttttttttttgagacggagtctcgctgtcgcccaggctggagtgcagaggcgcgatctcggctcactgcagcctccgccccctggggttcacgccattctcctgcctcagcctcccgagtagctgggactacaggctcccgccacctcgcccggctaattttttgtatttttagtagagacggggtttcaccgtgttagccaggatggtctcgatctcctgacctcgtgatccgcccgcctcggcctcccaaagtgctgggactacaggcgtgagccaccgcgcccggccgagggtttttttttaagcaaaggaaaagaaaatcttaaagttagagaggttgtgaaaaaacatgtcataaagtaacgtatgacggcaaggttagctttgggaaaataaggtaatgtaattcctctgaagatggagcaaaggaacagataatgaggactgattataatacatttatagtggaatttaggtgagtgcccaaaacatctcagctgaagaagaggagatttgaaggaatttaagctggagaactttaatctgcccagtagaacagggtaggtcttatacttagggagaagagaaggagaaagacttggtggctcaagaactgaaagtttggaacagaggcagtgagtcataccacatgaaaaaaatataaggagagaacagaaagcatgctgggcagcactgaggacccagatgaagtcagaaatcatagtagagtcaatacattttccgttaggactattcaagaggaaaaacatgtggtacaggtagcacagggctggcagacagccaactacaagaacctaatgtgtacagcattgaaatggcccataatatggctcagaccagataagaaataaatgacaccagaaaaattctcagggctcatgaggccagtgaagggtattacaagaaatgggaaccctcaaggcagaggccagttcaggttaaggatatagacaaagaataagtatatagaaatcaaaaacaaaaagaagaaaaaaccagaaaataacccaggcataaggaaccatgaatggacacagttagaaacagaagaaaattgaaaaatgccatgtatcaaaactcatccagtgctgctgaaaccattcctggaagaaaatgtatgtccttaagcacatttgttagtaaaagttagaaattaatgatgccaaaaagatagaaacatattattaaataaagaatatataattttgtatatacaaagatgaaatatcaataaatgaatttagcaaggttcttagatacaaggtaaatatataaaaataaattatatttttcacaaatattagaaaatgaaatagcaaataacttacagcaaatatttttaaatgcacaaaataaatacattaaaaatgtataggacccctacaaataaaatatacatcattttgaagagaaacagaatacttaaataaatggagggttaccccatatttatcagtggaaagattcaatattgtaatgatgtaaactctctgcaagttattttttaaatttaatgcaattccaataaaatgtaaatttttgtttgtttgtatgtattgttggcacttgataagttgactttaaaatttatttgcaaatgctaagaatagctaaactattcttgacatagaataagggagctaggggaaagactcactttttcagatatcaaggattaatttaaagctacattaactaaaactgacattggtttacgcataggaaaaatgaccagtgtaacacagcagaggccagtaggagacccatgcaaacatagagagttgatttatgacaagagtgtgcatcagagcagtaggaaatgaaaactcttaataagtgaatttgactcttatctcacatcataaaacaatcacttctagaagaattttacaacataatgttataggtaaaacaaatttagaaaataacatgagaataattttagaatcttgggacagaagaaaaatttctgcaatagacacaaaatacattaaacataaaaaattagattaatttaaaatgatactaattatgttgtagtaatatgaacttctgttcaatgaaagaaactaggaaagacaaagaggaaagatacagactaagagaagatatttttcacatatataataaacagatagtatatagtgatatcctaggaataacttagaaaaaagccaatccaatagaaaaaaaagagcaggatatttgactaggtatttaatcagagagactgtttctctgattattaatgagaaaaggcattcaccgagtgtcgtaacctactcactataatggttaaaatcaaagttatcaacagtgtcatgtgtcacatgtgttagtatgtggcataattaaaatgtctaacaatattataatagacaaaacaaatttttcagaatagtcctatgatagaatcctattcagcaataaattttttttaaaaaagcaaatgactgacagctacttgcagcactgtggaatctcacaatcagaatgcttaataaagccaaatacaaaagcatacatacttaaataacttcatttctatacatttcaaaagcaagcataactgaagtttggtgttagcctttaggacagcggttacttctagggagtaagggcagggttactaataggaagaggacaaaagggagactgtcagggtaccggctattttcatcatggttacctgggctattcattttggaaaaattcctttggttgtaaatttgttttgtgtgtttttctatgcgttatactgcaacacaaaagaaaacagacaaagcatgtgaatggaattgttgacagtgtatttcttgcattcataatacaatacatttgtaacgcaatttcccatttctgtttcaatgactaacctttcatggatatgtagccttagattttagaatcttgcttaaaactaatgacaacaaacaaggtaatgaagactcggtaaaaactacactattgaatatattatgattctttagcttcagagcagttactgtagctgccttcctccttttctctttgcccatatatagcctgagccttctaatatttctaatacaccccaaggttgtcaactcatggcttagattattggccagtttgactacccctaaaaatgtaagtggaaagggtcacagcaggacatgtagccagactccattaaaaatattaataaaagaagagcacaaatttattaaatgaaaatcctctgatctgttcactgtagcaaacagctgttattctgtatcctaccgagggccttgggacccagtggcactagcaggtttgcctctgtgtacatttctctcagctggtcaaataaacagctcttctatcctcctgtagagaggcagggttgctcccagttgtcaaactcaaataatccccttcaaacagaatccctggcaagttcaaagaaaacatgccaaaccccactgctctgggggataatggccaccaagaaccgactgtgggagtagaaattaaaagatgcctctgaacatgaaaccttaataaaccaagcatctttacaaatattactccctcatccaatgccctttctcataaaattaaccccaatcccttatgctctcatcccctcattttatattccaatagttgaagttcaagtttacttagcagcataaaattttacttacactgttttccaatcacataaatggtcttgaatatagtgttaccaaaacataagacaaaacaagtagaattacatgtcaaagcacagtttgaccttcattttaataaccaggagagatataaaaatattaaacagctgataagacacaagttgacactgcatggacacgactaattagtaagcaactgattaaccataaataactggtgcaactaataattcatatacataccttgtggctgatggaagaaattaataatttcttcaagatttgtgagtatgtttctcaattccttttcagtcatcacaagttttccttgtatccccatggatctcacccacacagaaaaacaggcattatcttttctctatctatcttttctatctctgcatctctccatatattatctatctatctatctatctatctacctacctaccatctatctaactatttatgcttgagaaaataaggtccaaaatttagctgattaagcaggaagagttgaatgtatgtttcagtgggtaaataattataccaatagtgaaaatagcctgaacactttaaaacatcatgttactgtgtaaatatcatatggctgcttatatctatcatttggtttctacctttatctacagtgaatttcctgacttgattttaataggcaccatgtggcctattttgccatcccaggcagctcgtaaacttcagaaataaataacttccgcttatgtcacaggggtgttttaagtagtaatataaatgtgatcacttgccagaaagtatttgaattcatcagagaaaaggtaccatgtatgagaaatgtaatatcacagtgggtaggggctaaacatggtcattcttagcctaacacttatctgggcagtatgtctaaggttttcctattgatggaatgctagcctggatacctagattgtgtgtgagaggaatgaacattgagctgggagtcaagagatcccaacatttgtcatggctctacttcagactagcattggcaaattttcataaaactctactttctaggcattaggtatctcatctttaatatgagatagaaaaaaacagtagataaacttgaagatggcttccagtactaacattctgtaattctgtagttcatgctaatccttcatgcctaagaaggtaaaaaattgtttttgaaagtaaatagcagaatgatgatttagaagttaaagttctaccttcactgaaatgcctaccctcatcaactaattaggatttagccctcacaggtgacttaggataagagaaaaggcttcccttatcctatcaaagcttgtttccaagtactgtagtatgtaatcttactcatttcttccaactcactataatctgtaattttattttcattttaaaaaacattttctcctctaatataatttaggctatcttgtttactgctgaattcttagcatccagaacaaacacctagcatgtagcagggctcaaaaacatacagtgagtgaaaaaccaaatgcatatcaaaaccatttagcttagtgtagcatatgactagatatgtttaaaagaaagatgtttaatgaacactagtatgcggaagactgttttcctcagatacactgaaagaaaaggtgtgctggaatcagatcaatagaaagtatccggcagttttcccagtctaaatcacttttgccaggtcattagataagtacatagcttacgtatgataatggttttgcaataattcaaagagagtagtcttctattttatatgacatggcattaattcagtgaaagctttgctgaatcctagagtattacttttatttactgtggcatggttttaatatatactcaagttagatgcaaattttagcaaaagatatcagctgagtgctttaatcagtttcatattgtgctaataatataccataatatacaaattgttatatatcatgttgtagaaaaataatttatataactgagctttacaaaacttaaagcataagaaatgtattttacatgttttctcagcatctgtagtttcaacatgtatattgtttgttattgctatttattgtgtgtgtctatttttaaagatactatgtttagcaggattaaaaatatggatgtcatctgcattgctccagaacactctatcatagaatagtctgttgggtaatttgtatataggtcatcaggatttctttataaggttaatctatagttatattttatgtagtcagagaaatcattgtcccatgatgtcttttcttgggtcatcttgataactgattgtcacacaatgatccaatcagccatttgattgatctgattcagtatatccatggcacctggaccaaacatttcaaggtcagactctttctgtgtgacactgatgaacatggcatacaacatcaagggataaaaaagtccattatattcaagaactgtcccacaccaaatacatttccatcgctttctttaaagatgactgagactccgaactgaatactgttaggccaatgatttcagttgacagcaatctgtggtatgaagttgcacagttagtatggacattcggtcagattgataaaaatcatcacggtaataatgcttcattaagaaactagagatttgtgttcagaaaagcgacttcaatataggatttggaagaaattaatactgaaataagcaaatagcttatgggtctagacagcagtcatgaagatacaatacaatgttatccaatttcaaattttaaaacaaatggacagaactatggaggagtcattgaatttcctgtcctctgaacaatcagtctcaaatacagattcatttttcatatgcctgaacttttggctgaagaattcatcacaaatatccactgagtatttacatgaaataggcattcccataggagctggggatataacaatatatacatttgacaaaaatctcttcccttttggactttcaggtctaatggcagagataggtaataaacatattaagcaaattaattaaaaagtgtattaggaagtgatagtgctatggaaacaaataaggatagggtgaaaaggggtgccttggacttgggggattatgtttgaaatagagagatcagggtacgctttgctgaaaagtgacaatggtagaaattgataaggttccattgggagggagatctacaacatcagtgggaagcatgttctgtgcagattaaatagccagtgcataggcaaggaggctggactgtactagcatgtgtgaggaacaccaaggaggtcagtgtggctgcagtgtgatgacatagggaagtgggagtaagatacacggtcaagtgtgtaggaccttgtaaaccatcataaaggcattcaagtgcaatgtgaagctgacaggggttttcagcagaaaagtgacaatatctgagttataatgtacagacttactcttctcaccatgggagaaaatacattatgggattacaagctatgatggaagaaggatagttggttaggagtgagatgatgatggcttagatcagagttttagactacaaactttccctctcaagtcaaattctcttccttgaaatgatacattaatgtctctggaaggcttccagagtttttccagtagttctctttagtggaatctatttatgccattaattaatgtaatgtataaatgtaatccatttaacctcaccaatctcagttgtcttatttgctaaatgggtttaaatacagtgcctaattcataacttaatggtaaaaattatacaagaatatgcatgtaaagcataacaccattgttatataatataaagtaaattttcagtacattttagctgttgttatacatgtgattgtcatctccaatgacaatatatatcattggagggattcagtttgtaaatatttcatttatggttgttgcaactgcattcatgaaaatgactgaagttaatatttatttcttttgtatgtgtactaaaattttgatattaatgttatcctactctcataaaatcaattaggatgggtcctttttttattccctggaagattttgtgtaggatcggtgttacttcttatgtttggaagaaatcactggggtaaagtcaccttggccaggcatttttttttcatgagaatgttttaaaaaacatatttaacctctaaaagaaatgacaagtcatatttcctatcttttcttgtgttcattttggtagtctgtgtttttctaaaaatttggccatcttttaattaaattttcaaattaattggaataaaatttcttagttatttagtaggctaaaaaaatggtctcccaaaagatagtcatgtcttaatcctggaaattatgaatgtgacctcatatgaccaacaacaacaacaacaaaaagttttgcagatgtgactaaattaaggaacttgagaggggggagattattctgggttcttgagtggaccctaaatgtgatctcagatatgcttgtaagagagaggcagacgaagatttcagagacagaaagaaaagacaggaccacaaaggcagagattgaaatgatacagccataagcccgaccatggggtagctatccaaagctggaagataaacgggacgggctttctcgcagaactttgcgaagcagtgtgatctagctgacaccttaattttgacccagtgactctgattttgttcttctggccagaaattcaagaactgtgagagaataaatttctgttgttttaattcatcaaaaggattatgtggtaatccctattaaaacttgtcctggctgggcgccatggctcatgcctgtaatcccagcactttgggaggctgaggtgggcggatcacctgaggtcaggagttggagaccagcctgaccaacatggcaaaaccctatctctactacaaataaaaaaatttagccctcgtggtggcacatgactgtaattctggttactcaggagaatcgcttgaacctgggaggtggaggttacagtgagcctagatagcaccattgcactccagcctgggcaataagagtgagactccgtctcaaaaacaaacagacaaacaaacaaacaaaaaaacttgtcttaatactgtaagaattttcaactgtatttttgtgtttattacagaagttaatagctaagtttttgaaacattaatgcttatgtttgaattctttgtgtatttacgtttatgcctttctaagtcattgactttttttgttaatatttgcttatttttcacattgtgtgtgtcataatagtgtaccatgtttctaaggtatgagtatattgtgagctctattcaagtgtacctcttcctctcaagcttttctcctcctcttcttggcaggtacttatcttctatatattcttatacttcaaggtttgcaaggacattttaaattagtcttttggttatttactgtaaaacttttgaattttcaaaattaacctctttattttgttataatatagatttgcatatggttgtaagaaataacacagagagacatcaaataggctttatccagtttctctcagtggtaacatcttacaaacctgtaacacaatctcagaaccagaatattgacatcaatacaatctattgatcttgtctagatttttttagttgtatttgtacttgtgtctgtgtttatatgtgagtttatttagttctatgcaattttatcacatgtagatttgtgtatttaaactagaatgaagacacagaactgttccattacctcaagtgtccctcatgttgtccttttaaccacattcacttttctcttccccacctctcccggctaccagttcctaatctctggcaacactgctctgttctccacatctataattttgtcattaaaaaattatatacataaatacatttaatatttaaccttttttagatttttttctctctcttttagcttttacttagcataattttctcgagattcatccaaattgttgagtgtattgatttctttttgtcctttttattactgagtgctagcccatgaaatggtgtatcacagttttttatccatttacccattgaagtggacatctgggctgcttacagtgtttagctactagaaataaaatttctttgaacatttatgtacaggtctgtgttaacataggtttccccctcccaggataaatgcccatgaatgcaattactggttgcatagtaattgcttgtttacttttataagaaactgatgcttctttgagaagctatgccattttactttccaccaacaatgcatatgcaatctttggatttcttttagtttctgacattcactatcatctagtattttaataactgcttttgtgtcacttttaacacttaattgctaggacaccacattaaagtctttctcatctttatcttgcaactgatgttttacaaaaaattttcttttttcttttgagatggagtctcacttgtccccaggctggagtgcagtggcgcactctcagctcactgcagtctccgtctccctggttccagcaattctcctgcctcagcctccctagtagctgggattacaggcgcgtgtcaccatacctagctaatttttgtatttttagcagagatggggtttcactatgttggccaggatggtctcgatctcctgaccttgtgatcttccctccttgaccccccaaagtatttggattacaggtgtgaggcacggctctcggcctacaaaaatttctttatgggaaaatatttggacatctgaaaaataatttccgggtaataggcaaatatcttcattgtcttcaattctgtagtaagatttcatatatacaaaggaaaataaaaagcacccacttaagaaaaaacaaattaagaatatgcttttattcaataagactacagtgtatgagaaaacctgacggaagttctaaagatattgctatacttaaaggtttctcaaggtggaactttaaattcccaagacaagaactaatttagtgacatattaagacatttaaataccattgctaaatgaaaatagccccaaattaatttttccaaaatcgaaaaagtatctttatttataagtcaatgcttattaaaagagcagtaaatacaaaaaaagtataaagaagaaaataaaattagccacagtagtattcacacacaaaaaactggctttcatacattcatgacttaaacgtctttgtgactagaatgagctggtttgggaagagagaaaagtggttaattttaagaaatgggattaaagtgaaaggactgtaaacttaaagcattactgacagaatgtagtgagcacagactcaaagcaagaagagttatcatgatgctaccttaactgttcagtaacaaccttagattgctggctccagccttgtattgaggccttcaagccagcaaagttataaactcttttattaaatgccaattatttagtttcttgtagtgaccagtgtcgtgcctgactcagcaccttctaaacttaaccattgtgaattgagtttatgaaggcagtgttagaatgtaaagatgaaggaaacatgtatacctcttaatttaatatggaaacctcaggtattatacaaaaccaatcctagcagcactggaagaggagcagtataaaaatgagttcactaaagcagtgccagattgaatcatctagctattgtgtaatgttagcttgaggatcatctattgcttattatttcaccagtggagaaaaagaacctataaaattaaaagaaaaaaaggctttctcctaggtgtctgtgagagaacagagtttaaagtaaatcaacacttcactggaaaatatttccctagttgtttcctctatggacaaagtccttgaggaatcagtcatgtatttcaagtgtcagcagagcttaggagaacagctgagcttcataactcttagcattttatttattcacaaggaaatattgacttaaattagctagattctgtcttggtgtcacttgattctctagacttacacagaggttggagaaggaatttatgcaattcaaagacgccaacttgtcaaggagtaaatcaatgtgattttcacaaagccagttttacataaggcgtcttgtaattctacaagaaatatgctattttcctttcattccattatagaaatatagaaaaacagttataataaattaatatatgttcccattctcatttttctttgagcataggtagcaacatcgatccaaatgattcaaagactttaagttgacccattcaactttatccaaattttgaagagaataatatgcctgaagttgaaaatcaagggcacattccttcacattttgcccatttgaaaaaaggggacaaaacccataaggctctatacagtttttcttgattagttacagtcttttaaattattttaaaataaaagcaataagcacttttaacttaatctttgtattcagccataagaacacactacctgttcttatgtactgaagcctcatttgaagatcctataatcactgcactttggcattgtatggaaatcttaataattttttagttcaggatttacatttatcacactttataagtaaaacactcaatgtgctaagcagtgtgtctagtttaagtaactaataagtggcagtcaaggctagaatccagagtaccttagttgctactgctagtgtccccactagcactacctttattatgattattattgagacaggatctcactctgcctccagggctggagtgcaggctgtagtgcagtgcctcccccagctcactgcagcctcgaatttctgggcccaagtgatcctcccacctctgcctgctgagtgattgggaccacaggcatgcaccaccatacccagctaatcttttaatttttttgtagagacagggtctccctatgttgccagtgctacctttaaatacccagtaaaacacatttaattctttctgtggcacgtaaaacttggagtggcttgcatgaccctttcgcctctaccctgaacttttatattcattccctgtgtaatcaatgctctccccttgagtttggacaaggcacacaacttctcattagtaaatatggcaaaggtgaagggctattgcagatatgcaatttagatgccaaataggttgattttgagttagtcaagagggaaattatcctgggtgggcctgactgaatcaggtaaaagcccttacaaaaagaactaggccttctctgaagttagagattttacataggagagagtcttcttgctggcttggtgatgcaagcagtcaggttgaggaagcctaagttgcagggaactgtgagtagcccctgggaactatggatggcctctggtccctgaggtcagcctctagcctccaatcagcaaagggtgggggctttcatccacacagaccaaagcaatattaattctgacaacaacttgaatgaaactagaagaaaaattttccccaatcaaacctacagatgaaaatgcaacccggctgataatacatgaccatgtaagatctcaaagagagggcccagataagctataactgggctcttgattcataaaaactgggagaaaacaagtgtgtgttattttaagctgctaattttgtggtaatttgttactctaatatagaaaagtaaagcgctttgtaagtggagtatttccccgtcatacttgagagtaaaatatgcttttaacctgtttgtgtataacacatagaaatggtctgctgttttgcagtcttgcttcacacatcacaccccttcctcatcactgcacagtcatatcagagctcctgccagaccgaagaagtgattgtttcctcaggcagtgatttgcagatgtttgattttgcaaagcaggataattttaaaaaatgttttggccacagacatagtgttaccaaactttaaattaactgcataacaacattttaaaaacaccagctactatataattattttatcattaaaaaccaaaatataataccaaaaagcttagtagggttagaatctcagaaagaaaagagtctttctcacgaacaaagagctggcaacttacacacacacacacacacacacacacacacacacacacacactccttaatattcccattttgccattgaccagaataaacagagcattgtcacagattgctaccagactatacacaatgtcatttggaagccaatgttgtaagaagttgttttaaaaaccactgggtagagcagatggcatcctctgctacttcgttcaggctgcttactatctttcaagattaagatgcttttatgaaggagtgaactagaaatgtacaagctgtctttttataccccactaattatacttttataaaaatatttcttcatctacagagcacctcttatttgccacatactattctacatagtcagtatctatcatgtcactgagtcttcattagagtcctgtgatttgtattactatgataatcgtcattttgcacatgggaaatcttacgtagcagggacttgacgaaagtgaagtgatcttaagttatttagcccacacttttaaacactatgttagaatgttacatggagtcacattttgccttgtgtatattcctttttgtccatattgatttcacacatagattaatctagaaaactgaatgagcatttcatggaaaacaggatataagacaagtatgaaggcatataaaaaattacgtgccatcttgaacagatctctactgacagcatatttgagagagattttcgatttgaggatctcaaacatggaagttcagaataaaacttaaaggacagcttttcaataatataatggtgaaaccaatggaagaaatcagtggagaaataaaaaggggtaaagaaagacgagagaatgttgagggaaacactaattagtaataacatggttgaggttcctcttggaaaccacccagaatctaacttgaactcagattcaacgaagatttatttactgttcattttgtacaagcactgtgcaaggcattgttacatgttttctagtgattatcagagtcataagcttgtggactctcgaatcagatgatctggctttcaataatatatctgagatggtatgcaaataggacaatatgggacttctttttttaaaaaatcaaatatttggttatgaataattttatgtgtcaatatggctagatcatggtactcagttgtttggtcaaacacttgtgtagatgttactctaagactatttttcagttgcgattaacatttaccaccagttaagtaaagcagacaatcctccataatatgaatgggtctcattaaatttgctgaaggccaagactgaggtttccccaaaaagaagaaattttacctgcagactgcaacatagaaattctaccttagtttcgagccttcagatgcaagactcttaactgcacctccagcctgtcggcttgccctattaattttggacttgtcagctcccacaattatgtaaatcaatttcttaaaataaatctctgtatatatgtatatcctattgtgcctgtttttctgaaaaaccctgactaatacatatgccagctgaactaaatgccagttctaattctccaaaatccattaaaaatcctcatttttatattatatgtgataatccatatataatatactaaatgtaattaagcatctagtctgtgtaatattggtctcaacagtttccccacctgtaaaataaggactaattatagtataaccttccagaaaagtgggaattatgtgagatgtcaagtgggtagcatagtgcctgacacacctaagatttcattaaatagaagctgttttgttatccttaaaataatcccacaaaaaaatattatttagagatgaaaaaactaaagctgagagaagtttaaatagctcttaggatattaagccacttattttgacagtgaaatgatggttacttttctgaatatagcttcctttttcctgagttttattgatcttcaatgggataaatgtgctgatggctgaaatactgaagtttacatgaagaataattgaaaagagataaggagtagcacagggtataaaacaagtaaaacacaatttgtaaaaatgatcattgataatgaaaatgctttaggattgattcacatatacgcaaattttggtggaacactcactaaaacagattttcaacatttagcagtcagggttgacactgggattattgtagaattctgagaagtgatcaaaattgagacttgtaatttctttccaccttatgttttatggatttggtagaatttgggagtgaaatatagaccaagactatgtaaatattttaaatctggctcatattttattatatatataaaagatgatcagtgatgttaagcacctttcatgtgcctgtttgccatttgtatgtcttcttttgagaaatgtctattcagagcttttgcccatttttaaatcagatgattactttttttttctgtagagttgtttgagctccttgtatattctgattattaatccctcatgagatgtacggtttgcaaatattttctaccatatatatgtaaaatataacatgtaaaataatcagttttagaacaaatttaggtttcattctgaggaaaagaaattacaatttagtttgggaggtattttgggcaaaaaaaaaaaagtcctatattatcctatcatgtaccttatcacagatcactgacaatatagaacaaagatggtcttgtttattttatttgtttaatgtttattgcaactttaattataattgtacaaaaagagaagaaaacaaaaattccctacaaaaagataatggtcaaatgcttattgtactttcctatgaaattattataattattttgcttttgataatctgtgtttaaaaatttttaatttttaatttttgtgcatacatagtaggtgtatatatttttagggtacatgagatattttgatccaggcatatgatgcataataattacaacagggtaaatgggtatatcccatcacctcaaacatttatcctttccttttgttacaaacaataccattatactcagttatttttaaaagtataataaatttttgttgactgtaatcaccccgttgtactttcaaatactagatattattcattcgatatcggtattatttatttttatttttattatactttaagttctagggtacatgtgcacaacgtgcaggtttgttacatatgtatacatgtgtcatgttgatgtgctgcaaccattaactcgtcatttacattagatatatctcctaatgctatccctcccccatcccccaccccacaacaggccctgatgtgtgatgttccccactctgtgtccaagtgttctcattgttcaattcccacctgtgagtgagaacatgcggtgtttgcttttctgtccttgtgatggtttgcttagaatgatggtttgcagcttcatccatgtccctaccaaggacctgaactcatccttttttatggctgcatagtattccatgatgtatatgtgccacattttcttaattcagtctttcattgatggaaatttggcttctttccaagtctttgctattgtgaatagtgccgcaataaacatacgtgtgcatgtgtctttatagcagcatgatttataatcctttgggtatatacccagtaatgggatggctgggtcaaatggtatgtctagttctagatcctagagaaatcgccatactgtcttccacaatggttgaactagtttatagtcccaccaacagtgtaaaagtgttcctatttctctacatcctctccagcacctgttgtttccagactttttagtgatcaccattctaactggtatgagatggtatctcactgtggtcttgatttgaatttctctgatgtccagtgatgatgagcattttttcatgtgtctgttggctgcataaatgtcttcgagacttcatccactttttgatggggttgtttgattttttcttgtaaatttgtttaagttctttgtagattctggatattagccctttgtcagacggggagattgcaaaaattttcccccgttctgtaggttgcctgtccactctgatggcagtttcttttgctgtgcagaagctctttagtttaattagtgtaagtgttatttttgtacccattaaccgtcccctttgctcccctgtctagtactcctcccagcctctggtaagtatcattctactcgctatctccatgagttcaattattttcatttttagcttccacaagtaagtgagaacatataatgttcgtctttctgtgcctgcattatttcacataatataatgtccttcagttccatctctgttgttgcaaatgacaggatctcattctttttcatagctgaatagtactccactgtgtgaatgtacattttctttatccattcatctgaggatggacattaggttgcctcaaaatcttggctattgtgaatagtgttgcaataaacatggaagtgcagatatctcttcaatatgataatttccttttttttttttttggttatatacctagctgtgggattgctggaacatatggtagctctatttttagttttttgaggaaattccaaactgttctccatagtgattgtactaatttacattcctaccaacagtgtacaagggttcccttttctgcacatccttggtagaatttgctgttgcctgtcttttgaataaaagccattttaactgggataaggtgatcttattgcagttttgatttgcatttctctgatggtcaatgatgttgagcaccttttcatatacctgtttgccatttgtatgtcttcttttgaaaaatgtctattcacatcgttttgcccattttaaaatcagattattagttttttttttttttctgtagagttggttgagctccttatatattctggtttttaacccttcatgagatgtgatgtacagtttacaaatattttcttccattctgtgggttgtctcttcactatgttgaatgtttcaaagatggttttattaatgaaaaaataccatgggtgtatatttctccatagttcatagaagcagaatggggatgaattcaggtgactgaaaatgttattatcttgaataagcttaatggatctatttcctaatgtagtaagtcttttccattgctaactttggtgatttttattattaaacaaagtcaatataagatgtggttggttcatctggattaaaatacatacacatgccagaatctattactccttttttatgtttatagagatccacaaaaattgatgtgaagagccagttttctaaaactaatagcggagagtgtcatgcaaagatttgtgactaaatgtgtatacttatagcttaatgcaccctgattgggagagccttgtgaaatatcactttactgggggagggaggagtagtcacatatgatggtccacagttaaacacacagctatgcctacctatacaagataaagatgaagcacatggaacatttccttggaaatgtgaaagggaatgaccccagcttaacctgagtcagttttgtattcaaatagtccctctgtgtacattttctcctttctctcaaacttgaatgagctctaaaataaatatctatttacattgaagccattgagcatttatctacctgaccatagcctagaaataagagtgaataagaaaaaggaaaaagtttacgctttgtattttgtaaatgtatgctagatttctatacagatattttcaagggccttgacattttcaatggcttatgagatattctaagaccttcatataacatttgagtccttgaaatcaaatttattggctttggaatacaaaaaagaacccataaaatcaaaatgaataaatgtttaattaaatgtctgcaagacataacattatgtaaacgtcattaattattaaatttagtattcataaaagttttattgaatttgaaaacagtttgctggatatattttttccacttcgcaagaatttctgagttctgctgaaaaatcatggcccatccttaattatatcatagttaaataatttcaaaaacaaaattacaacattcctttccagaattttgcagtaaataattaatgttgaatgtgggtgtgctttcatatgtttgttatgaggcatgctgtggcttcgaaagggctgaccaagttcttaaaacagctccactttgaattcttccattgcttgctgtgccatgatagataagaaagaaatacttggctcatgttccacttttttattataaaacctttcaaactaggggaagccttagattgtgttctccagaagcagtctctgggaaaggagttgtgtttagaaggttttttttactggggagtgttctcaggagatacagctgcaggaaagtatggatggcaaaggcaaaaactatcagcaatatggttgcaacagaggacccagtcgatcctgcagtgagctctggagctgggatggcccttcagaattgtgccaaaatattggggcagtgggatgggactttatttatttgtaattgaaaaataataactgtacatatttataaagtacaatagtttcaatactcaatatatagtgatcagatcagggtaattagcatatttcaatactcataatgttgagtgatcagatcagggtaattagcatagccatgtttcaatactcatgatgtatagtgatcagatcagggtaatcagcatatccatcatctcaaatatttatcatttatttgtgttggtaatgttcagtattctccttctagttatttgaaactatatattactgttaactatggtcatcctacagtgccacagaacactataacttattcttgctatctagatgtaattttgtatcctttaacaaatctctccttattcctcctttcccccacccttcccagcctctaatatcctctgttctactgtttacttacattagatcaaattttttttagcttccacatatgggtgagagcacacagcatttaactttttgtttctggcttatttcacttaatatccttcagttccatctatgttgccatacatgacaggattttattcatttttatggctgaataatattccattttgtatatgttaattccatatcttggctattgtgaatagagctgcagtagatgtgagatgcagatgtctcttcgatcttctttgctttggatagattctcagtagggggattgctggacaatatgtagttgcatttgtagttgtttgaggaaccttcatactgttctccatagtggttgcactagtttacaattggactggggcctctgagtccctgaattagttagctgtcggtctcatatctcctctgggaggtgacataacctttggcaggcagctcttgacagctgacagaaacactttagggaggggatcaggacacagaggatcacaatatgtatgcacttatgtactttaaggagtattagatttctcacaccaaaattcagcccatatgctgtggttatgacaaaggtagattaaggagagctaggatttcatccagttcatgagtttaccagattaatacattggtgatgatgtgttgctggaataagggtgcccttagtttctactgatgtttaatatttaagtgtgcacagtatgcttgatgaagctaccaatacaatattaaatgttcaatgacatcccgaacattctaaattcagttattggtattttatgtgatcatgtagaattctgggtttaatctaatttagtcaaatcataacccatagttattgtctattgagcatctatcactgtactagatccctgaatgcattatattactcatttctcaatttacatctcccatgttaaaaatagaaagctgatgtctagagagtttatacaacttatccaagtttacacatggtgtaagagatgaccaaatatctttgattccaaagactttttctctgccaatttaccatgttgccactctagaatgacatttttaaatccttcaaaatacatggaaaagtaatttaaaacggttgtgctcaaaaaggtgacaaaaagctgtatgtgaatactgattttataataaaagtcgcttgctactactatgtgccacatattgtttgaagcactttacttgaatagaccctttacaactttagaaatgatatcctatcatcttattatcctcttttttgaggttggtaaaataatatacaaatagggttaggtaattcccaagattacatagctacaggcagtagagatagcatgtgactcctgcagtctgactccagagcttcccacttaatcacaaagctctatctctcttctgggtctatcccacttaaccagaagtgggattctaaactgtgtactacattgttttaaaaagcaaatgttcccttgggagggtgtatgtgttcaggaatttatccattttttctagaatttctagtttatttgcatagaggtgtttacaatattctctgatggtagtttgtatttctgtgggatcagtggtgatatcccctttatcattttttattgcatctatttggttcttctctcttttcttctttactcatctggctagcggtctattttgttaatcttttcaaaaaaacagctcctggattcactgatttttttaaagggtttttcatgtctctatctccttcagttctgctttgatcttagttatttcttttcttctgctagcttttgaatttgtttgctcttgcttctctacttcttttaattgtgatgttagggtgttgattttagatctttcctgctttctcctgtgggcatttagtgctataaatttccctctaaacactgctttagctgtgtcccagagattctggtacattgtatgtttgttctcattggttttaaataacttatttatttctgccttaatttcattatttacccagtagtcattcaggaacaggttgttcagtttccatgtagttgttcgattttgagtgaatttcttaatcttgagttctaatttgattgcactgtggtctgagagactgtttgttatgatttccattcttttgcatttgctgaggagtgttttacttccaattatgtggtcaattttagaataagtgtgatgcactcctgagaagaatgtatattctgttgattttgggtggagaattctgtagatgtctactaggtcttcttcttccagagccgagtacaagtcctgaatatccttgttaattttctgtctcgttgatctatctaatactgacagtggggtgttaaagtctcccagtattattgtgtgggagtctaagtctctttgtaggtctctaagaacttgctttatgaatctgggtgctcctgtattgggtgcatatatatttaggagagttagctcttcttgttgcaatgattcctttaccattatgtagtgcccttctttgtcttttttgatctttgttggtttaaagtccgttttatcagagactaggattgcaactcctgcttttttttttttttgctttccatttgcttggtaaatattcctccatgcctttattttgagcgtatgtgtgtctttgcacgtgaggtgggtcttagtcaaatccctgaatagaccataacaagttctgcaactgaggcagtaattaatagactaccaaccaaaaaaagcccaagaccagacagattcacagccaaattctaccagaggtacaaagaggagctggtaccaatccttctgaaactattacaaacaatagaaaaagacggactcctccctaactcattttatgaggccagcatcatcctgataccaaaacctggcagagacacaacaaaaaaagaaaatttcaggccaccccaatgaacatcgatgcaaaaatcctcaataaaatactggcaaaccgaatccagcagcacatcaaaaagcttatccaccacgaccaagttagcttcatccctgggacacaagggtggttcaacatatgccaatcaatagacataatccatcacaaacagaaccaatgacaaaaatcacgtttgtctcaacagatacagaaaaggccttcaataaaattcaacaccgcttcatgctaaaaactctcaataaactaggtattgatggaatgtattttaaaacaataagaggtatttatgacaaacctaagacacaagacaagggtgccctctctcaccactcctattcaacctggtattggaagttccggccagggaaatcaggcaagagaaagaaataaagggtattcaattagaaaagaggaagtcaaattgtctttctttgcggatgacatgattgtatatttagaaaaccccatcgtatcagccccaaatttccttaagctgagaagcaacttcagcaaagtctcaggatacaaaatcaacatgcaaaaatcacaagcattcctacacaccaataatagacaaacagagagccaaatcatgagtgaactcccattcataattgctacaaaaagaataaaatacctaggaatataacttgcaaaggatgtgaaggacctcttcaaggagaactacaaaccactgctcaaggaaaacagagaggatacaaacgaatggaaaaacattccatgctcatggataggaagaatcaatatcatgaaaatggccatactgcccaaagtaatttatagattcaatgctattcccattaagctaccattgactttcttcacagaattagaaaaaactaccttaaatttcatatggaaccagaaaagaacctgtatagtcaagacaatcctaagcaaaaagaacaaagccggaggcatcacattgcctgacttcaaactacactacaaggctacagtaaccaaaacagcatgatactggtaccaaaacagatatatagaacaatggaacagaacccaggccgcagaaataacaccacacatctacaaccatctgagctttgacaaacttgagaaaaacaagaatggggaaaggattccctatttaataatcctggtgttgggaaaactgtctagctatatgcagaaaactgaaactggacctcttctttatacctaatacaaaaattaactaaagatggattaaagacttcaatgtaagaccccatactataaatctcctagaagaaaacctaggcaataccattcaggacataggcatgggctaaggcttcatgactaaaacatcaaagcaatagcaacaaaagccaaaattgacagatgggatctaattaagctaaagagcttttgcacagcaaaagaaactatcatcagagtgaacaggcaacctacagaatgggagaaaatctttgcaatctatccatctgacaaagggctaatatccagaacctataaggaacttaaacaaatttacaagaaaaaaaataaacaacctcattaaaagtgggctaaagatttgaatagacacttctcaaaagaagacatttatgcagccaaaaaacatatgaaaaaaagctcatcatcactggttattacagtaatgcaaatcaaaaccacaacaagacaccatctcacaccagttagaatggtgatcattaaaaagtcaggaaacaacagatgctagagaggatgtggagaaataggaacacttttacactgttggtgggagtgtaaattagttcaaccattgtggaagacagtgtggtgattcctcgaggacctagaaccagaaataccgtttgacccagcaatcccatttctgggtatatacccaaaggattataaatcattctactataaagacacatgcacatgtatgtttattgcagcactatcacaatagcaaagacttggaaccaacccaaatgcccatcaatgatagactggataaagaaaatgtggcacatttacaccatggaatactatgcagccatgaaaaaggatgagttcatgccctttgcagggacatggatgaagctagaaaccatcattctcagcaaactaatacaggaacagaaaaccaaacaccgcatgttctcactcataagtgggagttgaacaatgagaacatatggacacagggaggggaacatcacacacaccagggcctgtcaggggttgggggtctagggagggatagtattagcggaaataactattgcagatgacaggttgatgggttcagcaaaccaccagggcatgtgtatacctatgtaacaaacctgcatgttttgcacatgtatcccagaattaaagtataataatagtaaaaaagttcccactgacacacatttctgggagccaaagtcaatgtatttaaaggactgtaaatgaatgggatctgagagtgttatttttaagcagaggtaatgtactggcctctgtccctaacaatggtagtaaaaatatactccaaatgacacacactatagcaaaatgtgggcaaggtgcttagagaaggacacttgaaagaggaagagtagattgcttcatagttcacggactgttgttttgatctctcatcaaaagagccatccaaacagatctctacatttatcaaaatatcaacattttattttctctaatgtttaaatatttcttagccactttctcatatgtatttttaagactataaaatgaagaaaacttttcatcaaccatttttagcacagacagggaaagattatttttccctgaaaatattcctttaaaacttctatctttgctactgtatagttaagcacaaaaggagatattgattataatgtatgattctgtaattttatcattatttcattacaaaacaatttttgtggctgctcacaagcctgataaatatatatttagtgatttttttggtcaacacttaaagtgactttctctttctgtcattttaatggcattgtgataaaaagatcaagactgaaaagaaagatagacacaagaacatatcaccttttaattattttataactacctatttaggattcctagaataaatattctacttttaccattaagtgtgaacattttataataattacttccttctctctcagagaaaatgttggtttttgccaaggaaaatctacagcatgcaaattcttctttcaagatgcgaatagtgcatatgtaagctttgacgggtactaatggacatttcttcctatttttgacccttagggtgaaaataacagcgccttattatttttcaggaagaataagatccatttccaaacagtttagaaactcagggctttttttccctcttataaatagacaaataaatggtcacattagcacttatacttcattgtgagccaaggacatttttaaaatgtcactactcagggttaatgctctttttttttttgacatttggccttcagatttttctgcttaattgtcggtttgccacctcattgccatatacagggtcaaatgcatctctttcctttcacattgccataagatataaagtccaaatgttttaaatgttttatatattgtgtactaccagacctttccaagctctatattaatttaagcctctcgaatctagagaagtcttccgctcaggctgaaattgtccccaggaaggattatcagttacttgtgtccaaccctaagctgctcactttttagcagatgcttgtggttttgctttctccaccagtgaaaacattttgggctagccttacaaaagtgaatacatatgcaacttacacatataatttactgatatataggaaagtaaataaattttcaaggtgattctgttaatgattaactaactcacataacttggacttcaattttctttttaagtaaggatcacttccagaacggcaccaaatcgaattgaagtgtgacctctatacatttttcactaaagatgacttttgaaaatattctaaatctatgggtatagaatactgaacctccttctgactggtactattcattgagactaattcactgagagtgagaagcatagtagttttagttttgatatggagatgtttggtttaatctagaacgcatgctgttcattatgggcagcctattgtgtcatgccacactttgggacagttactgggggaaatgaagagaaaagctgtccctcttaagaaggctaggagcctaaagactgatttctgtctcacatcaccctttatatactgatttgcttgtttcccacattggattattatcacctttataaaccattataagccctagattggattctcaattcttggctgccttttcaatcatttagccacaaccatcttgtcctcacccctccctgcagctgtggaaagtgggcttaaattgttcctaggaaatataggtggctgaattctgtacatcaggatgccattcccttggtcccagctgaagtgactaacaatggacatctattttaagaggataatatttgggctggataaaagcatctggtgtggcttgggcaaatgcttttttaaaatgtgaacaaagatgactggttaggtgagtcacagacttctggggaattgggccagtgaaacaaaaaagttgaccatagcaagctgaaactaagagatacaaaggaatgatagtgtgtaggtaccatacaatagcaaaagccaaagaaacagatgccatggggaagagaagaaaagagaaataatgaaaaacagtcatcatggctgaagtgatatacagagtgacacacacaagctgaattttcctaattatgtcagagctctaattcttgctcctagaaaagcaaatacacacacagaaaacactgatttccattgtctctgagttggcttttttttctctcttggatttttctctctgttgtttttccaacattacttaaggtaaacttagtgagtcctctaaaatattttattactataaacgtgtgaaacatctacagatttccccagttaccaaagcagagatttggtccttggccctgaagagttggtgttttcatagtcagaaatagaatgtgcatagatgaatgtaatagagaagataaatcacaaataataaaattataattatacctattacccatgtgtgaccatttttcagtggtttaccgataagttcaagaatgagaaaaactgtgagaaggtccggaaggcagccactgtactcctgcatactgaagaggcattgtccttccataaagaaatgtaggtggcatttcaaggaggaaaaagaactaagaaccaggattgaaatatgagaaacatacagagaagtgatttcaaggaaaatacagagaattctgagtgccagataagttacttacattgtgctagagttcatcacatacataatctcacttaaccttatggaaaacatggggaagtgaatatcccaaactaccaaaataagaaagtcaaggctcagggagcttgtagtaatttttccaaagttaaattttaaattcaaagtcattattttctggctttaaaatccacattcctttcattttcacaatatgcctgctcttcactcaacacaatcgcttgatgtcaaatagaacataataatcttattttccaccagagccctaaactcttttttttttttttttttttttttttgagacagagtctcactctgttgcctaggctagagtgcagtggcattagctcactgaaacctccaccttccaggttcaagagattctcttgccccagcctcctgagtagctggaattacaagcgtgcaccaccatgcctggctgatttttgtatttttagtagacacggggtttcaccaagttgtccaggctggtcttgaactcctgacctgaagtgatctgctcgcctcagccttccaaagtgctaggattacaggcgtgagccactgcacccggccagagccctaaacttttgattcttgtgtcctcattcttcccttgaacctgccagaaaagaaagttcttctaaattttaaaagctgttaaggaagggacaatcttgaactaataaaatgaaatctgggccgggtgcggtggctcacgcctgtggtcccagcactttgggaggccgaggcagctggatcacctgaggttgagactagcctgaccaacatggtgaaaccctgtctctacaaaaaatataaaaattagctgggcatggtggcaggcacctataatcccagctactcgggaggatgaggcatgagatttgtttgaacccaggaggtcggggttgcagtgagctgagattgtgccactgcactccagcctgggcgacagagtgagacttagtctcagaaaaaaaaaaaaaaaaaaaaaaaaaaaagaagtctggcttgcagtagatggtctcaaaggaccttcatactttacaaatattaacacagagtactccatattagccctggatattcaaatagagccttgcctagcttgctgagattgcagaagacaaaggttttcttagtatttgtggaggctctgaaagaacttatgcctgtgagctctggagtcagtgtctggatttgaaacttgaccctgtcacttcatagctatagtttagcaagttacttaatgtctgtagtctctgtttcctcaatgtgttataataggtaattatagattttctgtattaaatgagtaaatattgtaaaacacctaggactgtgccagaacaatgataagcactcaataaatatgagctattttgaagggaacacaagggtttttcactcaacattactcctatttttaccccctagtaaaaagaaggtctttctcaaataatttgtgacttgctaaaaaagtcaacaaaaccctttaatgtggctgtgtttaagtgtgtgtgtgtgttgagtggggtggcatatgtaagatattcttgtgttgaaggacttgacacagttgacagctatcttacttttaaaagggctttctgtaaatgtttagagaataaatattttaggccttatgagccatagtcacaaataataggtaaagaaataagtgtgtcctaataatactttattggcaaaaacaggcagtgggccagatttgatccaaggtctacagtttgctgactgctactatgggcacagtgctcaaataatgagtatgtagctgggacaattgctccccagattcagtacgaatattaatatttgatctgcggcaggccatttaacctttctgaccaaagtttttcattcatgagttagaataaatgctccatgaagcttctttatgactctactaactcatagtatgcaagggcctacaaattgattccatgtagcaaaactatcactattctattaaggttcctaaactttcctctatttcttctaaataaaatcctgcttgcctatttaggttctcctctccaatttttcctgactgttgattttgagattttataatgcagagtaagaacgaagggttggtgtagaagggtaatgtcaacatacttgtcagggctggggaaaatagttttgtgaaggtttccaaagtaagaaataaggaaacacctataatatgtggggaaagcagaaggtaaaaaaagtagtaatgctctgccatatttactcctttcactgtgtttgaaaaatgaaaagagacaagtttattttgaaatcttttccagtttttattttttattgatacataatgtttgtccatatttatggggtatatgtgatattttgatacatgcatacatgtgtaatgatcaaattcaggtatttatgatattcatcacattgaacatttattcctttgcattgggaacattttaaatattcccttctagctattttgaaatatacaatatattgttgttaactacagtcaccttactgtgctattgaacactggaattcctatgttgtatgtttgtacccattaacctacctctcttcatctccctggccctccatacccttctcagcctctggtagcaatcattctattctctacctctataaggtacacttttttagcccccacatataagtgagaacacgcaatatttgtctgtctatgcctggcttatttcaattaacataatgacctccagttccatctatattggtgcaaatgacaggatttattattttttgatggttgaagattattgaattgctttttattgtgagctgtgtgtctttaatcagaacatcattctgagattgtaccacatgggtaatggcttgttagatattatatatttataatcattctagtatttccacagattgagtagtgaatatgtcagcgttattaggtcttcagtggccattattgcaatttttataagcctatttttggatgaagggcagaagcttcagataacaataatagttggcagcctggcactttcatacaaacttaaaaaacattttcatcttcctaagtgaggtaaaactaatgatgactcttgaacaaagacaatgtccttactcaaaacatcagtgatttcaagttgcatcctctttagctgagttgctgcattcttcaaataactcttaatgacatctcaatgatatcttattccattgacaatgatgacaggttaaaaatttctttaaatagctgtctccggtccgtgcctccaagatgacaaagaaaagaaggaacaatggtcgtgccaaaaagggctgcggccacgtgcagcctattcgctgcactaactgtgcccgatgcatgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagtccgcaaggaccgaacacccccaccccgatttagacctgcgggtgctgccccacgtcccccaccaaagcccatgtaaggagctgagttcttaaagactgaagacaggctattctctggagaaaaataaaatggaaattgtactttaaaaaaaaaatttctttaaatagctgcgtatttttctggaactgtacatttctgtaaatctccaatcaccttatgactctggttcttactaaagttttattcctttaaaaaataccttgttagtcttgcagattgtttcccaagacttcagtaggcttataggaattctaggtagcttcaatatggacatttgtcctacagcaattagtaatagtccccatttccagtatcaactcttaaaactccttttcatagtaataagcctattcagcactttggacagtgcctaacacactcagtaagtatttgtggaatgagaagtaagtgaacagtcacagagaatgacttggacatatatctgcctgtaacaagtactatatttgctaaaattcccaatcacaaggaaactaaacaaaacctaacagaaccagccaatatagtaaagtctgtactccattgaagaattgaactttcaggttggggcaaatgggatactgtttactctcaggtttcatctaggtactattaccatcatgcttaaaactcaattgggttttgtgttgagtgtgggaataagacctttgaaaacctaattaacaaaaaattcttatctcactaatgtcaccttctatctgccaggattagacaatggtttttaagtgtctctgccattttcttttctctcagtttatctttggggttcttctccagagagaaagtcatgccactttagaagattcactcttaaactttcatttgacatggtgaaggtttataatgtactggatggtaataaaacactaggctcactattgttaccaacatgctactgttaactcattttcatgttctcttcttagaaataatgcaccattttcaaatgttaaacatattgtctattatagggcaaagttctctacagataatactactggaaactaaagtagacacagatattgaataggtgattcttcattcatgactgtatcctggtactgatttctataccaaggtatttataaaggtatgctgttttcatttcttcttcaactgattcatattattattgttataaatatcacatgcagtaaacatattaatggtaaataattgaatattcacagattgaggaacagctactatattactcttatgcttcatggacaagggaagtgtattcataaagtgaataaataagatgtgatttacaaattaagtgtaatagttattctattcacttataacatatgaaaaagttatgacttgaaaagttattctattcacttataacacatgaaaaagttatgacttgaaaatatgacttgaaaatttgtctatttaggacaaatccacagttgactgaaatagacaatggatctgaaaccactatcatttaagatatacaaacttaataaacatctattgtgttcatgttatgtgcaatgtgctttaaatataaagatgattaatagtgtagaaatttagaaagacaaataaaaaattatgatcatcaaccataccaataatttcatcatgtgtaaatgttctaaacacacaaattaaaatacagaaattttcagattttacttaaaaaaacccaatactctattatatgctattgacaagaaacctgctgtaaatacatggacatagctaggttcaaatgaaaagtacaaaagaaactaatgcagtacgaaagaaaatgcaaacaccaatcaaaaaaagcagaaacggctatactaaaataaagtaggcttcagaacagggatatggagggacattgcatagtgataaatgggctaatcaacctagaacacataacaatcttaaatatatatacatctaacaacggaacttccaaatactagaaacacaaactaatagaactaaaaggagaattaagcaaatccataattatagttagaggcttcaaaattctttgctcagcaattgataaaacaattaaactgaaaatcagtaatgacacaggaaatacgaataacactagtagtcaacttgatgtaattagtattgatagaaccctctatccaataacggcagactacatagtttattcaaatgcccaagaaatattcaccatgataaaccatattccaggccataaaacaagtcttacaaaatttaagagaattaaaattatgtaaataatgttttctggttataacatattcaagcagaaattagtaataaacaatctagaaaattccccaatatctggaaattaaataacacagaactttctaagtaattcatgggtaaaaaggcaagtcacatgggaaattataagcatttttaattttataaaattaaaaacacaacctgttaaaatttgggcgggggggcggatgtagctaaacaggcatatagaggaaaatttatagcattaactgcttctattagaaaaggaaaaagttctcaagttaatgatctagccttctatttaagaaactagaaagggaagagcaagcagaaggaagaaaataaagagcggacataaataatatgaaaaacagaaatacaatacagaaggcaatgaaacaaaaaacagttctataaaaagatcagtaaaattgataaacttctagccagagtgaccaagtagaaagaaaaaaaaaggcacaacatcaagaatgaaaagggatataggacctcaatacagatattaaaaatgtaataagagaatattaagctcaactttattaacatacataagttcaacaacttaaatgaaatggaataattctttttaagaaacaaagtaccaatgctcactcaagtggaaatggtcacctgaatagtcctacattaattaaatgaattgaatttgaagttgaagtcttcaagcaaagaaaacgttagaaagtcattacgtgagaaagacacatgcacacgcatatttatagcagccacaactctcaattgcaaaggtttggaaccaacctaagtgtccatcaaccaatgagtggataaataatatatataagacatcgattgccactcagccataaaaaggaaccaaatagtgtattttgcagcagcttggatggagctggagatgattattctaagtgaaataattcaggaaaggaaaaccaaaaatcgtatgttcccacttataagtgggagctaagctaggaggacacaaaggcataagaatgatataacagactttggggacttacggttgggggaaagttgggagggactgaaggatcaaacactacatagtgggtacagtgtacactgctcaggtgacaagtgcaccaaaatctcagaaatcacaatggaagaacttatccatgtaacaaaaaaccacctgtacaccaaaaactattggaataaaaaactaaaataaagaaagaaaactttaggcccagatggcttccctaataaatttcataaaatatttaacaacaacaaacaacgacaacaacaacatacaatttccatacaaactattacaaaaagcagaagaggagggaaaactttacgaggctagcattatcccgacacccaaatcaggcaaagacatcacaggaaaataaatctttaaaccagtgtccttcatgatcatagatgcacaaattctcaaaaacctaatagcaaatcaaatctagcaaatagacaaaagtgataatacttcatgaccaaatggagattatctcaagaatgtctagcccaacatttgaaaaatcaaccaacaactgatatcaacatccattcatggtaaaaacttgcagcaagataggcattaaaaaacatgcttgctaataggtggtaattatatatattaaaaaaaccctatagctaatttcacacttaatgtttaaaaacggaagattttcttcctaaaatcaggaacaaggcaagaggtctattttcaccactcccacccaacatactgcaagtcttagcttgtataacaacagcacaacaactataataaaaggcatataaatagaaagaaaaaaataaaatgacctttattcacagccaatatgactgtctacatagaaaatctgaagaaatctataaaaaggctatttgaactagggttgcagaatacaaagtcaacatacaaaaatcaaatgtatttcagttgtttcaatgtcaattttctccagattgagctgtggaatcaacacatttgtagtatattaaaaatatatatctgttgacaggcagggccttaggaagtctcctgggacttgtctccaactcttggcctcaagtaatcctcctgcctcagtcacccaaagtgttggaattatagacgagccaccacacctggtttggacagtctttaatacactcatgtaggaatgtagattgggagaaccattatggaaaacagtatggaggtttcaaaataaattaaaaatagaactaccatatgactcagtaatccctcttctgagcatatacccaaaggaaataaatcatcactttgttaagatattttcattcccatgttccttgcagtattgttctcaatagccaagatatggaaacaacctgtccattgatgaacaaatggattaaaaacccctgtggtacatatatacaatggaatattattcagtcccacaaaagaacgagatcttgccatttgccataacaaagataaccttggaggatattaggctaagtgaaataagccagactcagaaagaaaatattgcgttattctacctatacatggaacaaaaataatgcatttcaaatacacagagctagagaacaacaggaaatggggagatgtaggtcaaaggatacaaagtagcagatatgtaggatgaccaagtctagagatttcatgtgcaacatgaggactataggtaataaaattgtatttgacatgagattcatgccaaatgagtagattttagccaccgttgccacaaaatggataactgtgagttgctggatatgttaatttgcttcaatatagtaatctttttactatctataagtatcccataacatcatgttgtagaccttaaatatacgcaatacaatttatcaaagcaaacaaacaaaagtccccaagaaacaattgtcaatctcacgaatggaatgcgacattttggttaaactccagcactgaaaattatttccaagcattaatttgtatactgattagacatttttgtgttccatgactctttttacaattagatgttaacctgtagaaaactatataagatatagattatattttccaggtgaagatatagatgatttcttttttttaaaaatattttgtcataatttcaaggttacatagagattatcagaatagaacaaataatactcatatatcctttacccagatgatatagatacagattaatcacaatagtttcagtctaattgcctttagaacagtaaacacatttcaattaaattagcaaaaaagtattatgattatgtgttgtgctaaagtaaatgaggtttatataatgctatggaggcttcatgaatgaggccataattggcatgtaggactgcatgtcagggatgccttcactgtaagatgatatctgaggtacactttgatgagtgaggtcaccaaggacctcccaaatgctgaagtcactgcttttatctcccctaccccctaagttttgtgttgcatttcatatttctgaaaatattattaatcagcttgaactaaacagcaacacttgaaattcaggtgttttatcatcaaaatacacatttcactcttctcttgaaacatcagaatataaggcaacatttggtttgcatacaagcagggcaacagttagctggatctcagcaggggctgattcctaggcataagaggcatactcttctgatttgcaagcatagcaggcattatgttttcttgatccctgcatgtgggcgaaggacttgagaaaatctgtcctgaaaacaaatgcagtatcagcactataatgaggagattctggttggggcctaaagcaaaggtttttggggtactaaacctcatactcatgaattaagctaaggactggaggaagggtttaaagaggccacaggttagtagcacaccatggctctttttttttttttctttttcttttgagatggagtctcgctctgtcacccaggctggaatgcagtggcgcaatctcagctcactgcaagctctgccgcccggattcaagccattctccttcctcagcctcccaagcagctgggactacaggcacctgccaccatgccaggctaattttttttgtatttttagtagagacagggtttcaccgtgtcagccaggatggtctcaatctcttgacctcgtgatctgcccgcctcggcctcccaaagtgctaggataccatggctcttgatgcaatcaagtgcaaatcctctctgaaggaaattgttgggagacaattctctatgggtctcatgtttctacagatcttgtgagcagaagacctgtctttgttacgaactatttttcacggatgcttgtatagtgaagagccttgaaagatagagatggtgttttcctaaggagtaaacattgggtttgtgtactatccaatacaataaagatgtttccctttggctcgtctggcaggcatgcttgctgaccatcataaaagatccagagagggacctggaattgggatgtgataactcagtggtcaagggattttgtttattagaagtgttttaattttttaacaatattaatatatttatatataatcaaagtaaatatatttatatggattttgtgtaattataaaaaattagcaaatgttcattaaccatgtatcacctcaaatcacacacattaatgatgattcttgctccaaaaattgcctttctttctttttccccaaattccagtgtgctctcttgcctcctatttttgactcctattcttttgtccataaatagatttattattttcagtatcatttttgttgttgttgtttcccgggctgaagtgcagtggtgtgctgttggctcactgcagcctccgtctactgggttcaagtgattctcctgcctcagccttccaagtagctgggactacaggcatgcaccaccacacctggctaatttttagtagagacagggtttcaccatgttggccagtctggtgtcgaactcctgacctcaaatgatccaccagcctcagcctcccaaagtgctgggattataggcatgagccaccatgcctggcctgttatttctttttagttattatttacatttattattattacaatttgagtgtctgtaatataatctgcaaagttactaacgatgaaaagaataatcattacaagtatgtttatcatgtacccatcgacttacataaactcttggcaactatgtggatcttacacgctattggagaaaatacaaatggatacaacattttggggaaaaattaggtatattttgtaaaattcatcatttgtatgtaatacaaggcagaaattctattcctagagagactcttacacatgttcaccaggagaattacatgaacatattcacagtggtattgtctatatttgtaaaattctgaaaacaactgtgatatctctagataaagaaatgaatacagacattgtggtatagtcacattactgagtatttaggtgacagtgaaaaagaaaaaatgtggtctgataaaattgaatgggtaattcttggaaacacaatattgattggaaaaagcaagtgagtacaatgacattttgataagaattttataaaaatgaaaataaaattgtgcatatgtttacaaatgtgataaaacctttaaaaagacaatacagtggtaaacacagagcaggccatgtacacatttattagcaacaggtgatgggagaggtaaaaagcaatccacgtagattaaaactatgttggtgatattctagttcttcagttgggtgctggttcataattattcattttcttatttgtctcattatctataaatatatacagagagaatgtgtctctcacatgtgtcaaaatattacacactaaaaatggaatatacgaaactgccttgtgtattgctaatcatgtttgtcttgaataagtgtctgtggactgtatcagtcttaggatttagagattattttacaaggcgatactttttatgcctgcctgggtgtgttgcaggttttggaggtaagtaacatcatcttcttcagtgtcaaagcccatataactatgtgcaaagtaggagaacaatatctacttgagttactaccgggcaggtagcagatatttgcttataggatgcatttctacaattgtaattatgtttttaagaataaaaatattccatactaggaaactacataggtgttactgaaagcgtcacgctgtgtaatggaagtgaggattacttttttatggcccatggtttctatgaatagaattaaccagacaccaattatcacctcattgaaaggataagtcactgtgacatctacagctgagatcaaactcattgcttttgcaatgtgaattaattagagttggagagagctacactgaagggtgaggaagcactgcagatttgaaaagtctatattttaagcaactcaggggaaaatctgttccaattagtgtgtgacgttaatatgcaatggtcttatttatataaaagtgctttaaagaaatacttctaaaagaaaacattaaaagagtcatacaaaatatcctctttttgtgatgattataattaaaagaatataaaaattcagaaagtagattatttatttatttttaactggcaagcaggctctacagaatggggtatctttacttgaaagcatgtgttcctgggtagtgaataaagagagatagttggcttcttaccataattcaaaaacatatcagataaatatgcctaccagcctatttggacacagcagtaggtattaccatctgctcccaaatatgcctgcaaccctgtagctcttccattttggcatcagaatttatagaaaagagcatgatgtcctaagatatactgatttctgagaagtgctttgaaaatgtatctgtagtgacacagagtagggtaaatagctgggtttgattcaaatgctactgtttattttggggaacaccacccccacatttcttcttctatgatggaacaggatgacatgacccagaagacaattctgttggtatgatcaggtagacagaacattgttcaagcagatcatagccacatttatcatttgtttgtttttaccagaaaatgaaacaaaacaaaacaaaaatttaatgacacaaacagatgtaagcatctttataggtaaaagtcctgagaaaacagtagccacattccgaagggaatgttcctgtctcaggaatatttctaggcaggtccatttccaccttcaaaattatgtattggaaatcttagtattagaatctagatataaaaatctcacagtgatgtaatatatagtacctaattttaaggagttcctgatctcatattatattattaacattgatttccaaattctcattcatactgtgtgtataatcataaacagaaatttgattgcttaagaatttataatgcgtaaattggatttcatataactatagatattttgttgtgaaagcagatttattttgttaatttttatcatacctgatcatttggaaagaataaagaagataaaaatgtttaaaaatcagcacatacaagatgtaaatatgaaatctgaaccaattggccaatgtaaaacagagagagagagagagtagagagcaggagaccagaagctttagcaaatgaacaataatgatcagcaaaacaaaacaaaacaaacccgaaacaaacaaacaaaaaaaaatgctcattatagatataaaaaaagatctttcagaaagatctgagctttaatagatgcttagggattcattgctggaagaaatttgggatattaggtagatagtagtttcttatttttaagaagacagaacattaattatagacagatgatgttcttgaatgaacagtacgatttttctggcagctctataaaaatacacctgtacagatacgattagcatcctcacctcccatgaaatcaagaatggggatggaaggtgattctgaatatattcttgatgcattaatgaggtagcagagcagagtgtgatgataaaaccaaagtgcttgctcaagattgtcatgactgacatttacaaaataggaaaactaataagagaattattatcttttgtagcacctgattaaaaaaagaattctcaagcgttaaaaaccatgtcattatccacagacaacttgaggagctaaagacttgagacatgatgtgtgcctgtcacttatgcatgttaccccactgagttattcccaaatacccatatgattaacccacatgtatagtaattgagaatatttttactttaagaaaagatgtgggagaaaattattccttaatcatacatatagaaaatcttatttcaattattccagaattctaggattacttaaaattttaatccgtattttttaaaaattgactatcctgagttattgatgtgaagtaaataatgatacctcttggctatatttgcatggaatttaaaaaacacacacaacttttttggggctaatttgacttagtgcttaacataaatgatcaaaaatggaccatctgtcaagataagaatataaccagtgcttcattggtaagcatacagactcttcttttaaatgtaaatattggcttcgtcttttatgtaattattgaagacaacagccagagattttatttcatatgttttataaatatgtaggttgtagctgctccattatttttaatagcttttcatttttgagaaagaaaatattcttacaataagagtattttctgtcatccatatatgagggcaagaaagaggcaattatgatgtgtctattctcttttgaatttaccattctatggccaccaacaggtagtgcctgagtaggggtgatgatctaaacagaagaaaatggccagtttgagccattgaaccagaatcacgctgcgggaactgtggcttcttccaagtcatccaaagataactgccagccaagggggtagagagaggtggccttcagccatttggcgttcagaagcatgtaagccagatttgctccaagagcctaatcaccatcaatcagaaagataacaactcgccctcgcattgaattggagctgaaagattcgctttcccaccagggtggctgattacgtagataatttagcccatgtggaaaaacatttaccaatgacaacattttcttaaatatacagactacaattgttttacgatgtgatcattcacggaggttactgttataagtgaccctgatttcactgtacaaattaatattttcaggaaattaaactggtagagattttttctcaattttgaaacatgacacttgggaaaaaataagaaaacaaaaacaaaataacaacaaaagcaaaatttgtgaattgctagtttccaatagaatgaattaacgctataatttgagcagagtgattttgttttcttgcaaatagaaaactaaagcaggtattgatttatttgtgtctttggtcagtttttatggtctctgtgtctttgatactgcattgtcctggctcttatttgtggaagcatgtagtaatcaaacagttttaaattaaattttctttttcagtagtgattttcctatttagaacttcctagctcttttgtacttgtcttaacagtgctggtattccaagttataactttttatttgggtgggttagccaatgtattttttaaaagtctaattaatattattttctaatgtcttacttccagacacaatttgagaaaaagggattaagggaactcctttagtcacctaatgtcattaggaaatagtttttgtttgtttttttttccattgcaccaactttacagacagcataatgatactttataaatgtctcaagccaaatgtcttttttaaaaaagatcagatctctgcttgagttagcatgaaaaaattttcgtaagtaattatggagtaaaacaaaatgtggaataaacaagtaaatatatgatgaacttatatatgttaaatgagaatgtattattttaaagaaagcaattgctcacactagttcttggtttcaatgttgcaaaaatctaaagaaaaaaatttagcatatcctttccttctttagcgtatcctttgcttccataagaaaaaaaaaaatcaaagaggtgacaatgaactttctccaatttttgcaagtacctcacctttccattaaaagtggagcaatttggctgggaatggtggctcatgcctgtaataccagcccttttggaggccaagatgggtggataccttaagcccaggagtttgagaccagcttgggcaacacgatgaaaccctgtctctacaaaaaatacaaaaaattagctgggcgtggtgatgtgcacctgtattcccagataccctggaggctgaggtgagaagatcgctggagccttgggaggcagaggttgcagcgagccaagatgttgccactgcaccccagcctgggccatagagcaagaccctgtctcaaaaaattaataaataaataaaaaagatgaagcagttcttccaaacacacagtaatttctgtttataaattgattttgataataccattatcaaaaaggaccatcagatatagcctggcttggcaaatttttctgtataggactaaatagtagatactttaggctttgtgggctatccagtcttttgtgactactcaactctgctgttgtggcatcaaagcattcagacaatagtaatcacataagtgtggctgtgttccaataaaacttcgttggtgggcaaaaaaattcaaaattcatgtaattatcatgtatcattcttttgaatttttttccccaaacatataaaaatgtaaaaatcatttttagaatatgggctctataaaaacagataaggtaagtagacaggaagatggctttagccaacagatagtgtgccaattcctgagatgaataattaagtcttggctaacatatatactccattcctactcaggtaggtgttttataaaggctgtttaatggtaatcaaatttgcaaaaccgttatttccaaagatactcaagcccactgtaattttcactgaatgccagtgctgtcagctaaaacaagtgctgtaagaaccatgttggacagtatctaacctcatgaaacaggagcttaaagataagttctcatgatgaattgtattgaattacttggtgctcagtgtctctttgtttacttcctgcctcgctgatattaagctatgcattcatccacctagtcattttgtcatttctttgttcattctatcgctccacattcaatgctaagcactttcctatgcactcgggaaacaggggagttcgacgtgattcctgaactgcaagaattgataatagccacgagtgagacaaacaaactggtggctggattccagtgtgataagtgtgagataggaaaagataattgccacaaaagagaacggatgctgtgcacaacacagaaagtaaaatgaagacttcagagaaacaaatccgtttaggacattaaaagaagagaattcttcctgccaacagcctcagataatacatatcctatttatttatgcaacattgtagcaattttctgcatctttcacagacagaattttagggatgaaagacatcctaataataacttctttgaattctcaaattttaactgatgaggaaaaagtggccctgagagaagtgagaagttcaaggtcatccagctcttgagaggtggccttattcaactccaaagctcttcagtgccaactcagcattgttttcactaagcctttcatacctcttccatagcttttcaatgattatgcattgttgattttgttgattctctcttttctatgcagattctctaagtcaactttcagagctcttaccttttcttcagtgattccttagtgactatagttgataaaaattgagaaaatgcagttggaactaatgcacaaaggatgttccctttaaaaaattttctgctgatctgaagtaaaaacacaactacctcagctctcagactcagcatattgtcttcttcattccaggttactccataaattgaaattatcgtcatttgtggctctcacaagattagaggtgactgagtacttcatcaactaagatcagaatttcccatggcacaaaacaaaacacttgtataatgatctaggagagtggattaaacatactgaatgagagagctacacactgaaaatgttcaggggattatcagtgtagcttttcaaatccattcaatgaaagtgaaattgatgtggctttgcttaagtgtcagtaccattttggggtctgaacttttatatttctgacttcctgctattttaactgtaaagaaaagaatccacactctttacttagctacgactccacccagtgctctttttggtacattcagggttgggaagtggagggaagcattcaacttcctaaggcagaatctctgtagacctgcagggtcttagagttattgtgcttttctctaggacatcataattagaaaagggggggtcgatggctgagatacctggaagaatttccaaaggttgaacatggcaactacaactacaacatagcaagagcttcgtaggaaaccttactcatcatttttgttatccacttagtgggtcactgtgttatagggcttcaggtacatagtttcatttaatctatgttgaatcctatgaaacagcccctattctccccatgcatctcagtcacatctgcagtggagggaagtacacaggatttggaaatgaaggttataataataatatcaataatattaatacaataataacaataggcatgtaccatttgtgttttagggattcttataaatattaatacttaatatgttaatttatttaatctttccagcatccataagagttatgatcctcactttaaaattataagctatagttaaatatgcctaaagttaataagtaaaagagcaagagtttggaaccaggcgatccgactttagaggtcacatagaaataccaccatactacagagaagctcccacaaaaggcagccgatggaggggtgtttatatttgctgttaacctatattccataggcaaaaaaaaaaaaaaaaaaaaaaaggtttcatctgcaggctcctacctaagtttaataggtgtataatttgccaatagaatttaagaaatattgagcaaactctgtagttggtgatttaaatgctcatttaaaaaatttcaatacatgatagttgttctttctccatgtattttttaatgaaatctatcccttatccacctccatggattggaattgttttgttctatctcttattatccttgaatatacctcagcatagacagtgtgacataatgtctgtatgtgtttgtgataacttaatctaccttctatgggagatcagttggcctaattgggagaacagtctccaaggacagctagcattttaaaacttctaatctgaagcccactttctaaaagtatgctcttcagctatctttatctttaagatttttatgtctgattaacatcagaggttttatggattagcataacagatatattagaaattatttttttgttactcacatgaggatatgagtaatggaagtattgtaggaatagagtgtaagaatctagagactaggtggcctgtatcttttagaaggaggccaaaagccagactttgaaataatctagtatacacccattgattctgaagatacttgctgccacactaaattctgctgctagaatattggttgcatttccttcaagcaaatttgtcacactgctggcgttaaaacactaagaatgtaccgaacaagctgcatgcttgattgccaataagtgtttgtatgtgtgaccaaatttcatctaccagccttgtttttactataatgtggttgtaggaagagacttataacctttacctgactctactattgaaacttttatttaccacttggaacctactagttgtgaatgatccattgccttagatcagattgtggcaggagtctgtgtgtgcacacacatgcacatacacacacacaggagaaaagtgaaataaaagggaggaagtaggtgagagaatcaggctgccaactgtttatatatggacttacttgtccttgtcccctttggttggaaagtttttcatccacaaattctcctgaatttcttacagtgatcaggccatttgtcttttgctacagagatgatagcacattctttatgatatacacttaactacagttgttcatacccctgtcaccttcaggattgatgactcaaaagcactctccttcagactaccatgccaacttacatgcctttatttgttctttgaaagcctgtgttgtgtatatttcatggaaaaatctggtttaaatgttcttccttttactttttacacatgacaaatgttcaagccacttttctccctcaaaattttcattaatattgctttcttcctttcttctaatgttgccatgcttcttcctcatgtctttgaaatcagaaaaccatttagtaaacagtgtcataaatacttcttaaaacccttagggctcatatcacggaatactatttccaagcctgcagcatcatagttttcttaagttacagtttttcctgtaaaacttatattatttacgtttgtctgtatgaattaagtattctctccccagaatggcatttcttgaatttttctccctaccttttgttttcattttcttctttaaatgtagctataatctgtttcaacaaggggtgaagatacattgtagaaccaacagaaaccttcatttgacccagcagaggaaataaatttagtattaacatgagcggttgcattagtttaggtaggctgtgctatgctgcaatgaaaaacaatccatggtaacaaatttactaaacaaatttatacaacaaattctttctcactcttacaaagtccacccaaggttgagggactctccaggttgactctcctctatgtagtgactcacggatccaggctgcttttatcttgggcttatgccacttataacacttggcttttatggtaaccgaagcaatggaaaaaaacagttggaaagttatctaccagatcttaaatgctttacccaagagtaatacaaattacttctttttacagcacattgaccagaccaagtcaccaatgactgcctaactgcaaggggactataaataccaggtgagcagtaatcatctctgcctagtgctttcctagagcaagcactgtgtaactgctgaggccctctggcaccaactccactcagtctggtcgggggagcaatggaatgcaactaaatagttacaattagcatgcctctgtcattcagagttatccttttaattaactggcatttccacttagagatacgactggcatctcattcaactgaacccaatttccctctcccccactctttgcaaagtgctattcgtttataaagtagtcagcctgttcctctcctttaggcaagaataaataaaatgatatggggatggggtggtgaagttttgatgagttccttccttagcaataaaccatgagggaagaattccaacagtacctccatatttataagattgtatcctgctatggattaggatcttgagagctttaaaatagtttctcaacttttaaaccttgctaagcttgttatactctatctatatctatgtagagattagcagcaaagcctttaaaaatgtagcatctgtgcatttttctttcaggactacagtaaggagaagggaaatctggggtgctgaagaatggtcatgaagagaggctatggtgtcagtaagctctgagatgaaatttctctcactgttgcctatgaactgtttgatcttgaataagttcattggcatctgtattgctctaaaatgaagatgcaaagacctacctcagcagtagttgtgaggatgaaataagaaaatgtacccaaagcatttagtggcaagcatcaacgaatagtggccatcaatataattgttaatactaataatcataacagttatactgcagagagtaggagaagagagccacaaagagctcagtctgggtggaggtctaggagatggccctgattttagtagtggaaatatttgcaagaaggtttgaggcctcctcttatattcttcttggatgatatctttctaatatttttccatctttctgcgaatgaaatagagttgtttaatatcaacatttattttctttttgattctgcctagatatggtggccttcttggtctgagttggagagtctggggatgtgccaggaatactgggtcaatagaaggaaagcttagattttgaaaatcgatatgtagactgaagatgagggagacatttctataagggtcacagggacagaggaaaagcaatatgaggtagatctgggggtactcaacgaaatgagcttggcaccaaaccaggagctccaaagagacactacagaagtcaaggcttagatggggacaggaatgacttcatggctcctttcacagaaaatgttatggcatggggagaagaaaaggaatcgtattgtagtctcaaaggacttcattatttgtttaaaggatagtagtatgtatactgctactatggcattctcaagattttgcttggttctctctccatttcacttacttttaatactggtgacacccaaataaaaaccccagcacacgtctttaggtcagtttttctcaaagaatagtccccagaccagcaacttcaacatcatctgggagcattatagatatgcaaattcttgagccccacctcagaatcagaaactttgggtgtgaggcccaggaatctgtgttttcaacaagtcctcttggtgactctgttgcacacaaagtctgagagccaaattgttacagagtatatcacatatttctcatattcagtatgctccaaatgtgactcacctcttcttctccactcttgctaaccatacccagtcccactgtttttacaaaaatatttcctccttaagaccagaggctcaagtcagaaacttgaatttctactctacttcttacccacccatcaaataaaatctccaaattatcaaatcaccaaatagctctcaaatatatcctcttatctccctgcccacagaccaccatcaactcagcctgtactttggaaagtcttctctgaaccactattttgtgccaggcattttgttaagccagagtcagcaactatagatggcaagacaaatccagcttatgcctgtttttgtaaataagattttactagaatgtagccacaatcattcattttcatatcacctgtggcttttgtgtgtgtttgtttcactgcaacagagtagttgtgacagagactgtatggcccacaatatctaaattaatctttactatctggtcctgtacagaaaagctttaccgatctctgtgattggcactgggtactggagagaaagatgccatctacatcctcatggagctgacagtccaacagggaagatcagaagttaaagtgagctatctagttatctaggtcaggaacatctgacctacactatggggaaccagaaaggatttccagggaaagtgaggtgaagctgagtttcaaaggataaatagaaattcattagataaagaaaaaaaaaaaaaagaaaagtgttcaaaccagtggaaataccttttttttttttttttgatagcttctctcagctcttagtctaatcctcagtacattctgattttttaacctagctgactgttcaatgatcaccttataaaatccagtgagtctaagtctttagaaccggaatcttctgatcgccgccttcctagatggtttttctgtgcctgctgggtgagtcctcactttggatgtggtcagtcgtgattcaggtagcactggaacaccactttcgagcaccccaaacaacccacattaagactctaaacaaattgcttcctgcaaggccaatacacactttgggaattgccaaaagtagtaactatcagattgcattttacatctggtaaaagtgacctggatagaagagtactggtgtaacagttttgcccaagggtctgtggccttttgctcaaatgttttcagaggcaaattatacacaagatctgaaattattttggccacatatttatttttttcctagtgaaaattcttttcctttttgtggagacgcttgaggaaaacattttttaaaaaaactcaagaaaatatatctgaaataattatagaagaatttacttcctttacttttttctctatttccactgcatgatacaaaacaaaacaagaaaacctttcctctgctcattaaggacgactgcttcataggcactttctttctttctcctaggagaaaagaaggtgcaaaaatgggggtccaggccattgccatggggagtccaggctccaacaatttgtggctagagccatttttcttctcattttgctgtaacctcctctgcttttactgctgccccaacatctcaggtaaaacacatattcattctctttcctgtctacaaagccatgctagaataattccacctgttttgtagctggcactgatcctttttggcatgaaaaatggaaacactgggaccgtgaaagcactgtctacatttccagcatctcactgggtgccctcctctagctaataacttgctcccatccaaatggtacattttcacttcaggcagggatgtctctggatgactgttttagaggtagaagtagttaggggatctgagacacttcttaattttcccctcctctccagcctctaacattcctcatgaatcagatcactgactgctcgctgctttttttcctgcacagcctgctttggttatcaccagcattactttcaatcatgttgcagatctagctgattaaaaacactggccttgagaaaattctctttcttagaagtcaatgcttgaaggagattaggactatttatattgtaaggcactccctgaaagcctctggtggctttactctcttgactgatgcaaacctcgactaattctctttatccagataatccactcacttccaatattcatcaaatggcaaaatgaaaagcttttaagaaagagaataaatgtgcaggcttaaaatcacatagaattttagtcttaacaaaattgtgagagaaattatgggaaatcagggttctgaatcctatttccaatgagataacataaaagcagataaaattcatgggaccatagcaaatatgtttcgtatctcttgaattactttagcaggtgtttcgattacaaacctttgatgaggaaaaaaatgtgtttttctttctctgataagatcacaataggacaaacttttagaaatctgagctcctatttttttcttttttttttgtttgagacagagtctctttctgtcacctaggcttcagtgcaggggctcaattatagctcactgcagcctcaaacacctggacccaagtgatcctcctccctcagcctcccaagtggctagaactatggatgtgtaccaccatgcccggctaattaaaaaatatatatatattattttttagagatggggtctcactatgttgcccagactggtctcaaatcctgggctgaagttatccttctgcttcagccccccgaggtgctacaattacaagtgtgagccaccatgcccagccatacttcatttttatacatgaaattatctattgcatccatctttccatctgatgcttatattaagtatattcgatatttactatgcagtgaccacacacaaggtactaacaaataaagggggagagtgttgtcctaaaggagtttccagtattatagtaaagactgatggagtcattctgagttaggccagaaaactaggggaagctaaaataatcaaagtcagtcttttctctgattcaatcatttctatggcattaagagaaacaaaacatggtgagaaaagggatgttttttgaagtggtgacatctagaactccagtcccagatttgtgtaattagtagttagttaaacaggcttctgtgaactaaaagcggtgtcaatcatacctctgcatctgttactctgggttaggggtaacatgtaggatgatgctacaagattcttactagtgctgccagggtctcagcaaggcatatcaaaggattttccaagaatattcacaaagtagtgtagccattttattacactttgaagaattctgaccaaaaatgtaaaatgaaagaaaataaaaactcagttctctttatagatagcaatatgctatagtaaggtatcaactggcttagtattcaccaaaaaatgctctgatatttggagcaaaagagtatgagaagaatggtctgttgatggaaggagctagcaggtttcttttccaggtttactctatatttgacaagtgggctgtttctggcaagttgaataaagtggtgagaatcactataagagaacaaacagaagagctataaaccatatccttttgacctgaattttcaaacagaaaaactatcatttaaagtttagtcaatgcaaacaaaacaagaagactgcaggccaatcatgttgcctttaaggtctgattccaattactcaggtttctacagggtagttcgggtgcaaacagggatgggtattgatggccatacagttgaaacgagggcacttatgtctgtgtatgtatcctgttatatctccataatgaaacaatgaatgtgctgaattgtaaaatgataagaatcgtttttagaggccttagcctaggaaaggccccttacactcggaaaatcctattcagggcttgtacaacatgtaaaacctcagtgggatcatttggtcctgtaggtgggcacaatctgaaggtatctgaataagggagggaggtaagctgatttcatcttggctaacactttttaaccacatcaacatgaatattgacattctcctgagacccagtgtatatgtcatagcaatctcttattcattcctggggactttatggtcctgaggataaaagatgcttggactgcctcccttcccccgacaaagatttcaagatactccctgaacaaaaattttacaagctccaaaaaataaggaaaaaaatcaatgtaacccttttgcctcctctttctatagttaagcagatggccggcattagggggagatggctttgaaacgggtcccagttcgtatgcatctatgggccttgggcattatctagaagatacgttattctaggtggaagctcccatgcagattataggacatttagggaaacgttctcttgaatttgaatttaaactgtgctgagctcaagaatcagtgttgttcttaggagactctgcatatacaatggttatctacatttcatggttgtgcgcagattttagagaggaccgtgtataaggtatccaaacaaagcttgggtggctgtcctgaactggagctcagaaagatcactttacttacactctagtctacggtgttgttggaggtagaataattttttactttggtaaaggtatttctggtggttattctatttcgcagattctctgaagggaagaggtttgaagaaggaagcctacagggcagggaagcaagttcagagattggggtatgttcctaattgtagagggtttcatttgggatgctttttacttacgttttgaaaataatcttacatagaggataattatttccatgacatgaacagacatttctcaaaagaagataaacaaatggccgacaaacataggaaaaaatgttcaccatcactaatcatcaggaaaatacaaaataaaaccgcaaggagagaccaccttaccccagccagaatggcttttactaaaaagtaaaaaacaatagacgcttgcatgaatgaagtgaaaaggcaatgcttatacactgttggtgggaatgtaaattactacagcctctatggaaaacaatatgtagatttctcaaagaactgaaagaagatctatcattcaatctagcaatcccactggtatgtatctacccaaaagaaaataactcattttataaaaaagacacctgcatgcctatgtttatcacaacacaattcagttttaaagacacagaatccaatctaatgctcatcaactgatgagtggataaagaaaatgtggttgcatgtgtatgttcatcaaagcactactcagaatagcaaagtcatggaatcaacttaggtgtccatcaatagtggatttgatatagaaaatgtatatacccatcatggaatactacacagccataaaaagaatgaaattatatcctttgcagcaacatgtgtatagctggaggcccttatcctaagataattagcacaggaacagaaaatcaaatactgcatgttgtcacttataagtgagctaaacattggatacacatggacatgaagatgggaacaacagacactgagagggtgactggaaggaggggaagggttgaaaaatgacctattgggtactatgctcactacctgggtaacgggatcattcatatctgaaacctcaacatcacacaatatactcacgtaacaaactgctcatgtactccctgaatctaaaataaaagttgaaattatttaaaaaataagaaaatgtggtgtgtatataaatatatacttactatggaatactattcagccataaatacagacaaaataatgtcttttgcagcaacttggatggtgctggaggccattatcctaagcaaagtaattcaggaatggaaaaccaaataccacatgttctcactcataagtgagagctcagctgagtatgcacatgcatacagggtggtataatggacatgagagagtcagaagtggggagggtaggaggggctgagggatgaaaagttacctactgattatgatgtacactatttgggtgatgggtacactaaaagcccagacttcaccactatacaattcatccatgtaacccaaaaccatttgtatccctaaagctgttgaatttttcttaaatgcattttagcaaagtctcatgcacccaaaaaccttttatttacttattgtttttcttgggggggaagggaaagagatggttattttcaagcaatctttcagatcttaccttaaatcttccttgcacagaaaatgctcctctacatgcagaggatcaagttcttcaattattatctcctccagataccttgtgcttttcattcctagtgcttgccacagtttgtaattaaatgtatgtaattattcaattaatccagagcattgttttctcactattggctttccaatgcttgttaccatgcctgacccatagtatggatacatatttgtccaataaatgataaatgctcagggtgtgtgtgtgtcacagttggggagaagagcgtgagatgggagaaacaggacagatacaggctttactccttcccaaatatattaaaggaaggtgactcctgaaagcagaaggatgctatctggacactgaatagaaactctgaagtaatttttgagcttgttgaatttttagcatgttttaactggaatctgatctaaaattagtatctttttccagcagagagctcaggaaattaagtttttttttttttttgtactttcagggtatgattaacttatacccaagtaattaattcgtgagtacaaaagcactgttagatttgtaaaacatagctccattgtgccttaatactttcattgacatcttgttttacttactaacctaccattttaataacttaaaacacttgttgtacttaagcataggaaagtgattcaaatgagataatgcacatgaaatggtgataccccacaagacactatatatgcagctattttaaaatcattttataattgaaaatttcactaaatactttggacactccaaatgtaaagttggtaggccaactgaggaacaagatcttttatttttctctttatcactttatctttgtacatgccaagagccatgcagcaacctcattactgaatgaaagtttactaaataaagaaaagaataaataaaagaatgaatccctagtctttcctagaataaactgaacttaggaagctttattttaatgttaatatgccaagaaaaaaaatatttcagaagataaaaccaactgtaaaatcatgggtggtatttttggaaacaatgaacctgtcatttgtcccattgcttgaaaaaccaaactgatgcattaccttgaatgtatggtagaggcaaagaaaatttaaaaaaaaaaatgaagggatggatccaggttttgtggcatctgaagtttacacgatgttgatgctgtttttttggaaaaataaattttaaaattacaactataaatttaactacacgttcttagacagggacatgcaagtgagggacctgaagcacaactgaagcataaactccctggcttcaggccaaatcagcttctggcaggttggacagagaaacacccacacttgggtttttgatcattgcattacctaaacaattgctacaacttttgactgtggctctgcaggatttgaaagatgcataacactataaaagtatttaaatatgcttttaggtatggcaagctatcaaaataatatgcaagtaaaaatactgtctcaattattagcaggatctacctgagaatacatggtaagcttgatcccaaacctgtatagattcacaagcggagtgaacagatatgatccatttagccccacttaactgaccattttctgcagaagttatagtgggaatagaaaaatcctgcccaatttcacactacatgcacagtgatttagtacccagcaactttttagtcacacactggcttcctatctactttttaggaaggtctgtttttattctttatgtcaagaatctaaatagctattctagtagcctgcataatggaaacagactggaatcttccagcattactcatacatctcctcccttaaaaaatgaaaataaagttcttatatgtataaagatgcagctttcctctattgagacgacagggttttgctggtggcctgaaagttacttgcaagcatagacagctgataattgaacaaataaggtgactaaaaagcagtgagctcaatataccctgccctttttatttttataatttcaattccaaatgatcagtgaaggatgaagtacttattctaccttaaagtaaataataagagcattttattttttaacagaatagaaacccaacactcccattatttctaacaaaagtgatgcacatgaaatcacaccacattttactccacaattacaaagggaagttagagggcctaaagttgtagtagcggacatggacattattcacctaaaaatatactaaggataatatatttccatgtcatatggaaagaccaagacagccaaattaatggggacaaatgtaatcttttcttcagcaacatgaaaaatatgctaacaaacttgtatgttctttagtatgtcctgctgggttctctgcagaagtgaagtgaattggtttaaccttgttgagtttatcttattatgactccttatcattttataggtttaccatgttagtcaccagtctaagttattgcagaaaccagttagttgttttcctaaaaccagctggcctagtttctatctattgctttttaacaataacaaaaaaatgagccttccttccaatgtctcagaaatctgatttagcaaaaatggtgagggtgaggagataactctttgggttgtgatatatttacatgaaactctattttctggacaaaattaaagagattcatattgaaatccaggcacagaatcagaatctcagaaacattcctgcaaaaatatttactttgcaagattagatgactaccaattcagattctgtgattttttttttttttaagaagtctcagtctgtagcccaagctggagtgcagtggcacaatctcggctcactgcaacctcccaggttcaagcgattctcctgcctcagcctcctgagtagctgggactacaggcgcgtgccaccacacctggctgattttttgtattttagtagagacggggtttcaccatgttgcccagggtggtctcgaacttctgagctcagatgatccactggcctcagcctcccaaagtgctaggattacaggagtaagccaccatgccttgccagattctgtgattttttttttttttaatctcacagagaaagatgactacacatgaaagtgtattgtacttgggagatggacaccctaactactctgactagatcgctatgcattatatacattaaaaaaattctcatgcactccatacatttgcacaaataaaaagaaatttgtgtttgggacataatggttgaatgcataccattttctaaactgtgttctgtaaaacatttttccttgaaagatgccaacaggtagacatcaagtaaagagcccatggtctaaatagcaaatgatgtgcctgattatatttcatctactggaaattcacagtgcacattggcatcttgaaggcttttggaagtcatagagaagtactagactgaagaaatctgttcaccaaatttatttgaagaaagatgtcatttaagtgcttattaataacatcttgcagaacagtgtatgggggagcatcagcttgggaaatgctgaatcagtaattacatggagaccgtgatgatatatgccatcaggcacttgtggtgctttagaaagctctaaaaagaacctccaaggaactctgcagcactcaggcaatctgcctcattaccatcaattatcattgactcctgtatacatacgtgacatatggagctatggaaaagtctgtcaaatatgaaagctgtgcatgcctccattgcatataaaagctacctctttagatttagtcaaacatttgcagagttcctgagttaggtggtattctataagctacctgcgtaagtggttctcaatcatgaagcagatcatctggagaggagggtaaaaattcatcttctcaggtcccagcaccggtgagtctgactgagtagatttgaagtagcacctgtatattcataactttaaatttccttcaggtattcttttatatagccaaatttgggaactactggtctaggccagattttccaaggatcatgtgtacaacatttccatagattgtgacagctaagtctaaacgtttccaagggttggtatcactgttagaaactcttccttgcttgaatctaaaatgcaactaagaactatcactttctcattgcttactaagtgctaagcaatacactaatcactctcaggaattattttgtttaactgtcacaacaatgctgtaatgaagatattattattatctgcttttagcggtgaggaaaagaaaacgtacagaggttatataacacctccaggagtccaattttcagttcaaatacttattgaaagtcaggataatttctcttgtagtaaacagaacataagaaacatggcatagatgctgtcatagtcaccaactatttatggaaatgtgacaaaaagtatttttatttgaaaatctccattcttgtaatgtaaactaatacagctgctgtggaaaacagtgtggagattccttgaagaactaaaagtagaactgccaattgattgagcaatgacactactgggtatctacccagaggaaaagaagttattattcgaaaaagatacttgcacacgcatgtttatagcagcacaagtcacaataggaaaattgtggaaccaatccaaatgcccatcaatcaacaaagaaactttggtatatatatatatacacgatagaatactactcagccatacaaaggaatgaattaacagcatttgcaatgacctggatgagtttagagactattattctaagtgaagtaactcaagaatggaaaaccaaacattgtatgttctcactgatttgtgggagctaagctatgaggacgcagaagcctaagaaggatacaatggactttggggacttggtgggaagtgtgggaggggggcgagggataaaagacaacagatatggtgcagtgtatactgctcaggtgatgggtgcatcaggttctcacaaatctccactaaataacttactcatgtaaccaaataccacctgtatcccaataacttatggaaaaataaaataaaataaagaaaatctccattcttgtaaaaaaacttgatcagatatattttggctcatgttctgaacaatattattcaatgtaggaatctctctaaagagttttgtagtctacaagcccaagaaaagtttaatgagcatcaagatatttgctatcactatttatttaatgttcccagaatttgttacatgaggggagactccctctctactccacccataaaaggtactagccatttatgatagaaaacaaaaaaagtagatccttgaaaagtgattcatgattaacagtagcagacttcatatgttcctcagtgatatctggtttcctgagatcttacagtgaaatgatgtgttacaaaagagttattgttactcatcagatattatttctagctttgctgattaagagaagcaacacttattcagtatcttgtctttggaaagacacacctatatgggaggatcctttgccttttaaaacaagaatttctattttattttgtttatttctatctacataactacaaaaaatcaaagatatataatatttcaaagaagaatcttaatatatgatagaaatggatgagtcagcaaatgtcctaaatttatgaatgcagaattagcctaaatctgaaaaccatcagaaggcattgctctatttttttcctttttagtcagatctccatcttgggttttattttggactcctcttcattcctaacataattttagctaaatgtttaagaggattttaagcttcactatttctaagtgtcctcccatcttgaaatgctatgacacttgccgcagtacatgacatgaacatatggtgatttggctcagaagtccagataaccttggattgaaatcctgtgtttctcatttagctacgttctgttttacagatatggactatacccatactctcatctaatgtttatgccagtgcatggagtaacgtgcaagggtatgaacaattctgggaaaactcatctcctccctggataaacagtacaaacccaatcccatttccagtgatgattaaaaataatctttgtacaaaaagggtaacctaccactattaatacagttacaccatttatttaaaaagaaatagagtttgtgacatggggaaaatggcattgctatatccacaaggcacttaaattcactgtttttgttgttgttgttgttgtttgtttgttttagcaagcctgatatctttggacagaaggagaaatgagaaccgaagcaggactgctctgtttgtgcagcagaatcctccatttttggtggaaaagtgtctgccatttgatgaacactgaaacactaatattttcatttgcggttagatttagggtcagtcatgcagtcatggcctcatgccatctgtgccatgtcactccaactcaggtacaaaaatgcaattctggtattggaaacccaggtgttggagctaggacatttctctgaaatgctagcaccatttccccttcagcaagctgtgtgtgtcctttccagttctccttaggcatgatataaaaagagtatttttaatttaactcctcagtacaataagtcgcatattaactatcagtagactgacagctacatgctatggaaaatcaccaggcttattgtagtccagattagaaagagaatacagaactctgctgcctcagctacatacaatcagatatgtacagagaaacattttttttttccaatggcatcaagaaagccacatgttgttagcaaagtaaccagcccatagactgataaaaactgaacatattatatcttagaggttaaaaagcaattatactttctcgagtgaaaccttgggtatttcagaacaaaagggtgtagcttgctttactttacatcaaattatacgagaaaatatttccagaatgaaaggaagacaacatttgttgaaaggtagattccaaagtcatcacatgcaaatttagaatatcaaaaattattttgatgaggggtcaacaggaatagccacaatgaatcacagtcaaccacattgtgtgagtgggaaatcatgatgtcatatcagatgaataggagacaaagagaatatctaagctaaagcacacctcagaaaaagtaaattgaccagtgggcagctattggtttatgtaggcatattgtctaaaaggtggggtgggggagggaggttaagtagttttggtaaactgcctaggaagttaataccactagtaagcaaggcatcaagcaatcatggatataattaccttttatctacatatctgtgtaaggaaacaagaacatcagtcatatcaactttaagtatatgtcacacattataaagtattatgccatagatgcctttgatgcaacagtagacattttcctgggagaggtattggatagtaacaaatactggaaaaagtagcttttaagataattctcattaagtgttacttacatatattagtaagattctttctaactatctatctatctaatcatttccttgtgccaaaatgagaattcctagatttatctaaataactatcttaaaatagatgcaaaaataccaccatataatcaatatatttactgatgcatttctaatatggttggtcaaagacagactgaaattagaccagagaagaaatgacaaaatggccataattgctttcaagacaattataagactaaaaacaatcaagcaattatagactctcagctctaaaattgcctttaaaaaaatacaaagaactaacaaaaccgaactgttcagctcataccaaatctgcttcatttgattcccggtgagttcagacctggtggctgctatttcaagcctcatttctttttgacctcaaataataaagttgaagtcagccagtttccattcagccttgttgcattgtttgccagtttataaggctttatgtttgtaccaaaaatgttacaggaggaaaaccacaaagaagtcacaaatctgggcaattttccctatattacacagatgttaaaattgttgcaaaagttgccaaccactggacatacttgacagcaggaaataatccaaacaatgaaaattccagtcactattttgttaactcgttataacaagagactgctgtattgagcaactggttcctctccctaccttccttttctgtcttcctgccatccctcccttcatccactgtctatccattttctagtatcatctgtatgctcccttaagcttctcagtctaacagaaaaagacaaatgtaaaaagaaaaaaacccatgacaatataaatttatctgagcctggatttctcaacagtagagcagctatccttagcagaactggctccttacttagcagagtgggccactcctaagcagtatggtcagagagtctaacaaatccctgcttgactttatattacctagccaaacttcctgtcatgggagcacctcgctgccagagaagggctgatatttctaccattaaagccatttcaacttggtgtcaagacatactgtgagaattaccttgtgtgaaggctttctctaatttgctctctcactccattaccattcagttgcagtttgactttctttcttcccacagtacctgtgcttacctctcggttagcatttccctcacagtgctgcaattgtctgagaaaagcagtatctcccacttcagactatgagccttcagggcaaggactttaccttttatattagtttcacaacaggtagcaagatatctggcacaaaataggtgctcaagaaatacttcttgaataatttcattagaaaacatagcctcccaggtgagaatcactgatctaaacaattcagctaatatttactgagtatgtactatgtttcaagcactaggtacaattatgtgtggcagaaataaaaaatccatgccctcatagaactatatatactccaagagaggggacatacaacacacaaacaacaaataaagagtatcatcaaataaagactcaatggggtaaagttgttttaggctgtgatgactttactgaggaggtgacctttgagctgaaacatgaaagaaatggagccagccaagtgaacagcaaggggtgaatggtccaggcagaagggacagttgtgttaagatgagtaagagcttagggtgctccaggtacagaatggagggtatcatgcctacagcattgccaaccagggaagaatagtaagagatgagatttaccctgttggtggtgccagattatacagagcttttaaaggaaagctaggagttaggcttttattttaggagcaatggaaactctttgtaggattttaagcaggagggggatataagccacaatttattttagatcgataatgtcttggtcagtgatgcagaaaatacactgaagctaacgacagaggaattaggggcaggattcaaaacatttagcaattcctatagcctttggcatttatcaatcagaaaagttgccaaccggtcagaaggaacactgtccaataggccataatatttgaatataagctgaatacagtaagtcctcacctatatcaaggatagctttttagaaattgtgactttaagtgaaacgacatacaatgaaactgattttaccataggttaactgatataaacaagattaaaatttctatggcatacttattgtcacaaaaagttagaaaaacttctaaataaagattcaaaacatttcaaatattaaacagtgaaattaatgtgagttatatatacatttaagaaagattaatgaaaacaagatagtcactcaatttttggtgaatcactgagtgatggtagttgtagtggtagtaaggtaaatcaggaaataattgatggtaaagtgaaaattttaagaagttcttgctattgtctcacagctcaaagacaatcactgaatgcttttgtactgcttcatttgttgttgtgcatttgtaagattattgtaatcctacacatttttatttgacaataatttgtattcgttcattcatgcattcactctttaacccatttattccagtttaggaatgcaggtggctggagcccatcctagcatctaagagcacaaggaacaaacccagaacaggatgccatcccatcgcagagcacattcacacacacacatacacacacaggtacacacacacacactcaggctgggaccatgtacacatgcacaaggaacaaacccagaacaggttgccatcccattgcaaagcacactcacacacacatacacacacaggtacccacacacacactcaggctgggaccatgtacacatgctgactcacctcatgtgcacttctttgggatgtatgggaaaacgagaatacctggaaaaaatccacaccaacatggggaaaatgtgcaaactccacatagacagtgacccagctgggaattgattgcttttctcatcaatgttataatgaaacaacgttgaacaaaatgacatgatttgagaactgctgtagttagttaacctcataacaaacagtgagagataatggtagtatgaactaggtggacagtgtaagtatgaagagaaatgaattgatataaaatatactgggaagctataactgacaagacttgcagataatttagacagaaggggtccttaggcaagggagaaatgtttggtaaacaaaactgaaaggtttgacttgagcaatcaatgataatggatgtctattccactttagtaaagactagtccaaagttctgtttttaacatgataaagttagatgtctataccacattcagatatatgctaaataagggaatgagctttcatatttgagccaaaggtagtggtcaagacgggaggtgtaaatttatatatacatgtatcagtctttcatcgaatgtctggaagagattacctcgggaaagagtaaagaaaataagttcagaaaaaataaaatatgaaggaaaaaaagaggtgatgcctacagacaggaatttagcaaaaggaagaaaaggaagcaccctgtttgaatttcgtatatcttctaactttgccagaatttgccactactagaatatctggtctacaaggtaccccaagctctctgtcctcctacttcttttgcctctattaaccttgataccttccaaattggctgccaattttatttaggctctaaaataaattcataaacttaccaatactgtacttttttaaaaaagatgtgggcatgacaagtatttttatatgcatttagttgaggccagatggttttactacatgaacaacatagatgctggatcatcagcttaaagcatgtgtgtgaccatgatgctttggctatttaatttaaaaaataaaactcataatatttaccattgttaataggtctttctaaatatgaggtatgtatatctatatttcaaaatatttaggtcattagctctcctttaaccttccgaactcatacatttgcgcacagaaacataaacacacatatacaaacacatatacatgcacatactgtccaagtattagtaaacagatgactgatgataattcaggagtatatgtcaaaacctacattctattgcatactatacaaaacatatattcaattatacacgtatgcataataacatcatggcccattatctcacttattttgtggctaaatgatacaaggctaacatgaccaggaagttagctagcacaaacagatttgggggctgtaagtataatagtctatacatgtagttgctttaaaaatatatcagctttctgaatatcatacgactttttgagtgttcatgtatacaatacttgtgatgacattcatgcctatcaaatattttggagaactcagtatgattagataaaagtggagtttaggtttcgtgtaaaagactaaataaattgtagttgcagctgtgttcctgtggctaacgctgcccacagcagagcagagaagttagcgtagtatacaaagaatagcagtatttttcactgtggtctgagcataattttaaaattatgaatcttaagtctaaacaaatgttaaatgtaacatcatttttctcattccaaatggacttatgaaagtcataataaatgaatacttagcaagcaaactatagaagattctatttgggaaatataaagctgtatttcattcttccacagatgtccacatcaaccacatttagtgagagtactgctcttacaagcagtcctaacacaaggctttatctaataacgaattaggccgggcgcagtggctcacgcctgtaatcccagcactttgggaggccgaggcgggttgatcacctgaggtcaggagtttgagacccacctggccaacagggcaaaaacccatctctactaaaaataccaaaattagccaggcatggtagcgggcggctgtaatcccagctacttgggaggctgaggcatgagaatcactggaacccaggaggcagaggttgcagtgagccaagattgtgccactgcactccagcctgggcaacagagactccgtctcaataaataaataaataaataagagaattaaatattcgattcgtgtaactcagctgatttcccttcctcctttcttatttacgtatttatttagttattatcttccacccttactttcctaatagaaccataggaagtcttggtccttttagcttctgacagctgatacatcgttcaattaatgaccagatttacaaattttatatcactataggtaatatgctaccccttaagtggtagctgtgccactccaacaaaactataagataccttacatctaacaaataccttgtctctgaatcaattgtttgagttagtcactagccagatttttttccctttattatttaactggaatatactgtttgactacatcccacatacatattgacattgtagttatttgtccaaccagaaaatatttaccatggatttatttatactcaaggcatgacagcatagtattgaggagtacagactccccagaagttcagtttttccacttaccagtttttttattctgggcaagttatgtaatttctctctgcttgagattatttgtaaaataggtgtaacaacaatatctgagggtatgagttaagatatattaagcacttaagagtgcctgacatataataggctcttaatgttatacattgctatcattttaattattaagatatgcttgtctatcttatgttaagtactagggatagatttctgaaaaagctattcctgcactgaaggtattttcaggggggcttgggcaatgtacaaacaagacaggtaatttcagaataatgagtggtttgacaggagtaagtccagatcttgaaatatttacccaaaatatagggaaactaatttaatgatggatgatgaaaataaatgattactatgaaaatttgggcatttacttttcatctatttataataaaacatcaaaattttaagtaaaattaaagagtttctccagttaagtttcattggaattccaagtcacgtaaacagaatccttcttaacaattttagacacccatctttctgtttcactgtgttactaatttaatagtctacaacttgtgtaaaacagaggtcatatatattttgtggggacaaagtgttacagtaaattccagaaaacaatcaatatctaggaatgaaagtaggaatcctgcataaaaagtgtttatatattctctttcatctatttattgttctcttattgagacttacctcaaagtgaggggaatcattttaaagactgaatctctacatatgtatgtaatattatttggttcctactgaccttcctgaattgtgattacctgggtgttgcgtatggataacgattgaatggaaatctttgattgagtgtatttattaggttgctgagctattttggggtagtcatttcacctagctggcctcaggggtaccagttttttaggatggttagcatcgtatatcaggaacagattccaaaattacttacgaatcaaatgtccatttaaaagccgttgtttttaatggatcctatgacgaaccctttagtaaaataactaattctatcttcatttcctggtacaaattttaattttgtcatttttcttttctaatacaagatttttttaaaagaataaaaaaacaaatccggtgcttttgtaggatggaaaagtctgaaaaaatagttgggaaggaaaagggaaatagaaaagttgaagttaggagtaaaaagttgagagaataaaaaatgatacttagggcaaactccaaaaatactggtgcttttgatgccttctttcctttgcattgtctctgctctacttacacgttgatgcaaattaagtctgatttcaatttaactgttttctttcagattttagtatgaaaacttttagtatttgtggaggaacaaaaatatcattttgaagaatgcatgtccagtagcaataagacaacctatgactagaaacaatggacttttcacagcctatacaaatttgtatgaataaatcagctaacagatatgtcagaaatattgtttataaatagcggagttcaaataataatatcccatggaacagattgtagcagttcgctattaccattgtaaaaactccacaccatgctatatatattctatttgccataatatattctatttgtcaaagaatttccctccataaataaaattgtcattttacagagaagtacacatagtaatagttacttggactttgcttaagtatggaaaagcatgtaatgctattcttaattaattgaaatatcagtatatgcccaaagagtttctctgtataaaaaatctcaattgtaaatatcatatatgaatagccaattcaaatatttaccataagagattggtgacttaattatgagagttcgataatatggagatgaatgtacgtagtggttcatgtagtaaaatatgtttcttaaaacaacattaaaatttttaaaatttggcagaggtatcagtgaaataaggcttttcatgctttgttgtaatgaattttaaagacagatgtactatttctttcatttgagggggaattgtttagtctactgagcctaagtaagggccactagttttttgtttgtttgtttgtttgtttgttttgagacggagtctgtctctgttgcccaggctggagtgcagtggcacgatctaggctcactgtaagctccgcctcccgggttcacgccgttctcctgcctcagcctcccgagtagctggggctacaggcgcccgccaccatacctggctaattttttgtatttttttggtagagagggggtttcaccgtgttagccaggatagtctcgatctcctgaccttgtgatccgcccgcttcggcctcccaaattgctgggattacaggcgtgagccaccatgccaggcctggccactagttttgaaggttgtgaattttcctaaatcttgcatgatttgggtaaagtccatctgtacctaatctgcaaatgtgcaaattactacataaagtacatcagtaccaataataatttatacaacattttatgcattgaaagtcttcttgcagaggaaattattaaatattaaactagatgaaacatgggtcaaattcaagcttttagacaatggagctggaaaaaagtatctttatttcaaaggaattatgacaccttctttggagacatagtattctcattctattaataaaaataaacaataagaagaagtcagtctctttctaatttaattaaaaggatgtttgattttaatgcttcattcaatttactttgtccctaaccaaatatgcaatcataattaaatgaactgtaggcaatgttgcagattccaaatcttcttcccatgctatagggaatgaatggactacacaacactaatacttgtgtgcaaaatacatagggctagatactcactttgtttttaaaatcaaagagtaatatatgattaagtgctatataaaagaaggagaatgtgttgatgctgagaatagggatggcatatataatattaagttatattcatttgcatatcagataaagtccaatgcaggaaacaaaagacattagtttttcttttttcattttttaagttactctaagggtagtgatttcaatagaagatattttaataatattatttctcatctatttcatatcatgcaatcagggttatttttacagatgtaaaggaattccttttctagtggtttctgtatttggctaatcagaacaaatgaatgcatgttaagtacagattccagggcctatcctaaaaccattggaagagaattacacagaggtagggcaggtgttggctggcagatagatggtgatgttgtctgaatatttaaagactccttcctaggttattcttacgatgttccaggcttggcaagtttcctaaaatttattttaataacctgctccccggggacatttattttgcataacttggagctctctaaatattaatcaacattatcttcaaataaataatatggattcagtatccatttaatataagatggtcaattcattttaagaaattaagaattagagtgtatacactgaaagaaaagcaaaagggaatttctagaaatatttcataaacaaagtaatgtgtgcatggcaagggaagctttttaaatgagttgttataaaaaaactcacttttgaagacatggatacatagggattttagatgtgagtactgtgtcaaaatcactattggatcacactggaatatgaaagaagcattgttcggttactgaacaatcgcagtcatgtatggccactgagtctgtaaggatgctgcacacagacttttcaattgttttttatcaggagaaacagcacagggctttagggaacaggggctgagctgcctgtgcacatgtagaatgagaaaggctcccacttcctcgtaagggcatcaacacagtcccaatttacccagaccacaacagcactgaaagggaactgggtaagactctatacagcttgagcaagaagacttccatactctaatagatctctcagacttaacatttgtgaaattccacaccttacctccatccccaaatctgctactcctgcagtctttggcacctgcagtttccaatagttcatatagaatcattctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggtgcccgccaccacgcccggctaattttttgtattttttagtagagacgaggtttcaccttgttagccaggatggtctcgatctcctgacctcatgatccacccgcctcggcctcccaaagtgctgggattacaggcgtgagccaccgcgcccgtagaatcattcttgactctcttttcctctattcccatctgttaatctatcagcaattctcttggctttaccttctcacacctccacttggtctatgcttgctaaactggaatacagcagtagcctccaaacaggtctctctgattctcacctagccaaattgatagttttaaattggtaccacatctctttccacacaaaattcagtgattttccaaattatcgagagtaaaaatttaggtatttgaaatgcccacaaggcccagtggagactctccctttctcctcccaggacactcatggctgcttcctctggctattttgtcttcatagcacttttcatcatctgacttgctgtgtgttttactttcttatttctttattgcatgattcctaccaagagactgtatcatccttgaaatctggtatttggagtgcgtgtgtgtgtgtgtgtgttttcactctatattcccagcccttaaaacactgccgggtacattgaaggtgttcaataattttagaaatggtacataaaaatcagtagttatgtcacaggatgtaatcttagcagacagaggtaaggaacgtttccacaatataatcaatgattataggccctttctgtgcaatgacacagtcatggactcatatgcgctttatgatgctttaccttgaatttcattaatttgagatcacatgtctatgttaatgagatcataaattccttgaggtaaagggtagtgagttgtgtctggaattataactttacctaagtttaaagacgtatcatattttgcctcaatttgcagaactgagagaggactcatgtctttccactctgattgtatgctttcaactcagaagattttagacttcaaacaattcctctggcacctagtatgatactttgtacatagtagaaaaatacattcaatatctcttgatttatcacttcctatgtaatcttttggttcagagaaacatttaacctccctagttctggattgaattttttgaataaaacagcccaaatcgatgtgtgtatacacagagtttaaaggattgaagatgatgagatcattttccctgtgatggctgccaccaggacttcttcacattgctgttgactaattctcattgcaagagttagtgctggagagaaagaaaatggctttcaatgctttctgttacattcccagaaggtggctaagtgcgataggagacactaaagagggaaaatattggatttgaagctaattactaaggaaatgcttagtaattcattaatccaatactgaactcactttatgcaggattatttgggtcaaaatattgtgagcatatatcctatgttagaactttggctatgaatgttatattgtaacaatttattttgttacatactttttaatagtttaaagatagaatagcagctacatttggtcacaactagaaatattcagcttgaaaaaaaccccacagttttctgtcatccctcttgttcttcaaaagttgagcaggcattttggaataagctcattagtttatgacaaccatttaaatattaatgatgacaataaaacgttattttttcatgtgaaatcatcttataaattatatacatgcacatgtgttcatgcacatacacacatgcacacacacatacatagtaatttgagagaacaacatatttcttttgctaatgaaatatctcaacctcataacataccgtcatagtatagaaaggtgaattctcagcttttacaacttcatcaaatgttgaatactgagtaattcactgtggtaaggagtttatgttcacattaaggagaaaaaaatggcaagcactagaagctcaagtattttcattccaacttgatttttaagtctctaattaacatcttttggtcatggttgtttttagattaacatggcttaattactttattataaggtgttggtagcattctataaaacatttttctctttattatttacttatatatgttaatttttaaaagctgtagattctcattaaacaaaatacaaacactttcaaatcatcatctgaactcattttcataaatgtagataaaagtggtaaaaaacgcaattaatggaacacctcaaatataatcactacttagattctagaaaaaaggttaaaaagagaaagactagcaagtgaaatgataatatgtgaaatcaagagtaacttaattttacaaaaattaattctcttttagtaaaacaaatagtccaatggttaaaaatttttcaactgcagtgtttccatgtagtagtttaagattttcaaagagggcagcagtttatctgtatgtatttgcccctgtagataaatttcttgaaaaaaggatcaaaacatcaatcattatgttctttgtctatatgacaagtttaacataaatgtaaaaagaaaatggaactatggaagaattttggaagtaaaataaaccctatcagtattggagttgtgtatttccaatgggtgaaatgcctatttgggattgccttcaactggtaggggatttactctgtgcctggcttgctcagggataaactagatctccactggcagtgcagtgagagaaaggtgatgttttcttcttgtttattatttggtctttaactataaagcattagctttttcaacaatcacaaaagccccactttacatgatttcacttgctcaagatgtaatttattgctaatggaatcacagaaaaatgttttcactgtttctggaatgcagaatcaagtaaggcaaattgctattgaagaggaattattgattcttgttataatagctgcatttcagctttaatacatgaaattttatttttattgtttcaataatttatatttaagcctcaaggtttctgtataaccttccttgggctattttgttttaaaccaggtgtgacaattttgccttaatgtatcattctcttggtctgtcttgaaaaccttaattgagtagatgctatcaaactgggtttgagaagttgtaaagttaccaataacttgcttggcaaactttgtcaagaagctttattttgtcctcagtttttctgtctgaatatataggagactgaatgaagagatatataacccccctcttaatatctccaaagttataaaattattatttaactctccatagaataatcaagggtgcatattgaaaccatggatgaacttctttatgaaatgtgttgaacaaggactggtgctgttttctaaacaaattagtttatttactataacaaatttattaagcaaaaatgttaatcaaatcaaaattaatcattactgtactctcacaggacattgtactttgcttaaaagtgtttctctgacagttgtatattacagctggattcctggtgcatccatttgtctcatgaggttgcacaagccacaaagagcagggaataaagttgttctttacttattttatttccagacccaattcaggtctaaataatatcatcttccatttcccgaccattgttttcattatataatattttgactttccccaaaagaattcatgcatcaggtattattacctcattttgtagcagagaaaacaggtcagagatatttagttacttgttgaaaatgataaagatgttaagggatagagctgagatactacatagatctgtctgatgctaaagctcaagacatttctcctatgatagaccagagcagatgaataatacctgttaaatcaaaggcaaagaaatcttttttttttcttctggaaacactgtacctaaaaacttcccaaaatgtgactcttttatctgactataaaaagaaatagcaaaatcaattatattacacagtatctgcatcagctttatcatctcctaaatagggatataatattgagatgtggtgagagttaagtataattatttatatgacatgaaatagcttatgtacctgacacaaagaagttctcaatgactgttatgtacaattattattatcattattgagtactatttgcacttaaaagtcaaacatatcttgaatcagaggaagttcttacttttagaatagctctaccagaaattaagaaatatcacaaaatatgcttctgtaattattttaaaggtgacttgtgaccatttacccatttctttcacttttaataaatgccttaactttttaaaagtatagtgtgttcattgtgccaaggaaagatgacatctgtgtttgtgtggggagggaataaccacagttttaaggtacattctttaacttgattttacaaattgaacgttatgagcagtaatttaatttatgctacacattttaattcagaactaaacagttctgtattttaacacagagttgtttatctagaataatgtttggcattaataagcatttttttgatatctatttatttaaaaaatgaacaaattaggcccttttatgtttaatataatgctaccattctaggctaaaattacagtttttacacaattaatgttatatttggttattataactaccctagacactaagtaatagcataataacaataatagttacagtaatcttcattaaggtattatatttacttatttatgtgcttaaaaacatatagacactaaatagcagagccaggatagactctcaaatccaaatttgggtatcatctattcttactagctatgcaggagcccccctcccccccgcccccaccttatccgtgggggatacattctgagactcctagtgaatacctggaactgcagacaattctgaaccctatatttactatgtttttttctgtaatagtaagtcctcaatgacatccacaggttcttggaaatgtgacttaaagtggaacaacatacagcaggtcctcaaataacatcgtttagttcaaaattgtttctttataatgttgatgaggaaaaaaattgattttcttataaattgtttcagttatagtcccagttttcaataacctatgtatgacattaactgaagacttaactgtacttacatccctatgatagagtttaatttataagttaggcacagtatgagattagcaacaataactcataacaaaatagaacaattaagtaaaagaagcattacttgaacacatgctctgtgataccgcgacagtcgagggtggctactaagtgactcaggaatgggtagcttagaaattataaataggccggacaaagggtggattcatgtcctgggtgggaaggagtgggactgcacaagattttcatcatgcttctcagaatggtgcaaattaaaacttatgcattgtctatttctatcgtaattttccatttagtattttcagaccatggttgaccacaggtaattgaaactgcagaaagtgcaaccacggctgagagaaccactgtaccggcaacagtggctttctatgaggttgtgattgaactattctacccttagggagatgcatatttaatatttcagactaattagtgtaaaaatataaaaaggataaatttgaagagtcctagtaccctggttgtccatgatttgcattcattacggaaatggtgggaatatctagtataattgtatatatacctcccgctgttcttgatgaagagaatggattattttgtttgaaaaaagatttattatagtcaggaaaccaaagtcaatgagcagtttgtaagactgaagaagagtctaacatttctggaatgaagttactattaggaactaaagaaaaagtcccttcataggagttgggtcactatgtaaatccatgcatggaaaaaaaaaaagaaaaagaaaaagaaaaaaaagaaaaagccctgtttggctgttttccagcaagactaaatgcagtgttttatcttgatagattacatacaccccaccttattttctcctgtattggctaacccttggtatatgtgtacatacccacatatttaaatccccactattttttttatacttgtcttcttgtgtaacaccaaatcaaatagagagaaatactaaagaaggacagatataacctttgaaaaatatctgagggtctccaagattcaaaagctcagcagtccaagcaatagcaacattcagatgacaaccgggactctggactctttcaagacgctggggattggaaagccactgtgacagaaacagtgctacatctttttttatttttttgagacggagtctcgctctgtcgcccaggctggagtgcagaggcgcgatctcggctcactgcaggcttcgcctcccgggttcacgccattctcctgcctcagcctcctaagtagctgggactacaggtgcccgccaccacgcccggctaattttttgtgtttttagtagagacggggtttcaccgtattagccaggatggtctcgatctcctgacctcgtgatctgcccgcctcagcctcccaaagtgctgggattacaggcgtgagccaccgtacccggccaaacagtgctacatctttaacaactcccatttctttttcttcctgggaatgaagctggactacctttctcaatttcccctgtggttagaaattagattcggtcatatgattgagtgccaaagacatataaacaaaattatatggaattcaagcttggtgtttaaatcctgtaaatattccacttatatttttttctctgtctctgtctctctgctcccccttctcttcttccttctcctcttcttcttctttttctctcctctcttctctcccatcctcccctcccctcctcttctctctctctctctgtctctctccatctgcttgcttccctccctcccccttctctctcctccccccgtcttcctctcccctcaggggaagactattcccctgaggcactacagaccctaggttcctgagtcatttcatggaacacggcacctggatacttgcactggaccataacacaggtaattaagaaaggtttcttgttttaatgcagtgaaattgttgggtagtttgttatagtggttatcctaccttgaccactttagaatggtagcttctgttttatagacaaccttattagcactggaagtaataagccacaaagtagtttattatttttccactacactaaaatgtagttccagaaaaggataaattcaatacattatactgttctccttagccacccatgtttcctctttacataattgagaccaaatctccgggaacagtgcacatcatgaagaatgaagaatccctttcacaccaacacccattaaaaaatctgatataaatatagatttatatattataaatatattatctggtatatacctaatgtaaacatatatttatatattatctcatgcatattaatataaacatattcatatattatatatctctatataatagttattaacaaagtttctgggaaagtcaactatttattctggaatatatgcttggggcatgaaggtgggccatgggaatcgtggaggtttatcattaatagattaatagttttggctttctcatgtcccctttctaccagagagcaataataatgcctgcaaggcatgtggtttgactgctacatagacatattcatccttatagcgattatcttagtagagctccattaggaaattaaaactgggtgctgataaaactgagtaattcaatgtgccagtctgttccttgtgcttgtagggaccatctgcagttctgcaaaacaagtgtgggttgtggacaggtgctctttgaatgcaggctcattatcatttaagctccgcagaggcaaatcccatagaagccctagaagagcagcaagcaggtgtgctggcgccatctccagagaactctgatgcctccctcctgagaggcccagtaacaggaccaccaggatgactggcataagggacaggagaggtgggtcaatgagcagtgagttatagtctccctagctgaggttttagaatgagcttgggagttttattcttacaaatatattttcttcatcactctttgaacttagtcctaatgcaatgacgggtaagtggttgccatcagcaacttcaaaattaatttactcctttggcgatgaaatcaattcttagaaattttgccaaagttagcagtgacttatgttcacctggtagtctttaaattgcctgttgtattttaatattttctaatagtgttcattgcatgtttaagcttaactagagatgtttgtaacttctgtacatcacttgatataaaaaggaactgctacatttatctgaagctatacagtagcagaggacaggaaagaattcagaatttctgactcctgtaattgaattctatttttctggtggtttttatttttaaagtattttcacataccccatctgtcctgtatatttccatttgctcctctcagttcattcttttcattcatctggctctgtgtcctggaagattaatctacagggccatattgttgggcttcctggtcttctggcttcctgttgagttcaacccctagggaacacagtaggagcagagagagggagtgcttgccaaagaccctacctgtacccctcagaggaaggccagagctcctgggaatggcccgttctctccacaaagctttctgtctctgtgttacagtacccattctctcctctcacccgtctggatggtaacatttcactaccacttggtctttctactcctctcccctttgcaaatagactgcttactaaattctccccaaattcctcattggagcatgctatttgttcatctctgagaccctgacagagcaaccatctcatttgatgtttatgccgaatctataaaatatttgtcccattttgtaatggaaggatttgatacatagaaaatgaaattacttgcttaaagtcacacagctggtcagtcagtggttagaattcagcaattttgactcttattacaatgttccttccacaccctgacactgcctccactttctacaattatttaatcatgttaactacgttatattgaataaatgtttaactcattatcaccttctattatcttttccaagtaaagatcaggcattgaaagggagcccctttaaattaaaattattgatgaaaatcattgatggtaatgtggatgttaatcatagtaatttttaaagaccgaatgttttctaatggcataattaacagtcacaggagatcatcccaatatgggtctcttcaaatatctctatgttcagagtttagtacatcaggcattcacaaactttgtatgttattaaaaaataattggcctaataatttggtcacacattttgaataaacagttgactcatccatcctcagagagaggaaggcttgagactgccagttcttgggtagaaaatcattatggtttggacagtaacataaccgattataaaaactactaacttggccagttgtacttagtgatccgaattaagcaaaaatgatttcctcttacacgtaatacctcagtacatgttttgtgaggttttctcatgtgatcattcatccagagatgtttaggtattttcccccttctaggagcagatgttctgtgaatggaggcacacttcttctaagatcaattcttttattattaaagtgataacttggcaacacagccaaatgtctgataaacgaatggatggagtatttcccttctttcattacagatccatataatacgtcaacatttaaaaaagttaaataaagtgaagtattgggaaagggaacatctcactctgatagatttgaatttgctatttctgctctgtgacaaaaccctgagttgatatgtgatcagacatttacaaggccctgcattctacctggtaatggctatagtggtgttgagctgctgtgagatgatttactgcaatttgtcactttttgaaactgttccaaaatagtctgctgacatgtactaaagagctttcaataaaatccgaaatagttcatttttttatgtcaactggaaacattaagtggtacctaaaatcatttaaagatttattgaagtgattgaaaacattctttaggccgggtgcggtgacccatgcctgtaatcctagtgctttgggaggctgaggcgggtggatcacgaggtcagaaggtcgagaccatcctggctaacatgatgaaaccccgtctctactaaaaatagaaaaaattagctgggtgtggtggcacgcgcctgtaatcccagctactccggaggttgaagcacgagaatcacttgaacctgggagggggaggttgcagtgacgtgagattgtactattgcactccaacctaggcgacagagcgagactctgtcaaaaaacaaacaaacaaacaaaaaacaaaaacaaacacaaaaacccaaaaaacaaacaaacaaacaaaatctttaatggcaatttggcataccgcaaaagcaatattgttattaaaattaggagaaaatattttaattgcatctttaaagtatttatatcatgttttagtctaactgcatcacctcaccacttgggaaatgtatcagtttaaaggtattctgaaagttattaagcaacttttaaacaaatatcagcaaagtaaaggggatagttgtgatttgcataatttaatatcattgaaaatcataggcctgataacttaaattctagaacatacactagtgtaattaggttaaagttgtggcttatatactgtttttccttaagaatctaagtatgtgttgctaggcagcaaaatctatcttggccactgtgaatcactttctaatttatttaacatgcaacttagctaaaccagataatttatgtgtactattaaatattactagaagtttcctaaatttatctttgggaccactgctactagaaagatcagtatttcatagcaggtttaagctgccatcaaaaaatttcctttgattattgcttataattattctccttaggggaaaaaaagaaaagtatattgtatatctttaagtttagatattgagtgtccttttaatttagaatatatactatgagattctttttttattagtcaagaatacctggtcatcacaatgctttaatttctaagttaaatataagaataaaaagatataaactaaactctaacataccccctcctcacccccaacccgaattttaaaaagctgctaggccaataataacaggaatctgttttcttggagtggatctaagaaggaaataaggtaaagataaaattgccctcatgtctaagctgggctacatggagtgagctggctttgccctgtgtagaagcaaggagggaacacagtagaatagaactggatcttggtcagagattgggactatggccatatactttttccttgttcaaattcataggatgttctagtacctgactacgattccctcaggcaaaagatacctgacaatggaaacctgcaacaatcaaatcacatcgaaggaaaggtaattaacataggcacgtatcatcaaccaatgcagcccaaggaaaaacactctaactgaagatgtccttcatgaagaacgggaaacaagtgcctgatggcgctttgacctaactacttctttgtccactccacccactcaacagactctccttgtaaaaattacacttatgagtgttcagtgacatcagaccacaaatgtgacttcaaatggggttttgatacacattttccactgtgataatttctcatgctgaacagaagtgatccagaatatcatgcctgtagaattctatgatttagattgtttattcgttagtacctgtattaaacactgctgtgcatggctaaaagtaaatttgttattttttttttaaatttaattctactgtcaagctcaattacatatttggttgtagtaagtcagtgtttctcaaagtgtgatttatgggccagatatgtcaaaatttacatagggtatcattttaaatgcaaaatttggggccctagacttcttcaattagggtctctgatgtgaggctcaggagtctgccttttaataaaaaccccaggttattcttatgtacactaaaatttgagcaccagtgtaataggattttgtggtggttgtcgtttttctttttttgattagggcttatagtcaccatgaacagagcctcacaactaatttatttcacagctcgaagggaccttggagattattgcattcaatagctacctgattaaatgaagatgtgtttgaagttccaaaaatatttgattatttcaatgagaggccagccttagagactatttctgacataagtaaaaacaataataactgtcatttataagggatcagaaatatgcttggcaagtaacatgacatttttaccaataaaaatgaccctcagacatagaaaggtaatttaggaaacatagtttataaataggtggaccatttctactagtgcttactaactccaggtggcctttagaacaacaataactaaacacacgtggagcagctgcagtgataataaggtcacccaaaacatttgacttgactttttaaaaacattttctgattgattcttaaaaatggacagattttgaaattcttgaacccagtgtgtgtatatagatagactttaactaccaccaaattggaataataagttagtacattacaagtatgagattagacctgttaaaaggaatgattcttattttatatgatttgatcatataaatttcaaaactggtttaccaatctgagaagtagtctcagattctgttatttgcagagtcctaaaaacctgaataatgataaataatccaatccattaattggcaaaactattctttggagtaatcacagtgactctggaactcccaatttgttctttttgcagtaaaaatgagtttcctggggtgggggaggggattaatactgttattctttttttaaaatttttattctatttatttatttattttagtgtgaggcccttatttggcacttaccataaattttactactgaagcttctacttattctctccttctaagtccagtgttggcaaactacactaggacctgccagttaagaatgttttttacatttaaaaagtgattaaaaaataatatgttgtatcatgtaaaaattatatgaaattcaaattttaatgtccatgaataaagctttcttggaacacagccataattatttgtttacctattgtctatggatgctttcaagttacaattgcagagttgagcaattgcttgccacagagaccatatgtcccacaaagtctaaattatttactatttggccctttatagaaaatgtttgagaccctcccccctctccctgcttcccttctacagtagtggttttcaaagtctttttcccaaatctggaatatcaatcagcatcactaggaaatttcttgctagaaactttggcctcaccctctatattcagaatcagaaattatggaggaaggcagttgtggaaggtggactcagcaattggtgctttactaagcttttcagctgagtctgatgcatgctccagcttgagaaccactatcacctggagggcttgttttaggaatgcaataagcaaaaatgatttgaaaatataggttaatacgcatatggaagcattatgatttatttagcttttgtattgcatttgcaagaaaaacatacaaaaataaagaagaaaattacgagcactggtgactaccctttgtttccagagagaaagtttttgctagagaaaaaaaaattgcatgttttactttagaggttactttaattttaataggctttatgaaattacttcaaagtagctttgataaatcagaaaaatgacatggcaacctttttttggaagctgaatctcagtggtacttaagaaggcttatcacttggtttatacagaagaaaatatagtatgtttcaattatttatatacaaagttaaaaacccaacctgtaattatatgtggaaataaaattgacttcagcagacggaaagaaaaaaaatacagcttctttttgtagatgagtctaatcctgatatcctgtcatttgatacatacgtgtcatgaacaccaagtactcacccccatatggctgacatttttgcatctactattgaagatgagactgcttggtccccatcagaaccgaaactgtgaggacagatgaggatgaaaggaggcataaaaactaatcatttaaaaataaaatataatagaataatccactctaagtgaagctattgctttagaaagcccactaaagaaaaccctttaatggcttttaacattccactctaagacaacgaatagctcaatgtaccattgcattctcattcagtgatatttatttcaggatattaatgaatatttaattttagtactatttaccagtacaataaaacctaaggtaataaaaacaagaaaatgatatggttacaaaagctagaacaaaatggtgcagttacaaataaagattgtaactgagaggtatggtcttagtaggctaatactgcctttggagacagtaagcaaatctgacaatggatttggttttccaaagagcattgtaaacttataatgaagaactttattttcagttaggagacatggaaagattgtcttggagtagttaagagttcagcttccgcagtctgactgtttaggttagagtcctagcatcacctggataaccttgagcaaggtataaaattatcgctcacctcaggttcatgtctatctatcagataaagaataataacattatctacctcgtagccttactgcaaggatgacatgagataatccacataaggcttgtagccctaaaacttggcacatagtacacactgaaaagtgttagctattgttattgccattattaattatttatcatatatttgcaatgtagtggtggtggtaaggcaacaaagatatgcagagaaagatgattcagtttgccaacaaactcagagctctctcataaatcagatcagattattcactagacttgccttctggatcagcttcgaaagaatttattggtggtgttctgtagaagccattttagcaacgcatgcatggtgactccacaaagttcacgggttccctggcaatcagcttcagcaacatgttcatgaaagactgaaatcacccagataaaaaaatcccggcttcatcccaatccaagtaggtgataacaactttcacttttctatgaaaagtaaagttatctcacttagattctttgctagaatttccaaatgaaaacatagtcaataaaggcattcttgtctttatgccttggcctgtaaatttcaagtctgtttccaccttggggtgacaggcatttggatgctggcagctgcctggctgtactgttccttcatgagggcgtatcactgaggcaactccaatgcctgaccttagtctgcatgtatgagatagtctttccatttaagtacctgaggacttagagcttagtataaaaaagtaaactctggtgaaactaagtacaggtagtccagtatacatgaagacccattttacaaacacaagtgacaatatcttgctttggaagaagtgctgctgcccatcacctaagcaattgtcaccggagtccctaacatgtgacgctattgaaattacagatccagaaagctgccttgttttttgaaaacttaaaaggttgctttctgtaatgcctagccataagaaattattctaaccatggacatgtcttgttatgtgctttttaccatcagagggtgatattagtgttccagggagtatgtatgagaaaccacaatataatcattctgcatcttccaaaagtctcaatataaatgcagcaaatatttactaaggatacgtgctttgtgctagcgtagggttgggggatatagtgataaatagtataagcacagtcttttacatcatggagctttcatcatctaattgaaactatatataaaaatacataatatattatatataatatatatgtatgtaacatattatatatataatatatactatatatatatgtatatatatatttttttgagatggagtcttgctatgtcacccagactggagtgcaatggtgtgatttcagctcagcaaactccaccttctgggttcaagtgattctcctgcctcagcctctgggattacaggtgcctgcccccatgcccagctaatttttgtattttcagtacagacggagtttcactggccgggctggtctcaaactcctgacctcaggccatccacctgcctcagcctcccaaagggctgggattacaggcatgagccaacaaccggcctgaaactatatttttatatgaaaacaaacactggcaaatatgctatgacataaggtaaaacttttggatgcgtgtgtttgataaaacaagtaagttcagttaaattttccttggggcggcctgttgatgcccctctgccacagagatactttagtggaagaaaagcaaagatttttgagatagaagtacctgctgaatacactttgcacacaagatcgtgggagtccacattttaaatgttaccactagactaatactttacctctatgcagccattataattaaatatttcctcccaattcaaagataattaccatatatttaggggtaggaatggctctagcctccattcccatcatccccttcaaactttcttactctctcttgcacttttacctcggatctcaatgaattctagtccttcagaatgacaattgttttggggagtctgaggtttttgtttgggcatctcctgctcctactgtttctgctttccctccctcatgccagacttagcaaatcaaaagcaatgatattgcacatcctttagcttcccaggtttcccagatcccaggaactcaacctgggtcacagatcacataatcagacacagaggtgttgagatccctatttctaagtgggagtggactcctgatgtcccccaggctgcaggcaggcgtctggggatgggtgcaagacatctcacaaatgaaattggacttgaagttctgaagaattggggatgaaagagttaaacatgtttaaatgagatagaatttaaaaatttgaaatggttgaataccaactaggaaactttacgaaaaatattctctatttttattttctttgagaaacccatcttggaagattaattttagaggctattgtagactacgtttttaatgcaaaatgctccggttgttgatgagacaggttttgtttttcagttcatcagcaagatggcactttgataaatcacagattgctcagtgcctaaagaggcacattgtgacagttttcatcacaatgtgatataaagaggcaaatgaagcagtgctccagatcacgcctgggccagttaggtgatagcacccactgtgtcgttaagaaccaggagggtctgtcatttctaacaatgtgttcattgttttctgacctacctgtgagagtaactttttcaatcacttagggactgaatttgatttggagtttgttgcttataaatagttagatgagtgagagtaacacagatagcagagacctctgtaaaaagaaataaactggattttgttcttttctgtcttgataactgagttggaatcttctgtgtcattgcattgggtacgaatgaagagctggtcactggttcacccttgcacatttgcatgcactggctaatactaactagctccatgtctaatcctttaaccaagctttctggcaaatcagagccatggcatttttcataggcatctgatttgaatgcacatgtagagacattacccgtgacttcaaatttctcatcctgatgctctgcttattttcagaatatatgtaatacaacattctgccctgtatacccaggtaaaattttcccttattccatcactgaaagtaaattctaaaggaaatattgaacactttcactccttgatttgtttttaagtctcaagggggaaattatgatgttcacacacaggttaaagcagactgtaggatcctaatagtaataactatacaagattaatggtaaagacaaatatgtaagaaagaattcaggaaaaaaagaaaacgaagttgtcaaccaactttatcattgggtggtggaggtagggctataaatggtgccaaatgaattgcttgactgtaattttcacctttcgaatattgctgtggcgctgtagaggctagtccaaaagaggctgatctcatttgtcacccagtggtttcttttgggccttgggcaaatgggccaacacttattttcaaggctgacctcatcttttctggctgttgagtagactttgcacttcagttgatgagggcatatgagaaatgaaccagataaattgcttgattagaatcttcgtgaaccagaaccgatgagaggggcacacatttacttgtgaattaagaatcaaatgtatctttctttggcccagtactgacacacatttacatcctccccactgtgtgttgttcactagtagcaaaccctggctattccttattttagaattttctcaccactatgtgctgcttgactattggccatgcttctcttgcaattctcatgttagtctataaatgacattctggttaggaggggcactgaccctcctcctgtgcgttcacgaaatgtgaaggagggaattaaacctgtaactcagccagttttaaagtaagcttgattattatttcttcaatagcatcagcttctataaccataataaacaaacaaacaagtaaatataaattctctttaactgctaaatggatggaaaatagactgactctttagtttttaaaaggtagttatagttagccaagatggaatcagcttacattcttggcgctgtatacgatataacaggtctgtgtgtgcctgagtatatgtgtgtgaggatgtatgttctgagagtgttaaggtgataaataacatattttttcttctcaaatgtgacatggcttggaattaaacatttacataaaaattatgaaatttataaaatgtgagaggtcaatttctccatatgccataaggtacagaaattaatgtcaattttgtcagttatgtgtgatttatttaacttattaatggtaaacagtgatattaactatacatttaaagatgtgtattttgttaactttagctaaagtgtctaggtctctacaaaacacgtctttctaatatgaaatatatttggtaaataggtggcaaatttcaaatacacttttctagccaattaccttgtagaaaaatcaacattcatctactgcagtgttccacagccaaaatccaataaaatttggggtagaggagacataaatttgtctcctcagaccagaccttctgatattttaagggaccaggaactattaaaaagtatctgatttaggttgttaactagtgaggcagatggtgttattgttctgcaaatattcactactcccacttgcattcttcctggaggaatatacttccctgccctgttgacattgaagatagcatcacgtattttggccagtggaatgtgagtagacgtgatctagtaacatccaaggagaattttgtggtgcttgatttgtctgcttgcactcttactgtcatccatgagaaatgtatgatcctgggagctgcaactccgtcagaccaaaagaaagacctaaacctgatgttgagcctggaacattaatgccacaatgaattacagacttgtgaatgagaaaaaaatatgtttatagtaataagctgagattctgtggttgtttgttaccgtcttagtctgtttaggttgccataacaaaataccacggagttggtggcttaaaccacaagcatttgttttctcacactttttgaggtagaaaagtccaagagaaagttgctgaaagggtttggttcctggtgtaggctctctttctggcttgcagagggctgtcttctctctgtgtcttcccaaaacagggagagagagagagcaagtgctagccttctggtctcttttctcataaagatatgaacctattgaatcaaggctccaccattacgacctcatttaatccaaattatttatataaaggacttatccccaaattattacatgaattttaatgggaccaaaacttcagtcgatagtagttataaaacattattgtagcataacctcactgatatatcgttgttactaaagcctgtgtcccagctctttgcatctgctctctcctaaaacagcaacaggtaagccagaaaagtaaaagaagagtgtaatctggtgtaggcaatgaaaatgacaaaaaccactttttgtttatgtggccttttaaaaaaatcatttcctatattttataccaatgtaaagatttttaaccagtaaaaaatattattaggtagaattttttaatttgctatagttgaatgcatgtaattacttctgaaagagttaactcttattttctgtcttgtgtgcttgtgtctggttgcattatgagattcataggttttcttaaagtctgctttgttagatacaatatgatgaatgcagaaatgcaatagggtggtattaaaatcaaataacgagatcaagagacacagaagcaatatcagtttcttatgtagtacgaaatgacgattgccttagtatataggcctgctctaagatgcattgaagggtaacattctcttttgattctagaagtgggtaatgtatcggccttttcattttttaaatgtagaaatctagtaactagattttttaaattaaaattatgtgttcctgtcacagattgtcttctttgtacatgaattggatctcaatattatgaataagcatatcatacaaacaaggctatcttaataggaacagcaatcctagaatacaagagtaagaaatgcttacacttgagggaggggtaggcgaaggcaaaacaagagatcctgggattaatgttctcagaaataagtctctagcctacaaaggtggcacatattggtaaccagaattataagattgattgatgtgcctgagaaatcaacctggagtcataatcaacattgcttattagtgcaagacctctcagtatgatggtaaatttctagcccagatgctctaagtgaagacattactcattgggctacattcatccttggaagaaatctttttttgtttgcttgtttcacataaaggtgctgcctgggccaatgtttgcttggattcatggataatcatcgacctacatcaaatgcctgatgtgagggtaagaggtaacactgcagtcctggtgatatcacttggacatagtttgaaaaccactaatttatcttagtaattataatttgaactgatgggttcagaacactctaaaatttgaacatttgctttaagtacaataatgcaggcactcatttccctggagcctgctttatttctttcctgctttagcttccttgaacagagacttcagaattactactcccttagaccttgtaacttggtcattcttactaataggctataacagctcccctacaaatcaatgagggttatgctttcagccttagacctctgtttcagagcagggcaatatttattcacagttcttgtttatttaggtgtaaaacagatatacaggcactatgagaatcaaatattttgttttaaaagggttctgagaaaagcaatctttgtgccagatatgtacatatcttgacatactttttgtaaactaccatgaatatattttcaagctttaaaacttatttcctaataaaatacctttagtcaatgttataatacataatagctgacttcctaatttttcatgtaaaattcccattttctaccttccaagatatttatatgtatgttaatgtttttatggtacattatccccaaaatttaaaaagtaagcagattcatacttgctcacctttttataaatatataaaaagtatttataaaaatacttttatataagtatatattaattaaaaagcacctcaaacttaaaaataaatttatttttgaaaactattaacagccaacacataattgattagaccaagttgtctataggaataccaagagattatgtataaatatatggctgaggagatttggggacatccatttcaatgattcacagcggcgtcatgtatttttgctcacatcaaaatcaaaatcaggtattccagattagatcatcctctatgtggacccagactctttccatcttagggttctaccttgtcaaaaatcttagagtcttctccatttagctgatggatcagggaagaaaccacaggaaaacaacacctgatttttgatcaatttggctggtaagtgttactcatcgtttctattcctattccactggtgtaaataagtaatgaggcctctctagattcaaaggagataagaaatatgtaattcctgcctaggcagttgcttcttaggaacaattccacactctcattctctgctaccaagtggttatccaaagcctctccacatattttcagttttttggacaagaataaatagcaatgatatttatctattaatctccactctgtgacagcataaagaattagtggccggaaacacaacatatgaaaacttaaggaatgtagcaaaagtagcccaaagacagaaatttatagcaataaatgcctatgtcagaaaagacgaaatatctcaaataaacaatataatgttacaccttaaataactagaaaaagaagaacaaaccaaaccaaagttagcagaagaaaggaaataacaaagttcagagcagagataaatgaaacagagaccagaaaaaaattacaaaaaattaacaaaactaagagatagctttttgaaaagacaaacaaaatcaataaactcttagattaatgaggaaaaaagaatactcaaataaataaaataaaaaataaatgtcattacaactgataagacagaaattcaaaggatcataagaaactactatgaacaactgtatgtcaaaaaattggacagtctagaagaaatggataaattcctagacacatataacctaccaagattgaattatgaatcaacagaaattctaaagagaccaaaaatgaggaaggagattgaatcaatattcaaacttctcccatcaaagagaagcccaggaccagatggcttcaccactgaattataaccaacatttattttcttcccttttctttttttttctttcaacttttatttaaagttctggtgtacacgtccaggatgtgcaggtttgttacgtaggtaaacgtgtgccacggtggtttactacacagatcatcccattacccaggtattaagcccaatatccactagctattcttcctgatgctctcccttgcctgaccccccaacagttgcccacagtgtgttatttcccactgtgtgttcatgtgttctcatcagtcagctcctacttataagtaagaacatgtagtgttcggttttctgttcctgcgtgtttgctaagaataatggcttccaagtccatccatgtccctgcaaaggacgtgatctcgttccttttcatggctgcatagtattccatggtatatatgtaccatattttctttatccagtctatcattgatgggcatataggttgattccacgactttgctgttgtaaatagtgctgcagtgaacatacatgtatctttataacagaattatttatattcctggctatgtggctatatacctgtagtgggattgctgggtcaactggtatttctgcttctaagtctttgaggaattgccacactgtcgtcaacaatctactaaacatttaaagaagaactagactcacgcctgtaatcccagcactttgggatgctgaggcaggcagatcacgaggtcaggagttcgagatcagcctggccaacatgctaaaactccgtctctactaaaaatacaaaaattagctgggcatggtggcacgtgcctgtaatcccagcttctcaggaggctgaggcgggagaattgcttgaacccggtaggcagaggttgtagtgagccgagatcgtggcactgcactccagcctgggtgacagagtgagactccatctcgaaaataaataaataaataaataaaaataataaagaagaactaattacatttcttctcaaaccctttcagaaaaattgaagtggagggaatacttgtaatttcattttataaggccagcattaccacagtatcaaagtcagaaaaagatactacaaaagaaaaaattacaggctaatattgcagatgaatatacatgcaaaaatactcagtaaaatattagcaaactgaattcaacaacacattaaaataatcattcaccatgatcaagtgggatttatccttgggacgcaagtatggttcaacataatgcaaatcaataaatctgatacaccacagtaacaaaacaaagaacaaaaaccaaattatcgtcccaaaacatgtggaaaaagcatttgacaaaattcaacactctttcataataaaatctaatagacaaagtatagaaggaatgtatctcaacacaataaaggctatgcatgataaatctatatctaacttcacactcaatagtgaaaacttgaaagcttttcctttaaggtcagggacaagacaagaatgccaaatttgacaacttcctttcaacacagtacaaattcctagccatagtaattaggtaagggaaagaaacaaaagaactacctaatagaaaatgaagaagtgaaataggaaatgaagaatagaaaaaatagagaaatagcaaatagagactatctgctgaagactccaccataaagctgttagaactcaaacaaacttatcattgttgcaggatataaaatcaatatccacaaattagtagtgtttctatatatgtataatgaactatccaaaaaaattatagaaaacaatctcatttataatagcaacaacaacaaaatatgtaggtgtaaatttaatcatggaggtgaaagatctgtatactgaaaactagaaaacactgaagaaagaaagaaaagaaaatacaaatcagtagaataatatcctgtgttcatggattggaagaactaatattgttaaaatgccattactacttcaagtgatcgacaggttgaatacaatccctaaccaaaattcaatgtcatttttcacagagataaaaaacctccgaaatccttaaattcgtatggaactacaaaaggccctaacagtgaaaactatttgagcaaaaagaataaaataggaggctcacgcttcatgatttcaaaatacaaagtgattgtaataaaaatctcatggcactggcatagaaacagacacatcgaccaacaaaaccagagagaaagcccagaaataaatctagtcatttgtgggcaattgatttttgacaaaggtgccaagaacacacaatagagaagggatagccttttccatcagtggtgttggaaaactggttatccacatgcagaagaatgacactgtatctttatctcacatcattataaaaattaactcaaaatggattaaagatttaaatggaagatctacaactataaatcttagagaggaaaagctctgcaacattgttctgggcaattattttgtggatattattcctaaagcacaagataaaaaagcaaaacatagacaaatgggattgtatcaaactaaaatgcttctgcatagcaaaggaaattattaacaaagtgaagagacagctcacagaacaggagaaaatatttgcaaaccattaatgtgataagccaaaaatatataaggaactcaaacaactcaatagcaagaaaacaaataacctgattaaaaatgggcaaaggatttgaaaacacatttttcagaagaagacaaacaaatagccaacaggtacatttaaaaaatgctcagtatcactaatcattagggtaatgaaaattaaaaccaaatgagataccacctcacacctgttagaatggcttctatgaaaaagatgaaagataagtgttggtgaggatgtggtgaaaagtgaacacttgtcttttgctggtggaaatataaattagtactgccattatagaaaatggcatggagattcctcaaaaaaactaaaaatagaactaccatatgattcagcaaacccacttctggatatacattcaaaggaattaaaacaatatgttaaagggatatctgcatgctcatgtgcattgcagcattattcacaatagccaagatatggaatcaatctgtgtccatcaacagataatagattaaaccaatgttgtatacacacacaatgaaatactatttggctcgaaaagaaggaaattctgtcattttcaacaacatgaatgaacctggaggatattatgctaagtgaaataaaccaggcacagaaagacaaataccacatgatctcacttacgttacttatatgcagaatctaacaaatttgatctcatagaagtagagagtaaaacaatgattaccagagcctgggatatggggcagggggtggcaggtgggatggaatgaagtgctgttggtcaagggatacaaagttttggttagacaggaggaatatattaagctctattgcacggcagggtgactatagtcaatcatgatgtattgtatatttcagaataagtaaatttcaaatgtctcaccacaaagaatgataagtggaggtgataggtatgttaattagcttgatttgattatctcacattgtatatgtatatcaaaacatcatatagtgacctgtagtgtagacaattatgatttgtcaattgaaagtaatattaataagaaaagaattagtggtcaggagataaaattggagatctaactcttctttttcatatatggggcactttttcttttactcatattttatttgctaaagtgatcacaagatgctgagaagagaaagtgtggtctcatttgggctccaagccaggcagtttagcaatagagatttaatttttaaatttaattctaattaaaatgagaagctagagatgtaacaaaattcaagaagtgaaaactacaaaataaaatacaatcctgggggagcaaatatttaaagattcatggagcctcctgaatgagaatactggtattccttgtttctccttatgtctcctagtgataaagatacagctgtacattgacatctgtggcaaaattatagatacatttaaaatatgttttagataaatacatacatacttgtgtatcatactatatttttatctctaaatggtaaactatgtaacacatcatataacagtaatggtaacattactgcataagctacacatatatatatatatttaaattgactaaatgtttaaattttcctgtacctttatgaaatgggactcagcacattaatatatagtacagccttcaaatgcatttcattttaagatttttttttgtcttgaatcctaaaagagtagcaggataacatgataagggattcagcattttcaaagaagaaaacaacaaggcccagcatttagaagatcttcaactattttcttgccaatatctgactattctatgccatattggcctttgtccatttgtgcctagaaaattcctcacagtgagattttttcttatgcatgcaccacggttgctaaactttgctaaacactgctacaaaatgtcgcaaaaagtggcagattggtgccaatatacattcatgattgctaatcttacccaggctctcaacagtgcctgagaatcctattagctttccattacccaacttaattcccattcctgacagatactatttcacatcttcctaactcttctcaaatcttcagttcatccatcttccccctcagatccagaagattacttaaaaccactgggggaaaacttttggacttctcactgcccaagtaacaaccagcatacaccttttcctttgtccttttgggacaaggaagagttgactttccatctacataattgatctaccatgtatctgcagtctgaaatccttccccgctggattccttagaaatactgtaaattctccaccctccacctgcttgcatctccattttctccacttctggaggaatctcattagaatttcatcatgcatggtttttcagcattaaaaaatagaaaataaaaagtaaacaaccttcaacacaaactacctctgcaagtactattttttttctctccttacccctttacggtcaaaattcttgaaggcattatctatattttctgtcccagttcttcaactcattcaacattattatttttcctgcaatatgccaacaaccctgctttcacacaggttatccaagcttacatgttgcgaaatgtagacactctttagctagcttgcttaacttcttgggaacatttgatactgttggcaacttttctttaggactctctattttcttacctcctggggtacaactctcttctggtgtgcctccttccgcaccagcttctctttttttcctctgaacactccttttatctactctcacttaaaatattgatgaccttcaaggctcagttctagtctttttctccacctcactctaggacttattaaatgaatccaagaaacctttggtaagtttgtccactcccaaagcttcaaaatctgtaaactgatgactcccaaatctcttccttcagtacagacatctttcctgggatacttgcctagatatttagctggttactaaaactgcacatggatgtttcataggcccctgaagtctaacccactcaaagatgcactcatgatctccttatctttcttccacacttccacacttaattgtcctcttgtgttctctatctcagaaattccactaccatctacccaggacacctctcacatctagtaaatcatcaagtaatttagtttctattgtcaaattgctttctggatatttctctttattgctacagccaccaccgagatccaagccaatactatgtattttttctcctcattggttgccatctcttcctaattggccttttttcccgtcaaaatctctctcctgtaatctattgtctacagtgcacctatgagaatacagttatgatattctcccacttaaaatcttttaaagctgtcctactgcccttatgatcaagatcaaacctctaaccatttaataactgactcgaccattcatgatctgacctcagtacgttaagcagcctcataacttgacagcatcctcaaattctgttgtccagatatactgaactcccaccagttcttcaaagcagaacttgctcttgtccacatctaaggcttcacatatttttgttttctctcagattcactttagcacccctcttttctatttgatcctacccatccttcaagtcttatgttacatatcacttcctcagaaagccctcctgaaatttttggattagtttcagtaaatcctactgaaatatgacttcaacatttatgtacttcccttatcataacacctatcatgctttattattatgcctattatattagtttcctatttcttctgtaacaaattacaccaatttttttttgcttaaaacagcacaaatttattatacttctggagctcaaaagtctaaaataggctagcagtgccattttccttctggaggatatacaagataatcaatttctttatcttttacagcttttagaggctacctgtattctttggcttgtggtcccttcctctatcttcaaagtcagcaggccatctttaactttctgtcttctgacctctgcttctattttcacattgccttcccacattgattttctgcctctctcgttctcttataaggatcttggtgattacattgggcccacctaggtaatccaaggtactcttctgatcacgatatctttaacttaatcacgtctgcaaaaaactttttgacacagaagctaacatattgacaggtttcagtaattaggatgtagatatcttgtaggagggtattatactgcctttcatacttgtttaaatgtttgtttttcctattacagagcataaaatcttttctcttcccttctttattcttagtgcctagcacagtgccttacctctgagaggtgttcaatacatatttattatgaagaaatacaaagtcctagactgatttcttttttaaaaaatttctccaaggctagacacggtacctcatgccagtaatcccagcactttgggaggctgaggcgggtggatctcctgaggtcaggagttcgtgaccagcctggccaacatgatgaaatcctgtctctactaaaacaaaacaaaacaaaacaaaacaaaacaaaacaaacaaaccaaccagaaattagccgggtgtggtggtgcacacctgtaatcccagctacttgggaggctgacgtaggagaatcgcttaacccaagaggcagaggttgcagtgagctgagatcatgccactgcactccagcctgggtgacagagcaagactccatctcaaaaaaaaaaaaaaaaaattccaataaacatttactggtttctttttaaaaaaattcattcaataaacatttattgaacttcatctacctgaaagacatatttttgatgcttagattatagatgtgaataagaattgttctttgaatccatagtctaataatgaagacacatatatagaaagataaatacattaaggtctttttgttgtttgaaataagtatgcacattgagagtgaggaaccaaaagatgaatgtcaggacttcttaattttgaggagagaaggaagagtttttatgtaaggcattgccttcaaagagaattaggtcttctccggagaaacaaagtcagatgagaaatagcattctatgcagatgaaggtaggtgaagacataattagagcggcaaagccatttggttgatttacagaactgcaagaagtcagaaatggctgctgtttgggatagatagaaactatattatagtaagattggaaagataaaaaagagccagctctaaagggtctgtacatcatactattaaggtttgaatttagttcataaataatgtgagaccactaataatttcaaggatgtcaactatgactctgtacatattaaaataacttactgagatagcaatgtgtacatttcacggggggccacatattaacaaggagataagttagaagtcaataaccaatagtcaatgtgtgatattaaaggatgtcttcttgatctttgaaggctaaacttgatttcaatgtatatcaaaagatactgatgtagatataaagacatagatatagcaacatatgtaatactgaatgagtacaaattataaaatgtaataataaaacaaccaactataatcacaaaccagccttttccccttaagtgtatcacccttttaatttttttctcagtgactagctcttatcctgtcccaaatataaatttagtcaggtacaattgtctgtccctatgtaggtattaaaaaaacctgtggtgactttaactcacaaaacatagtttcaatccactaattaaaatgtctcagctcatgaatatatcaagactctgggtttgatttttttttttttttttaagttgaatcacttctccatctaccttactgtggtttctgatcctttcaatgttgtaatagtaggaatagaggagagttgagagaaacaaaaatatattgcttagctgaatctgtggagatgacatattcctatactctctggacttggtggatgtccaaaactgactctcttgtgtttattcctggaattttgggagaaactccttccactccatccacagagagctctcttctgcagcctctaggctcctagcatttggcctctactttctgttaaggtcatctcattcccccagctgacctgtgtgcaaagtttaagaccacctaattgcatattcctctcctgtgtggctcaaaagtggtcccaaggaaatgcttatgaatccatcatccctacaaaacctagagatgccattaacattctctaatcagccctctcctctgctgcaacagaccatgttagccagtttcttgcttgtagactacttaggcttagctcagatattagttcactacaacctgtaatttgaaaggacacagattatgatccctcactggtcttcttaaaaacaccttggagtttgtgtgtaagtttggagaaggagggcattcacaaaatacctctccccaaaagaaatcttcaaaacccctccttccaaaaaactccaaaaaaagacaacctacctatagttgtaagaggtttaagactacctatagttataagagtcatatagctggaccaaagccaccacctatttttgaaaactttcataacaacttagaacctcactttgcaatatacgctcttagctgagttaagtaagtattaagtactgtgtgcacagtactaagtcttatcttaatcatttcaactcagtgagaaaaaaaactaaagcccagagaggttaaagaatatgttaaaggtcacattgttgacaaatagtggacctgatattcaaaaccagggagcccaaatcagaactatgtctcctcatatcataacctttattgtattatatttgtttaaatgcccgtcatccctatcagattgcattttttttctcttcacaattaccatagtaatgctcttccatttcttaacactgatgtgcttcttatttttttaaatgcaatgcaagatggtgtattgcttctcatgctatatggggtttgtgtgtgtgtgtgtgtgtgtgtgtgtgtgtgatttttcgatttgctaatgatgacaaaataagcagcacagccaactttggaataaaaatgattccaaaacataaatattattgctataatatcgtgttaaaaaaataaggagggctgggcatggtggctcacaactgtaatcttagtactttgggagaccgaggtgggtggatcacctgagatcgggagttcgagaccagcctgatcaacatggagaaactctgtccctactaaaaatacaaaaattagccgggtatggtggtgcgtgcctgtaatcccagctactcgagaggctgaggcacaagaatcgcttgatccaaggaggcagaggttgtggtgagccgagatcgcgccattgcactccagcctaggcaatgagagcaaaactctgtcttaaataaataaataaataaggagaaaagttcattgttttcatctacaaaaaagcaaaattaatttttatcctgaattttaaactcattttacagccactgcatgaaacatgctattttatttactggagagacattgcactgacaatgcccacagtctgatcatccttagaaagctccctctcacatgccaacgaaaacctatctttctgtggggtccttctgtggagtagatttttatcttaaaatcagataactgatttttttttccacctttgctttattctgaaggtttggcaaactaccgcccatgggctaaatctggtccactgcctcttttctaaataaagttttattggaacacagccatgcctattcacttatgttttgtgtacggttcttttcttgctaaaatggcagaattcactagttgccaaagagtttgtataggccacaaggtctatggccctttacagtaaaaggttacttacccttcttctagacagtttagattgacataaaatcctctacagaataccactgcaaccatgttgccctccttcaatttacttttttaacatttattcatttttttatcttgcctttttaaccttgtttcatttttattgccttttccatatatttttagcaattttaaatttattttattttagtatattgcatgcatcttcaaagctaccctaatttctttttgaaatacaatggcataaaactgaaattaaaatatcccatggtgttatatacattttgcaggttgtctcaaaatgtcttttgtttaaaatacagttgaatataaagaaatcaaacaagtaagcagcgaaacttatagtttaaaaaacgatttttttgcactgacttgactatttatcttgttttgagacaccaccacatatttgttctctaactttgtaagctttagaagcactagctaatgtttttaatgaaaaaaagccaacagacaaaaataataataattctattttcaacttcatgctttattttctgagaggaagaaagcagtttatttgttacgggtacatttgaataagaccttaaatcatttatctgttaaaagcattaagtactgtcttttagatttttttaaaaaatatttatttatatattttttttgtagtgaagtagaatgaaaattaatgctctcctgtctctgtataataaaaaataatttggatatatactttttatttcatgaaatttcatttacctagaaaatatgcttctgtcatagaaataaccactgggtgctacaaaacgtatatataaatttttatcagtggaaatcaatttgcataaatttatattagccttctaattgaaccttctcatcttatctaatacactgtttgcttaataaatcttatagagcctctttttggctttaacttttctcataaaaaacttttatgatatttctaaagttttatttcactttatataattcaaaaaccaccacaggtaatatatataaaggtcatactacaaaaatgtcttgactcctaaccaattctatgccacactaaagttcctatactcagtgtttctgattcaatgctaagaggacttttacattttcaaagaccttttgataatgaatagacggtaagtatttggaaagaaaatataaatcccaggattatatttgaagcacttttcttcagtttgcaatgctaaagttaggagattaaatgagaaaaccccatactaaattttccaattaaaaaatgaggtaggccctggctataaagaaagtctctttacatagacttcattatgttgctggtcaaatcataccccttacatatatggtgatacacataggcagctttgttactccttctttctgtttttgccaaagttaaaagagattcttctgtattttgctttcttgttggaaaacaaagatttactaccatgtttaatacccctgggctgattttggaaatttcaggttaaacacattctaaaaaggcatctgtagtctaaggactcagagcataggtgtgcccaatccaaagaaaactaaaacaacatcaatagcagcaacaacaaaggcactaacttcctggttagcctaatgatgtttcattacaaatactcagccaacagttttaggaaaagtcctgtcctgtcctggaactgcaagatttgatggctctgccataagggattagaaggggttgatatttgtcattttgcaagcaccacagatctttggtgttttttcatttgtatttattttattgtaggattaaactagactaagcccataaagttttcctgaaaattaaacttttttcaacttaaaaggtggtgatttagccaaacaataaatatcgcaatctgtgattacaaaattggatcaaaggatgtgaaaataacaccagaggagcaattttagatcattgtgtttagatttctcagaagaatctgacactaagctgaattatttttctgaaacccataccaaaaatgttcattagagttcttgttcaaaatcactgtgatgggtaaggttctttgtccttcaaatttttacttatgttagatttcactgtggcatcactgaatagaaaaaaataaaataacaaaatagattgggtggtttgattttagggaaaaagtccttaaatgaatcttttgttttcctgcttttgctacctcattaatcctaaatggtgtcagtcagttgagtctaatagctgcgagtgttactaccttggtcagttccaaattatagtattgattaattgattgtcttcttccagttgtgaattatattaacgctggcccaggcagtttggcttgaggccaaaggctaattttcaatggaaggcaagaagcagtttcactgtttctctgctgtggttaagtggatgctcagaaaacagaaagctttgaaaagatgatttgacaaaaaggaatgcactaaatataattaatatgtgcttattgatccatccaacctagagaaacaagtaggaagacagtaagttgagaattcatcatttgtcagccccagacttccaaaacagtcttaaaacaattgactggagaatgagagtaggagggaagcaagatggtccagaatgataatgagccagcctcaggatctgtggaattaagtccagatgcaagtgtggtgactgtggtgctttcaaacgaagtgaaacttgatgtgggttacaggctcctctacatcataggcccagctgtccaggaaagcttaagaaacacctgccacattgtggtaccaccagggcagcagtaccatgttctcagaaaaatataaacattacaaattgaaagtcaaaacaagaggggctgctttctcgttaactctctgctttaaggaagaacataaaagggttgagtgtgcttatcattgattcttgtggaacgggaaaagctaaatggggcattgagaggttaataactttcacagatctataactctgagtttctttgttgccagatcaattcattttccctgtaaaatgtgaagggaaaactggtatgggatggagtattgctaattataagattatattatatataaatataattagattatatttataatcattattggtctttcttttcaatgtggacaaaattatgcttggtttcacagggaaataggaaaaggagcttttcttcttcaagtaaagagaaagagcatgaaaaaatgcgggaagtgattgaaggggtcttaaatttgaaagcattgacatcaaatatatagacgattgtcataaatggaaagtttggaggaaacaatcatgaatacgtggaaagcagtcacaaggtcaaatatgttgataggaattagaattctatgggcgtattttctataagagaagagagactgcaggtagacatattgatgaggaaaaaactactcttctataagtggcactaggtttaatattattgattattttatatatatatgaaaaatccttagcagaagcaattatgtaacagcctcttggcatggattctataatgaaagttcatagaataaatctccacaaaatataaaggtatattaattcttcattactgtctcaatgatctgcagcaaaaataaggttaaaatttggaaagacataatcattatttaacaaatattatgataagctaggctgtttatgatagatgataaggatattatagagggagggccaaaacaagaagcatgtctttagggtaatctgttgagtagttagtaattcaggtaactcacagtataaatggtattacaaatccagtgtaccagtgatttgaataaattactgcatatcttagtacactaagtattctctaagtgagctagttataatcttagcttcttttggaaaagatacaaatataattcatcctagtaaattcttctgcactcagcacagagaccctaacacaaaatgagtgctgcatgaatatttgtcaaaaaagggaatgtataagaatatagcctttgaatcaatttcctttcagtggcaaaatgtactttccctaaagaaacatagtaataaagtcaacaatgacacagtagcaaagtaaaatgtttgggatccaagcatgtataaatataactatttttatctcttctcttcctcctctctttacctgaataaatctgattaaccctttactcactttcattttctggagaagtgatcccttgcccgtttggacctagattaagcagcattatctcgggctctgtgtttcccatgttttggaaatatttgcactctcctataattgtttatttaattggcttattcatgatagatgtgctatgtcttcttattcttctgtatgttccctaggcactggcaaagggtttggcatatagatggcacttggtttttctagtctgtgtcattcttggcccctctcctctatacctcccatctggttgatttgcacatccaggtagctctaagcaatgcctatctagaatttaaccatttctctgactcccaaagccatcatcttatccagtacttgcctgcattattccaatagcctttatcctgcacctggcactgtttttgccccatttattcagttctaactcaagcctaaatgattctcttaaaatacagattcgatcgtgtccaaaatattcagtgaaagatcatcttctgttcagaatgttcaatgagagatcacctcactcagaatgaaagccaaagttcttaccagcagctaacatggccttcgtttatttcccagtcatcttttcctcctgactctcctcagactttcactccagacacgtgagcccttctgttccttgctttaggtaagctccctccttagggtctttgcacctgctctttccttatctagaatattttccccctaatatctacatgactcactccttactttcttcagagtttgactcaaaagtcacctactcagttcaaaatttgaatattctccttactcaatactttaattttatttccctactttatcttgtcctaatagtgctgatttcaagtctggtattcagcaagtaaaatgaacttccattctgtgtagctgggtgtctattcggatgggttggtatccatttgtactggttgggtcatgggtcacttaacactggggatacattctgataaatgtgttgttagctgattacatcattgtgcaaacatcatagagtgtccttacaaaaacttactaattatagcctaccagtgtagctatatggtatagcctactacccacctaggctatatggtatagcttattactcctaggcaacaaacctgtacagcatgctgctgtgttgaatactgtacaccattgtaatacaatggcatgtgtgtatctagacatatctaaacatagaaaaggtaaagtaaaaatatgctagtatgctcttacaggaccactgctgtatatgcagtccatggttgaccatggaccattgttacacaaagcatgactctattttaaatctcacctctgctcgtcactatctaatatacccgatactttgccggtttctctttaccattggcctcccctactctaatgtgttcttgttcaacactgtatcccaatatctgcagtgtctggcccactttggctcctaccggcatgctcttatgttagcctatgcacaatttcaccttaaaaagaattgcaaatgcctcagagaatgagagattccatagacatatattttctaggcaattaaacctccatgataatgagggagttaagtatctttaaaaaatactatgagaagtatattgcatgaaaaaatagtttgaactataaaacagaaatatatttgtttataccatacagcccccccaaataaaacattaccaacaggaaaaaaaatcgttatatagaatacttatttgctttcctattgtctccatgtaacagatcatgaactccttgagggcaggtaccattttttgtatctttgtctctccatcatctacaatagtgactgattaataaatattcaataaatagatgaatgaaaaaagggactttgaacatatccacaattacccatttaagagacagaaatcatcacaactatgcttttatttactatgcttacatacttttattttaatcaaggtaaatcatttatacatactcctattggctcaaatataaccttataagttatgttattccaaatgtgtgcatttatctgccttaagggttttcaggagcataatccttgtgattgaggtgaagatagtagatatacataaatgctatctcagcattactgtggttttaaattgtgtaatatgttctcctaagtaaattgtaaacaactgttgccaacaaaggatattacataagagatttcataatcttatttaataactatagtgatttctaatatttcaaaaagtgattgaaaaatgtaattctgcctagaaaaatttaggatcagatttagaagtaattttaaaaattgttattatttttataaatttggaaccatttaatgtgctaatgattttcttttttttaagaccgtgagatttgctttggactgaatgttgctagctcacccaaaattcataatctgaagcctgatcaccagtgtgatggaattatgaagtggggccattgaaaggtgattaggtcatgggatgaagccctcaggaatgggattaatatcattataaaagagtacccagaaaactgatttcccctttccactatatgacatagccagaagaccccatctatgaaccaggaaatgatccctcaccagacaccaaatttgccagcactttggtcttagactttcagcctccagaactataaaaaataaattgctgtttatatgccacccagtctaaggtaatttcttatagcagccaaagtgaactaagacaagatttttctaaaacgttgtctttcatgttaccctgttcatcacaagaacaattaaccactaaaatctttgttaataaattatataagatcatacagggcatgtttgtcaatcgtacaaaagatagttttaataattcttggctgggcacggtggctcacgcttgtaatcccagcactttgggaggccaaggcaggtggatcacgaggtcaggagttcgagaccagtctggcaaacacagtaaaaccccgtctctactaaaaatacaaaaaaattagctgagcatgatggtgggtgcctgtaatcccagctactcaggaggctgaggcaggagaatcgcttgaacctgggagatggaggttacagtgagccgagattgcgctgctgcactccagcttgggcaacagagtgagactctgtctcaaaaaaaaaaaaaaaaaaaaaaaaaaaagagttttaacaattcttataagcttaggactcaaaaatatactatttgttttgaggaagactcttctttgtgtgatccgattgtattactccatatttctaccggcccaagtacctctccccatggtcagcacagctcatgctaggtacctccaggatcacatcattgagtatttggaaaatgggtcatcgactagcaaaaactcatattataaatgcggagccatatgcaatgggtataacttaatgccccaaatctgtaggcctgaaaaaagaaagaaagaagcacaaagtcttttatatatcactcttgaactcaacttctaggtaatcttctatagctgagtctgcaactccttccctcagaataacaaatgtgcagctaccaagcaccaaaatttaataattcagcaatctcacattgctactcttatatttcatccttcatctttccacagcctataagtagaaaaatagttgaagagcatgaggcagataaacttaagggcttgatatgtaagaaggttgtcagcttgctggtctaattgttctggttctacactctgccacctataattgaatgtgattgaattaattcagcttatttatttggtcatttatttctagaaagaggtatctaacttttcatgaacataatcattgatgatttgaccattaaggtcactctcaggaggagttagaagtcagtctctatctatatagttctatgcaggctgaaaaaccattcactttctcctaatcttcttttcttaggtgcttttcttcctttttgtccatttattaggtaatttccaacttgattactaaactaagatgagagatatttaaaaatagacccatgttaattgctatgatttcaatgtctccattaaaactcatgttgaaacctaattgctaatgtaatggtgttgggagttggggccttaaagaggtgagtaagccatgaggcctctgccctcatgaatgaattcatgctgttatagtagaagtggtttaattatcatgggcatgggttcctgatgaaagaataagttctgtccccatttactctttcagtctcatgaaatcacttccaccttcttcccttctgccatgggatgaggcccttgccaggtgctggtgccatgatcttagatttcccagtctccagaaccatgagtcaaataaacttccattctttataaattactcatgcgggggtattgtgttatagcagcacaaaacagataaagacattaatggaattcagttctagatggttagatggtcaaaatatgtcctatgagtatctatctatctatcttagtagttttttctgtctgtatatcctaatgcccacttgtattaattcattttcatactgctataaagaactgcccaagactgggtaatttataaagaaaagaggtttaattgactcacagtttagcatggttggggaggtctcaggaaacttacaatcatggtggaaggtgaaggggaagcaaggtgctttcttcccaaggcagcaggaaggagaagtgcctagtgaagggaaaacagccccttataaaaccatcagatctcatgagaactcactctgaaaagaaaacagcatgggggaaactgcccccatgattcaattacctccacctggcctctcccttgacatgtggggattatggggattatggggattgcaattccagatgagatttgggtggggatataaaacctaaccatatcacgaccctaattgttttttagcttctatttttagaagtgaactgataagtactgactaaaactagtgtgaaaaatttatactttatactcattaatatattgcataattagaaaatatattagagcataactatcttaaaatttgttttttgtcattatgaactcaaattaaacttaattttaaaatgattatgtctaatgcttgattaattcaaacaatccaaactgatgatcttttaaaaataattatggtgagcaaaaaaaattccggtaagcaaattgttaatgcttaatcctatcaatcttgacttgaaaatgatggatgtaaacaaatcaatttaaaaatcagcttaagaggccgctatttatagtagtccctataaaaatggctttgtactttagttgttttataaaggcatcttaaaacatataaaagactgagttaattttaaaagctaaaagtatagtggccaaatgaagagatgcacatgcctatgatggtatccagacactatttgatacatggtatttaattgtaggcatcaatttgaaacatgaaatattttatcgatgtgctgggaaagagagatcagatgatgaaatatctggaacccatctcataataggaatggtgaaggaactacagatattttgcataggaaatagaagactaaggataaaaaaggcaggtagcttttgtatcaatataaggaagacttttcttgtaaatacagctactcaataatgaaagtgaggtttatgcttagtttaatcagagtgtggctgactgtgtgtgtgtgtgtctcaggaaagtagcctacaaagagattgaactgtgacctcccttagtctttctgccttaattgccttggttttcctgcctgcctgcctttttctttcctcctctcctccccttctctttcttcctttctttcttttcttttctctctctttttcctcacttcctccttccttctttccttttttctttccttctttctatcaaagggtgatgtggttttaaacacagaataaaaatgatttgaatcacagatatactaccaaatatcttttattatcttgggcaggacatttgccttctctgggtttaaatttgtcatgtacaaatcatggcctggggtctttacagcctattttagttctaatattctctgaccatgtaagtgtagacatattgacaaactctaagtctagttatgaagagtcattacaactataggcttttagagctgaaaagcatttagtcaacctccatacaagtcattacattttacatattgttgtttctacattgaattgctagtaaatcatttcaataagtccttctttaaatgctgtatatatagtataaaggttttttactacccttgaatgaacaaatgtgactctctcaagcagaaatgctctgggaacatcctgctgagctttcttcttctggccatacagtctacatacacaattaaccttcccttaattagattaacttgttctttacctgggactgtcaaattaatactgtaatcaaagatctcttttagagacctgaatatgttcctgctacgtgtaatgctaattacttctttactaaaagtaactaaaaacaggctcacttaatggtatgccttagttagaagatctggtttatgtctccaaactagtgctactcagaacttcacaaacaattcttaaaatcaactaaagaaaccttagtatttctgattttcttaattgttgaaactcaaagatttaataaaattccagactagacctacttacatgaaaatatttataagcattggcactggttcttatattaaaacatgatactgcatagcatttaatcaaatgttatttataacaaattaaattgccctttccaaaataagcaaagcatttggctatagaacccacagtattgttatgttcaccccacatatttccaaatgcagacattttaacagtttctggctatcattagcttgatccaattatgaaaagtgacactgatgattacatgacaaagaaagctcacttaaccaaattgactaaacttggtcaatgtccccaaggcaaaatgctacgaaccactagctgaagactaggatattaagcatcaacagtattttaaataccctctaacattctcaatcagccattgattaagcatctatggtttcaatgtttagacattgtgggaaatgtgaagatgagcaaaaagacatacaccctccttttaaaaagtttacagtcatagacacttaaggaggaactggcaggataatggaaacctgattcttttgccatctagttagatggttttgattctgtcaatcaggaaccaccttgaaataaaataatgaatgaggtctctgaagtttcacctgggtttgaattcttgtgtgatgtagcaagatatttcatttctctagttctcaggtccctcatcctaacatggagataaagtacagacctcaggttttctgtgaggagtaaatgtcatatatgtacaatatgttttgcacataatatacatatcaaaaataaatgttaaaatatttaagggatgaaggatacattaaacaagaaagctcttttttattggcaagagtgaaaagttaagtattttgtgttacataagtaccgattgcgccactggatgacccagccatcccattactggatatatacccaaaggattaaaaatcatgctgctatgaagacacatgcacacgtatgtttattgcggcactattcacaatagcaaagacttggaaccaacccaaatgtccaacaatgatagactggattaagaaaatgtggcacgtatacaccatggaatactatgcagccacaaaaaatgatgagttcatgtcttttgcagggacatggatgaaactggaaaccatcattctcagcaaactatcgcaaggacaaaaaaccaaataccgcatattctcactcgtaggtgggaactgaacaatgagaacacatggacacaggaaggggaacatcacacagtggggcctgttgtggggtggggggagggcggagggatagcattaggagatatacctaatgctaaatgatgagttaatgggtgcagcacaccaacatggcacatgtatacatatgtaacaaacctgcacgttgtgcacatgtactctaaaacttaaagtataatagtaataaaattaaaaaatatatattttgtgttagatggctacattcaggactgatgtataacactcacatactacaaaaggaaagaatttcttctttctttcaggcaatgccctgaaacaactagctcactagctggtgatcttaaataattggaggaaaagacaatttaggaaatactgatgaaatctaataccctaaataaagtgtattgagcttcacccaagtgtctgacaacatgtcttacaatatttttgtacacatcatgtcttaaaaatttttgtagacaatatggagaagttggaactgaaaagagccaggtagatttcttaagtggcaaaaatcataaaaaagacattggaatatgtaaatattaatttgtaaagcacttttggacttggctcagagttccgtcttcggtagagtaaaaataccaaagaatttgaaagtcagaaaggtttaggttggagttcttgctctaactctttagctgtgagagacctttgcctccttggccatcagtttcttttgtaatgggatcatatgaagataacatagaaagccattccttttctgcttggcacatactaagggctcaacaaatgatttcaataataatcattgttatttttaccttaatttcatttttgtaatgaggtgcagctgattatggtatcttgttttcgtttttattcactttgaaaatacagttagaaaaaaagccttttctctaggtaggtagttatgtttttttctgactgtgtgctatgattcaagcaactatcctgttttgagaaggtgaactgctaaaatatgctgcctgtttccattttcaaacctgcctgtgtgtgagcagacaggttcctgatgctctaaattttaataaaaataacaataataacatctacaaacaaatttatgtacctcctactgtgtcaaatagtattcaccaaagcagctttcatatatgaactcatttaatcttcactacagccaccagaaatataattattatctttatttaacaaatgagaaatctcaggcacaaatttgcacagtttacttaatatcaaatggctaataagtagaagacaatccaggcaaatgtaagtctagaatctatgaaatttgctccttataatagaattggtctgtcttgaagaaacaatgtcattaatggaggcatatttgaaatatttctattagcactagatcagacagaaatagaactaaaaagaaaataggaacatcacttgtatgattagttctacagaaataagtactttggactcccaaacaagtggcttttaaatgaacactggaagataatgtgcttggaaaatggaaactgattctatacaaattgctgaaacataaagcagaatgagtagtattttaagagagtcaagaatgaagacacagaggaattcaaaagaataacacatcaatttgactgggggtatccaagaaagctttttggggaaggtaagctgaatcttaacatataaaattgaacaatgatgaacccccatggaaacaggctgaaagcctgaaataaatttactacaatcttcgttatctcttatttgtttgttgagttatcatcttatttgacttcagtggtactgtgatttctgaaggacctttgtgtaccttctccatatgcagatatttccattttcttagagtcataagatacatcaaccccaaaataagatcaacaggggatagggacggtgatattcttttctttaaactgaggatgcaaaattttagcagataagagatttgagcatgctaacgaacttttaaacctcacagactttatttagaaagtttgtatttagaaacattgattttaaaacatttaagtttatcttattcatcacaagtttattacgagataatagtctctgaataacaagccaacagatcaaatatctcagagaaagaatatgggaattgtttatttcaaagaattatctttgtaggattagaaacacactattaaactgcaatgggtgaggaaaaaatgtccttggcagaggattttaaacaaaaagtattattatggtagatgaaatgtttatattagaaaagggatatgtaatgaaacaaagctgtgttaatagcaaaaattttgtcacaaagtagtgagaactgaatgcattaaatcataacctgttattgtttaacaaagattagactttaaaaaattcgctaatctactcactaatctgttttctcactttattccctcattaacaataaatagctttgtagcttccaaaagagccaaaataaagtatgtaggcgagaccaccaccgagggctaataatttcatagcagcagcagctaaattcaatcaacatttaaatctataagcatctgctgcttcaattcagaaatttaaccgattgttagatttccccccacgttcaggcctaacatcatatataattcagaactgaaaaataaatctctcattgacagatttcttagttattctattgtcattaatacattataaaggaaaatctatagtaaagaataactcaatattaggtaaacagagtaaaatgtttgagtattttatccatccatccatcctaaccaatattcgttgagttgaactatacatcagttactgtattaagtattaggacccagagaagggaaagggttaaaatgtggttgtggactcaccttgagttagccaccgtcggtgttttcagacacagtccctggcctcaagaagttcaaaacctaattataaagatagaaagtaacaattatttaaaaaatattttaatccctacattgtctttaagataaatgctgtcaccccattttttagtggggattgaggcagagatgagaaaaagtaagctagttaatgagaaactagtatcaattttatgaaatacaatctttaattgaagtagtgaaatgccaaaaaccaacatggaaatcactattgttcacaggctataaagcagaatattgactattctttaaaatgttgaattgaaactaacatgtccaccataaaatggctaaattgccttcttacaacatcagtttcattaagtccagtaaacatcttggtttgttgcatcctacaattacataatacatttcagaatatccatcctttggcctttaaataaataatgcccctaagttgttaaggggagcacttaaaccttggcagccaagctaaagcaaatccttgtctatcctactcgttctgggacgaattagcatggaaaattccatcttataagcattacatttatgtttaagaatttcataattaatttaaaaagatccacacctctgaaacatataaaaaggcacaatgtcttaatttctcaacagaataatttgtacaagatttgaagtctaccttaatgattcatttttgtattgttttcacaattgctttattttgtttagcacatttttttctcaactctttttaacatattaaactcttattcctccttcaattcccagcaaagttgtcatctcatggggagagactttttgacaccctgctccctctaagttttagttagatgaatctcctagatgctccaacaagctctgcatctttccctatcacacgttatcacatcaccctgtgtcggagaaaatggctaactgttcaccaaaacatttcccttttccttctgttacatagccagactacattttgtagttagatgtgactacattcctcaccatggaacacagtcttaagaacatcttgcatatgatcctcattctatgtttcttacctataggttaaatccctaaggacctaaaggaggaaaggtcccaaagacaaaaagaacatgattctccagccacagctttcaggatcacccctcacttccactaataaggtctattcacagtacagtgttacatagatgagcattcgtcacctcaccctgactaggacatctattggcactgcgttttatgtaaatgagaattaaatttctcttctttaagccattaaaagggtgggtgtttattatagcacttagcctgtttggtttattagatttcccacattagattgtaaactatggtaccccgtggatacagcaactagttttgtcttgtttgaggttttagctgagcgcttgacacagaaaatagcatatacttaccatccctctctctgttttttaaaataacttaaatcttatgtgataagatgtatcatgaaaatttcataggaactattattctaaatagttattccttcaggaatagggaacataaggcttcatttagcacgggttccaaaatatcctttggtaaatacctaaaggtaaaatttgattttgtttaagagctcacagcaagtggaacacatcaaaatatgcttgcaaaactgttcttataggcctctatttgtgggttttaggtaagacgctgagagcattgcacaaccttagtcagaagtaatgggcttggaagctccttgctgtagtcgtggtgatttggaatgtcctttgaccctctactggatttaatgccaatggagagaaaatgaaaggtaattttctttccttttcaaaacaataaccaatcacagaatccaagaccttctgctcttcacatattacaatgaaacagcttttgaagtctagacaaaaatagagacatctgacaagcaatatcaaatctcagtcagcatgcctccatgtattcattactgacacttctctccctttcccctagagtcaaacacactctattcaatgattccttttaggcaaccaaccacctgtttggggccacttcctaagggtctctccaaaagtctcacccatctgtctctctttactattgtccacttgctggttaagtttagtcttgcttggcagaagtcaactttccgagatttacctcctttactttcagccctacttaagcaacggactttagaggagatgatcagatctcctggcttcctttctgaggaatgaagaggaaacttttgctgctagacatgcaactgccttttgatctgaagtagaaaatcctcaggctctattccattactcatttagatgattgctgaatggcaccttcaggctagattttatggttgctttaataaatttgtagttcactcacattaatgtctatatattaataaagcatttctctagtgtcaggcaaacatgcgttggatttactagttaaagacacctcttacaggttttcatagacattttagataattttttttctttttttttttgcctctcagaccaccacacaagtgcctttcttttcagagtacaaatatcagtctagttatctgtcgatctggtagaggagacaacaaaaactatttaacatcagtgagaaatagaaaaaaatgtaatcctttctaagccatgcataatgtctaggtcaactaagttttctccactgtgattaaaaatggcaaattattaagaagtcccattttattttctggagattgagaaaaaatagatgataaattctcatgaacagaagaaaatggattttcagcaagtaatttggctcaagaaggcagaccctagtgcatggaacatgctcaatctgggggagagaaagaaatgaacaaggaggaaataacaataagggttctttcatttcccagctgtctgccaaaatttggactggttgttatggctgaggaaactgtaagagctgaagttcataactttaaagcgaagatctgtccatggtggggcacaatctgaccagatacagtttctagtatttgtatatgttcatgaagcctgggcaacatcataagatcccatttctacaaaaaatacagaaagctagctgggcattgtggcatgcacttgtagtcccagctagtcaggaggctaaggtgggaagatcgattgagctccagaggtcgagggtgtagtgagctgtaatggtaccaccgcactccaacctggacaacaaaacaagactctgtctctctctctctctctgtctctccctctctctctctctctctctctctctctctctctcacacacacacacacaaacacacgtatcctaatacatatgtgtgtatgcatgggaagttttgaaggctccaattcactttggtcataacccagttttccaccttcacagaaataacaaacatttcagaaatagcctttcatttagtgtgttttgcattaaaagagcataatcttctattttctaactggaattatctagatgatgtttatattcttacacataaaaatatttagatttgcttagaataatttttttatatttactatatggtatcccttctgttataaactgaaatttccaaattttaatatgactcttgagtattatataaaatataataattaaaacatttcacacctgaaaaaggtatttcaacagaaacactgaaatttattttacataatatattgcaatgattttcactctaaattagaaaaaagtttacttcctatcaattttatttctgctgttaaccctattctaaatcatccctcaaaattctgattatcaaaataacatgtaattttaaaacagattctcattagtgcaagcaactgtgactttttaaagtagcttaaaattacatattaaagagatttcattaggaagctttcattctctttcatttagaattgtttgcacatacttctcattagtcattgtactcagattttcagattcaagtataaggatagtcctttgcattaccttaaacaccaggtaagtaaaattccaggaaaaaataagttttgaaatacctaaaggtacctgtcttatgaaattgtcaagtcccttttttatgtgcagtttgtacaatacaaagccaagacagatgaataagagagtgtgattttaagctttgcttggcaaacatgttagatttcttaaatggcatagcttgtctttcctccctccctccctgcttccctctctttccctctctctctctctcaaccttgttctaatgtcatcccttataggtttcttgtgaaatagactgatttggagctgtgttaataacaacaacaacaaatactactgcaacccacattgcagtgaacaatatataaaatggcaaataaattgtacctctcatgactaaagaataagaggattttttttttgtggtgttgtgttatgttgtgtgtgtgtttgtgtatgtatgtgtgtttccatgtgacaccattataagaacaagcaggacttcttggaatcctgagtccttttgtctcaactaaattaagagataatttaaattaaaaaaatcaatatataatgcacttatagaaaagtacataaataatgaatcatacaaaataaacatcagggtaaacaccacccacgtcaagatatagcacatttccagtaatacatacttcatgcttactctcaaactcactttttcctcctcaccaaaggtaaacaaacaccatcttgacttctaacctatggtttagggttgccttgaacgttatgtaaatgtaatcaagtattgcatgttatttttgtgtctgccttctttccttaacattaaggttgttggctacattcatgttgtaatttgtcaaatatctgaatatacagtgccatatttttgtaactattctattgctgatggacattgggtaatttccagtttaaagcaattacaattaatgccgcaataaacatccttgtagatatttcttggtatgcatgttgtagataatgaggagtggaattgctggatcatctggttacgtatatgttaaatttcaatagataatgccaaactgttttccaaagtggttgtagcaattatacttttcctgcaatatatgagtgtttctgttgtataacatctttgccaatagttggtagaagttatttgctttgaaagtctaagcttggttagtgaaagaggagagagggagtgaaggcttggactagaaaagggaagacccctgacctaggattcagttgactggtagaagaatgatggttgtgccatgagtggtaaagactctaacaacccttttaaggattttccctggaagtagggagatccttgaaggattgcaggatctaatgagagacatggtattctgtggaattatgagagtggacgtcaacctggtcacagaattttagtgcaaaataaattgtgtgtgtgtgtgtgtgtgtgtgtgtgtgtgtgttgtgtgcatgcatgtcttggaatctttttacaagcaaataaacaaaaccaacacataaagtggaaagagtctctttacacaggaaaatcatcagaaattcctagggtggtgaattaaagatgacaaggaccacaagagtagaagctagccatgaagaactacttaatatcagtctattctaaattacatcttattcttctttttgtaatccattttgaacatggtatgtatcagaagagatgggaatacaattccattattttcaggtatgaggaattttccataagtgttcactgagctgttttagtaagtgattgctttataaggtaattattttatgattatcacatagaaggtgcttttgaaaaaatatcctctagagtcaggaaaaatcatggaattttatagttgaaagagatcttgaacaacatctaattaaacctcatttcacagatgaggaagttgaggtgcacagttgctcagtgatttgatggggctaacgtagtagttaactgcagatatagaagaatctaggccttttaatccggaagactctcatcataaattcattttattaaataaacattgaaattttattaattcacttttcttacctggtctattcctacacatccttcagaacccatcagggtttatctactacaaaacgtcctctctgatcccttctctccttaaatccatatgagatgcttctattatgtcttaacactttataatgatttctattttataactgtctatatggttatctctttgcccactatactgaaaaagcagaagacaggaactgcttttatttttttctgtttttgtcctcagcattttgcataagcctagcatacagtgataaatggtaaatatttttgaaatgaataaacaaatcaaaatctggctctttattattttgctatgcactcaggtggatgtgaaatatattactttacccattaggttgttttctgggctgttcattgatatttccatttctcatctttccaggaatatggtcaaagtgaacttccttgtgcctttgaaattagtgtggctgtgtaatttgagcagaagtatcacatgtcacttccatgcagaagactttaatagccagtgataatttgccccttcctcgctcctggcacagtgatgttggagactttctgagtgaggacagcatgagaagaatatgtagccaatggctatggtttgaatgtgtcctccaaagttcatgtgttggaaacttaatccctattgtaacagtgttaggaaagtcagacctttaagaggtgattaggtcatgagggctctgttctcattggtagattaatgctttaattgtgggagttggttagttattgcaggagtgagctcttgataaaaggatgagtgatatggtttgactgtgtccccacccaaatctcaatttgaattgtatctcccagaattcccacatgtcgtgggagggacccagggggaggtaagtgaatcatggggccagtatttcccatgctattcttgtgatagtgaataagtctcacgagatccagtgggtttatcaggggtttctgttttgcttcttccgcattttctcttgcagctgccatgtaagaagtgcctttcacctcccaccatgattctgaggcccccccagccattctcaggtatgtctttatcagcagtgtgaaaatggactaatacaacgagttagcccctttcctctctctcctgatcttctgaatttcaccatgtgatgacatagcacaaaagccctaggaggacactaataccttgacattaaacatcctagccctgagaactgtgagccagtagatttctgctctttacaaattatccagtctcaggtattttgttacagcagcataaaatgtactatgatatcaacccatgatagataagtggtgtgattgagaaatagaactatgttattctaagtcacaaagattttagagttactactgtctcataacccagtgcatcctgactaattaatgggatgagactttgggggactgttggagagagtgagcctattctgcagtgagagaaggctgaaccatagagttcagatgttgaactgtcacatatagcttcaaaaatggatcttgaagattctcatctcctggcattcatacacttgtgtaacctcctccccttgaatgtaggctggacccagtggcttgtctctaacaaaaataatgctgcaaaagtaatggcaagttgccgattagattataaaaagactggggcttctttcttgcttgctatgtcacattctgtctcttggagcctttggtctggaaaaagccagttaccacatgatgactagccctatagaagggcccatgtggcaaaaggttaatttctttcgcttacgacagagactactgaaggcttgtcaacaatcctgtgaatgagataggaaggggtcttctgagccttaccaaaagccatgttgctgaacttgagtgtggatcttctttcatttggtccttgaaatgaccccagtcctggctgataccctgattgcagtctcgtgagaggtctggagcaagaggcaccccgctaatgcagctacctccatttgtgacctacagaaactgtgagctaagaaaagtctgatttaagttgctatattggggataatttgtaatgcagcaatagttaactaatacattttatgagtatttccctatctaagtatactgtcccaatatgacaaacacatttaacattatgtcagagatgcctgatgatgaccatatctgaagttgaaagcaatgctgtaactctttatttattgcaccattgaaatatggtgcactatgtgaaccaaaagccatttaagaatcaagtttatactttagcttcttgcatcaattaattaataaaatttatataggtattagcaagcatctctaaatgcaaataaaatattaagatataattaaacatatactattaatagtaatcagtatttaggatactggaatgttgggggtattttgtgtctctttgatttttgcaaacaacagaaaatttgatttgcccattaaggagaaacatggatttttattagaccattttcatgttgccccaatataaactgacttctacttaaatagctaacccaattcctgtactgcttctgaaaaatttatcaaaatatgatcaaaggagtgcagggacagtgtgagactgggactttcaggctattttgagtcatctgaatctaaaaatgagagcatgacacctacacttttcccatagttgttcaatatcaggaatctaggacagtgtctgttcagtaaatcagagagttaatgttaaattttatatagcaaagataaaaaaaaagctgtaagaaaaaaattataaagtgttgggagaaagcaggagtgcagttctcacacaaaaaaaataaacttgagagctgaaaatcttccactagctatcttgtgacaatacagtgaagcatgagccccaagcgagggacctgctttggtagtaggctaatgagagactcagaaaacaggtatcctagtgattaaaaggtttctcataggtgattataattgtttttacatgtttgaagtcagcctggttttaatcccaacagaaatttctaatgaatactgcattttctgtggaagcaacaattcataatttccctttattcttgtttgttactacaaaagactctgtctcagagggctttgattaagatgatgagacaataaaacaaatagagagtccattaaatgcctgcctgaaaccagagctgcaccacttaatatgaaagactcttcagaaccaataatgaaataatcatcctttttccatgactgataagaaaatgaaggctagatacagatttgggaaaactaatttacactggaggagggaagaagggaaagaagagcaactacagaaaatcaactgttaataaatatcagagactgcagagaagtcacgagataagctgcagcgtatgttcctccagctagaaaatcgcaatcatttctctgagaagagaagctgataaggtcccctcccctccaccctgcaatcattttgcattttaggttatttgaaaagagcttgattattttcctttgaatgaaaccagattgattcacatttacctgtcaacagaatgttccattcctctgttttgcttgtctatttaaaggcatatgacctgactatgaaattccatatacaaacgttcagttaaatgtaagtaaataaaaatgagtgaccagcttgcattttaaatattttatatttttatttctggtagcaaattatgctaaattagaatccactgattgataaatatcactgatatggagtaatgaattgaggtcatgaatattgctttactcaaggtcagatacaatctttaaaaatcatacgcagaggaaaaagctgcatgtgaacatgataattatgctatttgaagcctattttaagggggcaaatacaacatataatcttctcctgttttgtaaacttggataaatgtgtaagtacactcatgtatcacttgatgataggaatacattctgagaaatgtgttgtcaagcgatttttcattgtatgcacaccacagagtgtacttacacaaacttaggtggtatagcctactacaaacctaggctacatggtatagcctatttctcctaggctacacgcctacacatcatgttaccatgctgaatactgtaggcaactgtaacacaatggcaagtatttttgtatctaaacatatctaagcatagaaaatgtacagtaaaatatcatctaaaagataaaaaatggtacacctgtgtagggcacttaccatgaatggagcttacaggacagaagctgccctgggtgagtctgtgagcgagtgatgagtgaatgtgaaggcctaggacattactgtgcacaactgtagactttatacgcactgtaaactttggctacactaaatttattttaaaatgttttttctcaataataaattaaccttagattactgtaacttttctactttataaactttttaaaaattttttggctcttctgtaataacagcttaaaacacagacctattgtacagctgtacaaaaatattttatttctttatacccttatcttacgagcttttctgtattaaaaataatctttatactttaaaaatattttttgttaaaaactaaaacacaaacacacatattagcctaggtctacacagggtcaggatcatcagtatcactgtcttccacctccacatcttgtccccactggaaattcttcagggggaataaaaggcatagagctgccatcatctatgataacaatgccttcatctggaatacctcctgaacgacctgccagaggctatattacagttaactttttgtttataggtggaaagagtacactctaaagtaataattaaaagtatagcatagttaatacataaactagtaacatagtcgtttattatcactatcaattatgtactgtacataattttatgtgctctacttttataaaactggcagtgcataggtttgtttacaccagcatcgccacaaacatatgaataatgtgttgtgctacaatggctgtgatgtcactgggtgacaggaaacttcagctccattataatctcatgggaccactgtcatgtacttggtctgttgttgacaaaagcattgctaagcagaacatgactgtattgctctatcaagtagagacagacaagaggaatgtgcaaaggcaaataagaagtgaggagctggtcagtatacttatatgggtttaacttcacttgttgaaatagggcgctgggatcctgagcgatagtgggaaaatagttctaatagcacattgcatattatctcttaatattgtaaacattttgcttattactaaaaggggatgtggaacaaaatgcttctctgagcatcaatgcagttgggttctagtatggattctatagcttataaagtttgtatctttagtaagtcagtgacacttttttgttttagttattccattctactaagtgaaggagtcaaatagtattatcaaggaccagttgaaccctacgtgtgtgtgtgtgtgtatacagatacctatggtatatatgtgtgtgtgtgtatatatatacatatttatacgaatacatatatacatatgtgtgtgtttgtgtatatatatatatatatatatacacacacacacatatacatacatacccatatatacaacttttaaaacaaacaaattgttaagctgacatggtgttagccctcaaagctatgaaaacttgagcatacatcttggataaaaaaaggtaacttatgtggaatctcaatttcagcatgctgtttacataattcacaaacaacatttagttgaaaacatatgtttggaaaataaatcaaaatattctgtttgtgaaatacagaattgatgctttaaaggatgaaacatgctttgggtgatagaaactgtgttcactatcaacagaatatctcgtttagtctaaatacaggccaattggtcatatccgtagtaagccaatgggaagacatttgttggggattaagtagggactgtgctggtctgtttcagtatgtttttcagtgtgttgatattaatacaaagttttgaaattttggtactttttgttaaagtattggttttattttcctcaattcatcacacaacttgaaacctttcatttgaatggagcattcgcttcccacagagtctgtggtattgttgctttcagctagaccctagcagtgttcctcagccatcaacatttttaaatgcaaaaaaaaaaaaaagtgtatacaaagacaattttaggaagtatacataggctgtaaattatttatagtgcttaaggattgaaacagctacaggctgtcaagaataagaaaagacaattacctaaaaagtaggggtgaaaacagagttataggctggtcattgtttcattattattaaatacaaaggctacataaatgctgatatttagaaaatattttaaaaatctgagaattctaaactcttcttctcttacctaaattattttgaagaattaaaagataaaaggctgtacagtttggaggatagtcctctggacataaagatggggaggccaagattctagcccatgtctgaccacttgttacttatgtgaggacttagcatacctgaccttcaatgttctcatatgaaagataagagaattatctgcccataagaataaatatgtgggggtacattgtgaaactcacacgatccaaaacatgagtaattactattaccaatatcttaaggtttcttcctacttcctggaacacagagtgaaattatatgaaatagtcatgtctgatcaagcatgcatatttggttccatccatctaattgatcattttatatgtattaaacaccattctaagtaaatcacaaatctccttgctctgaaataattcagaaatgaacaacacagtatctctgccatgatataccttttaatttaatggagacactcatctcttaaggtaccaatgttgtgttcatacactcttttataaggaatgattcaataattttgctctaaagttagacaggtctaggattctaatcccatccctactctactttatacggttatgccattttaaacaaataactttatttttctaagtcttattatccttacaggtaatatgcactcaaatagtacttaattcagagggttgttgtgaatattacgtgaaatcatgcatgcaaaacatctagcatatttcctgtcttgtaatatgtatgcaatacataaatatccacaatttttctttggtcttttccttaccataatctttatgtgtctccccctaaaaaagagcaaagcaacaactgataaggacctggcctgctactatctttcaggctttggtgttgctaccaactggcctggctctcacagctgattcttgctattctcctgttgaacataaaccatttcatggaatatcaatatcagacaaggtcaatctttgaccatgatagatctagatacaaacaagatcactccctaatcatgtctgagaatagacaaaaacataataacattgtcaaaacccacaaatgaccaagcatcccccaacttagttaatgtgtaattgttacttctataccaattacagttttacctcactctgcctttcttccttctgaataagattacagtaccaaatggcagagttatcttcactttctggaagcatctaatccagagcaaagccacacttccttacactttcccccaaagcacttcacacaagcccaaatcctataatattaataaatcctatcactcccttactaaagtccccatagttccccgatggcttgtgttctcctacgctgcagtgaacactaaactcaacttctttgactggtggtcgtcttcagctggagtgcactgacactctaacacacctgtcatctgtgttgtctccacatgtcattattttgagatggagtctcactctgtcgcccagactggaatgcaatagcgcaatctttgctcactgcaatatctgcctcccaggttcaagagattctcctgccccaccctctcgagtagctgggattacaggcgcgtgccaccacacccagatgatttctgtatttttagtagagatggagtttcaccatgttggccaggctggtctcgaactcctgacctcaggtgatctgcccgccacggcctcccaaagtgctgggattacaggcatgagccaccatgtccggcctatttttcttttctgctgagttaatcttccagtctactctggcttccttttcctgtcaacactcctttcatgtttcagatactcaataaatgatttttgaaggaatgaatgttccctttctgtatttctactttttatctttttctttatgatagctccagtccacacaagcttcaggaaaataattggctcaccactctatcagacattgagcagggaattgcatagcatcaagctttttgacactggagtctctcaaaactttggcaggactaatctagaaaaataataatttcaaataagtgttatgcagtgaaagaacacaaaaaggctactgagaatttttaaccatgtataaggaagtaaaagtgtgcatttaggtttacttatatttttgataataaaatttgaggtttatattttttagtcttttaaaaatatctggttgagctcacttattattttaatttcacttagcactgtggctttgcatttctttaatcttttgcagttttcactgggagatttttaggctataaacacacacgtgcaattaactgggttgaaaacatacaccataaaatcaaaccaaacttagaaaataagtttggttaatttttgtaccctaagtgtccatttaaagtttcactggaaattaacccttatgtgagcaattttgtagccctctgtcaaataggttttttttttcttttattcatttacttaacatggactcacttagaattcaagcaacttttagaactgacacatgcgatgtggaagcgtaccatgtattttactgtttctctgctgctctcaagtcattctcaagaattttagttaatttcttctccatgaatattttttagtgacttggtttggaattcctgagatttggcatttcaatgtgctggattaccgaggaacatcagctcaaatgcaaacttaggagttagttttaaactggtctgaaattctcacatgttctaaaataaaaatgaagtggatagatgccttatgattcccttgggttaagagtgtccataatcagtgtcttaccttaatggaaaatatctgatttatccctgagatagatgactgcatatagtatatcttcaaataagaagaggtagatgaacagaacttcttaattggctcctacatgcatcccattatggaaggtctgcttttgattctaaggtcaggcctcttacttccagattcatcaagcaacttgggtgacttttcaggaaattctcagccatggcaggaagatataacttatgatttttatgattaaatatttatatagtaccaaagacatgtgggcagcaggtcaagtgttatctacaaggcttagattgaaagacggctgagagccttagggcttctctgatgatgagtgcacaaggagacacaatatcatcccctaggtaaaaaaaagaaagaggagagaatgactagttgcacctagggtattttgtaatatatatataactaagttgattccttaaggaagggctctatactattcgtgtattattgctgggataaagatttattttagaaaacatggaagaactttaagcacattctcttattcagggtcctagtataaacttctgttatgtaaaatacctgttagatgccttaagtaaaatctctaatgcaattgctgtcccgtatgccctatggtacacaccagagtccttaaccagaaaactcaaagtctgtaaaatgcatctctactggtagaattcacatgcagtgatttgctgctatgaagcgctaatgagaggaatgaaaataagaccagactaaatataaatggtgagaactgataaaagtgttataaaggaaaccaagatcaatttaaacctagagaaagttttagccacagatcaccatatttggaaagatgaatataaataggttaaatagaattttaaatatatttcagaaatatgcctagagtcacagagcatttaaaatatacaagtcaatttcctaaataaaggtaaagtaaattcaaatttaagtttcaaaaatgattttattagaaacacgctaaagtaatttatatataaattataaacatcatatatatatatagctgaaatcttatttacaaaaaagtatggccctgctgtgattactggacttggcattagagaatttgctttctgattctagctctcctacttcctagcagtgtggtttagcaagtctttgaaacttagtttctgattgtaaattggcaatgcctatttacctacataaagttgttattggtccagtggtggccacaagatctgaaatgttaatcaaatcaaaggggcagactagtcagggcatggttgaaggctaatgttgactcccactgtctgttagcgaggaaataagttgcctctgctcctactgggagccatttggtgaccatgagcaagccagcttggcaaacaaacaaaaacaaaacaaaaccatgaagaggagtttagaaagcagaaatcagaaaatttgagcaaaaatcctgatatcctacaatgagagtctttctggcctttggactttttgttatgtgagatgaaacacattcctttcatttaacccaatttgaatgtgatctgttttatttctaacatcttcttacatttctacaaagagcacttcaggaaaattcttctctcttctttatctgaatcatgtaggtattaaatttctatgagtgaaaacagtttacacttgttggcttcacctatgagcaatatattttgttgatattttacacatgtaatcttatttaatcctacaaccctctcactttatagattaaggacccaacactcagagaataaagcaatttgcctaaggtaacacaggattccaaccaagactgtctgttgcagatttcattgattttttcattacgccactcagcaaaacaattgtaaatccttgtggaagattccctggttggcagagatctgctaaaagtggattccttaagaggtatcaagaaataccctggataatcaacaatgcttttgcagtgaataaatgtgatgggggagttcctttatctttctaaccaaaaactgcaaaaacctttagaacaaagaaattattaaagcttacacaaaaccatcattgattacatttccccatgtggttttcctctctattgtagaaatcctttcctaattcaaaagaagctattattaaaaagctaatctcttcttatatgaagcacagtgtatgctgcaaatatcttaaattctgttctaaacaccgttttactgaagggttagaatagcaggactattatcaagtcataagagaaaagaatagacacctctgaataaatatatggaaaatcttatcatgaaaagtggtttatttgactacaaacactgacatcttcagaaaagcttttttctttttttgtaagcaacatacaaaattgctggaaactgccatatacatgtcaggagcaagaagaaaactaaaataaatgttggaaacaggcagcattaaaaaacaatgctgacttaagtagaaggaaacaggaagttaagaaatataaataaactcttgtgtttgcattttggtggcaaggtctttcctatttttctcgattgaagaaaactgtggaatgcttatttggacaactaatatttggcaaaggtgagtgcagcaaaatttaaatcaataattctgttgataccaagtttattttgatcagtcttcctaagaacaatgtaaatgttaactagtatgtctttaataaggcaataggataggataggacatacatggggaatagagtactatattatagacttggtgattaaaaaaaaacattgatttcctattacagggttaggatcaggctcaaacattgaacttttctaagccacttaagttttaaatatcttactgataaaaataattaacaaatgtcttacaatattctcaatgcatttaaaaggtaaaaataatgttttgttgattgcaaaatctatacaaaataattctcattaatttaaataaactgattatttgggatgagggactaattttgatgtgataattatagcacagtcattaactcattttaatgatagttgccaaatgtttaccatgcagaaagcctacaactggaagctgtggagcacagcaaaaagcccatagtgaagtgtgatcattaccctcaagaaacatttaggaaatgaaacactaataactattttagaaagaggagagagtgttgaatacactaataaagatggacacgaacttttggtggagttcagtgcaagaagtgcttgtttcaaccggaagataagaaaagccttgatggaaaagatgccatttggatggactttggatagtgtgttgggtagcacacacagaggtggagaacatgactgagtcgagtccagtgtttggaaagcctagacagtttgtcagcagtagtaacaacgattaatgaatctcttcattctactaaatttgcactctattataacacaaatcttattgtcagatctattgcagtcttacctttctacagattaacccgaagtccctatgcaagatggttaaaaatttactgaatacttctctttaatatcctgatatgtttatgacattttaattttcttttggacatttttcttatcaagtaggagacattaaagctgtccctgacagctgttttccagtattctactattgttggattgaaaatttttcattttcaaaatgtcccaaagaaaactgtcacaagttattagatccagatgttgaagaggccacattacatcagatgcaagcttgatcaacagtctcctaacccttttatcaggatcttctctagttgggggatggggggtgtagtggtacattattagttgttgccttgaaacttctgtcttgcagttgtgaattagcagtatgaatgacatttgtattgagaaaatatgttcctaccaaatgatcttctgaactgctgcacatgtaacctgaggacatgctcagttagcactgaacacaactgttcagttatggggactttatagccactttgctcttgatctttgaagcttggctttcttatttcatttacttaagagtgcttttctaactgttctttagtccgcctcttaaatgttgttgtttcttcaggtcactgtctttagacatgttctcttccaatgtctgaatagtctcatgcactcctaatacatcacctttgttatccccattgattctcacatcaaccgtctttatccctttcttgagctctaaacatctattcccagctgcctatttgccatgtcaatctagaaacaatattttagatacaagtttaaacttcaaaacaaattctgaaaagtcagtcagctacttgggaggctgaggcaggagaatcacttgaacctgggaggcggaggttgcagcgagccgagatcgcaccattataccccagcctgagtgacaagagcgagactccatcagacacacacacacacacaaacacacacacacacaatcagatatacttttcccccttttatctgaaatttagaaagcctaggtgatggagtcagggccacaaaactggcatatagtagagcttggactttattccattttaaaaccttacccattgaattgcatgtttttgttatgctttaccacatatcccataggaatctcagtctgtttttcacatcatcatctatcaattctctcaaattagaaaatttaaaatcacttcttcctctccctctataagtcattaactctgtccctgaggtatcattttaatcttctatcagtcccactgttacagttcgggttcttattgcatcttttcaggaagccatcctaccatttttcctattcccaagattttcctccccttgatccattctctccatctctgccacagtcatatttcccaaaaagttcaaattggattagaggcaattttgattttcttctttatgtgtttttgcagtttctgatgtagcaagcgggtattttatggactcagacaaacaatacatgctttatagcaaagaaaaaggtcttaggaaatatgaaattcttatgtagaaaatggctattttagagatgtgttatagaaaagctaatttgagtgtagagtatgagaagaattggagaaagaaaatcaagccatagactggctttttctgctcactgtactcttaaaatttacagtttaggtaaagataggcacaatatatctctgatttggggatcagattaaattgggaacactgagaattttgccctgagtgatccactgcctttctgggtcaacttagactaatactggctgcattactgctaaaattaatgctgtgcgccagggaacagatgtgaattcatcatgtgaattcaagaatagggacttctgatttctaatccagcctgatactctctttagctttggggaattgagttggtaaatctgctttgcagaaatgtagttagtaaatatgcacaggccttgtttcattagcgaatatgtctgatgcttccagtgactacatttctcactgcaaacaggtctctttatataaagttactaatttttttccttggagttttcttacttatcatcacaaaatcaagttcataaattaatggatgatgttaatctactattaaggagaccaagtcagctagtttaatccactcatgtttggataaagcctagctcagacactttacagagtttcctagcctctaagcattaccgggttctcaacttttaaaggaacactcacgagtcctttgcttccaactatagagtactctatataactctggcttaattttggaaggctcacagatgaaatgtttacattgcatttatgtaagatatttaaaacaaatattaaaccagtcaattcaatgatggttttaaattgatggtcctgttaaatgcaactgaaaagaacataaatagtgaatagattttgctctgtacagccttgtaaaaatagcttttgacacagatttacttgaaattgtgctaatattatattgtatattaaaaatgaccaaaagaaacctatcagaaccatttataaatgtctcaaattattatcattattatcacaaaacaatatgcagaactaagaatttcagagttcataagacaacttattgttcctggagttaggatacacttcctcaagtatctgcggcattaaagaaaaggtgaagtgtgtgactattgaagaatgcaaattaattcatagtagctttgcagatctctaggggtggcaatttaatctaatgggaatttaatagctcatattaaacacattactaatctgatgctttgcttacagtaatttagaaacagtgaaataataaatcacttatttaaaaaaaatcttctggaatttgaatcttttcttaactaagaaacagcaggtaggaagaatccttgttgttttcaagtgaattcccatcaagttttgtattcatgttgaaacattaagtaaacacatttaattcagacaacttaaaccagtgtcttttgtctaatcatataatactgtaaatatgaactaagtacttcaccagttcacatttaactacacattggcttccacttcatattcttgatgagcagggagcatgatcatgtatatctaattataaacacatggtaatgcgttgcttaggtttcatgctcaattacttctagataataataataatatagatccaaaagaaaccataaaagtatgccaaaattcaaaacgttttcccatagaaacttgaaaaacaaagcatcattaagacagtcttctttctttgcattatctaaaatgacattgagcaaagttttcttagcactaagcatacattttatatcttttttgtggcttttagtttttatcattttgcttatactcagatatttctgtatgctgtaattgccaagtcaatacagtataactatctatttatccattcttttactcattcacccatttataaaaaatatgtagaatgcctactttattccaggtactgccctagaagattgtacatgcagcagttaacttaataatgtcatcccctcatggttagtctcaggtggaagaaggacgcaatgacacaattaacaaatcattatttcagtttgtcattaagtgacttgaaggggagagcatgatactgggatgtagtgagtatagcagagggtggggttattttatcttgggttttaagagaaggcttaagtgacataattgttgtcattacaagcacagagaagaaaatgaggaagtaagttatggagataattgggggaagagtattctagatagcttttagagcattctagaggttggcaaattagaaggcttgtgcctagaacaagaggagtttgctcaaagaacaaggtgaccagtgttgctggggctgagtgagtgatagggaagggagtggaagctgaggtcagagaagtaatgatggagggtggtgggagatgacatacagctttatagaccattcaaaagacattcagttttacaagaggaggaccattggagggttgtgcgtaaaggcatgacatgatgtaacatgttttttaaagaacacactggcaattatgtgaaaactatactggagtgagagttgggggaggcaagagaaatcagttaggagggttgtgatggttaatattgagtgtcaacttgattggactgaaggatgcaaagtattgttcttgagtgtgtctgtgaggttgttgccaaaagagattaacatgtgagtcagtggactaggagaggcagactcaccctcaatgtgggtgggcaccatctaatcagctgccagccagtgtggctagaataaagcagacaaaagaagttggaaagagcagacttgctgagtcttcctgccttcatctgtcttttgtgttggatgcttcctggccttgaacatcagactccaagttctttagcttttggactcttggacttacaccagtgattttccactggcttttgggccttgggccacagactgaaggctgcactacttttgaggttttgggattcagactggcatcctttctcttcagcttgcagatggcctactgtgggacttcaccttgtgattgtgtgagtcaatactccttaataaactccctttcatatatacatctatcctattagttctgtccctctagagaaccctgactaatacaaagctattgtaataaaccaggtggaaaataatagggactcaaatcagagttgaagtgatggatttgaggagaagattctggatttattttgaaagtagagccagtaaaaattgctgatggagtccatgtggtgactgaaaaaaacaagaagtcaagtttgactcttaagctttttggtctcaaaaacctagaatgatggacttgctgtaactgagtagggggaatctaggagagaagagttggtgtgtggtgagaaagcagtagtttcattttgaacttttaattattagatatttaatagacaaccgcatggagacagggagtagatagttggacataagagcattaagttacacatagaattcggggtgcagatgttactttgagagatgtcagtaaatgaactgcctttatctaaaatacaaagagcttctaaaaatagaaaaaaaatcaatcatacaatagacaaatgagttagggaaacagttcaaagaaaaaaaagccaaataaaaatataaactaaagctattagactgacaaaactcccaaaatctgacaacatacaatgctggtcgagctttgtaaaaatcaactttgtggaaaaacgtgctctgtcttacattgctggtaggtatgaaaaatggtgcaattactacagaggataatttggcaacatctagccaaattaaatgtgcatttaccctttgacctagaaatgctaattccagtaatgtattgcaacaatatgctcgcaaaaatacttaacaatatttggtcaaagctgttaaatgtaagactatttgtcatagtaaaagagttgaaacaactcaaatttccatcaatggcaggttggttgaataaatcacggtgcatccatataatagagaaccatgactgcaaaaaggaatgagaaataactctatatacttccaagagcaatcttcgtagtatatcttttagtgaaaaaggaaaggaagagacaaatacatagtatgccattatttttctaagaaaaaaggtggtatggctattcatatatatctgctttttttttttttttttgagacagagcttcgctctctctcccagtctggagtgcagtggtgcgatctcactgcaagctccgcctcccgtgttcatgccattctcctgtctcagcctccggagtagctgggactacgggcacccgccaccacgcccggctaattttttgtagttttagtcgagacggggtttcaccgtgtaagccaggatggtctcgatctcctgaccttctgatctgcccgcctcggcctcccaaagtgctgggattacaggcgtgagccaccaagccccgccatctgcttgtatttttttaaaaaacaccttggaggacaaaccataaatctggtttttaaaagttgtttctaaagagaggtgagggtataggatacaaaataaataaatgaaagttaagatctatcttcacattttaattcatatggaggggataagataaatatttgatatgttccctttatttggtattttgctttgtagagtttactttgtgactatgttaatatttacatatttatcaaactaaatttaataatctttaaaattatcctcaagaatagaaaataaggggaacataccaagtgtttttcctatctgtcttaagtgaaccaattagtatttagggaaagtttctctatgtagaaagaaataaagaagatacgataaaattggaatatcattagtttgtagacactaatgaattaatgaatctaaaagttaagcatcaatggtctcaaactacaaagaagaaagaaacccagagacaatataactcttttttttttttctttgagatggagtctcgctctgtcgccaaagctggagtacagtggcgcgatcccggctcactgcaagctccacttcccgggttcacgccattctcttgcctcagcctcccgagtagctggaaccacaggcgcccgccaatatgcctggctaatttttttgtgcttttagtagagacagggtttcaccatgtttgccaggatggtctcgatctcctgacctcgtgatcggcccgccttggcctcccaaagtgctggaattacaggcttgagccaccgcgaccggctgacaatataactcctgaaagaatatactcccaccaatgatgtagtttcaagggggtaaagagatctgaatcttactaagcctctattcctaattagcaatttgtagaaaacggagaagatagaaatatatattaaaagacactattgttaagcaatgaacaaaattcagactgtgggtcaaacacctgtgtttcctcagtaaataaattgcaaagaataagaaagaaaaattagaggcagaacctagagatcagaagagggaaatatcaatcagcctcactgtgttgagttcatctggattcagatacaagtaatgtgttaaagacattataaggtaattgaaaattagagatggaccagtattttggtgcattaaagagttattgttaattaatgttgggtgtattaacggtattgtggcatattttttaaatcttagagatatctactgaaatatttgtgtatcaaatgatatgatgtctggaatttgcttcaaaatactactattttgtagaggatggttgaaatgagacaggactataaataaaccagactgttcatgagttgattattgttgaagtgggtgatggcctcagaaagaattcattatactattctgttgatttttataagtgtttaaaattttcaatagaaaatatttaaaaatatatatcctgtctcagattttaccttacttgcaattagtaagttagcctaccatggtttcatggatgctgacagaagatatgaaactcctgggtcagatacaaaggactttattactctcagcagagcaagcagtatgagctttagcatattttcattggttcctcctaaactcagatcccatggggtgatgcagaagggcccagatagatgattatcacgcagtagatttgtgtcctaagctaaggtagcacaaatcttttataatgagcctttccaacctttgccccagcggaaaatgttttcattattttactgaacagtaaaatacttgccctttgctccagagaaacaaacaatttctatcctccaaagctcctcacaaccttgaaaagtctggaaaagagagccagcatctctgctcactagatgtgcagaaatgcaaaagatccatagagaattatctccacaaataatgtattggctgtaactcttcaaaacgaatctgaaactcaagaattgggtattaaaatatatataacaggtgagtttcatccatatgtataataatattaagaatcactgcgttttccacatttggtttcaaaatttaacttgttcattccaaagatactttgggatttgaaaatttcttaatttgccatgaaacatttaaataatttattttaatgcctactcctttgttttcttgttttcatcaaaaaacataacttttgaactttattataaagttagttccacttttctccttccttgcttcttttgaatcatatttaaaacatctcttaccatttttttgcttgagaacacttgcaaatgtttctggaatttattttaatggacttggattattactttcatacaaatgacttgccacatgccacatgccacatacatgtgccacatgtatgccacatacaaatgacttgccacatcctaaacatctcctttctctttggccaggaaacaaaggcaactattttttttgttgtgaacttactaattttgctccctggcacaaatgtatctttagtttcaatatgcacaagtggttaattttgtttccttttttttttctcttcaatagaaaccaggcttttaaaaatcatttcttataggttctattttcctatttcttaattattatttttatttttctgaaatttcttatttttcttcctctctttggaagttgagaataaagataaacatagttccttaataatgtttgcttaaagagcatttgtttttgtccttgcaaatatcaaggcaatacatgtgtgtgagtgtgtgtgtgtgtgtatgtttgtgttggagtacattctggcatttttttccacagtcatatgtaagccacacatacagacccatctatgtctcttttcatatttacttataaaggtctgtattgcctggtatttaatcatacagactctgaagctcaattgtgttaactcaaacatagcctaattatttactggctctgagacctcagccatattaccttttgtaaaacctcagtatactcatctttaaaatgagagtgataataggtcttgtgtcctaagtttctcattaggaatataggaattaatgtttgtaaagcaattagaagagtgttgggcatattttttaagtactgtataaatattagctttcatcactggttttccttccttccttctttctttccttccttcctctcccccagtgtgcgcacgcacacacacacacacacacacacacacacacacacacacacacaagagctaaggtttcttctcaatgatattaagaagttaaattacaagacctttaagctacaaaatatttgacatataccaaagagccttaataattagattcttaataaacaattacatgtaacatgtttaagagaataacaataaccatcaaatttttggtattgactttgtcaaaggctctttgttgtgctttgcacatattatgtcatttaatcctcataaatagcctaagaaactggtactattttttttttttcattttgaaattaaagaactttattttcagccaggctgagtaacttagcccaggttacacaactgtttcagtgttgcagccagccaagatttgaaaccagttctagaaaattttaatatctgcactctttttagtgatctatgctgtctccccaagtttaatgaacataaaattttagaagcaaacatttttgtttcttgaatatactcgtcaattctgattctttataagaacaatagcatcaaaactggattttgcctggaaacagaataattatttcagtgttttgtatgggcaatacccaccactgagagggataaagatgtttgtattttatgatatccatcactattcattggtgaattccatgttcttaggtaatgtttttcattgtttaaaatattctattagcacatttgaaaacagatttaaatttgacaacagccttaaattattgccataagactaaggaaaataacaataatatcactaatacacatcaaatgtctcctgccacccctaggcctctgtgatttttccctatgctgaaacagttcttttaagctagcttttagtgtcttccagctactctctacacattcctattgttgcctcctcactatttagtcagtctgtttataacttgtgattttaacgctattaattgtatattactgcaaaaacactttggtcaaatccattgagcagccaagaaaattaacttgttttaactgctagcttattgcattttaaaaataccctacacagccagtcaatagaaagctgggagaaaaacagaagaaggagcaagaaacccggcatgttgagatagaagtattttgcacatacagccaaggccattcacagatttaatgagtatgttttgattatcatttaaggaactaatacagatatgggttattggactcaagacgattcctactgagagaacagttggtgtgtcactcttgtgtgacacatttcaaccattacatagtttctattttgcaatgtgtgaggtgaaaaaaacaagggattaggagttagatctgggtttccttctatagtatgtgacttgaggtcatttgaactcccgtgcctttggtttatcactgtaacttatggaattagcctagagttctctaagattctatagattctaactcctataactgtgacctgtttttttaggtcaggttaagagtaagatggtgattaaaattttaattataacatgattacttattaaatgaagttgaaacgatgcacatcaaatcccaaaataggctcttatgtgaaagttctaactcgtagcttctcaaggtgctcttatataccactatattcagtggtttcagattctgtttcaagatcttgttgcagagaattgactttacatctctttagctgaactcattaactgagaggcgtaaatgctttaaagtatcattaagttagaagagttgggagtgttgggggactttgagaagacttgtggtttggggacaacaggaaaggtttttccatttgatgcatagacatcaacgaaagtttacacaaaacacagtgttactctgttattcgtgcacagttattggtatgtgaaagtattctttgctaaatgcaatacattgtaattaaataaaatcacttcatttaaaaccgcacttgaaaaatcaaatgccctgttttcctggttttttgtttgtttgtttgtttgttttgataataggcaaccattggttaggtctgcctcatttgggaatcggttatatttattacaattttataaaggtataaattttagtcactttgtattcaaatatacagacacattatgcaaaaggcacagttagcatcaaacagtgtccctgaataataagttcacattcacatgagacactttcatgtgagatgaaagtaaggtgctaaaggacactaaagaagagctgattattcatcccttcacagcattccttttgatcaaaatatttatctatcatctctctctctctgacaataaacaagcaggaaaaatgcaaccgattctgagggtctccttatcccttgttcagctttgttttttgtgtagtttttcttgtttgtacttttatttgctcacttttctagaatatcttcatcttcttttttttcttactgggcatgataataagaatgatagcaaatatttggtggaacaacagataaatgtaaacatgttccagtgcttaacatccatcctccaacacccaaacaagatggtaaccatggaagaattctcattcccaaaccaacagagtgttgtctgccccctactaactaaggagaagtgcaaagtatccgggacatttgttgatggacatcaggcctgctccagctgtcaaaaacacagctgttgcgtttccctctgagtgatcagtgctccagatgccctccagctagtgtgttccccgatatggtccagtggaaagctgaaaaagagctgaacacttggcttctaatagcaaatgcaaaaacaaatttcacaacaaattgcattttcagcattgcctgatgccatacgattaaacaggctgaatttgttttagtccactaactcggaagacatcatgatggaacagtttctcttggtgactgttaaacgttaaagcagttaagggaggaggatttttttttttttttaacttctactacaaagcagggggtgggagagggaaagctgatcaaacttattagagcttctcaatgaggagaaagcaaataaggccatttaatgtctttaccagggtaaaactgacaatgagacctctctgtgacttttttgtacacatttgttttttaaacttttagagaagataaaaacgccaatatttttatctagcccttctaatgttcttcaaagctttttgcaaagatacattataaaaataatattcatacgtacatttacatagtgcctactgtgtggttggcactatataaatatattaactcatgtagttgtctcagcaagcctgtgtgatatgtactaacagtattacttttaacagatgaaggaattaaagcccagagatgttaagtaacgtaatcgagataacacagttgtacaatggaagaactagtatttgaacgagcccttctgggttcagagtctatgctcttaatcatgacattctgctgcctcttgaacacacactacttatatatttgttcaaatgcagtgctactgtttggcctactttcttggaacaatagttccagtgcaggatcagtttgatgattcatttgtgtgttaacaagttcaaactacaacctagcaaaattggtccatgtgcatttgtgaagaaacttcctttagaagtcatctgctggtgggaaatgtttaaagcctgctttcatgtgtctcttaattgactcagttgcagaagtcacgcctgagagtagtttaacccaggttatgcaatggagcagttacatacttgtacttgttcaccgggaaagttatggagctacaagagaactggatttgccactcagccacttactgaaaatttcttccctgagttctggagagaaaataaaaataccctgcctaccacacagaattgctataaaaatcaaatgtgataatttatatgaaaatatattacaaaatataaggattacaatgggtggaaatttccactgctccatgggctaagcagaatggggggagaaaagggaaagactgaggcctctgttttggcaggaatttcccctactgctgcaggaactgggcaccagattgtggagctgaggcacagtgaggtggagttgggacgaagggagcagctcctcagggggctgtacaacccaggaggttaatctaatacaactggattaaaccctgctttacaagtaacacatgtagctgttcatgactttcttcattccatcgtacattgattcattgattcactgtagaatgattcataaaatcctctatgtatcaagaattgtgctagggagtcagaacaccacaacagtaaaatagtacagtatttaccctgatggagtcaacagtctggtggaggagacagattagtaaatggacaagtactgtacactctgctagatgaggggcaagaaataccataaaccattttgtgacaccttctcctctgtgttgagtgtcacctgtataaacattggcagtacttgctgtgtggttcagaacacacaatctagtgtcagcctgcctgattggaattttgattccattccttactagctatgtgacactggtatagttaccaaccttctaagtctcagtttagtcaccttttaaatggggattataatagggactacctcacagagctgtaaaaattgcatatgcttttgtatgtaccttgacatacattttactcagtactgtacaatgcctggaatatagacacaacaaatattacctattaaaataaggatgccaatgctagatagtcaccagctcccaaatcctagccacttacctctctctacctcagttttctcctctatgatatggagctaattatactacttgcttcgcagggttacagaaaagaaatgggataaaatatgtaatcctgagcctaggaattttaaacttcaaatcctatgttgagccacccttctatatgccctttcttctttctcctccctctccagcctcaaagactaagcctgattaactacacagccgtcatcttccaggttcagagtgaagttagagtgaaagctcaaggcagctgagaataataaaaacaggactgggagaagttaaagctggaaattgtaggtgttcttataagtcttcagcttgggtctagaaagaccaagcttggtatcattcctctgttttgtgccttatctttctttttcttctgatttttattttagaatgaaacaaccctctcctctttattgaaataatattagggttattatagacattgatataacaaaatacttctttgtaaaatctataactgtgttaatataaaaataaataaccttaaaataatttaaaatggaacagttaaatgacttttggttaccaacatttattgttttttcttctgaattatttctattttttttctattatttcccacattgggcttcagagggcattagttctgcgggattttaaagagtagagggcaaaaaaattcaaagaaccaatatgtttaagaaatgccagtgttaacattttttttaatccttaagactagtcagacaacttatatgcaaatgagaactaagggcccctttagccaaagagattccactgggaggctgtagggctggcagtttaaaggccacttgttccctttgcaactctgtctcttcctaatgttggggatcctggataggcaagatgtttctcatctgtaaaatgtggatgataatagaacctactttataagggtcttgtataagaattaaatgagtatttgtagggtacttaagaagcctgcgtggcacctcataagtgttttatatgggctacaaatacataaaataagattcaatatttcccagagttgttactttaccaaatctctttttaaggcatatcactttgaactagtgttccttggaataaacctgagcaacactcaaattcattatgtcctcttctttgacacagcaattaccttagcacaaccagcatcctctcatctgggagtatattggctatgtcggatcctttatccattcaggactccatctacacagctatcttcctaagacacaaacttgagcatattattcccttccttaaaaagtttctctggtttctaagggcctgccagaataaagtccagacttcctttttatattgaaggcttttcaaaacttagccccaggcagtcttgacataaccttccttggatccatttctactctttaaaacctcatctccaccaaaatcccgcccagcattccaaattcctctttgcatttgtccagtattatcttgtccatatgttttctgataaagtatttcagaagcggcttcctttttgaagccttcttggtcccctgctctcttacataattaatacataaatttatttttatctatggcgtgcaatagttctgtcttcatgttgctaacaaagcatgttttccattgtatgacagttatgccgttcatgttcactctgtttgtttctgagccctctggggtccgaaaatagaacatataactatctgtttaaggaacacctgatcttcaggcttggaacacagcagcaaattaattaatgttgcattggactgaataaagaaaataaagcatctttgggaattgcttctttcgttttctaaccatactggctatcctcaatattctcctcacaatgtcaaacttctgtcttgttttggtttcaattttttctctttatatttttctaatcaagcctatgcaactcatagatccggattagataggccttgaatgttgcttgatgctcactttaccttctttctccctgtcacacttcatttttaaaagccatttcaatgttaaaacaagactagtggccattagatgaaaattttacggagtttaatcctgcacctctttttctcagtaacataaaagatttcagtctcattctgacaagaaaaataaaatgaaatgcctttccaatataaataggtctgacaattttaggtacagaaaggacactggtgtttttactcctctgtggaagccttctaagtgagacaaatgaaagctaagtcctttggtaacatatataataggacaggtaagactggtgagcactgtaactaaatctgggactgtaacatatataatgggacaggtaagactggtgagcactgcaactaaatctgggacttttgtgtgtggtagtgttatcagcattattcttctagtatgagaatacaagcaaagagcagcattctccactgtcatgaatgcccggccctcacagctgacgaggtaaaaaacactaccagacaatcacaccccacattctccagaggcaacactgcaacctccctggggcattgtcttggtattccttaaatataagaagccaaatagaccttttaactatgtctcatttgtgtagtccagctgttaagtagcaaaataaaaagcataagcatcaatgaatatactacaaggaaaggaaggggtactttggtacacaatttttccactaaacaaagtctcttttcacatcgtgtgtgccaattaaaatatattacattattacatatgcataagcttatgtgaaaatcctttttagatttcaatgtacagatatttaaatattggaaaaatagaattgttaaaattttctgggctgatatgaggcatttacaaacttttacagatttaaaaacactgtctgcaaagatttttagaaatacaaggtctctagatgtacagcttgacatagtacaattgattttgttttcagagactactctggttaaaaaataggattatatttcagggattgttttgttcaaaatatcaaatttcacagatgatttattccataatgataatgcatcttctgtgcttattaaattaaaaaaaaaaacattatagcaaggaatctaataccaaagacatgtccttaaacatttggctaaaagccaaattccttaaagtttaaagcagctgctcagtttgtatttaaagtcatagagatacattttaaattctttcccaataatacatattttttcactatagaataaccctgtttacattgaaacacacaatcaagcaaaggaaaactcttcgaatgtatcaagagcaatccctgtatcaacaccaaacttgattctctggtggaaggattagacattgagcacaagtaaacctttggaaacattttctgtggagtgaaggcagaaggtggatcagaattctaacctccaccctgagagttctacacatggcggacagtgaaaatctggcagctgcatgttcccagttttgcaattctctgcaggaaatgggcatctgccccaatttcagcaaaacattgggactatggtaaagggaagctttttgttcttcattagctcaatacaatttgcattctgtagtttttttcatccatttgatacggacttttcacagtgatatacaaactcatattgaaataaacggtatcataaaatactcttgaaaagcttagaacttgaaggacttaactgtttacttagagaagtttacttagagaaaaatgggagaaaatgctgtgaaccttttcctttaggtaactcaaattaaatatttggatgaaaataaatcattgaaggactacctaaactcatgcctgtgacatttttagagtattataataaatggacacattcaaataattattgtacatgttactaaaagcactatcttttagtgctctgcctatggggtaaccattctttactttcttaataaacttgcttttgctttttttttaaaagcactatctagaaggcttcatattgcaaaatgacaagtttttttgagtttagaggcagaaagcattactgataaatcttaccaaatgaaggccaatacactaactaagttagcccaaacatatttggtcttgataaccttgttttaatttgcctcctttgtgcattggggatatattctttgtaaaactgtttctgaaactttctaaaaataggtggattttaaaaagcaaggggatgctccatgatataatagcacatctttccataatgcaaatgaagtgctttgaatagacattagtatccattcatttgcatttcggggggttgaattcaaatattgatgtagttagtattcctacagcacagtcaactacatttgacatatactgtaaaatgtaatttgactatatgtaggaatgtgggtaacttaggcaaacctctatttcacaaaatcagtttgtccccacggccattttgtatttttataattcaaaagataatccttatagtcatgcaatataatagatccctccagcttttactgaagaggtactacaatttattttgctgacacttgcaggttgataacctggtgtatgagtaggaaagtagggggaggctaactgattggcagcagccaggatgcccacctccatattctgagaggtaaaagagccatgacaactgccttcagttctgtccctctccctggttgaaatatcgggtgtgaagacatggcagaggctgaggccatgaaatcaaccaggtacaacttttttcaagtatcggcctggaatttctactctaaggctttaagagattgcctcaacaatttgccttgttaacaggaataatgtagtaactaaggaaaattaaatgcattcattggcaaagtgagaaaagcatcatctttcttgctcagccaatcaatgatgatgcatgacatgatcaggatagaattcggagcaacaggagaaaacttgcttctggttacactggcttcctaatttggttaactttacttcctcaggtaaaatatgagaggaaagaaagcaaaagacaaaacaataacatctgtattagttggcttgggctgccacaacataatatcatagactgaatggcttaaaggacagaaatatattacctcacatgtctggaggctgggaagcctgagatcaaggtgctggctgattagatctctggagagggctctctttctggctcgcagacagtatcctctccttgtgtgctccatggcagagacagagagtgacctctctagtgtatattttcataaggaccccaatctgtaactatactcttatgaccttatttaaactgaactatctcctcaaaggccctatctccaaatacagttacattgggtgttggggttctagcatatacactttggaggaccagaattctgtccatagcaacaaccaaaacctgttagcaatctgtcacgtgtagcagaagaagacaaaggaatgatacaagattacggcatgatgttgcacaaacgctgtacctaaacaagaaatacagtcatcacttcagagcttattagaaatatagactctgaaaccccaccctagacctactgagtcacaatctgcattttaacaaaatcctgaagtgatctttatagacattaaagtttaaatcaatcaatgttataaaattcataataaaagcaagggttaattttgtccattgtgttggaaccttcttccacaactagaactgccaaatgtatccactgtaacaatattaatattcttaggaaaaacttacaaagtttattagtattatttttcttattgtaggcaaaagtaatctattaatttaatttaatagcttgaccttttgttactatagcctgtgatagaccactagattccttgcccagaaagtttagcaaacaacttccaggccttaacataaactgaaactttggttaattgtaccattagcttaaaacatgctattcatcttttacaagagttctgtgtttaaaaatggcattatttttgaaataaatagcactttaagctaggcatatttttctagaacacagggagtgcgacattacttataatggaattttcaattatgtagcatttcaaagcaactttaaaaaatttattccataatgtcaaaaatgtagagttatgcccacaaagcttaatattttggcatagttctagaaaagtgcttaataaatcaaaaaccctacttataactggcatttataggtccctaccatatattttcttaatattctgtctaaacacgaaaacagatgaaatatgcaaaagaatacaattatctttgccaatgagaaacaacagatacaccctattatcagtcttcaaactattagcattaggagatcactgaaaatatcaatagatgttgtttacagtttgaagtgaactgcgaataaaagtgacatattccccatgtaataatttttgaaaatttgaaggaatatattttaatgttaacatatattcttggttaattttacagtacaatattcaaatttatgccagaactcttaatggatgcctcatttaaaaaacaatgcagattaataatggatgacttgcataattattagctaaactgcaacaagtatacagtccatattactaaactatgactttttcttactgtaactatatttttggtttgtgtgttttaaatctgaactacaatggaaaggtataagaatttctacttatgagaaacataaagaaaactgtgatgtgataaagcactaatacagtattatagatccccagcttgtttataatatagctctaagtgggcagatatttttggaagggcccactgagtaactgaggaatagagctgtgtgggggaggtggcatcaacatgtcatcataatacttgaggggattgtacagcataaggcacaatgtctaatctctcagaagtgtgattatttcatgaaaaccacaccccactgagctgccttattgctgttataaaaaatctttattataggaagctcttttgtgctgtaagaagatgaattccacactttagaatgttaaacagcagtttcagcagagttctctagttcacacagattaatctacccctttggaatattcatgattcaatcagaatgctctctaagtcttggcaattttaccattgtaaaataaactaggtatattctgatgaaacagcctatgcctaacaaatgccttcattattttttttaaaagtattttatggattctgttactatcaaagaacatctctctatgaaagtagacatcattccactagagcaaattggtattattaaaaaacttggtacttgagaaaaacaggataaaaccaacacattatcaggcaaagtgcattgacaatgcaaatcaaatgcacgtggtttaattataattgagtattaactgaagaactgaggattataaatgatatgtctctggtgaagagttcggctgagtacattacatattcattagctttccatttttattccctaaatgtccagtcctttttcctatacacctggaattatgcttgcatggctgaaatgaatattttgaattcagaagaccatgtttatgtataaaaaggatatagaactaagtattgaatataacaaatgtatttctactaatctgcttactttcatctgattagaagatcatgttggttttgtacaaggccagaacattctataaagactactcaaagattaactttagaaggagtattggagatttcctcaagattcttacaaatgaggaagttgagagagagacaggcagctacagtcagtgactccctcagatcccacacagaactggtgatagactcaagagtaagaagcctaggcacatgactcctgctttagtgaagtttattttagataagtttcagataaaaatgtattgtgtttgctggatattatgtgtatggggagggagaaagggaaaggccatttcaggaaaattttcaattttaaataggtggttctcattgcgtaaacttcattttcaacacagttattcttatttggcatgttctttctaagactgcctctgatttggctccattattgaaatttaagtatggctttcatttataactttgaaagaagtgctgaaaatgggggataataaaatatctctgctctagtttagataatccaatagtctacagtgaaaattggaaaatttaaactaaagtcattattaatgattaaggtaaacgtattaattatggttatatttttatatctttatgacttacaacaacttaaactggcttacctagtttatttcatccattaatgacttttaaatgatatcacacttaaattttctaagtatgtgctaactgctttactatcttttctgaagaaagtacatcattgttttataacataatagttttctggactctgtaagatatgtcttaagctaagagttaatcatctttcacaataaaaagatacatgggattcaaattgatacatttgctaattgctgatgtctacatgttgtctatgaactgaaattgctcaaagaccttttccccaaaaaatcagtttgataatttgattgacttcctgttactttggtgaatactaacttgatccagtgaattggttaaactcatttatacacgtatactggcatctatggcaactcaaatccatagggaataattgttcctgttttgtcttttttctacaaagagttatgattaatataatgaaacttcttgataaaaagtacatagttttattaaaatattatcagacagcagaaggggaaggctgaactaagatggaactttccagaatcattgcaaatggtttctagagaaaaaaatttttttaaattatgtctatgattagctcatctgatccattaacatatgagcattaggtaaatatgtcataggtgacaaccagacagaaattacctgaacagtttcaataagacacactgaacaagccttaacatctttatcgaagaccaaccatcgtaagaaatatagagcacctcttacaaggaacactatataagaagatgaacatgattgatgaaaaattcctcacacctcggagaaaaacaactcatgctggttgctttatgccaaattccttgtgctacaaatctatctatgcagaacccacttcctcacacatcacccaatgctatcagtgtcttgaactaaacgtgggtgcttcctacaaagccctattgagacatcactagctgagaaacttaccttgagacataatctttttcatgtaaaggatagcgcatttaagaattctagactctggcctttgaacagtttcacaacaggaagatggaaaaagaagtcagcctggaggaaaagcaacagagaattttgcccaatagaacataaaatacagaacacaagaagaggagaaggggaaagaactagacagtttgaatagtgtctttagggtatttaggaaggtcataatatagtatcatattgatgcatctcattcagacttgccatgttaaagagtatgaatacctcctcttcttcacaagcccagacagcagcaggaactcctaatatattttttgttttcaggagcctgttactgaggaaaatttatggttccctcttctggaattctaggatcctattgcacataagaaaataataaatcaattgggtcaaatttatcagtatctaaaaatgaattgacgttacctctaccagatattatttgcacttaaaaggctgctttatatgagataggtaaagtgggggaagaatagtggtcattttagatggctaggtagctttactttgggaatcaaagatgccttcagggaaatctagtaggcagtggtctgtttctctgtgcaaagggcaagactggtgggacatgcttgctggcctcagatcaaagctattatttggatgaaaaatctaatatcaggggattaaagcaaattttacttttacttacaacctatttaataaagctatcttaatccctatctatctcagaagactcactttttccttactgttattattattgatgataccaaatcagtcaggatgataaaactcagcccagggaatttagtgggtagtgaagggtatgggcagaaggtgacaagtggagggagaggggtaattgaataaaaatggaggttaaaaatataaaaatgtgggaaagaggaaggaacattgtattgtttcaaggttttgtcttttatctacagtggagtaatgagatcttggatcttgggtaaacagttggaatgagccacagtttccttatcttaggagataagtactttgactatctcacagggttgctatgcagaacatttaaactataagctgcatgaaggtaacctctctaactattctggttatcattgtatctttcacttaacatggatatcatataataggtacttaacaaatgttgagtgaattaaagacatatttcacaatcatatgaagatatggtcattgactaatttgcattaagggctacaccagataataaatatatctaaattttgtttccaacatactaaaggaggactttaattcacaaccaaaaagatgatagatattgttagatacttctatttcatatttatatggctttttttctaaagtgcattatcataatttctgtttactcttataatactttggtgaaataggttaagaaagtaatatcaaaattttacaggaaaagaggcttacaaatgaggtgaagtaacttgatcaaagacatccccctttctaccatccccgaagtacaatcacggtcatatgttaagtttccttacatactggtgaagcccttgagtaatttttttccatttcttttttcatacacatcacaacccttctaagatcctagtttcatgtagtggagttagtagtattatttgcacggtatgggagaagaccgagattctttatttttctcctctaatgtgaaattacaacctcagcccctagcctggagaaaatatctccaggtctgaaatcccatcagctatctggccctggcttcctcctactgttttggcattttactttttgtgataactgtggcttaaaaacattatgtccacaatctctttgacactctctgacactcctccctataagagacaaaggcttgagtatgggctgaacttaggtacttgcttctaatgattagaataaagctcaagtaatcatgtatgacttggagaacaggccataaaaagatatcacaacttctttgtagttctttccttcttgaattacttatctgggggaagctagatcaccaataagcagcccacatggtaggaaactcaggcctccagcccacaggcagtgaagaacggacacatcctgcccatagccatgtgaatgagccatcttggaaatggatcctccagccctttccaaccctttagatgactgtagcccaagctgaaacttgattgcagcctaatgagggacccagagccagaaccatccagctaagctgttcttaaattcctggcccacagaaatgatgagataatattttggtggtaatttgttattcagtgatagatagataagtaatgccctatttttccaagcatttctgtttctgtagtgggagaatgcaggctgtctatatcatgtcagttggtcatgttagctgaaattgctgggcacagtagcccatacaataaaatgtacaaatatagatgaattacattttacatatatatgcctgtatttctaaggtatcacttgcttatattaaataattgctactcttataacccctgtgcttcaatgaagacattcattcttcatgcaggaatattcataagaattgaattcaattaaataggatgtggtcagctttctctcaaaatgtgttactgtagaaactcccagatggaataagaaatgttgaaaaaatttaaactcattctttttataaatacatcttattgaattattagattgcaaatacacatatgtgcacacatatgtgcatgtgtatttgcaaatcaatagttcaataatatgcacacatatatgcatgttgatatatgttgatatatacagtatatatacatatctgaatgtgtgtgatcatatatataattaatctactactgtatcttttttttctcatatggcaataaatacatggactttagggtaaacaggtttaaatctcattttgatgccttgctagttctatgaacttgaaaaaacttacttgatcactgtttctgttcctgcatttgtaaaatgaatgaaatcttacaatgtcatagagttactatggagattaaacgtcattatgtatttcaaatgcctagcgtaaagcctagtttaagaagcacacataaactattaatttcttttccttttcccttgtcttgccttcgttttttgtttcttatagttacttactcctacattacaaattgaaaaggcagaattctaataagcaggctccacaaacagtacttaaaaagtatgtgaagtgtagatagtttatgtatgtacattaccacaaatgtttttacagggagagcacaaaggcttatctataaaggtaagacttacatttaaccatatatactttctttcttttagaaataattttaatgtgggtcattaaggctagaagtgaaaagtttgtatgtgttgacctttttgtttccctgtaacattcatatctcacctaatttttccagtagaatgatatcacattttattgctatattcttggtctaaatatagacattttaaaaaattgataacattcaacttacaggtattatccttctattcttaaaagttatatttacttacattggaaaaagcagagtaatagtcctgtaactgataagatttggattgcaaacaagagtctttagttaagtaaaaaaaaattattggaaggctacaaggggcccagagaattaagacagataggaagaccatgtgagctgtggccaggaagaacagcaatgcctcatagaagaaagtctggccggcctgttcctgtgtgatgaataatctgtaatccttcattgcgcccttacccaagactcaaaaccacaaaaaagcatccaattggccaagcttagatcatgtgtcctctctagactgtacaaaaatgttgagagaaaacttatggctcctttgactattcaaatggctgacaaatactcgggtttactctcagaccaaaattatacatgatggaatgaaacaactccccaaaatcaaataagactatcttaggagagacaaagctgggctgacaaaaaaatacatttgtggaactagtattgtcttaactgactcttttcaagggaagagaaactacacgtgccaacaaggctatagaattgaagagcaggcatgatgagatatgagaaaacaaatttatcattgtgaacactgatacttcatatttggttaggaagactgatagttacattaaatacagaaattatacactttttaaattaaaatagagaaagaatagggagtgactagataatactagattcattgttgagatttattttcatttattaagatttatcttgtaatgaaaatctaattattacttaagtaatagcaatagattcatctagttttcatgttaaattaactcaatatggtataataaacagtgtatttggtctttgtcctctgttcccgactgataggagtgtattttgttattcataagcaaatcttttgatcacacttgagtttatgctaatgagacaatgggggtgggtgggtgcaggcctagataacttcagaatggggcggttcgacagaaagactgaatgattagaatgattctaaagaggaggtaggtaggagaaaagattaggctaactaaaatctcttcaacaaaatttgacgagcttccaggctggtgaacatatcaaaatgctgggagggtggcgtacccaggtaggatatgccccattcatctcttccatctggctgttcctgagtaaatataagtacagtgtttccctgagatctgtgagccattttagcacattatcacacctgagaatagggttgtagaaatccccaatttatagctagtccatcagaagtatgggaggcccaggcttgcaactgacatctggattgggttcagtgttgtgatactaagccttctaattggtacactctcaaactaactacatttagatgatgtcagaattggattgaatgctaggacacccagctgtttggtggagagttggagaattgcttggtacggaaaaactccacacagttgttgtcaggagtgttgcgcatatagagaaacagtgtttctccagactaagagatgctataatcaattggctgaaaataagaggataaatctgtatcttttcttttaaaaaagactaacctgagagattttgcctgagattactatcttttgttggataacctaattaaaaacaacccactgccaaacaattaattctggaagctaagaaaaacagatttttatcgctttatagtgtgcagtccagaacgtgaatacttcaaatagccaatctcacacttgcttaatctaccaagtgagctgaaacttgaaagttcttatctccttgattcttatctgtgtatgtctgtcggggggaggggggaatgggtgttctaacaagttaggaacagagttaaaatgcccgattttcatgttgttttggtaacaggcttatatctgcactgtctgctactattggtgagaaaattagtttttaaaagatagtctcagtacagttgttcattagttagacttaaaaaacagacacagaattccatcctttgtacccaagaaaacattttaatgactgggaattaaatttatctaaattggcattcttaactctttggctggaaaagccaaattagaaatacaatactctcttgcaaataagtaattagagtatattattgactgtgttgtagatttcagatataatcaggaattttacaagtggaaatcctggaactgatataataaatggaagaattaaagggtttaacaaagtttcattttgtgttgatacccaaattggacaattgagtaccattaaagtagtaagactatctaaatgctacccagcatttttgaaactacctaattttccaacaaataatactctctgcactatatataattaggtatatgccaaagtcagctttgttttgctattcctgaatgccatttttgttacttgtaatctctattaagtatatagaacagtaacacacttgagatttaaatgaatatctaagaaatgcttcctttttctttttttttaattatactttaagttatagggtacatgtgcacaacgtacaggtttgttacataggtatacatgtgccatgttggtttgctgcacccgtcaactcatcatttacattacgtattttccctaatgttaaatacttcctttttctgataatcaggcatttcttctcttttgtttgatctctgtttctgtcactctccatccaggaaactggtggcatagaatacaatgggactgtccaaaggtgcatctccactttttgtaatttcacactctttatgattctatttcacacttcttaaaacatggtactatccctacagtgtcactattcacttgtatgttattgtgcaggggaacaaaagttgctgtgtagaataaataagttgagatcctttagtatgctgagttgacaaaactaaattctttagcacttgtagtgcattatgcccatcattacctttaaactactgaaaggaggtttagaagagttgcataagatcaactactaaggatcagcttgtggaaaatcaacaattgtccctgcactacattattacatgctgtgagaactattgagaactggaatactaaagtactaaagaactatcaatctgttgttgctatgcaccatcattataaaacatttccatttcagctagtcatattcaattagctaatatgtaaattgaattcaattttattaaggtataagcaattcacaataatgaagcttacaagtacacgattccatcaattgttaaaagatcattgcatggtaaaatataaacatttcactgttatgaaatttattctggaagtaataaaaataccagttctttttgaatcaatataaataatagaaatgcaagccaaggaattgcattttttataagtttgactgttttcacactgtcttttgtttagttttatatatttatttattattaatctaattagatcaatctgctagggctcatgaaacaatactccaaagtatggcactatgacatgtttagtactttgaactaaaggacattggaaagcctcagaagtagcctcagacccacgatccctctgaccttctgacattcttcttgaagcaagtcacagaaaccaaaatttctcttcctcaaggccagtcataaaaactagaaccccttttccacaaatccagctataaacctagaaaaatactactctaaccctccttgttcttctatataggagatgggtgtaaggaaattctctaacccaaccttgtccaataatagctcttaagacccttataccagaaggggccctactcagtccctgggaataaggaatgatgcacagaggctgtattagtttgttcccatgctgctatgaagaaataccagagactgggtaatttataaagaaaagaggtttaattgactcccagttccacaaagctggcgaggcctcaggaaactcacagtcatggcagaaggcacctcttctgagggtggcaggggagagaatgagtgccaagcaaacggggaaaatcttcttaccaaaccatcagatttcgtgagatctcactatcatgagaacaatatgggggtaactgcccccaagattcaattacctcccaacaggtcccttccacaacatgtggaaattatgggaactacaattcaagatgagatttgggtggtgacaccgagccaaaccatatcattctgccccgggccactccctaatctcatgttcttacatttcaaaacacaatcatgccttcccaacagtcctccaaagtgttagctcattccagcattaacccaaaagtccaagttcaaagtctcatctgagataaggcaagtctcttctgcctattagcctgtaaaatcaaaagcaagttagttacttcctatatacaattagggtacatgcattgggtaaatacacccattccaaatgggagaaatagaccaaaaaaaggggctataggccccatgcaagtctgaaatccaatagggaagtcattaaaccttaaagttccaaaatgatctccttaacgccatgtctcacatccagttcatgctgatgcatgacgtgggctcccacggccttgtgtagttctgcccctgtggctttgtagggtatagtcactctcctggctgcttttatgggctggcattgaatgtctacagcttttccaggtacataatgcaagctgtcagtggatctagcatcctggggtctggaggatgatggccctttttttcaaagctccactaggtagtgccccggtggggactctgtgtgggggctccaaccccacatttcccttctgcactgccctagcagaggttctccatgagggctcagcccctgcagcaaacttctgcctggacatccaggcatttccatacatgatctgaaatctaggtggaggttccccaaactctattcttaacttctgtgcacctgcaggcccaacactacaggtaagctgcaaggcttgggacttgcatcatctgaagccatgtcccatgctataccttggccccttttagctacagctggagctgaagcaactggggcacagggcaccatgtcctgaggatgcatagagtgggcgggccctgggcccagcccatgaaaccattttttcctcctaggcttccaggtctgtggacagggactgctgtgaaggtctttaacatgccctggagacattttccccattgtcttggtgattaacatttggttcctcatacttatgcaaatttctgctgcatgcttgaatttctccccagaaaattgttttcttcttttctatgacatcacccggctgcaaattttccaaacttttatgctttgctttctcttgaacactttgtcacttagaaatttcttctgccagataccctaaatcaactctctcaagttcaaagttccacagatgtaaaggacaggggcaaaatgccttcagtctctttgctaaaggatagcaagaatcacctttattcagttcccaaaaagttcctcatctccatctgagaccacctcagcctggacttcattgtccataccactatcagcatttcgctaaaagccattcaacaagtctctaggaagttccagactttcctacatcttcctttcttcttctgagcccttcaaattgttccaacctctgactgttacccatttccaaagttgctctcacatttttgcgtatctttacagcaatgccccactacctcagtaccaatttattgtattagttcattttcaaatgctatgaagaaatacctgagactgggtaatttataaagaaaagaggtttaattgactcacagttccacatggctggggaggcctcaggaaacttataatcatggcagaagtcaccacttctcagggtggcgggagacagaatgagtgccaagcaatgggggaaaagccccttataaaaccatcatatcttatgcaaacccagtcactactgtcatgagaacaacatgggggtaatcagctccatgattcaattacttcccacttggtccctcccatgacaaatgtggattatgggaactacgattcaagatgagatttgggtggggacacagctacaccatatcagaggccaagaagagtttccactgatgggggctttctggattattaccctttgtccaattgcactcctacatggctgtccactcttcatggaatgtaagcataaagtggacagtttttctttgtgtctttcagccttcattctgaaggctctcatgttatgttcttctcctcttgtcttttgttataggggagtcagccttatgaggggtgagaaaaggtatcaccccatttttgcccctactgtttctggtgtccaataagggacacctgagacacctgactcactttggaacatactggtgttattctcagacaaccaacaaaaagccagataaaaaaggtcagaatttttatcaatgtcagctgtcccagatttctgcctccagaatcttgtcaagaatgtaaagtaaaaatttgtttgttccttcctttccaaattcagattaacatgaaaaaatcatttgtataaatttgctcttagattcagtaactctggtgactttttttttgttgttgttgtttggccatgatattctaaacatggaaagttaccttgcatgtctccatgaacttattagtctgagtcaattctaaacaataaggggttatatttaaaaagagcaaaattggccaggtgcggtgtctcatgcctgtaatcccagcactttgggaggctgaggcaggtggatcacctgaggtcaggagttcaagaccagcctggccaacatggtgaaaccctgcctctaccaaaaatacaaaaaagtagctgggcacctgtaaccccagctacccaggaggctgaggcaggagaattgcttgaatccaggaggtggaggctgcagtgagccgagactgtgccattgcactccagcctgggcaacaagaacaaaaccccatcccaaaataaataaataaatacacaaataaggaacaaaattatttgagagagctctcatcccaaacaactatatttctgatacctatgggaaaatcaaatttaaaaatggacacaaaggagtataaaagctagccttagatactcctttaataagattaaaaagcagaaattagattagaaacaaagttaaaattcaaatccacccataaattctcctctctgccctcttatactctctcaacttcctgggagtccctgacactccagatcttttgcatttctggtccccagatttaaaattccctttttctaaatctagctccatttccttagtacattcctttagctaaagaatgaattatttgtttgaattcatttgaattatgacttttggttttgggtgtcaattcatttgtggtccttccccttccatgaacagcctttgttttcccatttgtcacatttttaacactccgtctattggggcattttgattatttgggctttgtgtgcaggcagccaaccataaggttgggaccccaaagaaaatggccagagagaaatgtgtgttaagccccactgtggctaagcaaattgactaccgccagctctcaatgtgttgtctaagcttttctaactctggctgtcatttggagtgctctggatcttgaaaaggctgcacctttttgcttcctctttggaaaccttagttaagcctcaaaaggcttattagtttttgtctggaattacttgtcagatataactttggttcttatttgtttgactttctctactaagctaaaatggaactgtatactcagaaggaaaaagaaacaatttattaaaacatcacaaacactaacaattctaaatatagagcacagaaatcttttgatttccttcttagttggaaacctgattcctgataggaaggagcaaacaaatgataatacaattggatagatgggtgagcccctcaatagcattcaggctgcaaattaattattgaggaattaaaaacaactaaccttacctgggcatgatggcacacacttgtaatcccagtactttgggaggccaaggcaggaggatcactggagcccaggaatttaaggctgcagttagctatgatcatgccactgtactctagcctgggtgacagagtgagaccctatctttacaacaacaccaccaccacccaacaactatccttatctcaaaaactgagtatttaaaaaaccgacatgtgccctgaacttaaaaaagaaagaaaagtttgggtagtaattaccctagaccaccaatatgcaaatatcttcccttcccccaaagccaggaatatttgctgttttgttggttgaaatctgacaagagatttgcaataatttttttttaagagctccatggtccaaagctgacttaatggaaagctgatcttcagactataaatttttgtaggcctctctcttctgtctatttgatcctgcatctcctgtgagaacttcttagtcaactaaaacccattttttcaaatccctgctatctatatgttcagtccctctgtcagcttcttttcttgttgccatgatttttgatgaggttaacagggcacttcattgacctttttgagaaacttaaaatctcctcaaattagctcctctaagaactgttccttccatttacttctgttcctccttctgccttttgtcacctttgattttctgtccagtttccttaaatccttgatatgttccccttcaagtccctttctcctccatttggtgaagagtagatacaagattactaataggaagcatcagcgttctggcagccacatgaagggacctgaaggagacatcctgtgacactaaaacctcttgaggaatccaggaaaggcactattgaccccctttgggaggcctctgtcttctgcatgtagccctgagagtcatgaataagtttctctcaggtctgaagctctgctgtgttttgcattgcctaatctctttggctttgaggataccaagggttagttactgcagtgtgaaggcacttgacctttgggtttgcagtggctgacaagtcactgacaagagatgcagttttaaaagtaactgacagcagttcattaagtaattattgctgcaggggatacagactccactttttggagttataggtgtctgggttttaaccctttgtctctttttcttgtgtacttaagtgaggaaggcctcgggcatctgattcggtcagagagaaactggaaaatcattggttaagttagctaaagggatcttagagtcaaagtcttgactggaggacacagttcaggcacttaagagctagtagcatgctcaccactgaaaaatatgacttccattttagaataagctgggcatagaatgggctagttgacattaggtcacccaccagcttcaataaaatgtccatgcaatgaggtatattctaaaacaattacacaacctaagcttgtggcattttactcttatgcttttatcttcattttgagagacccaagattaaacaaaagcaaaactgaaaatccacgtatctgattaaattggtctccaaaatataactttctgatattcagccccttattttgaataagcttcttaattttatcctaggaccctctgcgtacttccctataccattccaagtggtctttggaaacattcagacagccacggtgtgtctttttcatcaccagtctaaaatctagcccacagcctccacaagattgagctctgataataggcaaatatgcctcaaactccttcttagaagaacttgcaatctccctgtgcccatgagatgtaaatctattaccctgtcttctctagaactatgcttatcttttatcttcactagaactatagataccttttggaaatacaaacttcagggagatgactgtctgaaaaaaaaaaaaaccacaagtattctgtcaaaaaggaaaagtagaaactaactcaaaggcttttggttcatgtgatatgagataatccttggtaaataaagataattttaaattttttggtcatataaaagtaggaatgtcttctgaattgtcagcatcaaatataatacaaacatttttgcctgggattgctggttagacaggtttaggttgtgtctcctaaatgttttaaggtcataaaatgataaatcgaacctaagagcagaaccaattacttggtatatattagtcatgagagcaagaaaaaaattacccttaacaatttattctgtgatatttttgatacttgcctgatttattggtggactgaagctatgggagtcagttgctgtgctctcctgaaatcttacacacatcttgctgtgagcttattttagtatgaagccctggattttgggatctgggcagatggccatggtacagcctgaagacatttgtgtatctatagcacctgggctgctagccaaagtgcagggtcaagcccaggatagtcctgtcctccctggcccagttgtgactcctggtgatccaggcattatcttcacagctgtctgacctctatcctttggcttgtgctctatccctggtatgtgggtcaaagatccagatgtgctctgccatttgcaggcacactgggcaccatctgattgctcaaaacccaggatgactagaggtgggaattgaggaccataactatgttcagagtctcagaggccttggttaagacaaggctagctaacacagatttggattggtttcaatttttcaaaagaaaaacatagattatgcttagcctgttttcatgacccattcaagcacaaatattaagaataagtaaattcaataagatataagtggaataaaagtttgtaagtaaacttttcaataatatttatgttttataaaagatatctacttaaaaatagtttcaaaaatatttttggtattctgaaactttaaagtgaaattaagtaatagttattaaatgtctgccttatttataagttaaaatactgacacattaattactagtcattggtttaaactatatatattttgacatcttgtttttataaggtatacagaaggtaaatatatttaagtctgtaaacaaacataaaaattctttctaggctggatgcaatggctcatgcctataatcccagcactttgggaggccgaggtgggcagatcatgaggtcaggagttcaagaccagcctggccagcatggtgaagccctgtctctactagaaatacaaaaattagctgggcatggtggcacgtgcctgtcatcccagctactggggagactgagttaggagaattgcttgatattttatacaaagagagacactaaagcaattaggcttatttgatatattaaaatatatggaagcattgttgaacagtaagtgatgctaaactttctttaagttatatttacaggtatggtagtaatacgaatgtttcaaaattgtataaaattcctagaagtctatacttctaatataattttggttattacattaaaatattttatgccacagaaacaaccaaattttatcaatttcgctcatcaggtttctaatcacggccattttaagtttttgacatccaaatagttattgttttactttggtttttatttaaaagcactgtcaatcagctgaggtccaaacttgtttctttaattagattcatagaaaggatagaaagaactctgaaatgtacaggtttctgataactttaagattataccattggactgggtgagaattttcagagctctaataaatgaactgagtgattttgtgaacgtgctcatcgagatcaaacagagtaagaattaattcgtgggtctaaatgaactgataagaactttttatgattacttatttgaaattttgctgattacttaaatgttaacttttctggatttaaagaaactgttttgttttgtttttattttaagctatctatttgttacagcaatttggtcaaatatacattggtaaatagaatgaaaatatttattcttctccccatctgatatctccaaaatttggaaattatttgtgagtattctcatttttatggcaatgtagttattcacataagttcaataagaaaatattctctttgtaataggatacaaggggaaacacttcttaacttacaaatgcttgactggaatgacatattttaaaatatgaccagacaactttgagaaactaaggtaaacttcagaaaggcaagaaagcgcaccttggagaaactggtctcataccttgagcacatggttcacgtgactgctttacaggtgggtaaaaaatgtccctttgtcttctttgtctcttttgatctttgttggtttaaagcctgttttatcagagactaggattgcaacccctgcctttttttgttttccgtttgcttggtagatcttcctccaaccctttattctgagcctatgtgtgtctctccatacgagatgggtttcctgaatacagcacactgatgggtcttgactctttatccaatttgccagtctgtgtcttttaattggagcatttagcccatttacactgaagggtaatattgttatgtgtgaatttgatactgtcattaagatgttaggtggttattttgctcgttagttgatgcaacttcttcccagcatcgatggtctttacaatttggcatgtttttgcagtggctggtaccggttgttcatttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattctttcctttaagaatgttgaatattggtacccactctcttctggcttgtagagtttctgccgagaaatcagctgttagtctgatgggcttccctttgtgagtaacccgacctttctctctggctgcccttaacattttttccttcatgtcaactttggtgaatctgacaattatgtgtcttggagctgctcttctcaaggagtatctttgtggcattctctgtatttcctgaatctgaatgttgacctgccttgctagattggggaagttctcctggataatatcctgcagagtgttttccaacttggttccattctccctgtcactttcaggtacaccaatcagacgtagatttggtcttttcacatagtcccatatttcttggaggctttgtttctttttattcttttttctctaaacttctcttctcgcttcatttcattcatttgatcttccatcactgataccctttcttccagttgatcgaatcagctactgaagcttgtgcattcgtcacgtagttcttgtgccatggttttcagctccatcaggtcatttaaggacttctctacactggttattctagttagccattcatctaatcttttttcaatgtttttaacttctttccgatggtttcaaactcctcccttagctctgagaattttgatcatctgcagccttcttctctcaacttgtcaaagtcattctctgtccagctatgttccattgctggtgaggagctgcgttcctttggaggagaagagttgctcttatttttagaactttcagtttttctcttctgtttttttccccatctttgtggttttatctgcttttggtctttgatgatggtgacgtacagatggggttttggtgtggatatcccttctgtttgttagttttccttttaacagtcaggaccctcagctgcaggtctgttggagtttcctggaggtcaacaccagaccctgtttgcctgggtatcagcagcggaggctgcagaacagcaaatattgctgaacagtccaggcccagatggattcacagctgaattctaccagaggtacaaggaggagctgctaccattccttctgaaactattacaatcaatagaaaaagaggaatcctccctaactcattttatgaggtcagcatcatcccgataccaaagcctggcagagacacaacaaaaaaagagaattttagactaatatccctgatgaacattgatgcaaaaatcctcaacaaaatactggcaaaccgaatccagcagcacatcaaaaagcttatccaccataatcaagtgggcttcatccctcggatgcaaggctggttcaacatatgcaaatcaataaacgtaatccagcatataaacagaaccaaagacaaaaaccacatgattatctcaatagattcagaaaaggccttcgataaaattcaacaatcttcatgctaaaaactctcaataaactaggtattgatggaacgtatctgaaaataataagagctatttatgacaaacccacagccaatatcatactgaatgggcaaaaactggaagcattccccttgaaaactggcacaagacagggatgccctctctcaccactcctattcaacatagtgttggaagttctggccagggctatcaggcaggagaatgaagtaaagggtattcaattaggaaaagaggaagtcaaattgtccctgtttgcaggtgacatgattgtatatctagaaaaccccatcatctcagcccataatctccttaagctgacaagcaacttcagcaaagtctcaggatataaaatcaatgtgcaaaaatcacaagcattcttatacaccaataacagacagagagccaaatcatgagtgaactcccattcacaattgcttcaaagagaataaaatacctaggaatccaatttgcaagggatgtgaaggacctctccaaggagaactacaaaccactgctctacaaaataaaagaggatacaaacaaatggaagaacattccatgctcatggataggaagaatcaatatcgtgaaaatggccatactgcccaaggtaatttatagattcaatgccatccccatctagctaccaatgactttcttcacagaattggaaaaaactactttaaggttcatatggaaccaaaaaagagcccgcattgccaagtcaatcctaagccaaaagaacaaagctggaggcatcacactacctgacttcaaactatgctacaagtctacagtaaccaaaacaccatggtactggtaccaatacagagatatagaccaatggaacagaacagagccctcagaaataatgccacacatctacaactatctgatctttgacaaacctgacaaaaacaagcaatggggaaaggattccctatttaacaaatggttatgggaaaactggctagccatacgtaaaaagctgaaactggaacccttccttacaccttatacaaaaattaattcaagatggattaagacttaaatgttagaccaaaaaccataaaaaccctagaagaaaacctaggcaataccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttctgcaatctactcatctgacaaagggctaatatccagaatctacaaagaactcaaacaaatgtacaagaaaaaagcaaacaaccccatcaaaaagtgagtgaaggataagaacagacacttctcaaaagaagacatttatgcagccaacagatacaagaaaaaatgctcatcatcactggccatcagagaaatgcaaatcaaaaccacaatgagatatcgtctcataccagttagaatggcaatcattaaaatgtcaggtaacaacaggtgctggagaggatgtggagaaataggaacacttttacactgttggtgggactgtaaactagtttaactattgtggaaaacagtatggcgattcctcggggatctagaactagaaataccatttgacccagccatgccaaaggaatataaatcatgctgctatgaagacacatgcacacgtatgtttattgcggcactattcacaatagtaaagacttggaaccaacccaaatttccaacaatgatagactggattaagaaaatgtggcacatatacaccacggagtactatgcagccataaaaaatgatgagttcgtgtcctttgtagggacatggatgaagctggaaaccatcattctcagcaaactattgcaaggacaaaaaaccaaacactgcatgttctcactcataggtgggaattgaacaatgagaacacttggacacaggaaggggaacatcacacaccagggcctgttgtggggtggggggatgggggagggatagcattaggagatatacttaatgctaaatgatgagttgatgggtgcagcacaccaacatggcacatgtatacatatgtaacaaacctgcacgttgtgcacatgtaccctaaaactaaatatatacaatgtaaaaataaatatatacaatgtccctttgtcacatgcccaggaacgtttgaatgtttttgggaaccttgagcagaaataaattttctcacatatatagatattataggtgaaatgtgacattgaatctttggcttggttctgtagctttcagatatttttaaaagtccagtctgagattccttataaaacgttcaagcaaagcaaacttaaaaagatcctatgtggctgatcactagttttactgcacttacataaataatcatgccaattttaatgagactaaactgattttgcaaacaaatatattttactttgattatctttggtaggaatgggggtgactttcaacataaatatgatattttagaagaaaggtagagtgaattcattattagactctagctcattgtttttgcaggtttgttgtccacctgaattctgggctggatcctgaatgtttttagtgtcctccgatatgtctcgaaactaatactttcaggtttttctcacaatctcttgtgtggaattgttgaaattaaaactgaacttttcctgcagccctgcaagctgaagcttgaccacttgatatggacttcagaaaaatcaccagattagcttatacatacacaaactttgtgcctattcctgtatgggctgcttagaaaagttcacctgatgcaaactgcaaactagaaaaatctgtcagtttgctccttcctgcctccactcccacagaaaatgcatcaagctcaaatctagaaatcttctcaactggctatcccccagactcagaaaataatttatagtctctcctaaacattgacttttgcttttctttcattttcatagaaatgcctcttattaagtatgtaactgctcacaccatatagcagcctcactttggagtaagcccaccggcaacatcagtttgggagctgagacttcacagtttaactggactggcctattcttggagctgagagattggttccattgctcatgagacaatccagcaacccaatttctggactgtgaaacttcaggaagtttcctgttaaggaaggaagaagaatgttgtggttcagaaaataataccccaaaatatggcactttggcatgctgagtaatttgagccacagtacattggaaggtctcagaagcaacttcagaaccaaggtctctctgaccttctcctgcccttctgtctcttgccactcattttccccgagtgactcatagaaatcagaattcctctttcccaagataagtcatagaaactaaaattccttttccccaaagcaaaccgtaaagtctaaaaatgtcactctagccttcttccacctttcttctaggagctgaccataaagaaattctttgagctactcttgtctgatagcaggtcataagactctcattccagaaggggtccttccctatacctgggaagaaggaaggccatacagagaggtcaagaagaacctgcacagacaagcctttctgggtttcccaactcagtctattactattagatcattccatttgtgtccaatcacatttctacctggctgtccactcttcatggaatataagcacaaaattagacagtttcttcttgtgtcttttaagtcttcattctgaaggctcccacatcccataaaacgttgattatatacatttgttatgcttttttcctgttaaccatctttcattataggagtgttggccttgacccttatgagggatgagaaaaggtatcacacactttctgcctctacaaatcaaaacgaatttaaaatttcttttcttctatatagccactcatctttcttctcagaattttcaactctacatagccaaagcctctccaatacaaggcccgactcacatgctttcttctaggatgttttctgatctccagcagggagtcacctcttctgacccttgaatcccacacaatagtagttctccatctttggttaaaaatatagatgtaagagatatattccaattccattgaatcagattcaatgagggcagctaaatttttacaagttctcaaagtgattctgatgcacattgaagtttgagcatgatcaccatacatttcatttgcatttctgctatctcacttattactctcagctttgctttacagttattcaaattatctatctttaatttcctatgaaaggtagctcttgagggtggaatctgtgttcatgattctctttatatctcttgcagtacactgtaggtattgagtaacgtgttaagtcattgagtaaacggaggaagcaatgagctcctaagttatctattattatttttttttaatttgagacagggtctcactctgtcacccaggttggcatgcagtggtgtgatctcagttcactgcaacctttaactcccaggttcaagtgattctcctgcctaagcctcccgagcagctgggattacaggcgcccaccacaatacttggctaatttttgtattttttagtagagatggggtttcaccatgtgggccaggctaatcttgaactcctgacctcaagtgatccacctgcctcagactcccaaagtgatgggattacaggcatgagccaccgtgcctggcctccctaagtgatttttaacatcaaagttgcattttataacatttgtaattatcttggtaacaatgatttttgtaacttcttagaatttttctaatgttagggcaacatttagtaagcaatggtggagacagatatgaattagcacccatctgatgtcttagagttttagagtaatgattgtttatatgtcatctctgattatacctgtgtatacctggtgttctgtgttgaaaaggaatctgaggctgtataaaatagttctatgcactatattatacatacagtctagctaagggaatgagaagtcttagcatgtacactgagactgtaccatcctttatcatctttaaaaggcaagtatgcatttgggtgttgcaaaaaggcacaattctatcaaagatcacaaactcaaatgcttgcagggaccatggagacaaacataagcaagtaaagtagctcagaaagagagtgggttaactggagagatttctactctaaagaatcatggagcactcagtactagctggtaaagtgtatggcaaagctgcaggttcagtgttatcagatcttgcttttgaacgggagtcataaagcaagtgatatagtttggatatttgtcccctccaaatctcatgttgaaatgtgatccccagtgttggaagtggggcccagtgggaggtgtttgggtagtgggggcagatccttcatgaatggcttggtgccctcctatggttaagagtgagttctagctttattagttactataagatctgattgttaaaaaagagtccagcatcttctcctttctctcttgctccctctctcttgtttcctttctcctcgtgacatgcctgctcctccttcgacttccatcataagtaaaggctacctgagggctcaccagaatcagacgctggtgccctgctggtacagtctgaagaaccatgagacaaataaacctattttctttataaattacccagcctcaggtattcctttagtgcaatgcaaacagatgaacacagcaagattgttcttcgtaaacctcttgatttctaaatgttgacaaccaactacattttcaaaaaaatttgtcttgaccaaatcagaatgtctgcttattatacctcataaacttatttggattctctctccatttttgtctatgtctctgtgtcactgattgcctggctttgtctctgtttctccctccctcttcctccttctttctcttgggttgtccaactttatttgaacagttagaaccaactgctaaagtttcaactatgcattatttgtagaagtgagcttccacggtggactcttgtcactgtctttgtcaaggaaaagtcagctgcaaacagcactttgttggctattttgtttgaagctgatgccttacatgtaacttcttatactgaaagactgaactgggagatgaaaagaaaggattaaatattctttcagacttcagtggtttcaggtaatgaattatagttctttagaattcaaaacatactttgtcttaatgaatggataaacaaacaggaggaaattgggagaaaagtgttattttaaaaaatccctgtaaatgctttagatacacattaaattaaatactgtttgaataactacagttaagtaaggggaaatcatttttaatatgactgacattttgccttgcaacttgccttctcccagaagaactcccgagcacaccatgaacagtcgcatacatacattctttaatatatggccacaatgttgagttgacatccttacacttatagaagctccagagcactggccctgagcatgagcatgtgtagcttcatattttcctgttccctgaatggatgttttcacctatgatgtaccagtactgatagaactttctgaccccagggcaaaaacatctcatctgtgaagaagtataggcattgcttgaatgttttgtgtataaatactaatatctgccctatcttatttagctgagtaaatctctcagagggtataagtcaggcagcttgacacaagctgttatagttaggtgagacaaggaatgcaaaccctctgccattaatcatgtttcttagctctttagattttaacaaataaccccaatgacaaaaggttaacatattatcaggtgtctcttcaaacagcaggtaaaggtgattttcatgtttttgagtttacttaaagccattctcatatgcactaaactgataaaatgttttgcatttcagtgtcagaaaatttggtctgccttttagattggctcaggggcctttggcctttttgggactctgcaattggggaaatggcaacctatgaaacagcaaaaaccaaaccaaaaccaaaaccaaaaaagaaatatcaacaacaacaaatatattattggtgaaaaaaatgagtcccaacaaatttgttttcctgtgcattcctatgatagcagcttgtgaaaagtctttttatttatttatttgaattctttatctttatccttggatcacacatagatgcaaattcagcaagggagaagagaaaaatgttcagctttcctgatcagaaagcatgaaccagcttaagaaatgtattacatttgaaattgaccctcttttccattccttcaccatgttcgcacacctctgatatcctatttcattctttataccacttttaataggaaaataaatgaaagtccagaatcagagaaccaaggacagatttaaggttgggggctatcagagatacataaaaatctagtgcgggcattgccagcaatagatcccagggttgaggttccattttggatccaagccaggttgccttgctgagcatcattgtgagattgactggcatctgaatgtggcagcatgtaaaagaatgtccaacatttctccattatgaacaggataaagttcaaattctttacacaatacttcatccctgcctacttttctagcaatatatcttctatatccctatacatattcatacatacttgctagtaagttttaaagctctatgcctttgtacatgctttttcctttatttggtaattccttctcttccttctttattttgaaaactactattcattaatttttaaaagccggctcaagggtgtttctctgtcaattgacctacagttgaatgtactttccttcgggcaaatattgcatttggtatattttttcattacagactttgtcatactatattgctattattattttttgtattttacaccacacaaggctgagagttctttaggataagaagtgtcttctcttcatttgtgtcctggataaatagcataatggggtactttgtacatttgaaagaagccaaaagtaattgttgaataaagtgtttaaataaaagaatgatttgagatataactgctctagaattattgtttataatatttttgaaatatcagatttagtcgctgcagcagtcttaactacgcattgggccaccttgatgctatcccttgttttcctttcccaagtgaaatacaaaatactacccagagtgccttcaccaaaaactagcagtctgacttccctattgtctttacaacctatatacaatgcttgctatcctctcttttagctgaattttatatctcggcagctacatttgccacgggatttctttttttttgcccaggatatttaacatggtgccacaatactccctggggtactctgttgtaggggaccaaaatgtgccaccccaaaatatgcctctttggcataaagcttattttgagctgattattttgggaaacagctgacaaagaagaagctccaaaaacagcatacttcccttttgtacaggaaatgtacatttataaggaaatctctgttggtcatggcatgtccctttttgtatcaggaagagaagaacgagttaattaagagattttattatcaatgggtaaggcatgaacttaaatttgcataacacaccttaccctcgtttattgtacttttcctggccaccttcctataacttgtctcccccatactttcttcctttattttagctgaagatggtatttaaacccaaatttttaaattttgttttgttttgagacagcttcttgctctcagatcccaggctggacctcagtgacatgaagataactcattgcagccttgactcctgggctcaggcaatcttcttgcctcagcctcccaagtagctaggactgcaggtgcataccacatgtctggcaatttatttttatttttgtagagttgtggtctttctatgttacccaggctggtcttgaactcctggcttcaagcgatgcagtcacctccaccttccaaaataaatccaagttttaaacacctcttctgggttattcattgctgggtactcatgctaatacgcttctgtttcttttctgtcttgttaatctgtcttttgttacagataaccagccaatcacacgcaagagtagaaggaatgaaagattttacctctcctacactttctttttaaaagaaattaacataaacaaatttaaactcacttaagagaaaagtataaggacattaaacaaaaataagactattggcagaatttgctcatcaaggaaaactagatttttgtttaatggaaaagtagaataattgtgaaattttaaaaaggaactattttgagatttccaaactaagatataaattcaagagtgtccagcagcaacatcccagaattcagtcttcttatctctatttttgaagtacctactgacataataatattcaggtatgcaacatcccagtgtaaatgtttttagaaagccaggatcatgatatctatttttttggctaaaaatctaaagtatctatgacttccatgaacattcaatataaattattaattgatgaggcctgactttttttattaatttacaatttttaaactactaagttgctggcgtcgagtctagaaattattggaaaataatgttattctgttaatcaacaaataatatttacttttattcaagtaagctactaacaaaagttggcatattcattatgttgttgaatcatatttttgagcttgactgcacttgtttttgaaaaaaaaaatatgtatacacatatctccctgtttaatactttccttatctaaacacctcaaattgcttcagtttgagtgattttgatgttttaaatttcacttgggtttagagtctgctggagtctcaacagatgccaaagcataaaaaatggtttgagtgattttgaatgaggaactgtaattttcgtagtcctctttcctttgggtgaaatattcctacatttgttgagcttcactgattgcttgaagtcatactgtatttgtttctgagaactgctgtaacaaattatcacaaacttggtaagttaaaacagcagaagtttattctcttctgttccagaggccagaagtctgaaatcaaggtgttggcagggctgcacttcctgcagagggcttggggagagtttgctctgtgcctagttcagcctctggcagttgccagcttggtttctggccacatcactccagtgtctgcttcggtcttcacattgccttctcctttgtgtctctcttcacctctgtgtgtctcctataaggatacctatcattggatttaggccccacctggaaaatccaggatgatatccttctctcaacatatttgaattaattacatcttctaagcaaagactttttcccaaataagtgatattaataggctccagggattaggatgtgagcacatcttatgggggcggggcggggcaccattcagccactacccattcctttcattaggaattctattagaacaaaaatttcctttttggacaaagtaagtctatatattttctatttccttctattttctgtctggttggatgttgtatttataaattatatggatgtgctcatgggttacatttgagactgcttttagaagtaaatttatttcagtgagcaaatttttattgtttttcgttagcttttttggttagctacctaaagaagaggtatagttttatttacaattaatggtaatatttgtagttatatatgatttttaacatgaaggatggttataacaaaagattctctttcattcttgacataaattatgtgtcagttaataatatatctttcaatagtgaaaagaaagaatcccaaagatgaagatgatttggagttggttcctctaactttcatgattaacatctggaagccttagaagtgatttaggagaaatatcagcagatgtttcttgttgaagaaatctcagcatacaaacatttgaaaattcactgtttttaaacggtattttaaaaccctgcgccctcattccttttactttttgttcctgtattcagttcctggatttgaattcctccagttgtaggataccaagccaccaaagattctggagaatacaatttccacacttttgataggcattgttaggatatttgtgatttactacagttttatatctcctctaaaatatccattattcaaaaacaggttgtaaaattctgacaaagatttctttcatcattatgcttctatgatatagatgagattttgtggctacataaagaacaaaatacagttcagctaacgaatgcaactgcactaagtaaataaacaaagctcaagttaaatataggctaggctttgctgtgtgcaaacagacccagaagaaaaacaatgaacatctgtagttcattgccactggaacattaacttgcttttaggtgttcaagaagaataaaatatgtttgctttgattgcaatgatgattttatttaaatttagattccgttatcattgatttattttgacctatctcaaggactgacttagtctgtatcaataatttcctttaaaagccatttgcttcttaaggtgaccagaagatattcaattgtttcctcctacttatagctcaactcaggagaggtatggataataaaaacctctttatatatttaaaggattaagatctattttcaataaactaataatgctctatctctaaaaccattccactaatactgaaaatctcacgatgcaattctaacaaagagaatgtatgtaacattgggcaactctctctgccttttaagtgattacataagtgtaatagtttgttcacactccctctcagcacttatagatgtacaaagagatgctaagaattaggccaatgagttttattggcacagatactacaaaatactgcaaaaaagttttacaaccttttgttgtaaaagggaatcatgatgattgatcgcaaaacgtaatccaattgtccactattggcataaataattccacaagatccgggacttttttcattttgtttatgactgtatacttcatacccagaataattcgtacctagaacaattcctggccccttgtttgacttcaggattcagagagaatgttcaaacctctgattcaaagacctttgtaccttagcacatttcaaggaggatatgcttggttctttcagtttttggattacagggcttgaagaggattttgccagggcaaacaccttttccccagataaaagcataactttattgaactttagaatagcaagacatctcaaacttcacccacttgccatcttcagtgttaacaataagaaaaaaactaggtctggagaagaaaggcaacttgtatagagtggccttagaaatgaatgacagagccaagactaaatccaattccttttctccttggaccacaaagaagagtgacaatgacattgctggcctttgaaattataaaggaaagatctcaaggcttttagcctctgtggttgaaaaaatgctactgcagaactctgaaaatatatacaaatcacattatctttccttcacatttcttttatctccacctcttcctttttcttctctctgataatatctgcattttggtccttacattttttttctctcttttttttccatttttgtactatttttcccttcctcatgatttgaatgttcttgcctaaaagatttaaactcttctaatccagccctaaacgctgacctaataaaaattccttgcctttctcaggaggaccctttaaagtgaaaatgacttgctaaactgcttcaaccaatgtttggcagatctgggactagaatccaggattcctgtgtcctagcctcggttctttctattataagacagtacttataatatagtttctttctattataagagataaatagcagtgccctgactaattacaagatttccaaaatggatagaaatgacactttaaaatgtcattcctctatataaaaatcgacaatcttcttgtcctgcctctctgtctacctgagaccccagctgcctctctgcttataagaaaaatctctaagtcttatttgcctaaactctgttgacatctcctctcagagggtcttctgtatttcccttccaggaatcaagttgtttttatgcaccatccccagaaaaagaaaagcctttattcttgctcatgccccacttctctaagacagctcaattaattctttaagggttgttccctctttctctctctgtgtcttgtatcatattagatgtgtaaaacctccaataagaaatgtattaatatcttaactgtggcccatatgttgtcagactgaaagggcacctagagatgatctagtaaaatctcctcttttgtggggggtagaaaacaaaactctggaggagttaagtgactttgccaagatttctaggtgctgtgggaaactctgagcagaaggaaggaggagagggagtggaagttttctttatatggctaatgattttatagatagtatgtatttgtatttacattttccatattatgatgttgagtctgtggtagtttcataaactatatgagacacaatttgaggatggaagagttggcttccatgtcccaaccccaagctcttagtcatcaaactcaactgctccttaatttgaagagaaatttaaaaacagaaagctaaaacaaaagtccgaatttttatatatgatatttaaaaattggccaaggatgggggctcatgtctatgattccagcactttggaaagccaaagcaggaggtttgcttgagtccaggggctcaagaccagactgggcagcatagtgagaccctgtctctaccaaaaataaaaaataaaaaacgtaatcaggcatgataatgtgtgcctacagtcccagctgtgggaggattggttaagcccaggagtacaaggttacagtgacctttgattgcactactgcactccagtctggatgacaaaatgagaccctgtctcaattaaaaaaaatctctgtgccagggcaaagaaaatgccaactctatgcaaactagcagggacattagggacaagtggtcttaaaaaattttccgaactaaccttttaaaaaatatagtgactcctgtattggcaaaaatcacatacaatgctattaaagaacatttactcttcctcttaaaataatactcaaaaattagaaaatcagctgttaaatttaatataatttggcttttggctttagtggtaatgaaagaatttaaagagtaaggcagaatatgaaaaaagctaataaatgaatggatagagatagatagatagatagatagatagacagataaactgcatcaggcttctagataaacagaactgccataaacattacgatggctgacagctgcaaaaataagtgaaagtgacagtagccaatactatacaaagctgaaccatgtaatttacatcttagtgaaattaaacatactataacagcttggcttccaggcaacaatactattaaatttgcagtagtagattatgacatcatctgaaaccccaggatacacatttagagctggctattatggtttgtaatctgtattgctgttctggttagtttttcatttaattcattgcacgcttctattaaataaaaaaaaaaatacaacagccattgaggatgcgagttttttgaaaaatctgttaagcttcaggttgtactgatgtcacattttagaatcaataatgataacttatgtctgagaagcattcagaggtcagaattacattgaacagtataatcattcaaatatttttatggtcattaagtataatttggggagtttttctaactcacctttcttttccaaaatgtttcttagctaactaagactatacaatggtggaataacaacaaaacctactgcttttagtagagggtttacattatacagcagcattctcaagcaaatacactgtactgagatcattacaagttcaaacttttgcaggggactgggggatggagaggtaagcatatttgaacttcaaaaaactatttccagaattttgtgtgtaaatcaatttctttggaaaagggatttaaacggatatctaatttttttaaaggcctatttttccaaaaattgtgcagacattgattcattttaacagtgtttctcgagttggggagctttattacaatttcttgtggtgggtaggaaaaaggatcatatagtttgaatactcccctctctctccaccatatgattctaatgttcttgtctaaggaatctgtgctcctcttacccattcccaagactgaactactcaaaattccccatttattgcaagaggacacttgaagatcagggacatgaaaatagcttggcaaaacttcttcaaccagtgactgccagacatgggactagaacctaggcttcttgtcacatagcccagggttctttataaaaagctatgtgagaaagagaaagacccacagaggtaattcaattagacatagcagaaaaagatatctgctacacaaaaatacagggcagacagactataaaactatggctggaaggtaatttagtaatgtgcttacaggacatgtttctggagattctgctgtctttgtaccagccctccctctccaccaatgaatgtatacctacatgtgtaagtgtaaagccttacaaaattggaaattcaggtgaaagcacttggaacacacattcagtcactccggcctgaaatagatgatgctttatataaccaaattaaaggaagtacatctgatttgaagtatgtcattgaacactaccagaactctaaagcccatgggaaagtatcaccttcattcacctttcaggaaacttagtgatgctgccattagtgcttccctctttaagtcaagtataaactacagacaattatcaccaataaactttcagtaatagtaaacgcagatcaggtggagaagaaaggtttggagaactgtataccaactcgcacacatggtcttctgaaggaaggatagaactctgacctaaggtcccaacaaagggcaatcagagattcctgagcatctagggaagatgaacttaggaaaagtgatgcgaggagggtttaaggaaagccggcatcaaccttgtggccttagctggacaatgcttagtgacttctgaaaggcgagtaggcctcaagtaacctgatatttgccctaaatctgcagaatttaacagtcagataatggagagaatgccagaaaagtctgtgggacaaaaaactgttttatgagctttgagatgacattgtgaaatatattttctataaatgctatacacgtaaattaggtatgtacataacattatcttatccttgactttcaaaagtaaaaatgggcaaagaaaactggcaagttaacccagaacactgggctgaataaaagcaaactccatcagctaaagccctgaacttgaaatatggaaacattaagaccatcagagtgaggcacatgatcttgactccaaagactactgtaaagggactgactatattaaatcatgattcaagtagaaaaccgaaatcacgtttattaaaattacctatttctacctctgggaaacaacttcttttacctttgcttgagggaaaaatagtttaagacagttttcgccaatatatgtacaatagcgcctcttgtcattttaacgctgctttttctaggctagtttttctctcctccttcctatcaccttttttcattccctctcaattttctcattttctaatttgcatttgaaagagtagggtgaggtaggatagggttgttgaaactgggagggacttggcttgacggcattgtaaagtggtgatcctagacattatggttacaaaagatgatagacaaagaaatatttattggaaacttcaattaatagaatagaatagtgcgggtgaaataaaatggtagacgacacttttcatgtactcactgacaatcactttttcccaccctgttctctttaggacaaaccgtgcagaaatacaaggcatgacaatcataagtctttcttcaagaaatccaaagtaatgactttactgctccatcctgcaatcaacagatactcagaaacagcccaaagatgaattacttagctaattctttggtattttctcgcaatcctctttttcattgtacatttcattttttaacagccattggtactgaaacttatgtttgcaaaagcaagagagttgattaataggtattttatacatctggtattttctcataaaagactagaaaacttatttcaattatcataccaccaacaaggatgcaatctgttcacaaggcctgtttacgagtggctgctttgggtaatggctgttttcttagcatgggaaatgaaatataatattattaagcagagatatgcaaaatgaagtgtcaacttatccatcttcctgatgtttataggcttcattttttagaatgtttattttattttatgggaccacacgttaaaatacctcctatttcaaaggatctaatttcttttattccgattttaatgtccttgaatattaacattctcaaacttgtaagcaatcagctaaggaaatctgtggtaggtactttattaattccatttagataaatgtatcataatgggagagacaataaaaatgaacactttatctttgcctgagaaaaagaactggtctttgccagaaggatggcataaatgattttcacttttagaggccacctgtgataaaatgggggaaggggtggcggttggtagaaagcaaacctctaataataatgagtgtgtgcgtgtgtgcatgtgcatgcacgtgtgtgtgtgtgtgtgtgtgtgtgtgttcaggagggagaggggttgtgaatcaaggcactgtaatggaaataataaatcaattttgaagagcttgagtaagatcattggaaaagtctagctatatctgtttttggctaagtgtggctccttcgttatttcactaaatttcattatctctgcaaggagtggaagtgagaaagaataaactttgtaaaaaggtaaatatcaccacttatttaattatcatttctattattttcccaggaaggcatcctactaataaatggacctacctgcagataaaggaaaggaaatcatatactaaaggaggaggataactttaaacagtatagattatagaactctacaaagccctcttgcaaaatatattaaattcctttatatgaggaaaaggaatattaacactggcaagatatatactggggtgtcccacagtgtaattcccttatgatttaatggacacttaaacaatgactgggtcatgaaagcaatattagaataaaaaatacttcttttaaaaatatttcttagatccatgctgtctagtaaaaatatgagtcacaaatacaatttaaactttactcatagacacatcagaaagagtaaaatgacaggggcaatgaatttctttaaaatatattttatttaatctggtatgctaaaaatagtacaatttcaatatataatcaatataaaaatattaatgtaatgtttacatgcttttttccccataccaaatcttcctggtgtttattttattttacttacatttaaagtatatctcaatttggaccagtcacatttcgaatgctcaatagtcacatgtagctaaaggctactatattgggcagtgtagctcttgattgtccaagatatgcctttttatacagaaatgggctacaaaattgacctcaatataaatgagtaaaaaaaaatgcccttgtatagaaatggatgaatccttactatcatcattcacttagtcaatgattcctagagctaggatatatacagaaaaatcagaggttcttttataacagaatccagaaatttgtttgcttatttttaatgccatgtttcttattgtaatcagttttccatatatgaatacataaaacaattaatttgcatcattgacttagatagataccctttggtttcctgaaatgaaatctaaccattgattaatttccgttttctatgttgtgttgactctgctttcaaaaattattcatcttacttagagttcctaacaattttggtgtcataaacgtaaaaacatttctactcccaccctggccaaatgcaaacacatctgatacatataataatttgtatgtaatttcactttcatataataccaagggattaatagaaatgctaatcctcagggtaaaaaaattaatttatcatgaaatatatgtgaaacattaaagtacagtcacaagttctgggggctctgttacattttgacagactaatgaaatcttgttttcttaaatgatcccaataaatcattcaaatttattattattaggatttgactctttttattatgtactttaattctgtttcacaagtacatatcattttttgtctttttttataaatgttttttgaatacatctcctataggagaattgagggaatagacattgtcttttccaccttcttctcatctaaaacattcatcaaagcaccttctcagtttagttcaactgaatgactataaatgaacgatgatagtacatttctctaccttcagtcaatagtgtaacataaccatattgaacagaaaattacatattccattcctgaattacatttagaaagcctttgtgtagtttttgatctgatgtaacttcatgaaagcattatattcttggtacttagtatggtgcctgaatcacagtaaatatccaattttccctgaattaattaatatgcccttcctttcaaatgatgttcatttctgtttaaagtcatcatattgaaattttcatctgctagccacagaagatattaaataatatgaaaaacaaatactgcatattctcacttataggtgggaactaaacaatgagcacacataggcataaacatgggaacaatacacaccacagacacttgagtagggagggtgggaggtggatgtgggttgaaaaactacctattagttactatgctcagtgtctgggtgcaatatacccatgtaacaaacctgcatatcaatcccctgtaattaaaagttgaagaaaataaagaatagtttcccaagaagagcaagagatatggaagagactcatccatagaaaaatttggaaagagcctcagaaaccctaaccagtttgtttggtgaaggtatttctttcctgaagccagtcagtaatgattagcaaaagtgaccacttattcaaatgcaataaccacaatggaagacttcaaggatttaatgcaaaaacttcaagacttcgatgaaaatattaagtaatatgacacccccaaaggtacacaataatatttcagtatccaacctaaaagaattggacatctatgaactgctcaacaattcaaaataattgttttaaggaagcttgctgagttataacagaacacagataaacaactcaacaagaccgaagtttaataaagaaagagatagaaatcataacaaagaaccaaacaaattctggtgctgaagaataccaggattgaagtaaaaaatgcaatagagagtgtcaaaggcatacttaatgaagtagaagaaagactctgtgaaatcactggtcatttgaaaatattcagtaagaggagaaaatatttttaaaagataacagaaaataaagaaagcctatgggatttatgggacactatcaagacagctaaatttcacatcttaggagtccaaaaaggagaagagagagagaaaaaaggcagaaagcttatttaaagaaacaatggctgaaccctttccaaatctaagaaaaggtataaacatccagatacgtgaagcttaaaggtctccaatcacgttcactgcaaataagatttcaccaagacacattaaaataaaactgtcaaaaatcaaagacagagataatttttaaagcagcaagagaattgtgtatgtcataaacaagagatcctccatgagattatcagccgatttttcagcagaagccttgcaggccaggagaaagtggaatgacgtattcaaagtgatgaaagaaaaaaaaaaaaaaccctaccaaccaagaatattttaaagctgtctgtccgtcagaaataaagaaaagatagagtttcacagacaaataaaagctaagggtgttcatcgcaactagacctggcttacaagaaatgctaaagcatattctttaagctgaaacaaatggatgctattagtaatatgaaaacatatgcaagttaactcactaaagtaagtatatagtaaaatacaaaatattcttttactgtaatagtggcatgtaaatcatttttaactttagtataaaaggtaaaagacaaaaatattgaaaataaatatagctacaataacttggtaatgaatatgcaatttattgacttgtgtttatttatttatttttagagatagcatctcattctgtcacctaggccagactgcagtggcataatcatagttcactgcagccttgaactcctgggctgaagtgatgctgccctactgaatagctaggattacaggcacataccaccacacctagcgtttttttgtttttgttttttttgtagatatgggtcttgctgtgttgcccaggctagtctaaaactccaggcctcaagtgatccctctatgttggcctcccaaagcactagtattaaacacatatgcaatttaaaagatgtaaattgtgacataaaaaataggacatgtatctagggagatgaaaatgtagaatttttgaatgcaagtaaagttgttatcaacttgaaatagatcggtctaatcctattttttatgtaagcctcagattaacaaaaaaaagcaagaatctatagtatatacacaaaagatgaaaagactcaaagcacaccactacaaaaaattatctaatcaaaaggaaagacaacaacaacaataaaaaaaaataaagaaaggaacaaagaaataaaggactgataaaacaaccaggaaatcataagtaaaatggaaacagtaagttcttacccatcaataatgactttaaatgtaaataaattacattctccaatcaaaagacagagtggctaaatggttcagtaaacaagatcaaattatatgccgtctgtaagaaactcacatctgctttaaggacatacataaggtgaaggtgaatagattgataaagatattgtatgcaaataaaatccaaaaagaaaggggtaggggtaactataagtaaatgagacaaaatagactttaagtcaaaaattgtaaaacaagacaaagaaagtcattttataatgataaaagggtcaaatcatcaaaaggatgtagcaattttaaacgtgtgtatgtgtgtgtagccatatacacacccagtattaaagtacctacatatataaagcaaatattaacacatcttaagggagacatgacagcaatagaataatagtaggggactttgacaccccattttgagcaataaatagatcacccagacaaaaagtgaatactggattttaattacattttagaccaagtagacctaacaaacatatacagaacacttcacccaacagtagcagaatacacattcttccaaagaacacatggaacattctccaagatagaacatttattaggtcacaaaataactcttagaaaatttaagcaaactgaaattatatcaagcatcttcactgaccaccgtgatatgaaactaggtatcaataagtgaataaataagtagaataagtggtataaataagtggaaattaaggtgtaaataagtaaaaattaagtataaataggtttaaataaatggaaattaaacagcacacccctgaacaaccaatagggaaaagaaggtatcaaaaaggaatttaaaaaatattttgagacaaatgaaaatgaaaatacaacatataaaaactcgtaaaatgtagccaaagcagttctaggagaaaagcttatggaagtaaatgcctaaatggagaaaaaaaaaatctttaataagcaaccagttttgcacttcaaggagctagaaaaagaaaactaatgccaaagttagaaggaaggaaataacaaatttcagagcataaataaatgaaatagagactacaaaaaattagaaaaatatcaacaaaactaagagttcattttctgtaaagaaaagaacatcaacaaacttttagctagagtgatgaagaaatataaatgaataaatgttttaaatgctaattaccctgatggatcaccacgcattatatgtattgaaacatcactatgtactgaagaatatgtacaattattatttatcagttaatacataaagagcaaaaactcaaataaaatcagaaatgaaagaagagacattacaattggtatacagaaatacaaagattcacaaggaactatttgaataatatcaacaaattggtaacctagcataaatggatatgttcctggaaacatacaatccacaaacaataaataatgaagaaatagataacctgaacagtctaataatgagtaaggagattgaatcagtaattaaaaatctctcataaaagaaaggccaagacctcatggcctcactggtgaattctaccaaacatttaacagaattaacactagctcttctcaaattgttacaagaaattgaaggaaacactcatgaggccagtattcccttttaccaaaccagaaaaggacactacaaagaaagaaaattacaagccaatatccctggtgagcatagataaaaaattctcaaaaattaccagcaaaatgaattcaatagcttattaaaaggatcatataccatgatcaagtgatatttatccctggaatgcaaggatggcttaacatacataaatcaatatatgtgatataccacatcaacaggatgaattataaaaatcatatcatttcaatagacaaaaaaaaagcatttgacaaaattgaacatatttttatgataaaagctatacccaaaaatgagatatagaaggaatatacttcaacattataaaggctgtatttgaccagcccatagctaacgtcattttcagtggtgaaaagttaaaagcttttcctctaaaatcaggaacaagacaaggatgtccactctcgccacttctattcaacataaaactggaagttcttgcctgagaaatcaggcaagaaaagaaataaaaggcatccaaatcaaaagaaaaaattgtctctgtttttgatgatataatcttatatatagaaaaccctaaagactccatgaaaaaaagctgttactaataaattcagtgaagtcgcaggataaaaaatcagcacgaaaaagtcagctttgtttctgtatactaagaatgaactcttaagaaaagaaattaagaaaacaatcctatttacaacagcattaaaagaataaaaatacttacgaattaatttaactagggaggtaaaagatctgtataatgaaaatataagacatcgatgaaagaaatggaaaaaacgcaagtatataaaaaaatagcctgtggtgatggattgaaaaaaaaatcattattgtcaaaacatacttctcaaagagatatacagatttaatgcatttttttaaatcaaggttccaatggcattttccacagaaatagagaaaggaatcttaaaattcatctggaataacaaaggattcccaatagctgaagtaaacttggttgagaagaacaaagctggaggcatcacattcctgatttcaaattataataaaaacctatagcaatcaaagcactataatatgggcataacaacaaacatacaaagagaagagaacagagagcccaggaataaacccatgtttaccatcaactcatcttcaatgaagatgccaagaatacacaatggagaaaggatagtgtcttcaattatggtgccaggaaaacttgatatccacaagcaaaaaaaaaaaaaaggaaattctttttttatattacaccacaagcaaaactcaactcaaaatggattaaagacataatacctaaagccatagaattccagaagaaaacatagaagaaaagctccatgacacaggtctgggcaacgattttctggaaatgacccgaaaagcacaggcaaaaaaaaaaccaaaaataaacaactggaaacacatcaagctgaaaagtttctatacaacaaagaaatcaatcaacaacatgaaaaggaaatctacggaatgggaaaaaatatctgcaaaccacatatttaataatggtttaatatccaaaatatacatggaacccatacaactcaacaacaataaagctaaataaccttatttaaaaaattatcaaagaacctgaacagacattttcaggttatgaaatggttaataggcatatgagacagtgctcaacatcatcaatcatcggaaacacgcaaatcaaaaccacaataagatatcacctcacacccgttaggatggccattagcaaaaagttaaaagataagtgctggtgagagtgtggaaaaaaaagaatccttatgcattgttggtaggaatgtaaagttgtacagccactatgaaaacaatatggaggttcctcaaaaaaaataaaaataagactaccatatgatccagcaatcccacttctgggcacatctcctaaataaataaaattgagatctcagagaaatatctgtacttccatgttgatcacagcattttttccaatagtcaagataaaatataagtgttcatttacagatgaatgtataaagaaaatgtggtcggtgtgtatgtgtgtgtatgtaaacattattcagcattaagaaataagaaaatcctgctatttgtgataatatggatgaacctggaacacattttactgagtgaaattagctggacatagaaagaaaaatactgcatgattccacttatacatgcaatctaaaaaagataactaataggaacagagagtagaaggatggtaacctgaggttgggggtggttggggaaacagggagatgttggtcaaagggtacaaactttcagttagaaggcgaataggctcgggagacctaacgtacagcatggtgactatagttaatatcgatttaatataatattaattaataaaattaataatttattttgttactatataatattactataacatgttaataatgtgttatatactggaaatttgctaagaaattagatctgatgtattctcaccatatacaaaaaggtaactaggtgagttgatagatatgttaggtagcttaattgtggtcatcatttcacaaattatacgtaaaacaaaacatcacgttgcacacattaaatatgaacaattattattttcaattatgcctttataaagctaggggaaaatattaaataaataagtaacatttgtgataattgctgtgacagaaataatcactgatgacataaagagaaataagggaaaagaacatgaaaatatttagacaagaatgtagagaaagcctctctgtaaatgtggcatttatgctaaaaatatgaagaataagagcaagccaatgttgggaaaaagggcagaaagagcgttccaggcagcaagaagtgcatgtaacaaagtgctgaggtggtgaagggcttagaacagtcaaggaaacaatggaaggctgacgtggctgagtgtgaactacagagtataatgtgctcatgctggtgagttaggaaagatcaggtcagggcaaggattccaggaaaaatttgattctaagtgcaaaagaagagccatagaagttatttaggggatcccatgatcttatttatgttatagaaagatttcattggctactgtgtgtagaatggtatgcagaaagatcaatggatttagagagagcactttgacatgatggtatctttagatgatggtgtttggtctagctaggcagcagaaaaggtggagaaaagttaacaggattcacacacattttaagggtagaaccaatagaactcattaatggaatagatatcggggggtgtagggataggaggaatcaaagaacactcttcgaattattgcctggagtacttgcataaacactggattaacttattaatataaagaagacggtgagataaaagctttgagggttggggataaagggttctattttgatcatgttaagtttaaagtgcttatgcggcttccaggtggagataaggaggaccgattgggctactaagatatgctgctgatatgaagcctgaaactctaaattacatattagaattagaaaaaagaaagccactcttcaaagattagtcatacatctcaatttatagttattccctaactagaaacttcatgaagccaactttcaaaactattacaaagcattgagagtatttttttccttcaaacttatttttctcatcttaaaaaaaaaaaacatctgtgaactttctcatctttctgaacatggtataatttggaaaagtacgttcaccttctccaaacttctaattaactatttatctttcagatcagaccagttataaccaaaaatcccccatttcattcctgttatgttgcatctgaatagaagataaatacagttcatattcttacttgcacagcaagtggtaaaaaatccatttaaaacatgctatgaattgaattcatttaatctattaaatatagcaatttaatgaagcaaaatacactaattaaattattaaaatctggatagcaagtagtagttaaaaagcctgttgctatgcaactcagagaatttctataaacagtctgcaaaaatgtattggttaaatatgttggtattttgccttgaccttttataatcaaacaccttctcaatctgtgaaaatgttttttctgagactaacatcaaatagaattcatggattttaaaaaaagaagaaatttagggtttgattgtgttacttcttctattatattcaaaggtataagaagttcaaaattccaaaaataaaaattatcaaatatacatacggaaaaatagcagcagttccttaaaggtttctgcataattgagaaacttcattgtttatagagatacaaatctgctatattgcattattatttctttcatgaggttgtagcactttatgacagaagcaggttagcatagatgaggtgaagaatggagttttttaaagtcaaaacttttttttttgacagcaattccccccaccccatactgcctgctgagactgtcagagaattaaaagttggtcacaagttctaaaagtctgcagtgtatccttcccaaaatatacttgaaactgcataccccagagggtcgtttatgtaatgaaagaaattactctgatatgtgggcttttaaaaatcatttttaaaggcagtcactgagagattgatatgcaggcacactttaattttaaatgtcggaattagactaaaagaaaatgaacttcattaaaaaaataaattgaaagttaaaaaatcttctcttgtgaaatccaaaatatttccaaaattttgaaactactatttaactacaagcagtactgttgggtactgacttaatattagcgggaatttacaaagacctcttaatcacacatcccccgatcctgatcacagggactgagccaaacttggtggaataagaaaggtatttaaggacaactttaaatgggggcgaagggcggtcatctgatgccattatctttgctgtagtggtccgttgacgaaaaatattatttgcatgtatttgagcctcaaattgttttttagccataaacattttgagacttttctgtcaccagactgcctactcttattactccttgttcagaagtcagtttcttgttttttgacacacgttattccttctttccctacctgccactttcatgtcctaaaaccaggtgttcaaaagcaagcactatggccatgttctccaaactctgtgccaagatattctgtggtgatgcagtgagctcaaagaagtgccctgaaatatttaatattttcaggggaaacagcaacactgcacatacaagcttgaggtaatttatagtttcaacattagatagcgctatatgcctttagataatgtcaatatttgttgtgaagctgtctttgtgatttctatggataaaagaaacaccacatgaaaatcaatgtggagcaggaaataacagtagcagtggcaaatttgaatttgagttttgtgcattagaagatgtacaatatccaacatcttcatgcattccattgttaagtgaccatgcttatttaagaatagaaatattattatgtcaatatatggcaaaaatgatttccaagttgctagtaaattcttattgagtttttgagacctaactaccaaataaatggaactatcaggcatttattttggcctaacagcactgtgaaacaatcgctgagtcactaaggaatagaatttgagatcctctgccacaacagtatgacaaaaataattattaaaattgtgaagctgtgcagctacttcttgaaatagctctctctgtgtctgtatgtatatatacatacatatagcagatattgagcagaactttaaaatacataaactgccttttatctttcttatatagtgtacattaaatatagaagataaagttgggtttatttactattctaatggaattttctttaaaaacagagaactgtgaaaacattttaatgttttcttcactgcagatatcagaagtcttcaaaatgtatagcatgtactctagagtgtctacccaggctgactctattccatagaaataaaaagtttccatatgacccagtgggttaacctagctctgagtgactccacatggattgacatttgagctgtcagctaatgatttgcacaggtggaagtaagagattataatgaggtctcatcctccactgcaaatctgactaggagttttgacccattcttgttcatcattcagtcttcttattttattccttacaagaacattcgccaaaccttccagaggtttgtcaatatctataaaggaaatttcatagacttcaatatgatattcaagatcctctttgatctgtaatcaacctatttttttctaccttacatcctgccacatcctcctatgatcctataatccaacaaaatgaaactgcctcttttatgaacaggtcttgcacttctctccctgtatactatttttttaaaattctctctttcacttggatgtcctccttctgtccaagtcttcctgcttcttcacagctgtgctcaaatcctacctcttccacagagcctccacactttctccctgccatactcattctttcaccttgtacatggtataacatatacacagtcttgtgttttactatgtttgcttcacatgtgactttctccgttctgttacttatatgctttacgcttatgttttcaaacctctcccaaacaagtacagcatgcattcacgtctttctccacccacaactttaaatcatttgtggtaaatgtctgcataaatagatactcaaccaattattatcagactatattggaacagattatgctacaaccaagatggcaaattataaagacttaaggtattatacttccaaggatgagtctcatttatcaggggcccttatggagcttatctatcccaactcttgccactaccaactttttctactgtttgaaatttggagaactcccaaaaatgtcttcatccaacttttctttttccaccctctggccctaaattgaaagaacttgaacatattcttttgtcagaggttgctcttggtttatacccacaatttgtgcaagtagaataattggtgtcttaaaatacatattcctggagctgacttaagacacacagaattcaaattttgtgaatattagctattatttttattattaaaccagcatctctcagtccacagaacactagtcttcagtgagatattcatataggtttagataggaatgattctactcgtaaataatttgggaaatagtcaccattacatatctttcttagagattcaagattttaataaacatgaaaaaagtctttgagaagtcttgcaatctaatttatttaatttgtttaactcaaactttcttcaaactgattggaccatcaaaatccctttgtttccatatatatatgtatatatatattatatatatatatataatatatatgttatatatataatatattatatatatattatatatattatatataatatatatataatatattatatatataacatatatataatatatatgttatatatatatatattatatatatatatatataaccattagcatttcatgctctttgaatttgaattgggaaagtatctatctgtgactcttcttgatcatcagttttgccaatttaaaatagtgagggaaggtcagttgaaagttattctcagaaaaaacttatattgtaaaatgtcctttgtgtatgtatgtatttccctcaaaatggctcagagtcacctgcattcagtgcagaggggctgtgagattgaaaatatctctggacccacccgaagagggtgaaactattttcctgatcttacatatctcagtcttggaacccatgtctgtctgttctgcaacaggttccattagccaaggttggctggtaagagcctagattatgctttctgcttaggttggtctagaccattggcttgaactgtaggatgactttggtccctaagacaagggctgctgcccccagaatattgtctttctaagtctgggtaggctgctatttgaaggccaacactaaaatgtattcaaatgactcatctgtgtcctctttaaagtgtgaattagtgcaggcactcattactcacctccctccctttagaacaagttgcttctgacaacagtgagcgaaacagctgtgtgtgtgtgtatgtgtgtgtgtgtgtgtgtgtgtgtgtttctataaaagaaggattcttctactatactagaatgtccccaggccgtgaaggagattgagctgtgtaaaccaaccgtgccttatgctctaggggaagaaaagaaatggagaagagaacacctcaaccgaatttattataacaaatttctcgggataataaaagacatcatctcagccctagagggaaagtaggttatagctcagctaaatgtccttgtctaatgttgcttaaccccagctaacatttcaagccttaagtaaagtcccgtcagtggcacattttggcctgtttagtaatttcattggggacattcatttgaatgaattttttgaatctgatgaagactcacatcagtcattttcagattaaagcccctagtgtgctgatttctgtcttctcctgtctgtttgattctttaactaagagagcagaagaaataatatattgtataattgctctttattacaaatttgtaattacatgttacacttggcaacaactgagaagagaagagatgtagtctagaatatcagaggcccggggcaaaggtcaacaggaactgttttggtaatgggcaaggtggttttctcagagatggtcttggcaattagatggcaatggaaattctagatcaattgagagacaacctctagagcagcatgcagtccaacaacttgtatcatcgtcctcagtcactggcatgccatattctgctcctgtgacctccatgagagcacatgctggcaatttacttggatctcagcttcatctttcttcttttgtgctttaatctacacatgtacctctttctccacttggctctcatggagcagaagtttctgagaaaatggtgctaaggccaaaagagcctaatttctttagggcatgttctctttcttggtgtaagggggctatgacgtattctttttaagttcctaattctatatttcactaactatgtggggaaagtcaatattttattgccatcataaacaaagagaggccatttgcctcttgatgtgtcgtgctctgtgtctctactcatgcagttccttttgcctggaaagttacttccttcacaaatgccaggacagcattttcagcatctctgcatctgtagagcttcttaccaaatccaagaaaagtagagcacccctgctttcgccactactgtatctagtacatgctcttttacctcacttgtcaagctacaattcaatcccttgtctatatttttatctcctctcctaaactactattttacatactttatatttttatttgtacctataacaatgccaggcttaaaataaggattcagaaatatttgttaaatttaattgaacaaatattcaaacagttgattccctatgtttttgaatattctttctctaccagttcattcagtatggttgtgtcttaaaatgccaatctgtaagaatttaacatttttaggaagcttcatatattcaggatgttacatctcactatctggtattgatagagctgcaaaagtaaaagaaaacattgtgtaatttttaaagaaatggataatcacaattttttccgttgaaattttaaaatacacatatttctgaataatataaataaaaaagtctgttaacacagactcatcagaaatatgctattgcttaatttttatatatgattatacagaaggatctcttacccaaatattaaacaattttgttgctttatttattatacacatctatctgtgaccctctcaaaataaaactatacctataataaactatggaaaatgatgggtagtaatgaaagtttcccatctggaaaagcccctggtccagatggatttgctaattacttttataagatgtttaaccaacctttgaagaatattccaggcatgtttgattactttacattaccaacatttttggaagtaccattgtgggctctcaaactaaactttataaatgatatggaaatggtaaaatccagaaaattgtgtttcttaagaacatacatctttcacaagaaatgctaataacacattccttccaaacctgagcccagtgataaaatattttttcattgaaaggataattttaggacaaccaggtggaagaaatatgttacctcatattcataaaactaattacattaactttcactaaagtgttaataaataagagttcttaacatgtgctgcaatatatgctattaaaggtggttgtatgctttccacgatttgacatagaattagacattttattcaaataaaaaataataaacaagtagtaaccaatatactatgatctgagggcaacaaataagagatcatgtcataaattatttgtttaaccggttatctctcatgccagaaatcttgcaattaggtatttattccttttaatagactggcattttcagaatcttttattattattatggctgtcaaattgaatggtgtactaattataggcgtgtagctgactgtattcttatatacagtgggaaattcactacacagccttataaaattttaagatttttataacaaataaaatggtcctaaaataatatatgagaagatacatttgtaagccacttagagaagtttactttattaaaattaagtgcccaataggatactgtactaaattgaggatatgtatattttaacgtcagatgagggatttgggaaaagttaagagcctggctgtagaataagtaggacctcactctgagtagagaggtgatacttgtacagacagagggcaacattacagtatgtggttggcctgcctatacaacatctatgaaaagtcccagacattttagtgtcagtcagacctgcggaattctctgagttttcattttctcatctagaacatgcagttaataacgtttactttcaagtgttattgtgaggattaaatatctgcctgggatatagtaggtatatctaatattgtgttttttcctctctctcactattcatctacacatacacaaacacacacagcattttgattagagcagagaatttgtataataatctgccaggtcagatatgctttactacatctcttttctctgctcattgtttttgtgtcacaaaataaacctcagttttacttgaacaataacctgtccggaaaactatatattaatttatttatagagtcaaggggatatatcatatcaatagttacctaagaaagtaatgtttaataaaaaagcttacctctgtccatatttttgtgccatgctcaaaatgtcaactgtttcattttcaaataataggcaggtgttaagataattttgtatgtatatatgtatgtgtatatgattatatacatccagatatacatatatgcatatatctatataagaatatgtgaatgaagaatgtgtacatatatatacacagatgttatatatataatcatatacacatgcatatatacagatatatatatacctaaatttatatatatatatatatctaaatatatcactgctgctggcaatagatagatataacactttaaagaatgcattcggtgctactggtatgatgctagaagataaagccatatgcaaatccttcttttccctttcttaatgatatatagaacaatttaaaaagcataagatactcataaacttcattcacatattcttttttaaatttcgtttttgtaaaagtcagtatttctattgcagacaatattacaaagcatgggatttcactaaaaggtaactgtaaagaccattaaatttattttcctgttttcaagaagagaatgtttaaaaacttaattattaatattttatataaaaataaaaattcccctcatctctccatttgccttctatctaaccctggagtaactacaaataagagcatgcaatattactctcctcaaacttttctatatagtttaatatgtgttaatgtccaacttttttattttaaaactatggtcatacttatacattcagtataagagataaaattcactcacgccactctactttttaaaatgtatagaatatatacatttgcctcatttaaaaaacatttatatatttttcaggttgtggaagctcaaaaatttaattgactgtttctatattgataggttattgggttgtttccaatgtaccgcaattacaaacaatgctttagcatagcaaaaactgttttacaaagtgtggtactataaggggctgcatgagtaggagcagtatgcccttgcctggggtctgagaaaatctgcacatgacaaatactctcatggcccttatgagtgtcaattatttctacatgaataaggctgagacttaagtggagaatccatattgtgaaggcatgtactaagacggagtgacttgtagagtataattctggaacccaacaagctacattctgacactgaattaattgtacatatgaaagaaataaggaatagggaaatataacatataactgaataactaaaaatgataattcagaaaatccaaaataatctacaaaaaaactcttcctgaaaccagtaagtgattattgaaaggttgcagaatataagactaatttataaaaattagttacttttatataccaacaatgaaaaagtggaatttgagattgaaaacacattaccatttattttagcacacacaaaaatggaatagttaagcataaatctaacaaaatatgtataagatccatatcaggaaaactataaaactttgataaaaaatatcaaagaagaactaaacaaatggaaagatatttcatgttaatgaataagaagactcattaatgtcaggatttcagttcttcctaacttgatttatagacttaatacaatcctaataaaaatctcaataactcattttgtgaatattgacaaactgattgtaaagtttatatgaagtggcaaaagacccagaatagtcaacacaatattgaaggaaaaggtggagggctgacatatccgacttcgagacttcctataaagctagttatcaagacagtgtagctattggcaaaatgacagacaaatagatcaatggaacagaaaagagagccaagaagtagatccacatacacataatcaagtaatttttgacaaaaaatcaaaggcaatacaatagagaaaaaatagtcttagtgctggaacaactgaatacgcacattaaaaaaagaatttatatacagatcctacactgctcccataaatggactcaaaagcaaacatagacctaaaattaaaatgcagaactgtataatgagtagaaaataacataggagaaaatctgaatgaccttaggtatggtgatggctttttatatacattaaggtatgatcagtgaaataaataattgatagtctgggcctcactgaaattaaatacttctgctctgcaaaacccaaaagaatgagaagacaagccacaaactgggagaaaacatttgcaaaagacatctaataaaagactgttattcaaaatatgcaaacaacttttaaaattcaacataagaaaccaaaaacctgattgaaaaaatggacaaaatactttaacacagccttgataaagaagacatgaagatagctaatagatatatgaaaaatcttttaacatcataggtccttaggaaattgcaaattaaaacaacaatgaaatattactacacacctatattagagtgtccacaatgcaaaatattaacaacacaaaattctggtaaggatgtggaacagcaggaattctcatttattgtggtgggaatgcaaaatggtacagccacttagaaaaacagtgtggcagtttcttacagaactaaacatattcttaccatataatctcacaatcacactcctttgtatttactcaagtaagttgaaaacttatgtccacacaaaaatgagcacatgaatattcgtaacagctttgctcataatggcaaaaaaaaaacttgaaagcaatcaagataccctacggtagatgaatggataaactgtagtatatccagatgatgaaatattattcagcactaaaatattattcaacatgagttatcaagccatgaaaaaacatggagaaaccataaatgcatattactaagtgaaagaagccaatctgaaaagctacatcctgaattattccacctatataaatttctagaagagacaaagtatgaaaatagtaaaagtatcaatagttacccagagtaaggaaggaagaatgaataggtgaagtatagaggacttttaggtaagtgaaactaccctatatgagactgtaatggtggacacatgccattatacattttttcaaaacccatagaatgcagacatccaaagttgggtaataatgtttcaatgtaggctcattgatgctaccaaatgtaccattctgttgggggatgttgataatggggcaggatatgtaggtgtgcatgcagaggtttggggggcaatctgtatttcttcatctgaagtttgctatgaaccttaaaatctgctctaagaaataccttctaatagcagatgactgaaatgaaataaacagtgaaattcagaaattattctattggatgctaaatcttgaatattaggaaaaattcagatggttttagtttttctgctcttgtttatgtgagtatttaaatttgtataaattcagttcctaggtttgattctgactgcataaatgaccccacagtttgctttcctgaatagatggtattgattattttgtaactatttctttaagcccactgattttagcattttgactgaactaacttactacttagcagttcaaagagagaatgaaagtggacaattgttgtttactttcctttagaaatagctggaggctaaatgttaaaggtgagttttgcagctctgatacagtcaataattgtggttaaagccctaataaactgttcaagattaagtggcatacaaattcaagcaaggtggctccaaaatttctgttaggagcacattataagttgtcatttttatagagttagttatgtgaacctttcaatatgttagattacactattctattccaaatctaggtatgaagaaacattcttccacaggggacaatatccactctcatctgactcttatcttgaggtcagaattaatggagtgaaggtatctcaatcttcccctaaacttggtgtgataaccaaaaaaactcatgtcatggaagaatacataggaaagctgttccttctttgcttcatttcctttttataattggacctctgggcagtgaaataagacaggatggcttgatctatgctttctatgtgaagatgaggtacaaaacttcactttctgttaaggttatgctaattttacttccaagaccctgataatttagttgtacaattcatcttctatagagagcaatgtggtagataacccacattcagaattaattaccataaatcagaagtatattcattgtattactgtgagatctttcatttcccaggaggaaatgtcccatctacaaatgaaccctttacaggttcaattatatcttctcatttcttttctctttcaggcacagcataatgtctataattttagctttatattttcttttttacagaaagtatccaactgctaggaagtaagcccaattatcactagtgatagaacaaatagaaaaatgacagtgttcctcaaagctatctgcttagtataagtctgcagctgccttttcctcatgaccatttggttcaattaagtgaactgcatttgagatttattattgaacaaaaaaaagttgactggggctggaaaaaaaataaaaaattgtttctctttaccatgaaatgagtcttgctgctgcctacatatatctctctaattggactgcattaatcatagtgaatgtgctagatgtatattgaccctgtgtgataaatagcccaaactgaataattctgagtacctcatgtttccttgttcaatatacttacgcagaggaaaactaataatcaagaaataattataatttcgttcactatattcaatctttcttaggttttgtgacttttcataaacaaccaggttttgcatctggaaaaataactcaaccacgttataatcttcctggcatgtcctagtagattccttggtattttaaagtcaatacaatatctctaacactaagtaaacattattggtgttcttagctatccaagtaatgttcaggattagtcagaggaactacatacttaatttaattaaacgtaaaataattccttttcttggggttctatcctaactttcaggttttaattcctcttgttccctacagctggggttacacttgacctgtaggttcagcttagccatagcaccacagtcaaggtaataaagtttgttggtttttattatcccatcatctggatttaaaggcaactttaaaaccttttgatcctaaagtgattctggagtcatgaatagactcctgccatggttgtaagttttattcttcctcttgctctccctgaatgccttggttgttttatagtcagatgtctccagaactgatcagcttacgagcacaagcaaaacaatattaactactgaaattcgctacccctcactcccactggcaaggaaatgtctcaggtccattccatgaacatcttggtcaatcatttctccaccagtccctcagagaagtttttgaagattaatgtcttgtgtgacactattaatgtgatactgttaatcattcctcacgaagatattttctagaattttaacttagaggaaatactgaaaatgaagacagccttttagagaaaagtgtcctggtgcaatggaaaagaacatagattcttatgttaggatcttggctccgttattaactagtcatgtgaccacttaaccttaacctttcccagcttttatttcattttctaccaaatgtggacaataatgcttttatcaaaggacttttggaaaatatgatgaacagtatctggcacagaatagatgctcattaagtgttagctatttgcctattcttttttgcaaatgttagacaatgtcaagctaacatagaacaatatctaccaaatatgattgctattatccttggggagatgacagaataaattttcatgaataggcctaaaaataacattccatttcatttcccaccacctagtatgtaatataaaacctcacatatttggcatgaatagttttgaattcatttcttgaataacattgtgtattcttttacaatggaaaatattcaactttttaatttttttctctcttcctctatatgttctgaaaatagtacttgtcttgtcactttttctgcattcttaaaataagacatattcacttttcctcaaagttaaatattaccatacctgcctcacacattgctccatcacattttcctctatttcctataatgctaattgctcttcctctgacttctcttcagtctataaagaatgataaagactcatctattctaaaattttttttctcaaactatcactcaatatttcttcttttcttcattggtaactaattggaggaataatcacttgatggcttcatttcttgctctctccagacattccttgagtctaaacccttggtaaggcattagcaattgtgcaagtgctaaatctagtggtcacttttattcagatcccacctcatctctttctaaagcacttgattctgttgaccatttttttaattctttctattcttgtttccagggccagcacagcttgctattgctcctttggtcatttcatgtcttgaccccaggcttcccctcttacggagtactactaaatgtgtttcttatggcactaactttgatcctcatttgtttcttcatcttagtaaatgagatgcataatctcatctgctttcatggcctcaactactctttgtatgtagatagctctgaaagctctatatctatctatatctgtatctatatctatatctatatatctgtaaattagtgtatcttctcagtccacaagtacattttaaatttcctggtctgccagaggcatttcagactcaacatgctcaaaactgaaatccttgtatagcctcatttccattgccatcccccacccgatacttcccatcctatgaattctatcctaaaaaatgttgttagtatacataaattttctgtggtaaattcttttgtgacaacccggatattctatcctcttctttctcccacttcacatttcattggtcataatagccaattaattctacttcaaatatgtgtagtgaattctgtttccttaccatctccattgctactgacttacatcatgattgcaactattataataggctccaaaagggatttttaaaaattttacttgcttttgttatcagatgagtcccagcagggctataaattatactgtcaacaatacagcaaagactaaacctcctagcatcatcttcatggccctgccttcatagttttgctactactagcatttccatttcatttttgtttcttctcactctacaaccctaatctccaatcattttgtaattatcgcagaactcataatgtccattcacaactctgagttttgaacacattacttcctttgatgagcatacgtttttctaattactttttcccttaaaaaattcttacccatttcttgatatcactcaaataaaacatgctctatagaacctttcctgatgcccccaaacctagttagttcttcccttttttgcaatccattggctccttgtctttcatttgaatcctaatttcactgtagttgtcattttgcacatctgtatcccttactgaaactataatataggccagtgtctcatttttctttgatctttctgttgatagcatagtgcctgaaaaaatgatgctcaaaaaatgaatgagtaaacagaacagctcaaggcagtcttgaaactactgaatatatatatatatatatatatatatatatatatatatatatatatatatatatatatatatttgtctttggctgggcatagtggctcatgtctgtaatgccagcatttggaaggctgaggcgggcagatcacttgaggtcaggagttcaagacaagcctggccaacatggcaaaacactgtctctgctaaaaatacaaaaatcagctgggcgtagttgtgtggacctgaagtcccagctacttaggaggctgaggcaggagaatcgcttgaaccttggagcagaaggttgcattgagcggagatcacatcactgcactccaacctgggcaacagaacaagactctgtcatcccaccccaaaacaaaaggtatttagtataggaatgttggcataaatgtttatgtgctagccccatttaaaaatgacccagttgccatgtgtctaactactatttcatcgtcacctttttctccacaataattgctgtaatatttattaatataatcagtactataaaattttagtgctaaattatatgtctcaagtttgcagattaccagattgtagctacttgataatttttctatccagccagacttcacaaggaccagttattgtggccacagagtaggaaattactcagtacgttatcatttacggcagaattatgtttataaatcatggccttgagagttttctcattaaatctgtgagtctaaatgcttgtggatagatatgatggctaagcataaatcatactaatgaaatggttaactaaaggtcctactgtgaaacagatttatatttaaaaagattattatttgcagcacttttgaaacatatcagttgaataggagcacagaagatatttctgagaaacacatttgtataagtctgttactcatattaagatgtggctaaagtaagtatgtcataatcagccaggaaactataggaaacaaccttgacacttctattaagaaggtgcaaacataccagtaaaaatgagttcatttattagttctcagatgcctttgaaagcatgactttttttttttcaattttaattttccccatctgctttccaaacactgaagcaaaatgtttggaagcaaagtgaggctgcctagtagagacttatcatggttaaatgcagcacaagatttcctattaatattttaatttatctaccactcttggcttcatatgagcaaacatgagaaacaaagaccactgtcagaccaatttgtttctttccttctatttattctgtcctataaaaggaatgttttataaagattttttcttcattatatcttaagagattattcatctactctaaaattttgttgtcggaggtgatttgtaaacacacttgaacatatttattcagtatattatgctattttatccatattatgctatgctatgtatgtaaaatataaaatcactctaccctcctctactctggaccttttgcagtcaaaaatgtctattttcatactttgttaaacattttaatatagacttatcctttacaactaccataataaatacttaaaaaacacgtaaagatcagagtatttccatagtcattaaccagcacttggcctttaacgtggtatatctgtgtgagtctgataaaacctgaaaaaatatttaaaaacagaaaattattaatcaatattgtgttcacactttcattgttaattataattgaatcaaggtatctgtattacaaaaagctattgtccaacagtaagatgttatatgcttgaatttcataggtaagttaaatacatgctttgtttttcttggtagtcaacatggtttggctgtgtccccacccaaatctcaccttgaattgtagttcccataatctctacgtgtcatgggtgggacccagtgggaggtaatttaatcatgggggcagttaccctcgtgatgttctcatgatagtaggcgagttctcatgagatctgatggttttataagggacttttcctccttttgtttgacactttctccttgctgccactatgtgaagaagcacatgctttcttccccttatgccatgattataagtttcctgtaggctccccagccctgccgaactgtgagtcaactaaacctcttttctttataaattatccagtttcaggcatgtctttattaacagcatgagaacaaactaatacagtagttacgtcatggaaatagagtttactgaaaaacacatgggctagcaaatagttaccctctagaacacaaatacaaatgaaattttaatttctaaatggtaggtatttccttttattaattaaactaacaccatccttcaaaaatttataaaaaattgtcatacaaacagtgatacatgtgcatgctaaagataacttggttcatatctgaagtcaagcagctagcaacttattttatgtgttaagcaccaaaactactagaacagctacattgagatatgattgacaaatcaaaattatatgtattcaatgtgtacaatgtgatttcatatacttagacattctgtcatgattttcataatcaaatccattaacatatctatcactacccacagttactatttgcatgtgtgtgtgtgtctgctctcttcaaattttaagtaaacaatacagcataattaactatattcatcatactgtaaattagatctccaggacttattcatcttacaattcaaactttgtaccctttgtacatctccctatttacatcagcccccagcccctaggaaccacctttctactttctgctttttgaatgttttaaattccacatataatgagatcacacagtatttttctttctgtgtatggcttatttcactttacataacgtctcacaggttcaaccataatgtcacaaatggcaggatttacttcttcttaaaggctgaatagcataacattgtgtacataaaccatattttctttatttatctctcagcagacacttaggttgcttccatatcttagctattgtgaataatgctgcaaaaaaacatagcactgcagatattatttcaagaacctgacttcacttcctttggatatatacccagaaattaggttgttgaatcatgtcgtggttctatttttaattttttgaggagccttcatactgttttccatgatgatcataccaatttgtattcccaccaatggtatacaagggttcccttttttccataccttcaccaacacttgttacctcttgtctttttcataatagccattcaaacagatgtgaggtgatacctcattgtggttttgatttgcattatcatgaggattagttatgttgaacagctttccatatgcttgttggttatttgtatgtcttcctttgaaaaatgtctattcaggtcctttgctaatttttaaattagattatttgcttctttgctatttagttgtgtgagtttcttatatttagatattaacgccttgtcatatacaaggtttgcaaatattttctcccattttgtatgttgcctttttatgttgttaatgtttttctttactatgcagacattctctagttggatatagtcacttgttgatttttgtgaaaaacaatgtcaaggagttttttccctattttcttctaggagttttagagttttggttctgctatgtaagtctttaaactactagatcatttgtagccatttattaataacatatttatgtgtatccagtaccagtcttaattttaacgttagaaagccaaactcggttaatgactctgtatgtaaatactttgaatcaatgattagcatgaacaacaaaatattttgaacgattagcatgaacaatgaaagttaacatgtggaaatgatttataaacatgggagattcatttgctaattatttttccagtgatgaatattataatatcattaattcgttaggtaatcaagaaatatatattttgtgtgctgggcacttctctgttccatagccacaagatagagtctttgctatcagtgagattatatcattaaattttaaaatatgaattggtcatagaaatcactgagctctaaccaagatcttagttacctaagaccacactaataatagcaaagatatctcaatatcatatgctgttgtttcattcagctgcaaaatttatatttcttcttaaaatttggttggtatcaatttcctaagaaacttaacaggtaacattaaaagatgatatacactgaaatacatggccaataacatttctgaggcatatgtatggttttgaatatagataatcacttgccataacaggattatcgtaacactgactcaagagtagtggtgatttttcatcatacagtatcagcctttagaagagaaaccttaaacttttcttcaaaatgtagaaccacttataagatggttcttttaaaccggaaatttgagagactgctttctttacaattaaatgcagacataaagaaatgtcaggctttcatgtccttgaagaagatgcccccaacggaggtgcaaataactttgttccttgaataattactgcaaaacatcttaacctttagctctgaaaatttattagagattttgattagattttaacttaccaataacataaaacgggatttcccagtgttttttgaaagacctgattttgtaatatgtgattaacttgttaatatgttattaaatttgcaatacattacagtaagcaactataaagtttatattgcttatggttttcatctgaactattttttccattggtttgctatttaaagggtaattgtgaataaaaatttatttactataattactttttttcaaaatgtcaaaacatgtttcttatttcggaagatttataaatttaaagattcttataatattttctctctttttttaggttttctacaggaaaaatcttatctcagaggatatatatgtgtatatgtgtgtgtgtaatatgtgtatatatatgtgtgtatggtatatatatatatatatatctcaaatgaatgtcatgtattataaatttcttgatttttaaattcatttaacctaatttatgctttgcaattacttactacttatatagtaagaggtttcccaatctgtcaggtaatgtgaataagtaatactggtattttatctcctcagaagattcatggagctttgcagctttgtattatctatgagacgagggcctactgaaaaatatagtgacatggaaggatcctgaaaacgtttcattctccttagatactctgtaatgaatgaacacttttttttttctttcccatatctctctcaatatcatctcattcacttgaaatccttccaagttaactgaagcataactggttctttatctctattctgtgatagaagacttcaaagtcaagaaatttaaactttttgttcatggccaactttgtcactttccgcatgatgtaggaagatttcccatttaccattaggtgactgacatacattgtatatcagtaacacataagaggttttctttctgttagtttaccaagagagtattttttttaaataaactttatattttagaatactttaacagaaaaattatgaagatagtacaaagagttctcatatactccacatccattttccctattaactaacatcttacattagtatggtgaatttgtctcaattaatgaaccaatattgataaattattattaactaaaatccatactttattcagattgccttagttattacctaatgtcctttttctgttccaggattccatccaagataccacattatatttaatagtcatatctccttaggttcctcttggctgcgacagtttcttagactaaacttgtttttgaagatcttgacagatttgaggagtactgatcaggcattatatagaatgttcctctatgggaattttctgagcttttttgtttgtttgtttgttttcatggttagattggggttatagattttgggaaacaaaacctcagaagtaaagggccattctaatcctatactatcaacatgatttatcactgctgattttcatcttgattacctgcttaaggtagtgcttgttagctttctctaccaaaaaatattccccgcctttccttatgtcagtttctcctctctatcctcacgtacacgttggaaagaagttactgtgcacatcccatatggaagtggagagttatgctttaccttcttgagagtgaaataaccacataaattatttagaattcttctgcataggagatttgtctattcttcatttactcattcctcaattcatttacctatttaatcattaacatatgtcagtatggattcatgattatttattttatactttgataatttaatattattttatttgttgaatatattgttccagatttggccattgggagctctttcagttctctcctatattccttttacatactcccatcattgtttgtttgttctttttttttttgcattttgtttcttttatgtccttaaatttttacactacaagctgtcccaggcatatcttgtgtagttcctgctccagtactagaatcacccatttctacaaggagattattattattattactgactaatgctattagaaaccacatatgaaagttgaatgtgttcattgctactggtggttggttttaggccctctcagttgacagagaaaagaaatatacgtatataccgtaatacccccttatccttcttcagggatatcttctaagacctcagtggatgtgaatctcaaatagtaatgaactcgactgctggcaatcagaacatgtttctattcatgtcttctactcacaaatttaatgccttttccatcttaactaagcagttatgtactgcagttgtaacttttgcagtttgaggtacaacagtaaaattaacactaatttcctttttcttctttgcaatttcacagataaaagatcttagcaacctcagcattcagttttttttaaacctaaaggaatcacttaatagttttcatttggcatattcaaatggccagcatcagtactcttgcactttggggtcattattaagtaaaataagggttacttggacacaagcacctgtgatactgccacagttgacctgataactaagaaggctgttaagtgactaattggagggcactgtatacagtgtgcatttgccttatatatggaggattcacatcctgggagggatgacatgaaatttcatcacactactaagaatgttgtgaaatgtaaaacttatgaattgtttatttctggaattttccacttactatttcagatcacagtttaccagagataactaaaaccatggaaagcaaaaccaaggctaaatgaggagtactgtacactaacctgtgtatatacacatacctacttctgtatgtaaccataaatatctgtattaggctaatatgagttcatactcaagaaagtaacttttatgtggctccttgttatggattgaataaataaattccctaaaaattcacatgttgaacctctgacaccctgtagggatgtatttggacgtaaggctgctaagaaaataaagtaattaaggttaaatgagttcctaagggtggggatttgacagattagtgttcttacaaatagagacaccagagcgctctgtgtgctatttctctatgtctgtgcacaaagaagaggtcaacgttaactcataccaagatggaggccgtctatcagccaagagacatggccttagaatgaaacttaccttgctgacaccctgatcttagacttctcagccttcagaaatatgacaaaatgaatttctgttgtttaagtcacccaatctgggtattttgttatggtagcctgagcaaactaatatactccatgtgcactattaagattaggcataaattttaaatttataagctttaagattatattaaaataaggtggtcatgaatctgaatactcacgtttttattcagatttgccaaagaagttttaagtgaaatattaggcaataaagaaaaattaaggtctaattagtaagtacttgtatcaggtaactttaagaaagtaaaacatgtattagttaaattaaatttgatttttaaaattatcttaacccaaaacagtgttcaaactttcaaatttctgaaaataagcttggtggctcacaatgaaaagctgggtaatcaggaaaataaaatacgtcctttaaaacagatttcaggggaagaatctaaattttatttaaacaaataaagtaaaagttacccttattctaattaacactttctgttgaaaacatacacatattttattacaaggctggaggtaaaattatatcagaagtatagcaaatgttctaaaaacaacataagaagccaaatgagtgaatctttacagcttactcccttttttaataccatttttttcttgaaaataaagtgtaactgacagttctgtcacaaaaatatactctatcattgtaacataaatatgcagtgtagttctacgtattttaaaatggtagttgttgaggagaaaacagctgttttgaaagtacatgaacaaccaaataactacttgaaacatactttattgcaagggtagctatgtccaaataatgaagagagatttttaagagactattggagcattctttttcttggatccttctgaaggggaaaaaatgacttttctctcaaaagtaattatattttattgtataaccagatggtagtatgtgtcatgacataaaatgtagaaaaacactaggtttacttcaaagagaagcttaatttctttgaaatatttctttacaaccagggtggggaacacggaagcttgtctgtgactctggtgcatcctagaactctgatcagggcttcgaagcataattcagaggcaacgcctctctctatgcccagattatggccccattttcacattgtaaagcctctctttttagcctattgacaattatgactttactactcaggaggttggattaattttctggaaattaaattttaaaaaagcttcctaatattacatgatacctcaggttttttgtttgtttgttttgtttttggtaatgaggactcagatgatctcatcgggcacattctcagctttgaggtcaatacctagattattaaactaccaatcatggccagttaatggggtttagagttatgaaacagaataaattctatgattaacaaaagggctataaaatctctagactgctggttctgcaccatgaacttgtactcatattacagttcaggtttatattctgagtttaccattttgactttatatctccttgggacaaatgttctcacatgacctttaattactgtactgtcagtggaacctaggaaatggacatcattagcagtcttgcctgggtaattaagaagtaagttcagagggataattgctccatcattatttctctttaccttctgacaaatttgattttttaaataattgagttgaccatatgttcaaatatatgcaagtagcaatgcattattttaatttagaaatttgtatacacacaaaaactatgatcatttattcctcctcctcctccaccttgggaaagaaatggggatagagtgatagtagagttctaattatttaaatcagtttcagattgatgttatagatctattttgcattcacctcctgggatttatgcctatgtcagttaagagagagaatgtagaatgaagaggactggagcttttcaaatgtggctctgattgcttttgacattttaaataaataagaagttttttgtgttatcctactgttccctaagggacttacgtagatgaatcaaggcaatgcagaaatgaatttgaacaaattttacattacttttgattgtcctagaaggaatccaaaagcaaagcctagactaagtaatatgggaggttctagaagatattaaaatgtggcatgagacagctccatctaaagcaattagtgttaagatctgaaatctggggcagtctataaaacttctttaactgttcaaatctctgcacctttaagcagactgacttggaaaatgtatttcttcctgaaataggtctacaagagttaaaatgcactgcatgttcatagctacttctggcttcagactgtaatgatatggatgagagtcaggggccacagtcttcccaaatttctccagaaatttcccctttatctccagagcctcttggtcttgtatcaaagattcagaagttcactgttaattggaagcctagagtcagactagaatttatgataaaataatgataattaaaataattgtttctatttttctgcaatctttataggccagaaaatacagagacagagatatggttttgggtcttgcaaacataatgaagtagaataagatgaatgaaaaaacagaaaagaggccaaatcttacttctccccatcatctctggatgagtccttttagtccatgatgagtttaaaacattgaaacaaaaaaatcccaataaatatcaccaaaattaaacaagtatttatacttattaaatgttattgactatcttccaaaaagacatatagattgggaacaggattatttcaggtagtttccacagaaatatataaatataattaatcccagaaatataatttttagttaagagttacacattattactaactgtaaaccactagaattcttcgttatcataaaaaataataaaatccaacattgatggttggttaaggagattaagaaagtttctctttgttagtaagaaggatagaaaaaatattggaaaattcaaggtagaaagatgagagtaagatattaatataagagttaaatgactagcttaggacattggcagtggggacttacacagagataactatgtgtcatctactgttttaatactttacatatagtagatcatataatccttacacagccctataagataagtattcttccgttttatagaatttaagagctattttaagtttggtttggataattcccagcacaatgtgtgacacatagtagatgctagggaatatgattaaataaatcaatgacttaaaatgtgagagacaatggatgggtaaaagaaaactccacatttttaatcttgggaaactgggagtgtagtggcactgatagaaagagtgaagtcagaaaaggaagaaagtttgaacttaggcagttgataaatttagtatgaaacatgttattaacctaaaggtttcagaaatagaattgaaagagaaacaaatgcaagcagagttttatcttttattttttttggttctccatggcatcacacaaaattttaaacatcctttgtacatgaaaagatttgaatatatgctgattccctggaatgcttatttctgattctctgagacaaatctttgattcataaccttttctttttaaactagatttaatttctcctgtgaattttaactttcatggcagatggaatacacttaaaaagttgtaatagggtaagatactggcttaaacgggacagaaaagttaaaagaacatttaattataaaatgtctaataaccattttcattgactttttttggaaggttgcagagggaacttgaagtgttttgcaatgctgcaaagattatgataaccaaatcagtagaggagcaataaagaagctgaagcaggagggaaaagataaggattattgaagggaagacaagagcatgcagaagaaaattcccttagcaatgggctgtttatatttaattcctcctcttctctgaattgtcctgaattatttacatattgaataattagaagtcaaaccattagctgttcaatagaagttcattataaatttgtatataagaaaaagttataaaatatgattataccacaaggcagttattaatcctgtcagcaataccagcttaaaaatgtttccatcacaatgagcatgaaataaaaggagtctatttttcttaatataaaagacttaaatgtgtttgctaattaatatactttaagctgcatggcttctttgccaacttcattattatcctaatcatttcaggttctactataattataatgtagatcctgactattggcagatgaagattatggatggtaagaaaaactaattgtgtctccagcaaatatagggaggtgaacggtaaatccaatagaatagcaaattgattgatcactacatagagtattaattttggtaatgaacatgatattttattatttcaatattagttaattagtgaaaaagcaaatatgcagaaaggtagatttacagcagtggttatcaaccaaagggtgattttgccccccagaggacatttggcaatgtctggtaacatatttaatgattttcaagggctgctactggcatctggtgggtagagcctgaggatgctgctaaataccttataatgcccaggtcagcctgcataacaaagatttttccagtgcacaatttcaatggtgctggctagtgagaaactctgatttctagtatgaagttcttacagttatttgtctttaaatttttcttatttgggatttaaatattgctatggactgcagattatttataactctcaaaagggccccttccttttttgaaaggtcatatgtgcaaggtcatccatacacatcttaatgattataaaatgataacatcagtgacttgtgcccaaagtatttttgattaaaggtgaatttccattggtgtgatcttattattttctccattttatgtttataaatggatagaatagacacatatgtgggatgagggaaaagacacgcatgtgggatgagggaaaagacacatatgtgggatgagggaaaccaaagtctttatgttcttgagcaacaaaaacttcttactgattaatctaacttgaaaactaagatctaatttatacattttttactctacgtgacagctataggcctaaatattcctccacagtatgtacatagttaactattatctcgtatgctgttcaaattgtaaaaaagtttgttactgacacacaatttttaaatttactactttatgaatctgtttaattctgtccacctctatggccactgtcccatattctcctcactagacatgtttggtctcttgccttcttccaatccatgagctacatggtacttagactgacttttaaaaatacttagggtatgtcatgctctacttaaatttctcaagtgatttcctttgtacttgggataaaattcaagatacttaaaatgacctacagggcctctaaatagtccatcccctgcttctctggaactaatttgtatacactattttgtatcttaagctcctccttccagatcaatgtattccagtgacacaaattttacacttccttccttggaagctttgaatatgctgcaatctctttttagacagcgcctcttcatcattatgatctctgtctaaacgtcattttgctacataagctttccctgacagcaatggactgaatgtttgtgttccccccaaattcatgtgttgaaattgtaactccaaatgtgttggtagtaggaggttgggcttctgggaggtaattaagtcatgaaggtggagccctaatgaatgggattagtgtccttataaaagggacatcagagagctctctcacctctgtcttctgctgtatgaggatacaatgagaagtcagccgttggataggtagaaggctgtcaccagtacctcatcatgctgtgccctgatctcagactttcaatttttagaactgtgaaaaataaatttctgctgtttataagccatacaatttatggtattttgttatatcaatccataatgactaatacagtaactctgctcattgaaaattaggggtacttgctttaatcttttacgcatattgttatttatatcacttaattataatgtgcaattatctacctgttttgtgagtgcttggataatacacttttcccactagagtgtgaactcaccaaagcaccagcactatgttaatattgttcatctatgtctcaatggagccttattcagtatctggcacaaagcaggcactcaataaacacagaagtctttcatataatttaagattcttgtgattaattaaccttttattattcataataactaggtacaatctttaatctcctcagatgactaattttacatatatgattagaactatgttaaagttttttctcaaactaaataagatataatttttgaggatgcattgaatttaggcaacataatcaagagctgtcaaaacagatttcatgctatttttagccagagactgtgccaactgaaatgtgttccatctcaaacaataataaggtagtttacctgtagcattaggatagtgagacaacataccagcagttctattctaacaacgaccatcataaagatggtggcacagaactagactgagtacttactttaaacagtgagaagcataacagtggggatacatttcgttaccttgggaaattttgtggtactgcatcaagctactaattcacatttacctgtgttgttctgtatttacataatttgtcatttttgaatctcgagttcatcattttactttatcccttgaatattgcttttactgaagccgacttttgatggaacactaatctgatttgtctcaattgtttattgcattgagaaatagggattactatggacagaactttcatctggctataaaattgtattgattgcactaattataggtataatggtcatttcaaagaaaggaattgctgtaatgggtcctaaaaactctatgcattcataagagatatgtccctagaatttcccaaattcatacttttgtgaataacaggtcgatttcacaaatgtccagacaacatctagaaggaaactataatgagagcagaagctgagtttaagatacgcatttgtttgttgatttgctatgttggttcattcactatttaaagtcaagttactgatcagcctgccgtggctgtaattcaaaacacatctttagcaaattgataaattataaaatatcatggctctttcatattgctcatacataagttataaatgtcaagggttatctatatggttactaagagcaatgcaattggtttcagaagtcatcaagttgagataaaaagctttcatcacaattgctgataatttcttctttttttaaattgctttttttcccgaaaatatgttatggcatttccttctggccctatctgacaggaattatcttctatgtccttttggcaagttaggaaagttagcttagaagaaatatgtctcttctattgcatccctctaccatgtcatacacacaattgttattgataggcagctctctttgataataattattttatttttacccttctccagctgcatatgcaaaaccacgtgtgaaagtggatgagatgtacaggacaaagtttatgcattttaggttgcagataaggcccatgtaacttgattcctgcttatatttccatgttccgccttccccactctcccacttttcattttttgttccactaatattgaccacatcatgttttgtagttttttttttcttttttttttttttttgtctttcctggtgttctgtcctttgccttaaacattctcccactgactttcattatttttttaattggttaactcgtatgtatgcttctttactcagctctgatattacctttttcctttgaagccatccataattcctcatagcagttcctcattatttttttaactagttaactcctatgtatgctcctttacttagctctgatattaccattttcctttaaaaccacccgtagtttctcatagcagtgtgatgtaactcttctgcaaatctctagcaccctgcacagacatttttgctgaacttgcttcactgaattggtatttttagtttacacatctgctcctctctttagattctatgctattcaagggcatgtcctactatactgcttgtcagtaaatattcattggcttcataagagaagaccttttcttttctattttttaaatctaatttgcaaaggcattagcacaaaaattaccccccaaatcaatgagggagataatttggaaataaactgaatgaagccaaactacaacatattcgcaatgcaaacagactttctttgccttcagtccagttccccattatcctatttttatacatcaataaatactactaatgataatgatgttaataaattggtttggtttgtcattctcaaatatcccaaaatacacaattggtttcataaaagacatgaaattttaaaaatcacatatggggaatatgacaaatttgactacagttgacagtagtaaaatacaattattcaagtagattacatgcatgttacatgtgtattttctatgtttctcacttttacaacaaataattcttgggacaaagttatgccgtaataacaataacttttcagtaactcaatacgttattcactattgtaaaaagctatcttacaaaatgatgaaagcctgctgtgatgtggttatgtggattttactaaatgttttgaataagcctatcatctacaattagattcaagaaaaatgggaacagtcaacatgtggattggtattgagattttaatgaaaacacaaaagtggaaatttggaagtgcacatccacatttcctcagcacatggtacttgagggaatcctaaagtgaaccaagatacagtaatcactttcatggtctcagataaaaagtgagaatgctgtttacaataaggcaaacaaacaaacactggcaaccacattgcccttgtttgtagattatctcctaaacataaaattcaatatttttctgatgtaatgatttaatttccctttaaggaatacttataaacagttaaaaagacagattgcattacggggcttctagcagtaacatttgttcctacttctttctactctccaactgggctcaaggagggaaccctttccaactcttttagctattgctactaatttttaccttcatgttctaaaattgaagcaattaattcattccaaaatggttattaatatctcccattttccaggcactgttctaggcccatgattgagcttagaatctaaaaagaagttccctcaacaatagattttataaattagatcataattggtgacatatagtataatagaggatgattgttatgggaaaaagaaaagaagactaggatgagatgaatggggagtcataggtgaaaaataagtttgtaattttgagtaaagtgatcatgataatctttcaaagaacatgacatttgagcaaagacttaaaggaggtgaagacattcccatttggatgtttccttagagttcttttttaatctttgtgcatttgcaacttttattctctgcttttcctattttagactttccttaagtatctgttgatttttgacaactcatttggatttaaggatgtggaacttggagcattttagatgctctgtgtacatgggcaggtcttattggtgggcaggattcattttatgataataaagtagcaaactaatttctgttggaaagctccaaatattagtatcttattttctctagaggattcagtttctctagattatatatttccctagaaatatataatatatataatactatataatctctagattttatatgtatattttcttaccttggagaataagcctggctgctggcctaatggaaaggaaaaagagctgacagtcttattgttcattcacaggtttctgtttaatctccaccctccaacgttcttggtgtccttgcatccaaggcccttctcaataatctctccatgaaaggataggggagaatttttattgctttggaatcggtggtgggttagtcacttggctgcacaggatgggagtctgtaatctagttgccgaactgtgctttaaacagatttgtccactagttcccttagttttcggtcaatacttcacgcccacctgttagagtccctagtcccttcaattcctgagcctttctggaaattggtggaaaatcaacttgcttctcatctttacctcctctttctgcacatttcagcttcttttgtctcactaatacagtacacatatttcagacattccattttccaaaattgtcttcgtaactcttacctagctgcagtttcattttctattctgtcattgtagatatttactttttttgttctttaacagtaatcttggtaggttttccagagaaagcagcaataagatgtgttaagtgtgccatgtttaaacagaagacagtaaaattcaatcaaataaacatttatttgggctctatttagtgtgaggcactgtataaggtcttaattggaatacagatgttattaaggtaacctatctatgctgcagagattcagtttagtgtggaagaaaaagcacacccttgcttaactctacctcaaatcagattgataaatgccatgccatatattggattcaatagcgcctctctcttctgtctcaccaatcacctttaaaagaatatgtccacctagaacctcagaacacagtgtcatttggaaatggagtcattggagatgtaataaacttaaaatgaggtcatattgaattaggatgtgctctaaatccagtgattagtgtttttataagataaatgagagagagaaagatagatgtagagacacaaaaaagacatggggaaaaggccatgtggttgtcatgtgacaattagaagaggccatgtgccaatcagagattaaagtgaggcagctgcaagacaagaaactcctgaggccaccaagagaggcaggaagaatttttttcctagctctttcatagggaacacagccctgctgaaaccttgattttgatcttttagccttcagaatgtgaaataataaatttctgttgttttaagccatccagtttgtggtattttcttacagcaatcataagacactaaataccagtcataacaccagtacagagtacaataagagaacatcagtagaacagagcccaggaaatatgaagataagaaccctaccaaaaccttggcagttgcctttggccaagtggaaattctatgagtaaaaacatgtttgacattattaagctatctggcagaaactcttgaatatttaagggctgattttccagtgaagatttaaccacatgtacatatttgcactttaaaatgacatgttttctcggctgggcgcagtggctcacacctgtaatctcagcactttgggaggcctaggtgggtggatcacctgaggtcaggagtttgggaccagcctggctaacatagtgaaatcccgtctctactaaaaataaaaaactagctgggtggggtgtggtcacacctgtagtcccagctacttgggaggcttaggcaggagaatctcttgaacccaggaggcagaggttgcagtgaaccgagatcacaccactgcactcccgtctgggcgacagagtgagactccgtctcaaaaaaaaaaaaaaaaaaaaaaaaaatccatcttttctttaaaatcatcaataatatcctctgaatatacttgagaaaatgaaggcacacatttttagggtcatgcagccattatttatgaaagaaaatggaatgctattgaatgcattcttggtcatgaattttcttcatataaatagaaacactctcatttttggggagccaaatttctaactttgttagcattgagagtaaattttaaagaagtattccattttactattataatccaaatcgttagcaagattttctcagctaaagcaagagtaatggtgtttggcatgtacatttgaatatctcaaaagcagagattaatgcttaagaaactgaagtctaggaagagacaaatcttatttgacaaattctaaagacattctcaaagaaacaaaaagtgctggtgaagtaagattcaaattgttaacatttgttcagcaattacatgtgaattaaccagcctgtcaatatagaattgatgtgcctgagacatttcaagtaagctttgtaatctaatttttaaaagttaaccaaaagctttatggaagctaaactcgggaaaccagctatgattgcaaacacatggcagttagctgaaaattgtttggatggagagaaaaacggcttcatttatcacttgtaagatcaaacatttccacttgagtagctcacactatataaatttggttcagtttctctcttggaggctaggcacgtaccagcaatgctttctttcaagcttagaaagtgaagaaaccttcctttattctgttttaaaattccacagcctcatccaagcctaaattttagcttacctccattcctatgtcttttcctgcaccatctttactcataagcttaagggtacgattgctaagatagaaacctgaaagtcttctttagctatctctcatccctaacatccaatcagtggctgtgctgttatatcactaatctcatgtctttgccttttttccattctaactactgttgctttaggtagaatcccattatttcttgactaccccagtggtctctcctagacaattctctatactggtgccaaagtgatcattctgaattacaaatccggtcaagttaaaccttgctgaaaatccttcagtaactctgcataactttcagattaaaattcaaaatccttagcttaacacacagaaaaatttatgatctatcatttgttaattgaccagtatcatcttcccaaaacctcattgcacttcgtgtctgttctagttctactgaaccaccagattaaaacctgggagcacattctgtttgcctccacagcgactttgcctatgttctccccttatgcttgggataaccctccccacgctgtgtaatagcagacaagctatcctgcaaaattctattcaaatgtcatctaactgggtttatgaactctctaggtttactttagctagttactcagcttaatatttgagcttatagcctgtgaacaaattgatgaaaaagagaatgtataactgtggcattttgaagtaaatttcactcttaccatgtgtgatctaatttgtgttaggctctttttaatgcgtgattttgggcaaatacctacctaatcctcagattgtgatcaagtaatatcaccaactaatgacacagaactcatattcattttcagatcattcatgatttcatgacacaaatcctagaaacacattttaaacggaacacgtgtttgtatacttacaggcagtccagattacagatatgagaattgcaagaatattgctacaacatgttaaacatatactataatggtctttggatggccaaaatactaatcgtctcagcatcatttaatatcatgttacttattgaagcatcatttcttgagaataaatcattggaaagagaagcataagatgaactttgtactgagattcactttttgtgattcttcatctgctctcatctggaatagagccaacctattaaagactggtatttgctatctagggttgctatttactatcttagccttatcaatggaaagaatcccaaaatggattgaaagtagctttatcttctatttaccggcacctgattaaaatacatatataattaggcacttatttttggaaagagttattaaaatggatattttgatacaatttaaaacataatgtattctacagatgaaatattttaatgttgaatttttatcacatgaatttatttaaactacaaaattttcaaacactgtgaagcatgctggttaataagcattagagacccaaaatatcattacatgttatttaaagcagagtcttcaaactattgtggtgagatttatatactagcacattttccagaaatatcaggtaatatttaaatctcattaatagcaattatatgagtgatatattaaaacaaatcatttagctgatttgttttaggcatttatttttcttctcagcctttctgcaatgtacaaataaaaataaaaaaccaagaatttatttgaaaatctttcctccttcaaaaaagatattattttatcatgaagttcatgttgtctaagatgtagccctagaatgatttggtgccctgttcctgcctgaactgtatgtttttgtttttttttttaatttttctttgctctcccctatctcaaactcagcacaaatactccagtttcctaaaaggtatagatgaacagtcagtaaatgaatggaaacattgcaaacaaaccaacaacaaaaaaaacaaagaatgtaatctttcaggagaatgtcacaagccaacattatgtgctagcaatgatgccaaaactatttcagctgctagaattgtctactttaccttatctcatacgttcatgtgcctgcattaaaatacatattctaatgtttataattttggtgtcctcagcgcaaatatttccactttattggtctcatacagccaggatgcatttctttgaggctacagatttaaagaaaactctcctagcacatcaaagagagactctaaaagaatactaacccaccatacacagtataatctgtggctctccatcttgtctatgctatcctgtaaaatttttgcagagaatatttgaaaagaatggtacaacgttattctgctaatgtagtctctcatccatactgccacagcatcttaggtagtaagaatttcactatcgtatttgttaaaattagaatttccaaacttattctttttactccaatcttggaatagtggctctattcttaagtcagctcagttttaatatggagtaatttaaataggactctgtctgcttgaggtggatcatggatttcctccttataatggtgtgaagatttttttttcccttacataggattaagtttaaaatcatgttgtagggtttggaagcttatctgaaaactttctcaactaccccagaattctacaaattgaatgggaaaataaaatattattctgaaaagaaactttcacagaggagtccctgcagatctcatttttttccagactgtgtatactaaggcagcaaggtcacataggtcgttactgttttggatctgctgatgtttgtgaagtgtggcttggagaggaaagtaggaggacagagaaagcatttggggatttaatgaagaagcatattagcatgtgccatagtgggggcaggtttcaaggcagcatgatggaagacacacaccttgcagtgctgagacttttatctcatttccacacctgccttgtcaccaatctgcagactagtagcatgtggccctgcttggggtttcttctctcttgctccttacccattctctcttcactggcctgtactatctacaagtgaaaggtgctgaaggtaactgatcctctgttgtatttctttaaaagaaatcaacaaacctgatgtgacaatcatgtctttagctgaaaaggcagaaagaaatactttaatttgaaatgtatttaatgagccgttattgaatgcctactatatgtaaagcattttcacagataatctcacattctgggccaggtgtggtggctcgcgcctgtaatcccagcactttgggaggcggaagcaggccgatcacctgaggttggaagttcgagacaagcctgaccaacacggagaaatgccgtctctactaaaaatacaaaaattagccgggcatggtggcaaatgcctgtaattccagctactcgggaggctgaggcagtagaatctcttgaacccaggaggcagaggttgtggtgagccaagatcgcgccattgcactccagcctgggcaacaagagcaaagctgtgtctcagataaataaataaataaataaataaataaataaataaataaataacattctcggtgggaggcccatcttaaatatgaaagtgagtgctcttaggagagtgcataattcagcaaccttagcaaattaatatgagtactgcaattcaaacccttctctgagtccaagtttgtacagggcaaaataggaaaaggcaaacgccagcaattactagaatttattgtttgtttagttgctttcatgaaattatctcagaacaacacaatgaattagctgttttcattcttagttccaaagaaaaactaaaagttcagcaagattacataagaggttacaaaaccaggaagttgttgagcaggcacccatgtcaaacacaaaatcattatattatgttgtcatataataaaagatgtattgactctcaggagaggtctgaatattatgtacagctaccagcatattaacaactaaacaaaagaaaacactgataaatgtcaaacaaataaaacaaaatcatccccctaaaacttcagacacaaggctactgctccaatgtctttttattttctaagttttgaaggtctaataatcctgaattacattaacaggattctccccaaaacccctgttgcagagaaaataagtaaaggttattatcattttgcttaaggagaatttagaaggatgctttcttgcatgtgattttctaaacctaccccataattagctataaaaatgagattaaaaactcctctctgacaaccaaatcgttccttaatctacaatgttatcattatagaaatttaaggcttgtagctctaccattgttttaaatagaatacagaatcactctcctctgtttgaaaaatcactgaaaccaattgacctgtactttgcaagcaattgttttcattgactgtatcctaggtagataaaaatagaatgtttaaagcaattcattaaattataatcagtaaacaatattcctaatcttgcacattaactttttataccagtgtcaataataggttttaagatccattataaattatgctaaatgtagcaatatacactgcagttttaatttgctagtcctgtttattctcaacaaaggaagtgtaaatgtagtatcttcaatgtgttttcaaattaaaaattttaaaatccctcacatttagttagtgcctcacagatcataaacattaagcttgatttcagcaaatcaaaatatttcatttgatcctaaaaatagctaactgagatgtgaagtatcagctttactccacccgtttaaaaattgcaggaactgaagttcagaaagattaaataatagaggtagaatattgaagcatctgggattgcaacttgagtctaattccaaaaccatgtaaattcaacgcataagattaagaaaattctatattacaggggattttaaaagttgtttagtcaacacagagactgacttctacattgtacagcatgtctttgaataacatcattttgttcaacatcatcttcttttaatgtagaagagaaaaaaatgtatttctggcatggggctactgtctgtgtggagttttcagctttccccatgtctgcgtgggttttctctggatactctggtttccgcctacatcccaaagatgtgcatgttaggtgaattggtgtgtctaaatagtcacagtgagtgaatgtgggtgtgagtacaccctgtgatgggatgtcattttgtcccaggtgggttcctgtgttgtgccctgagctgccaagataggctctggccaacctctacctaaactggaataggcatgttagaaaataaatgaatgaatgaatgaacacaaattattgtcaaataattcataaagtatctgacaatcatacaaatgcataacaataaacaatgcagcacaaaagcactcagcaagcctgccatacttgtgattgtttatttttgaactacgtgttagtcgcaggacatcctcacaagttttgctttgcaaacatgtattccttgatttaatccaccaccactatggctaccattactcatggattgacacaaaattaggtaaataattatctcatttttattaatctttcttaagtgtatatatagctcacatttatttcaatgtttaatatttgatgcatttggggtctttattttgaagttcggtgatgtttttgtgaccaaaaatatagcgtaggaacctaactctatctcaattagcctatgataaacctggttttgctgtgtgtcataagttgcagtttccggtaagttactgatgatgttaaatgaggacttaactgtatttgagaggagagcaacaagattatttaatataaatgtgttgaaatatgtatagatgatctctctgttggaccagttaagagttagaggagagtaagttcagaagaaaactttattagtttgtggtacaattgtacctgaaaaacagataattatctattgtcttgagttcacctggaaataaagaattagcgtaaataagtgtcagatacagaacaagaaacttgacctcagagttcacccagcaaaaggttgagagatcctggtaggaatcatctaatgatgaaatctagcctctgtttacttcttcttataccagtgttagagtggaatccaaatctagctgctcaatgcacaatgcagtccatctctcttaaggggaggaggggtggatgcctattaggtatagtaattaggaagagtgttttgctgttggaaggtcaggcagagaaggtgtttacattatatctccgaaagggcttctgataaaaatttattcaaaccaatgcctcagtccacaggcaaagaataacaatggttcttcagctaatcaattggaatggtgcttatggcactttaggaagatttctatatctctttaatcctcatacaaaatttattccaatttagtttcacgtgttgatttctttacatattcaggcacacaagcatgcacatgtggaaacaagattcctttgtctgtggattctttccatgtgctcagtatattttaatgttcaaaatctagctgtcatttagctagttaaatgagcaaagaagctgttttactctaacaaataagaggaaaattgtttatttctcaacatttcctgcctattgtcagtactagcataattttcaccattatttgtttgtttgaaggtggtggagatattggcatgtgcattattaagatagtctgaatatggtaattttcataatgagatttattgtatacgcctcctggaataaaaagaggactgctctattctgaagcatttaaatggctgtaggatagtaagattccattatttttaacggaacaaaatttgtattctgagttcattagaatactgaatgagttgaagaaacaagttctgttcttacatcactcatgtaatgaggtagtatataaaaaattcagttctgtggtgtcaaacacatgggtggaatttaaatggacataaattagtagtaaatgtcccatcaaagaatgcaggtgattttttgttgttgttgcagtttttggtagtttatgatttcatggcacatggcctggcttgacaaaatgttatcaaatgaatatagagtagcagcttaacatgtgataaatgtaaaaggcttcctgtttttccctcatgtctccagtgcctagtatagtgttttgcttatggtaggaaggtaataaatgcctgttcaattaaagtgaaagaatataaatgcaatgggattgaaatacaacgtgtgaacaatttgtccataaactctgagccagtgtcgaaatgaatggtttttattttcattctctaatttaacaaaacgaatctaaaatatctctagagctatttactctgttttatttatttttatatatgtttgaaataagctgatgaaataccataggcacaaaggacctttttttcctcgtcattgtcttctttgtttctccagatatccatcacatttattacagtaatttactttgtcaatctcagcatcctgatcttgcctttctgctcattccagcttcttatacaatctcatcaccaaatatttataatacaactcacctagattttatttatttttacatcaacattttaactaaggccaactaaagttgtcatttagaattttcattgatcttttaccacattattttacagtgaacatatttcccctttcttcttctttgtagctctttttcagcagcaaaagataaagaagctgaatttcaccaagcttattgtgttgtaatatataactcccaaaactttttatatccttatctgaagtattttctcgtatttgatatacagctaaattaaaaggggagttacaacttattgaatgctaccatatcactgtgattttctgtatgtgtgtatgtatatacaacttattattgacaatattgctacaaagtagatattactatatgccagtaagttaaacacttatctaggataattaggtttttaaaaattgtagaaaaggaattttaagagcctgcccatccaattccaaagtctatgtttttctatataccacacattaattccaaatatagttttgaaatagggctgagtgaaaacctagtctgatgaaattcacttttttgggggccactgaatttttgattccctaaatatactgatttattgacttatggatcatgctttatatattaactttcatctcataataatcataaacacatttgctactgtagaatattccttgccagtacataaccgtctaaaaaacaaaggaagaaaaaaaaatctctgtgactagaaacaagttgaatctggggttaaatccttatgtttttcttgttgcttcatataattttctgtattatagtagcagacaacttttttttttttttttttttttttgctacatgtgagatgctaaaaagttacacaaagaacctcagctacggaaagcttttcttgcgaattttctcaatacatttttaattaattgacatatatctgtgcccatgtgaatcttttagatgtccacataaacaaaataaagtataccagtatgcaatttatatcataaagctttatgtttagtgcacatgcctgtccatagaatcctaaagaaaactctacatattgacagtcaattaggatgtgcttgcttgaaaacacccttcatctttcatcttataccactataaagtacgttattctatgagatattcagtccatgagattgctacacaaataaagcatgattctccacccctatgtctccctctcctcctctctctctcccctaccgtctctcttatactcactgtttctaccacagagaaatacaatatctgacaagcaaacagtttcctaaatatgaactgattgaattgcagacacatttttcaggttagaatactttaaaactctgctattagaaaaatcatttatagtacacatagagcttctgaaagaaacttatcctcaaattaaaaacaagacttttattagggtaatctatagataagtcaaacaagacattgcttgacccaaataaaaaatgttggacatgattaaccaaataactctttgtggcatgtacacacaagaccagtttttaccctatcatgaatcttccaatgggcttttgtaggggaagagtaggttaagagcaaaatagcccaatcaactatgccacttttcttccaagaattgtagcatgaaattaagtgagcaaaattggatgcatggaatgatgcccagcattactggtatccacataaaataacgatacatgaaatattaaaataacacaatcagatgcatttcccaaattattgtcatcgtatggtaaataatttcccctgggactacgtggtaattcttttatgagtcttcagtgaatgatctgtgatttggcaaaaactcttgtctcttcactgagaatattgagatcatcaggaacaaactctctgtctctaaagttacaaagtcacttatataggaatctgccctcatttctttctctacaatgttgacaaaacatggcccttctctccttcaaggaaagtgtctcaagtgttctctggtcttttttattcgcatatactgatctagaagcttgtttcaatgtttattttctatcacaatattttcaatgttttactttctactggttcatttctctgaaagtacataagatttctcattcacttactccttaaaaattggttatgtttcaggttttgtcctctgctcacactacaggctttccaagaatggcattactcatgcttatgcttcaacctattactatttactaacagcttctagtccactagcttaagctaaaatcccattcattcaaccacctgctaaatatctcttttcccttggaagtttcacaagcatgtcaaactcaatatttctaaaacaaacttattattcttccttaaaactttgcttttccttctcaattttctatgtgggtgaatgcaagtgccctaggctttcttttaactcctttccacaattagggatgaagttctgtctaccccacctcctaaacgtcacatctgcttgtgcctcataagtcattgctattgcgtctatggcctgcactaattagtcttctatctggtcttcctactcccagtcctgactctctagagcttatactccacattgatgctgatgttatattttgaaaaaaatttcagttttgattgttattccatgttcctaaatcctttaataatttttctatgcaataaagtaaaaacttatttacctgaagcacaaagccatggatcaccacagatataaaatggacctgatcaaaattcatgatattaataatttttttcatcctgatagattatgtgcattttcataataacaatctatcaggaagaaaaacaaacattaaaataggtatttttccagccgggtgcggtggctcacgcctgtaatcccagcactttggaaggccaagacaggcggatcacttgaggtctggagttcaagaccagcctgatcaacatggagaaaccgtgtctctactaaaaatacaaaattagcctgatgtggtggtgcatgcctgtaatcccagctacttgggaagctgaggcagaagaatcatttgaaccagggatgcggaggttgcagtaagccgagatcgtgccattgcactccagcctgggcaacaagagtgaaaactccatcaaaaaaagaaacaaaaaacaaaacaaacaaacaaacaaaaacaaacaaaaaaccaaaaaaaaaaaaaacaccaaaaagtattttccctcaatacttgttaaaaacaagtttgccacaattaaaatacataaatatgaaaccactttccaatgtgctagttaagagtcaggaaagtagtgaacttctttgtaatatctgaattgactgatattttttaaagtcaaataaagaagactataaaatgagattctaaaattccaagaaatgatcatagtttgaagtaatggtatttttgtttcttcttctcacctccaagctccagtttgtgcaaagaaaccaaagtattacaaaatgtaatactactagcatccaaatactttagatctatcctagaaaacactagattttaattttttctgcaaacgatttcaaagaatttaaagtataatcactttttccctttataaacacagactcaaatttcaggatttgataaaagtatctcaatttctaattatagcctatgttttttaatacaacacagacaacatccagacagttgtctacttttaatctaatctacttttatcataatataatattatggacagcagtaatatgtgtactgaagttcacagtggaggtgagctccttgttgacgttcaaatgcaatgataatcaaagtggataaactctctgctcttcatcccacctgcaggcttctagattcatgcattgatttatgccagctcaatcttctgacttttcatcaagatgtgcaatatacagtgccttcattatgaactatagtttcctctatcattataagaaacacaagttaagtaagctttcctcaaacagcagtgattgctttcaagttcctgaacaggctgcaataggcttgacgaaaaggattgatttatcactttttaaatagattcttaatctgcaaatcaataaaaatgtttcacttcagcagtggcacggggtgaatgactcacccttgaaaacagaatgaatgaatgctgcctttcttcctttctttaatatactcagattgcaattgtgcttttgctttgcttgtattacttgctaaattccagtgtttgggagtgcctgagatttcagcctggtttctccataaatcaagtgaggggttgaatgttaatctgctaggactgctattttaacactgccattcttcttgttatgtaataagaaaattaaactcaaacaatctttagttggccaaagataaaaataaaagatgaaaacacacagatgtggagaacattttgtgccaaagtgacacagcatttgttagtttcagactagcagaaattctggtaatttaaatgttatacaatcggctttgtaaattctaccaaagagttaaattaaaatacataggctcatttccccatatgtcttctactcttcatactttaccaagtgtatagtagaatctaaacacctcttcttagaggtagctcttacgtagttcagaagtctgagttaagtactcaaaaattccaaaaagaaggcactttagcctatagtcatcaaaagtttctttaaaattttctaggagtagtgataattaaaataagaaaaaccaaggaacctcataacaaacagctggtctgatttaagtatttttgaataatttacaatttaatttagccagtctctataacaaattttattcccatacaatttgaattaagtaactgcatggttacataaagtccttttttaacaatagtaaagtgaaatagtagtggcattttcacttcaattatatcattgattccaaaaaggaaacttcctaaagatatattagctaagaagttcatcactaatgtttgaaaacttctgaaaaagtacctcatttttgttttaaatgaataataatgttttatttgaaacagaataaaaatcaactcaaatttaggtatataagaattcctttttgtaatgtcaaaaatgttttatttattctagatttagaggcaccatattttatttcttccttttgttcttatttttcccatgttttaataaaaaggacactttggaagacctactttttttttccctcacatatcatcacccatagacaatacggagaagaaggtggtgagattgggtatttggttcttatttaaaagctatgtttggtgagaaccccatatactgggcatgaaacttatacacaaaaagttaagcctattcctgaaaatcctcattttagaaatatattatctaattattaaaataaagtaaggaagaaagcaggagagaaaactaaatattgttataaatgattggggagtcctcctggtctctgttcacacttcacttacatctgtagtacacaccagtcctttacaccgactctctgaggaaaactacccttcccatccttcgtctactatcctcctgatctcacactgcctggattgagtagacctttctagtgaccaatgagtcataagacagcaaaaccatacaagtctaaactcctcttagtttattattcatccttgtagttcaatccagtagacatttccatgggataacacattatttggcttctaagttttctacttttatgatacctctacatatttgggaggagtaatgggagggctcaaatttctcttcaactactcatattttaatttgattgagaatttgtattttgtccaaaagccagaaatgtgccagataagaatttgtcctctaaattacctaaataggctccttcaagaacagaaagtgaacagaccttgcctgcttgccttcaatacctgttaataaacaatatgggtcagtgaatgttcaagaaatagaagccaatgattacagcatcagtgaaaatgatttaatgataatttgtgagtccaacactgagacacaaattaacatcactgcattaggtatcttcttgtaaaatctacgtatgaaataaagatacaaaattcaagctgtattttgatttttctcatgattctgatgtatgtggtacatatactatttgggccctaaagacatttaaaagttatctccaaagctcagaattcattaaaggaggactctgggctgggtgcagtggctcatgcctgtaatcccaacactttgggaggccgaggcgggtggatcacctgaggtcgggagttcacgaccagcctgaccaatatggtgaaaccccatctctaccagaaatgcaaaatcagccgggcgtggtggtgcatgcctgtaatcccagctactagggaggctgaggcaagagaatggcttgaacctgggaggcaaaagttgctgtgagccgagatcacaccattgcaccccagcctgggcaacaagagcaaaactccactgagaaaaaaaaaaggactctgtttttgttaaaatgccatgtatgcatatctgatttttccataaaacacattctaagaagttatagtaattaaaatatttagcttcagagattgaccattttcatttacatctaactttccagtatttagtagcgatgtaacattagcaaagttatttattttctctatcttgatttctacatttgtagaatgggagttgtagcagggtctatgtcatatggttgttgagaggattaaatgagataattcatgtaaggtggttagcacacagcaagagctaaatatatgccatctattttactaactttatggtaatagacctaattaacttgattttgattgaggtactttatcgctctcattaaaatatacattaatctgccatctaatgtttattggcaaggcactctggtaagtattacagtcttaaaagtatttgccataaataattagcaaatcactagaagttctgatttctcaaggcctgaatagttaagcagttattttaattacacaaggctctaagtgtacaggcaaaaccatgacctggaaaatggacatgcttttgagttaaatcaacaaaatggtcttaaagtattgtagcttaaagatgtttttaaacattccaaaccagtagagtcctatgactttcaccagtaaaattaattgtcttcgtattctactaaactttggaacgataaaagctactgattactgggcatttgctatagaccaaggattatatacatgttttatgtatattgtcatacataattcacaattttcctgtgagaagagtatattcattattgtacaaaaaagaacgctaaagtccagagagtttaaataacacatttccaagtcacgtagctagtggcaagatgtggagtttgatttcagtgtacaccttaaatatgtcactataccatgctacttctcatatacctaggtttatgtaatagaccattttggtattatcttacgcatccagcacatttatacagcagcaaatgtctaggagtaacatatgcatgtcaggatctcggccacatgacttggatcactgccctgttttattaaatgagtaaatcagtgcaatgctacaggaacactctagatccttggtatgagggaatttagcacttgtggtttcaaccgttttgtagagacttcaagggtctatgacatctagtaatctgtacttttgttgaggtgaaaatttgaacaggtactactatactggcatgtaagcatgtaagagtgagtcatttagaaagtgtggagacctagctaaaaccaagatttgcaccttgacatattccacagtatttctgtatgcacatttacttgagttaaatgatttttaaaaatgtctattctgttaggtttttaaaaataatatataaaccttccaagaaaataaattactagtgctagtctgaaggaatcactcaaatttttaagttactgtttacaattttttttgcaacattagggtattttgaataccctagggcactttactatggccagaatatatcagaatgatgtatttgtgaaggtgctattgtattatagagcaagatttgaataagattttcctaattataccatccaaatcattactctgtattttatcacgatgagaaaaaatcattggttttattttaaaaaagacaaagacaagacttcatatgatttgttaaatcgataataatgcttacaaagttcactgagttggtttaatcaaatcttttttacttatcatctaattttattcttgaaccaaccatgagagttaggtagaagtacaattatcctaaccttaaggttgagaaaatggaggcttagagaagttaagtaatatgccaatgctaatcaatataatctgatgtcgaccaggtcgtctaactccacattcagtgcttccatttttaatagtctattttctaagaatttttctaacattgttaaccactattgaatgagtatctgataccaattcgagaaccatcatactatcttatctcaaacaaattggcttctttacttccactcataatagagaccatgagatcatctgatttctcttaggcagttccatatgcattctctctcttgtttatttttattatactttaagttctagggtacatgtgcacaatgtgcaggtttgttacatatgtatacatgtgccatgttggtttgctgcacccattaactcgtcatttacattaggtatttctcctaatgctatccctaccccatccccgcaccccacaacaggccctggtgtgtgatgttccctgctgtgtccaagtgttctcattgttcaatgcccagctatgaatgagaacatggagtgtttggttttctgtccttgtgacagtttgctcagaatgatggtttccagcttcatccatgtccctacaaaggacatgagctcatccttttttatggctgcatagtattccatgtagtatatgtgccacattttcttaatccagtctatcattgatggacatttgggttggttccaagtctttgctattgtgaatagtgttgcaataaacatacgtgtgcatgtgtctttatagcagcatgatttacaatcctttgggtatacacgcagtaatgggatggctgggtcaaatggtatttctagttccagatccttgaggaatcgccacactgtcttccgcagtggttgaactagtttacattcccaccaacagtgtaaaagcattcctgtttctccacaacctctccagcacctgttgtttcttgactttttaatgattgccattctaactggtgtgagatggtatctcagtgtggttttgatgtgcatttctctgatgaccagtgatgatgagcattttttcatgtgtctgttggctgcataaatgtcttcttttgagaagtgtctgttcatatcctttgcccactttttgatggggttgtttgatttttttcttgtaaatctgtttaagttatttgtagattctggatattagccctttgacagataggtagattgcaaaagttttctcccattctgtaggttgcctgttcactctgatggtagtttcttttgctgtgcagaagctctttagtttaattcgatcccatttgtctattttggcttttgttgccattgcttttggtgtttcagtcatgaagtccttgcccatgcctatgtcctgaatggtattgcctaggttttcctctagggtttttatggttttaggtctaacatgtaagtctttaatccatgttgaaatagtttttgtataaggtgtaaggaagggatccagtttcagctttctacgtatggctagccagttttcccagcaccattcattaaatagggaatcctttccccatttcttgtttttgtcaggtttgttaaagatcagatggttgtagatgtgtggtattacttctgagccctctgttctgttccattgatctatatctctgttttggtacaagtaccacgctgttttggttactgtagccttgtagtatagtttgaagtcaggtagcgtgatgcctccagctttgttcttttggcttaggattgtcttggcaatgtggtctcttttttggttccatatgaactttaaagtagttttctccaattctgtgaagaaagtccttggtagcttgatggggatggcattgaatgtataaattaccttgggcagtatggccattttcacgatattgattcttcctatccatgagcatggaatgttcttccatttgtttgtatccttttttatttcattgagcagtggtttgtagttctccttgaagaggtccttcatatcccttgcaagttggattcctaagaattttattccctttgtagccattgtgaatgagaggtcactcattatttggctctctgtttgtctgttgttggtgtataggaatgcttgttatttttgcacattgattttgtatcctgagactttgctgaagttgcctatcagccgaaggagattttgggctgagacaatggggttttctagatatacaatcatgtcatctgcaaacaaggacaatttgacttcctcttttcctaagtgaataccctttatctctttctcctgcctgattgccctggccagaacttccaacactatgttgaataggagtggtgagagagggcatccctgtcttgtgccagttttcaaagggaatgcttccagtttttgcccattcagtataatactggctgtgggcttgtcataaataactcttattattttgagatatgttccatcaatacttagtttattgagagtttttagcatgaagggctgttgaactttgtcaaaggccttttctgcttctattgagataatcatgtgttttttgtcttcggttctgtttatgcgatggactgtgtttattgatgtgtgtatgttgaaccagccttgcatcccagggatgaagccaactcgatcttggtggataagctttttgatgtgccgcaggattccatatgtattctcttaagtgaactccacaataactctgatataactatgagggttgaggaaaataaggcacagagaaagtgtgacttaatgaagggaaagacaggagcccatccaggaagccgtatcttttagctttggatactgtgatctttcactcaaatatctctttgatgacaataggaggaaatgataattcatgtggataatagagaataagaatgtataattctgaaattacctatggattgagagaaatttttttcaagaagggtttgaatgaaacaattaacaaagaattatgaaatatttgaaataaaagttgctgtgcatataactctacctttatgctcgttttatcaattagaaaacagagattcagagacattggctgatttttctatgattgcaaagctagtaagtgaggggtaataattataattagaaaacaaatattcgaacccttgatcttctgaaaataaaaaaagaaaaatgaaaagaatataaattaccataaaacaatgtttaaataaaaatgacaagcatgagagcattgaagatttttttttttaaatgagcaagtaagataaagacaaatgaatcctgaaataaactagaaaataaatgtcagggattgaaggtagaagaatctcaaacagaaatatgcaggcatcccacaagatagaggggaaaaaaaaggtattttttcatgatttactagaagaaactatttcaccttataaaaacttttaaagctatctgagccttctggtgtagaggagttagtagacatgagcagcccacttctcttgtcccagaagctaattacctatgtatcaaagcctgtcaccaagtaacagtgtcctagtcactattaggttgggagcagtgtatggctttgaaaataagccacaaagctaaagggacaaagtaaaaagaactcactctgtgtttactaaagaggtcaattgattttaaaacatgcagctgttctgtagtttagcaagaacaatcatatatagattcctgggcagaaaatactccatctactgaaattcttggtaaattattaaacagtaatcacagactcatttatattgagtagaagcaaaaagattaaaaaagaaatcccatatgtaaacaacaagaatgtaaattaaatctgcctctagcagattccttcaattctgctacttcttttggaatattccctgttctagtctgtttttcttgataagcaatcaaagtattaaatatgcttcccatagtgtctaaaacaaccgaaatggaaacagttatttgacctttgttccagtaatttttttccatttttttcttaaaaaatttacgtttgtggcacaacccaagacactaaatgataaatctacaaatgttttcagagaaatttgcaagaagtacatgaaaatataagtagcaaagcacatagtataaaaagaagcacttttaaacagccatatccatgacagatagtaataacatcttgtattcactgaaattttgtttctattgcaagaggtttattctaggacaaggtacaaaatgagaatgtgggaaataataacaataataagactttcctatattgttgtaattcaaggatagagctcaagaatacttctattttttcactggataatacacggtactatgtttcaattaagtccatcttcagcataaaatgtatgatagcatgtacatcacgggtgtccaatcttttggcttccctgggccacgttggaagaagaattgttttgggccacacataaaatacactaacactaacgatagttgatgagctaaaaaaaaaaaaaaaatcacaaaaaaattcataatattttaagaaagtttacaaatttgttttgggcagcattcaaagccgtcctgggcccatacagcccacgggccatggactggacaagcttgatgtacatagtttttgtgttgtctgttgagtcaaaagagtgctattgatgattccatttaaaattactctaaactctgtgaatttagattaagtagatttgaatccaacatgacaaatcaaaaatttaaaagttagcaaaaaagttgagtttttaacacttatatttaatattctatttaccggagctaatagtaaacagggagaatggtaaagttttaaggaagaagagacactgccaaatagtggcatgtaggaccatacatactacattcattcttacatgtagtatgtggtatgtcacttacatgattcacttttagacatcttttgttattgttgtttcatatcaggatctttaaagtggagacagcttaatgaattttaaagtgaaaagaaaatatttccattccatcttattatatttctttaaactcaatttctgctttatgttcagatgcttcaacctggctggtaactttaaatctgtcaatttagcatatgtgtttatattgaaatctcacagaaattatgagcaaaacatggtcaaattttctttttgatcacattttcttttgttgttgttcttgctttttttttttttttttttttttttttttttttttttgagatagagtcttgctctgtcgcccaggctggagcgcacggcatgatcttggctcactgcaacctgtgcctcctgggttcaagagattcttgcatctcagcctccccagtcactgggattacaggtgcctaccaccacatccagctatttcttttttttttaagtggagacagggtttcactatgttggccaggctggtcttgaactcctgacctcaagttactcacttgctttggcctcccaaagtaaagggattacaggagtgagccaccgcgcctagcatttttgatcaccttggttaaagtgataaggagtgaaacttgaagattgcgtaaaaattgacactatgaggagaacactttttttctttctttatctttttgttctttgagaacatctgtcagaaaataatgaacagtgactctgggaaaattcagctatcctcttcccaaaaccacctccaattgtgcagtaatgtatctcagcaaaacttggtaatgacaacgagagtcatcccagtttgacatcacagaaacaggataatatggctggctacttacttttattgtttgtaagttcatgcaaaacaaaacaaaacaaaacaaaaaacaaaaacacaaaaaaaccaaagtctttatttgcaagagaaaaagatttattcagagattacagtctatatgaccccatttcatcttttcataactaagagatgagttttcttcaactttattaatgcttaaagaacacagattccatgccctttactgtgagataacagtagacactagataatgttcttaaaaagcattttgaatgatgaagttggtttttaattaaagtaagtttaatacaattacaattattgctattctctgtctggatatacaaaagccaagaataattaaacagctcctctcatcctaaccccatagcctgctttacagaaaaaccttctatcttctgttagagaatgtcccaaggagggagctagagagaatatagaagaattacatggatcacataattgttacaacaaactagatgaacatccagtttaccattatgatttagaggtttggttcttcacagctgttagtttcatcttcagatactacttcatattgaaaactaaacttgcattaatgcaaatgggttttcagtaaggttccattagctgttaagatttaaatacaatttttgaacacaatcattcatgttctacataagccaattccctcactgagaaattcctagggccctaccttctcagtcacttctagctgctaatccctgtcatgggtaagagaaggtggcttttccttgatttccccaccagttctcacaaagaacatttgtagactaaacaggcttgactaaaaatttaggatggcggattgggtttacgtagagaaacataatgccctttagccatggtgtcatgttatcactggctatcttttgtctcaaactccagaccctgccatgccatctgaccccctgcttctcttttctccttatcttccttgatttcctgacacccaaaatacatgttcattccttacatagaacagttttcctgttgtcttttcccacaccactggcttaatgtctgccttctattctcaaatgactttcctttaaaaaaaagttaaattttaagaacctctgattgaagctgtataagaagaaatacatatacatattctctccacctgccgcagactttttaaaataaggttatcttcaattaagtcaagtacagtaacctttgggatttatattctatacatataattgaaattatgacttcccatcgagcaattttaatgtatggccacattaagaaaaaaacttgtatttaatgtgaaaactaatagtcatatagtaaatacaataagtaatattattaaaagtctgttcagtacatctttaatctttaattgtataaatgtatgatgatgctattaataacacatattgattcatttttattaaattttgacaaagagttaattttgtcctaggataatcaatacccttaaatggaacaaactcatatataatattgatttgtagagagaaaaaagtcattgaatttttgcttaggggaataagtgaaattatctataatataaatattgaaaagtactaattcactttttttctaggaagaaagagacatgggatatttctagtaatattgatttattaaaaatgtcatacaggagcatttttggggaaaagaagagctttttttttttttgaaatgatatctttgcagcaattaacagaaagcttttcctatactaggagctaaataaatgttaatgaacagagtaaatctggtcatttggttgcatggaataaaaaatcctgggcaaacttgctcagataagagtctaagcaaacatgaagacctgcagttgggctgaaatacagtaatgtatgagacagtttcaaggactagctattctattcatgtctcggattgccatgtgataatgcttaacatgcgttctgttctcttctctccaaaaccagctttcacttagtttcccctcttttataactttagcttgcaaatgggttaggtttgctactatctctcaggctttcctgatgtaccttgtctttttccacccccatttccaatttactaagtttttaaaatgttttaaattccttaaatagtagtatgattgcctggctcattctttctcgggataattcataggtggtagatcactggcaggactatgcatagagagacattggattatctgcgcatctaatcctatcaattgaaactggaggaggagagcacaagttttgtaggaataaagatttcccttaaaaggaagtattgtcaggaacaggcagtataacagctctcaggagagtagatcgttatggatgatctctgacctataaaaggggtatgttttacaaattgaaagccagagaataccgtcttgctaagattctcagagtgtaccaataacaacggctatctaatacacgcaggtaacatttacagaatagaagtctcttcttgtttcctgcctcccacctctttcacacttactgtcaatcactgaatcaaatcatctcaaataaataggtgcagtgacatagcagaagaagggcatgcacaattggggctgttttggggcttgggagatcatccatcatgttagacatgcatactaattagttcatgttgatatgcccaacatagcaaattctggggaaactggaggggaagtttggggaaaattaatgtgacctagagttgttgcttgaagaacatccccccacctctttttctctatcaatgggaggaataaaaggctatgctaattacatatttgttccctctctgcggagtctgcatggacagctagtctgttcacatgtagaggtgaggaggatcactaaagacaatgacagagagcaatacacagaaaatgatttcatgctaaaaataccaaattgtaagaatgtggatatctcaaatatatatttgaatcagtcatttatgtgcttgctttcctctgagatggtgaaagccaatttagcaggtggagagagagagagtcagaaaataatcatttccagaaacagcaggtgaatcatgcatatttttatattcacatatatacactcacaatgcagatagcttgaaaaaatatttatccctcagataactagatgatctacatacctcatagtatattccattttgtctagttgctatcaataactaaaaaaataaccacacaatatatttaaattaggatgcaaaacagatacctattatcacactgtaccaaatatagaaagtaaatgcgatagtcgaggaaagataatctgtttcatttatgttggagatgaaaacaaaattaagaaaatagaagtaagaaaaaaaaaaaaaaacctctatactgagcttgggagtctctccccaggattacgttgttcaacattttctagtgatgctaaggatagaaacaaccagctcttgaactttgaagtaattggttcacagctgtgcttatactgagatggaaatatgaaaatacatttgtacagaggagggttttttttttggtagttgtaatgaaagagttgtcaaattaaacgcaaactgctgtaagtaaaataaattacatgtggaaattcaattcctgatactttcatcaagtggatacatgtgctatatttccagaaagaatgctaacattaatcataaaaagaactcttacgctgtgttattctcttatgttagttagtgttaaggaagcaaaagtgatctaaagtgattgttagatatttttgtatccaaaaagcatggataagacactgaatcggtggaacacagagcacttcaagcatttattaaatgtttgagctgttcgggagggacataaagagtacaaagaccacatttctggctgcagagatacttcaaatatacctgggaaggcaagattatcacatttgagagagataatatagaatacatagataatcagaagagcaagatcagtggggctgaaataataagaaaaggctttgtaggtgacatagaataagggcttgaaatgtggctgcagagtaacagaaaggcagaaagaaggcactttagggggcatatgtctgtaaagtccatggagcaaagaatgcaaacaggcacatgaggaggggagaggatggagtaaagacagagagagtatggattgtttaggggagaataaaagctacatagagagcattgggctctctatatgggctacttggaaacaatgatatataaatatatataaaacatatatattatatagtatattatatatatatatatatatataaagtctgcaatgcaatcacaagtggccacatgatgaaaggtgggacttaacgcagaattaatataaaagaaaagcactggtctggaaatgtaaagaagatctgaaacttattccagctgtatgactaacataccatgtaatcttgaacgtgccacttggtttcctgacagttgatagatatttccaactccaatattaaccaataatttataatacattcatatgaggtcaaaatttaaaattagctaaaggaaaacactaatttgtagatgtggttggaaaataattcctctaagtaaaattattaggaaattcagatatatttgccaatagtatatattacttaaacactggaacacctaatgctaaagagaagaaaatattgatggaatagaatatttcatagtctcttcgatcctcaatgtcgtgcgttccaccagattagaatctatgtgagggggaggaactatgactaagctagtctgtacatttaataatgcctggcacaaagaaaatgcttaattttatcaatgttgaaagaaaatgcctaagtgtatatgcccgtaatgtatacttcatattaagttttatcagaaataaaaacatagatctcgtcatcaattttaaaaatttacttaagtctcactccaaaatgataattctatcatagttgcttaacaataaaacagacatgatctcagttgttgctgtacttcaggaacctacaattaagatggctcatataaaattagccaaaaaacaaaaagaggattgatggaactgagaagtatttatgtctaggtgaaagtgatcttccaagggtatgtgtacaaatgtgaagcaagcatcaggtcagtattctaaaagttctagtttaatgtgaaatagtctgttaatcacctagttgatttatctagtggggatttcataatagtttccctaacttttccatctgtcaagttcagaagtgacagaataaaatatttgatggtctggtgggaagatcaggaagaaatcagttacgagaaataaatgggtctgccactttctcttgtggggtttggatatgtctccttatctctctgtgcctgtgttaactccatctataaaatggatctaatcatgttacctttttcattggtagatatcagagattattcaaatcactgaccacattgcctggtacacagaaagcatttaatacatattagtgtctattattatcatgatcatcatcatcatcatcctcatcccaaccatgttgctttgttcagaagtgcagagaaaataaagatcttccaaggtaccattaagacaagtaaatagtagtactaggtaagaaatcaacattagatgcttaccaatatgagcatataattcaaaataagttaatagtaatttttaaaaaaaaccttatgaaggtagagtaattggaaatgtgatcttatgtttcagcttacaaaatgaataaaatgcacctgtttcaaaagcaaagacttcacctgtctctatactcttaatatatgctcatcttgtagttaactgcagctcagactaatattaatattctccaactgacaaaattacatcaactgaaaatttggtttttgcctgatattccgtgttagctttgctattttcaactgaaataagcattttgaaaaagccttaaaaagtcattgtcattcctgattgcagttcatattacattacctgtagaatttcatccccagttgaattactcatcaccaatctgatcattcttccataattagactcttttggtgaaggataaactctgaatgttaatatgagaacactagatttagagtgaagaacaagattgaaggcaatttttgaacttatcattaaaatttttacctttattgtcatagaaattatttctcactacgtgtttttaacgggtagtgtacagtagacacaaacccatcttttcacttgtatattaagacattaccttactaagtctgtttgaattgttcttccttggaacagtcttttaaagctggtatttattttaaattaaataatcaatataaaggacttatgaatttaacagtgttaaaatacaataatatgctattttgaccaaatgttacacacatcaatcacatattcattgtttctttctttacttttttattcctttctcattcacttttggcccaagaagcatagaaatgaattataccttggagaaaaattcattcaatcctctcttttacaaatgaggacccagaaactagaaaaacgtagatgtctaaacttcaaagcaatttggactttcaacttttgcaacaaaaaacacaactcagcatctaatgaaatgtaacatgttcaaatacacactaacaagggagtatgataacataatattcatttccaataataggagagatcataaacttggataaaataactttcaaaaaagaaagaaagaaatctaagaaattggaatttcaggaaaaaatgcacaaactcaaaaaaagatgttaaaaagaatattacatatatttccatcacaggttaaagatacgacacacacataatcttttattttcattattacggagaaatgcaaagatataagctttgtaaccgcctcataagagaaacaaagataggctctttgatgtatctttctaaagctacttcctcatgtatcttcctccagagagagttacacatgtttagctctgatgttatctctggaaagaatgtagagatgttggtcatacagataaaagaatgatacacattctcaaggcagaatcctttgcccatgtgagttggaactcagggaagaatgttgtgctatcaacttttgggttcctaaatagaaactgaatcataaacttttcaaggagcatatggcctgacgtcgcacagtgatcttgatgtccaaccaggtgatgatggtggacaggctggctacatagttctttactccaggaccaatttccatgcccttcccatatccctaaatgataaagttcattatttcaacccatattaagcaaattattctctatatgggttggcaggtaatatgtgttctgggatgaggataatcatgctttgtatacaaaaccacatttgatccaggcagaaatatgctaatattttttaaatgataaatatctatgagatatattatataactgctttaccttatatgtgcctgtcaacttttaaagtaagctcacttttaaaacgcccttgaaatttatactttaataattgtcataaattatgattattaaattatttgactttaagtctcatctttgtgatagtttatatgagtaagacatttttcagtgatggctccctgttgtgaacttcgacagctattattatgctgttcatttgacagaatatatataacagctgtatattttttacacatatctttatataaactaatagttctttaagggaagacctatatagggacaatttaaaaatttttaaaagcaaaatacattgtcaaaaattttctacacataacagagtggaggctgacctagggggtcaatgggctgtactttcccaacatttctttcccaaccttggaaacagggaaagaggaatgctttctgagaaagaaactatgaagtaaatcagagattgggacagaaataagtgatgccaccattaactgacaaaatgcaacattatgtccaatcactataactaaagaaacaatgtatccaaaattgtagtcagcaatgaaagcagggtaaagggaaaatctgagaggcaggtgttggcagtgtgtcctctcctgcaggtagggggtgctctgttgtacttctatcttcaaaaagaagactttaatagatcattaacaagagccattcaaatcatctaactcttcttgttctgattttatgcatgccaagaacactcccagttacaattttcttcccatatagccaggggatgattttacttagagttatgtttctcactttaaattaataaatgaaaatgttggtttaaattctagtctctgagaatttgcttaatatgaatctacctttaagtgatggacaacctgacaaatcgcatacgtgaacctgcaaatttgaaggccaagacttgtcctgtgatgactttgccaagaagatgccactctctgggggagatttctgggcagccagttggctttcctcaacggcaaaaggcttgctggacaatgacccttttcatttaaattgttctcttgataactatattatgagttatcttgctaactacattataagtttctctatcataggtacaaattacctcacactttgtgcttctaccccagcaggtactaaataaacagaggttgttatgatgtaataaaatgcaaccataaaattataaaattgcggaattttactttcttcatacattcttttcctgtctaaaaaacacatgcattaagaggagataactttgatcaaaacaacaacctatgtatttattcagaagacttttttgtttcatgtacaaattgctccattcaaataaaaaattacatctgaaaaatatccccatacaatgacaaatagtcattatggaaaagctgctaatttcgtgtttatttattgttcatcacagcctctagagcaatgctcagtgctagtgcaaagaattattcttatgttcaaattcttgctgtatcatatttagaagacaaggtttaacagaatgtaggcttaatagtctattccatgttaggaattccattcttaagaatatgtggtacctctggcacatgtctaattcagattgcagcaagatgaaaataggtatctgaaaggcatattttaaacaacgagttgatttgcatattaatgcctgaatactgaacgaaactattttagaattttacaaaacaagaaaggctttaggtttttttagttaaaaaacattttaattttttaaatctaatgtttttatattttataagatattctttttcacagaaactggtagaaagatacagaaaagttatattacctaaaaattcccagctaaactattggtataaaattaactttccaagctcttcagcatttattcaaaatttttaaaatctaaagccttctcattatcaatatttgttttcaaaacttccttttttccaatttcttttctattatactttaaagttttgggacacatgtgcagaacgtgcaggtttgttacataggtatacacatgccatggtggcttgctgcaaccatcaacccatcatctacattaggtatttctcctaatgccatctctcccctaccccctcacccctcgacaggccctggtgtgtgatattcccctccctgtgtccatgtgttctcattattcaactcccaaaactttctatcaaagagtggccaaaaatgttacatgagaaaaatcgcaagattcctgctactttaaggatgacatattgtgctgaagaatctaacgacaaatggtcatatcctctgttgagctataaatggaaaatacactttaatcttgtcagttgccagtgccattgggagggcttctccataggcatgaacaacacaatgacctatagctgaaaatcaactgaaaagaatttttcatgttaatagaggaagcatgtaaaaagctaggtgagaggctaggcgcggtggctcatgcccgtaatcccagcactttgggaggccgaggcaggtggatcacgaggtcaggagatcgagaccatcctggctaacatggtgaaaccccatctctactaaaaattaaaaaaaaaaaaaaaattagccaggcatggtggtgggtgcctgtagtcccagctactcgggaggctgaggcaggagaatggtgtgaacctgagaggaggagcttgcagtgagccgagatctcgccactgcactccagactttcttctttgaacacatgcttttccatgatttgagctggagttaagttgacgaatatcactgggtctgatctatttctataacctgcaataagtgcctggtatagtcctaactcacagttgttacataacacatatttactgaataaattaaatgtatgcattgacaggttagcaattttattcaattatttacatcaacttaattaccaagaaacacttagaatagctactgaatatttgcttacgtaagtaattgtacagttgtttctcaaaaaacctaagaacattgcttattaccctaaatgattgcttcagaatgaaagatgctcactactttgagactatagcaatggaacatcatggaagcttttagtagcaaagtgaaatacagtggatataataacaccattggttttaggtcaatttataccaatatatataatcataaatatgaagactcttttttacatgctaatctattttggaagccttttatcattcagcagcaaacatactttaattgggtaggctgtatgtaaatttatttcaagataggagtgactgtgagaagacattagcaatacaaagtctcagtaagagagatagataaatggcactctaggaaagagtgaaaaataacagatttaatttgaggtaaggcactctagaaaccgctaaagacagtaaagtgatactgactgatggggatgactggctgaaatggaggaaaattaacagcccataatcaatatgtggataaatgcctcccgtttaagacagaaaaacagatgttgcatcagaaagtccatgatactatgtgcatataagatatggaatgaaatccaagactataatatgaagtaaccaatttcttttctcagaacactgaagatttgctttagaagagggttatgttattttgtgactatttaaatctctttttaaccttttaattatgcttattatacattatggataaaatattaccaaaaattagttcaaatgtaggaatgacaccgaatgctacaagtagtagttaacctgaaatccattatccaaagttgttcagttaatgggatctatccccatgcaatatattaattactgctacagacttggtgggtgcgtgatcacactgtgagttaatacagagtacggaattcaatatctgttagaactaaagagctatgaattgaatagagttggccccagctggaaagctgttggacatgctgttggaaaacaattatatttccttacttataggaattaataccaccagaataaacacaagtcaatggtagctatgcgaagtaacaagaaaggattcacttaaaaataaatttcattgacaaataaatgatttttcatgagctgttacattcctgaagaaggcatataattcattttacccagctaatcattagaataaactactagtgaagaaaacagtgatagtaacagcagtttttgaacctaaatacacagacctcttctaacaatacaagtttcattctcttcaatattgaatgtggtatgtatacaaaagctttccttataaaaggtagttgtaaatatgtttttaaggaaatacattaaatgttttgctaattgtttttcaaatcaagaaaggaaaaataaaattgtagtaaatatttatgtgtatatatatatatatatcacaaaatatataatgcagttgtagattgtggccacttaatgcaaaaatggtgtttctggtgtttttcctggccccaccagcctttcttcctttcagctgctctatttaacctccatctgtaggctcagcctgactcagggccctgagatgaatgttactttaggcagatgggctctgaaagaaatcctttgttagaaactctccattcagttgttgctccaacgtgaactcattatccccccagggcgcaggtgtctgttagtaccccatctcctcctttgtgaaccccacttcccactgactgcattactattcagtgcccatgctcagacacagacattagtagcctggtttcctggcacttgtcctgctggtaatagatggacatctgccaatactaggattttggacttccacttactgcttggctgacccacttgaattgacatcctggttttgtatcttgagtttagatcttggataatagtgtttatgctttacttgaccttagactaatcttctaatttggaacctgagggctggaatgatcacttcttatacccctttctgtattaaaggatacctgtttgcatttgcataaggaaaataatgatatatgtagactgaaagaattctcaaacacttcaagattttatttattattattattatttttattttccaagacagggcctcactcttgtcacccaggctggagttcagtgtcgcaatctcgactcacagcaacttccacctcctgggttcaagtgattctcctgcctcagcctctccagtagctgggattacaggcatgtgccaccatgcccagttattttttatatttttagtagagacaggattttgccatattggtcaggatgatctcaaactcctgacctcaagtgatccacccgtcttggcctcccaaagtgctgggattacaggtgtgagccaccacacccagccaagattttaagagaaaagtttttcagtagcatagaaatgacaggaatattggacaatatccttcttaataatgaaaagattgacagatgttgtggtcaagtgatattcaagcaatactgtcatgctttatagaactcccacatgtagtttattataacatattttcatgtagtatttccctgggtccctgactattttatgccactttacttgaattttaaaaagaggtggagaagatggggaaaataaatttgtatactattttttgtttaagatgatgatacagggttaaaaggaaaagtagagaaaaaatactaacaggagtaatgttagtaaataaaatgtattataggtgacgagattaatacatatttggctatatgctttctaatatggtcaaagaaatgaagaaacatgattggctacatgtgtatggaagggaaaagtagagctgttgcttaaagaaagtacagcctttttggggatactgagtcctgtgaaaaccacttcctagtaatcttgatgtaaaattgctgttgaacaaaatgtggttacctgagtatcttccaaggcagtctcacaaattgtatatctctgactttttttttttttattattatactttaagttctgggatacatgtgcagaacatgcaggtttgataaataggtatacacgtgccatggtggtttgctgcacccatcaacccgtcatctacattaggcatttcttctaatgctatccctcccctagccccctaccccgccaacaggccccagtgtgtgatgttctcctccctgtatgtgatgttcccttccctgtttccatgtgttctcattgttcaactcccacttatgagtgagaacatgtggtgtttggttttctgttcctgtgttagtttgctgagaataatagtttccagcttcatccatgtccctgcaaaggacatgaactcatccttttttatagctgcatagtattccatgatgtatatgtgccacattttcttcatccagtctatcactgataggcatttgggttggttccaaggctttgctattgtgtagtgctgcaataaacatacttgtgcttgtgtctttatagtcacatgatttgtaatcctttgggtatatacccagtaatgggattgctgggtcaaatggtatttctgggtctagatccttgaagaatcccaactgtcttcctcaatggttaactaatttacacacccaacagtgtaaaagtgttcctatttctccacatcccctctagcatctgttgtttcctgactttctaatgatcaccattctaactggtgtgagtggtatctcactgtggttttgatttgcatttctctaatgaccagtgatgatgagctttttttcatatgtttgttggctacataaacgccttcttttgtatatctctgacttttctccaaatgaggtttgaattacacaacctaatgacttaagcaactgcaaatatcaaagtttgaaggtagcattggagaaactattttttccagtgtcaacaaaatcagataaaacattatatcaaacaagcagtgctatgaaaaatgtttcattcgaaaatcacaaacaggagggaaccctttttttttttgaggacttcaggtctatttccacagtgaaatgaagtgaaacaaatatattctttttaaaaatagcaatgaaatgaaagtggggaggatgtttctcttttcttcccagtttcaactaaatgttatatcctgggtgaaattctttagggtccaataccaatgagaagaaacaggttatctaaattttcctggggaagcactccaactttcttttggaaattaaacttttcacttatttttcttcctaactgagcttgcacacattaataatatgtatcttaggtgctatatatgtttatcttctagatagccaagtatactgaaaatgcacatctctcaattacacaaatacattaactccaaagattattttgttacattggcatcagacatgacaacttacactaagaaagttaactcatctttttgttcaagtcccttgcagggccatggatgaagctggaaaccatcatcctcaacaaactaacacaagaacagaaacccaaacaccacatgttctcacccataagtgggagttgcacagtgagaacacatggacacagggagggggcatcacacactgaggcctgtcgggggtttggggggaaaggggagatagagcattaggacaaatacctaatgcatgcggggcttaaaacctagctgacaggttgataggtgcagcaaaccacgatggcacatgtatgcttatgtgacaaaactacatgttcagcacatgtatcccagaacttaaagtaaaataaaagtaaaaattaaaaaaaaagaaagctaactcatctttttaatgaataaagtatatatatatgcatttgtgatacttgtgttcagcctgtattcatgactaaaattcacaaatgcagataaaagatatctagaaggtctgcaccacaatgtttctgtattctgaaaattaacttacttttaacttttaaaaactttaagttaaaacattttagatggtagatacaatccaaaaggcaagttacctgaatatatttaatattttttattttgaaaaagttttataatttatttaaaaaacttctaatgagaaaagttctacttgaaacatggtagttaagaaaaaaaatgagatgtacctgtggggccaataaatgtatataattattctatcaataagaactcttttcaggaattaattagaaagccagaggagtttctgaaaaaatgttactttgttactaattatagaacatgaaaattggtggggaaaaattgataagggacaaaataatgccctagaagtcatatatttgaagttgggaagttaaacaacagcctacaagcaattactgattttccagacaggaaagtggttcatcaagaaagtctcttgagattttctgactctgaaagtgagattttacaaatgctaattttaggacaaagtaccatattcacacattctttcatatgaatattcttccttactgataattacttgcacttagagatatattatttcttaaaattttaaatattaaacatatatttcagtaaaaatgtattatctaatccattagggcagccctcatcttctgcaagtctctcttcagaggttacagcagtaggtttttgttaaagtaggtttttttgatcagtatgagacatgggcagaggaggcatgaaggcagaggctcaagtacaggttatggctgggaagttacacactaggaatggaccctgggctatgattttgacttccaaaatcacttactctaaataaaatattttttttacttgaatattttcatgatgtagtatatttttttaaagtgctttcttagaatctatgactctgttacagaatttgcattaatgcttataactcccccaaggtcatcccatatggctagattagcattgaggctaaaataatcatgaattctgaaggcatattatctagatgcaaatcctgatcataatggcttccagtagtatggtcttggattactcaaacattcggttcctccattttttcctctataaaatgggaacaataatgatatcaacttcagaaggttattacaatgattagattaacaaacattaggttattgtgatgattagattaacaaacataaagtgcctggtacataaaagcattatgaaagtatttctattatttctctaaatagtggctctttgatatttcaatgtacttctttattcatgaatctgttcattattttgttaacagtggaactctttttagaagatttcaggtgaaagtacaacacgaaaaaagatctgctctttaagagtatagaataggggccgtgttctggaagctccctcacgtagtgctgtggaagtctctcacaccccagagcataaatagaagacaaattccttaataaaatattaagtgcagaatatatcttcctagccatattctcctgagatgcctaaaggagtctagtgatctactaacaaggtgtttacaatgacatttatcatagaaaaaagattcttccagatatttgagaaagaaaactgtacagcaaacacaagtttacaatcaattagaaatatgggagggtcaatattcatgtgactcacacgtaacataatttgatcttgagaaaaatttaagaaaaagtaaccaaaaattaactgagagaaatgtgttaaaaatgtacaaagttattaccataataattacaaaaccactaatgcaattaaacaactctatattacgattgtaagtacttatttatgagtgatgcttatttccaaaaatttgaaaagatggaagatttatttaaagccacttacaaatgtccagtctaagtatgtaactctagttgttcttaaacatacggatgtatataaagcactctataactctatgtttttgaattgtgcctttgtatgtttttatttgtactattctattaaatacataaagtgccttaattttttttttcttttttagacagagttttgctcttgttgcccaggctggagtgcaatggctctatctcagctcactgcaacctccacctcctgggttcaagatattctcctgcctcagcctctcaagtagctgggattacaggcgcctgacaccaagcctagctaattcttgtattttcagtggagatagggtttcaccatgttggccaggctggtctcaaactcctgatctctggtgatccgcccacctcggccttctaaagtgctgggattacaggtgtgagccattgtgcctggccaattccttaatcttaacacagcccctggggcaggtgtgttggcgcacgcttgtaaccttaacactttgggaagccaatgcaggagcatcacttgagcctgggaggttgaggctgccgtaagctgtggtcttactacaatgcactgcagcctgggtaacagagtgaggctctgtttgaaacaaacataagcctcttcaaaatgtttgaaaagatgattagattttattttacacatgaactctgttgcatatattattgatgcagttatttatctagaagtcttatactttctatacttcagaggactctctctatgtgtatatatataaatatatatatatatctatatatctatatgcatgcatacatataagtgtttatcctacagattatgttcttttaacacaatggtcaaaatgaagaataacaatttctgttcccttcaatgttacattgttatgtttttattttcctttttatccctcagggtaaaaccatttgctaagtggcccttactatatacaggtgatgcagagtgggtgtttctgtttcacttataaattttcattattctttagctattacacagagtggcaagggaaaaacaaggcaatatccatgcagttacactatattgctagaagaatatggctataagttaaatatatagcagcagataatggggaaaagggtgagattttgattcatggtacatctacattccactaataactattcaggttataatggtattcttatgaatttcaacactgaagcaaagtgtaagcagtgtttgttgaaattcactcaatagtgcttcactctgtaaaggcactaagcaatgactggaagaattcaaatcatcactactgtggcacacagctcattaccactgccattaaaagcgtcctatgtcattgcttatgtccttttcagacacatcatagtgacatcagtagccattactgcctataaagtgaccaaaaaaaatcagagagtatgtcaccaaattttagacttctgttttagtatgcatattcatctactttgtttaaaaaagcaaaatccaagtgtgcacaatcaagctagagagttgattgaataggttgctaatgcattctttcaatgttcccaccaaaagaaaaatagcatatttgaatttgatttggtatctttagaaaagaagcaagaatgttacctttttatataggtgagaacaaattaggtattctgttgctctctttgggtgatctcaatttacttaaaaaatcctttggttagatagctataatgtctctggcactgaaagttgtgactagaaaatagttttctactttaaaaacaaatgtcttggctttcctccaacatttattttcaataaatgcctacgcatttatcttgcagtaggagaccattatccagtcacaatgctcaattcctttgacgttatctcttaagtaaaacagtaatgttaagaataaaggacttggtgattgaaagagtgggcaagtatgctgggtgggtgaacaaatactgtgggtgaaaatcacccctttaatcatcatctgaagtgggaaaagcacatgttttcttcccttcagacacactgtgtaatgggacgttggggacaggagttggggtaagagtttgtacccaagtacaatgtctagtaagtccagattccagcattttcttgaataaatggcatcttcacctactctcatataacttaatctctgacattatttggtgctttatgtggcttctcttgaacatttgtgctatggagattcacacggattataacagctctgaagacctccacttgtcctaattagggtgctctcttaataaggtccctctgtactacaacaatctgtgtgctgcttctcttcttccaattgtcagtggagatttttctcttcctgtattttaattaattcaggagactaaacctattttaataggaagtagtgtctgaggttattggtatctatgtatatacatctattatcagatttattttctgtattttgtagccaattactattacagtggcgggcgggtatcatagtgccattgtgaagaggagatccattatgaaaaatcagtaggtcagtggggatggaaatatgtttaagaaaaaataattcactcgacgtaaatctgatcatatcacttctctgcttacatatttcacttaataaatctcttgctaggtgttaaattctgagctccttaacatagaatggcaagaaactttttagcatagaacactaagacatgccaagggctagcttatctaccagtctaccactactttgggaaagcagtatcagactatcagtcaccacacctccaacccccatcttgcacagggaccataaactgatattttgtctgtctaatacagaaacactgcaagcaagctttaagacaaatccttttgcctcccaagaagattgctgccacaggtaaagtgatatagaagtgccacctaatgtttacattttagactttggaatcccactcaaaatgtaacaaattcaactgtctgatggttgagactgaaaattggatttttttcatttctctaagtttttttttttttgtatactaaagtttgagaatgattgttttatggctttattcaattttactttccttaattttctcacactcatcacctccagtgataataatctttctctttcctaatttctatatcaccttgtttataccacttaagtggcacccatcacatgttttttttttgtgctataaataattgtaaatatgtctcatcacctatggggacagaatctgcatttctcatatactagcacttctgcagaacttatccagaaccctagtccattgtaaaaagccatttcatgatcacacaaaaacttaaaaggaagcactgtctatatttaactttcagagtagaggggtatcctgaaatgtaggctatccagtatcagcatagatgtaaccttggtccttgaaactcctttttctgaaagctgctttcagttatgcaaatgcttgaagaggtaggaacggaaaggaccccaggagctatgctccagagtggtcagaaatcctttgctgatgtagaacacccaagtcttccttaggataatctgtgagaaacatcttttttcagccttagtatcataaaaaaatgttcctctcctgaacaagcagttaatttttgtcatatagaaataataactcttagactggattctaaggcattctgacctttatacaattagaaagctcagaagcaaataagcagcctaactcttataggtgcagaggtatgtgatatggatttctgcatacaaatgttattcctggctttatttttggacaaatggacatttattctgattttctcaatagtttgccatacccttttgtactgtatcaactcctctgtaagagtctctaaatcctttgtgtaattagctgggattcaagcaaagggaagaattttaaattatttgcatccccttttgtgtcaacaatctgttttcttctgccagataaggtgtcatggtcatcactgtaaaattttaatttttgtatacattggtcataaatatctttggtgatgtagtatcctctatattttctacggttcattctcctcagatggaccagaaaggaatctgtgtggcccttcactctgattactactcttttattttaaatatgaaattgaaaatatcaaatttgaaaaggaacttcaaacaaaacactatagtacaatataaattaaacagacattattaacttaaataacattcatgtcatgttaaagtagtaaaaggaaaatattccctcagataacgaggtcagccagtctcaatattttaagatcctctttttctgagagtgtccagttgtcatcaaaaatgaactctgatgatctttcaattacagtgctttgggcaagtttttgttcgtttgtctgtttcattttagattgctaaagaatttctgtgaaagttcacagaaccactggtaccctgaagtcaagtctcaattacctttggcttggggaatagggttacatgaacacttgctggtgatttccaggcatcccttactcaattccctcaatattcccaccaccgagcttttcttagaagggctgttaacaagaaaccaaatgtacagatttgagttttgcctcatttcacttctgcaagattacagaaggaaactgaaatttctaaaatacatcttgtaggaaagagaacataaaaagaggaaacaaaggtaatcagaacacagaataactggcacctgaattcctgggtatggcctgcactgggaatgcactatagaatctgaagggattagtcaccatttattgagcttgtctagaaggagagcaggaaaagcagaaagtacttgggaatgagaacaaataattctatgcattagatgtattttagttctacaaaacgcaaaggacacactatctgaacttcctttcaggtgttcacgtgaaccttcctaggtggagggctttattaatcagggaggccaaataaagcctagacaccctgacacagaacatgttactgagtcagtacagcaaaccaagaagccttggaaagatacacatgttagctgaggaataaagaagactgaaatacttatcttctcttttcagttaaaaaggatttgtgacatattgtcttaaaacatattctctagtgtatgtctgtgccaaagattataagggtcaggagcgtaggctatggatttggtcagctgggttcataatttggactagtcattttggactcattgtttaaactctctgtgcctccatttctgtatccgtccattggagataacatgaatatccaccttgatggactatatgaggattacatgattagtctggaacacagtaagagcttcctccatgagaatcatatgattcatattttaactctatcttcattctgatatgcaaataaaagaatactatattgttcaggctggtcccaaactcttagccccaaggaatcctcctgccttgacttcccaaagtgctgggattacaggaatcccagcctctgcacctggcccttgcattttttatcagcttgatttttgtcccccacatatctttggaaccattccctatgtgcacatgaagagcaccttcactttttaacaattgtatagtacatcgtagcataactataaaataatttatctgtccagctttgtattgctggaaatttaggttgatagctcgtaaacacaaacaatactgccaaaaaaccatatatatatatatatatgtgtgtgtgtgtgtgtgtgtgtgtgtatatatgtgtgtgtgtgtatatatatatatgtgtgtatatgtatatatatatctgttatgttttcccaataatcaatatttaatatctaaggcaaatttattttttctcctggaaattacaacaaaatctgcctcatttgttttcataacattttgcattctttggcttctggagttagtccagagacaaactcttcactctgttgccttcacacaaaatagctggttaagttttatttgtaaatctcagtagattcctaacacactcagagaagaaaaagcaaactcagaataatttaccaaatatgaatgtagaaacgtgtaagcatgacgaattaatgataactatgaattatgtctacatagttcacattacagtaccatagtctcagaactatcttgacttctctcagagttgtaataattttaaatgtctggaagaagattctcttcttaaatatgtaggaaaggaattgagaaaaagtcatgcataaaaaaggtaggacgtggttctttttgcttatggtttgagtgttcactcagtgtttttatagaaaacgctaaatttataataactctaatggatacaaaagagaaaacactcctcattacttgtactgcttggtgttgttgtatctttattgttcttattttcaatgataaaatttgaattaattcttcaaaattttaatgcagggagaaatcatgtgggagccctctggtggccaaaacaatgctattcaatgttcactagagaagttcaggctcggtcaaaagactgtccttgaaatcctaaaactttactacctatttcatgttgatatatttagagtatcttgattcaggttaccaaagtgccaaaatattttaatgtctgttaccaaactcttaaagtaacattttcagtgcagaagtcaatattaaaatgtataaaaatgttgtatttttaaatgaacatagaatcataggtgactttagagcaacagaactattgaactacagaattttataacaggaataaatcttagagttaatctagtaaaattcacccatttaatgaacaaagaaataaagccagtttaggttaaatactttgcatatgtctcagagtaattattagaagggctggggctgggagtccacttctatatattgcaatcttgagtgatctggaaaaatgcggtcatttaattttgccttaatttcttttttctattcactttacataggaccttgtcttacgtatatattggccttgttttcatgcctttaaaaaaaaaaatcctgcttctgaaagttttctaggttgagttaagcatgagcatcaagtattttatagtttaaaggtaaaacagagaaataaaaacaaaaaagaaaacaaggaatatattagttttctattgctgcctggtagattaccacaaagttggcagcttaaaacaacacccttttattagttcagaatttcaaaagctcgggtctgatgggtctctcttcctcagctatcacaaggctgaaatcaaggtgttggctgggctgtgagtcatctagaagctctgaggaagcttccaagttctttcaggttattgaaaaaaattaacttctttgtgatggaatgactgcggtcactctttctttctcgattttggctaggggtcactcttagctcctagaggctgctctgagctccttgtccccacatggcctccttcttctatgaagccacattgaggaatccccattttggtgaatccccccacacttcaactcacttttaggaagtgcaagagctatttataggccagttttacccatgatggttcctctttcttaaagttaactgtcccatataatataacctaatcatgataatgactgttccatcatatttacaagtcctgggatttgtacagggacatgtatgggtatatgaatcctgggggctattttagaattctttctaccacaacaaaataaaattttcttactaaaatacatctcagttcaaaggaagattttatacacttttgcagcttttatacttctttcaatatcttaaatgtatattttatcatacctacagagatcatatattaataaggtcttgtaatatgaaaatattggctttacaattcaataacttttcaaatgaattttaaaaacctacatttttttttgtggtaggctctctcctagctgggaattcatcagtgaatgaaacaaagtttccttcccctgtagaacttacatgctattggagagcgatagataatacacaactatagccaataagtaaattatctaatgcattaggaggtaaaaagtgctatggaatgatagtaaaggtatcagggtaagaaggatttgaagtatcagcaagggattaggtaagtaagatagcatgaagtggggtaccatgggtgcttctcattgagaaactgagatttgagcaaacacatgcaagaagtgatggagttgtgcatgaagatatctggaggaaaaataatggagggtgaggtaacaactagtgcaagaggcctaaggatagtccatgcctggcattttcaatgaatagcaaaggaggaaaatgtgacagtagtggagtgtggacaaaaaagaaaataaagggaaaggtaccagataattaggtgccattgtagagtatggatgaagttggtggaggatggtaacaagtatgacttaagttttagaaagaccactcttgcagctttattaagaatgagttgtatacaatttggtgagtgtggtatacacttgtgttactatcaccacaatccaggtaataaagttatctatcatcttcaaaaggtttttgggtcctttattttctggtttttatataccaattatacctcgaaaaagctggacaaataattatatattatcaactgtaaaagatgagaatgaattataatggtacaatggtagaagcatggagatccatcaagaggctattgctgaaatttaggctacagatgactatggtttggaccagttttaggagcggaggtgaaagaatgggcttaattatgaaaatgtgttgaagatagatcttcatagcattttttatatattggaatgtcatgaataagataaagagtgggttaaaaaccatttttaggtttttggtataagtgactgaacacaaggagttgctatcatttgagatggagaagatgagaaaagtcagggacttagtttttggacaagtttcattttatatgttttctagatattcaagtggataagtcaagcaggaagttggatatgtaagtctggatttcatgagaaagacagggcctggagatgtaaattggaagtcacaggtatacagaaggtgtttgaaagccatgggattgagtaaaaacacaagggagagaatcaaggtataaaatagaagggtactaatgactgaaacctggagcatttcaatgttaataggtcagaaggatggtgaaaaatgagtaaaggaaacatgaaaagagaaaccagtgaaacagaagaaaagccaaagtgtgtagtatcacagacgccaatagaaaaatgattaaagaggaaggagtgataaactgtgtcaaatgctaccagtaagattaaacaaaatgggtccagagactagagcattggatttagcaatattgaggggattggtgacattgacaagttttagtggaatgatggagtaaaagcctaactatagcagttttaagagaagaggtataaagaagaatcacagaaaaaggagtatagacattaatttcaggaaattttttctgcaaaagaaaaagaaccaaggaatagggagagtgaatctggcagaggaaatggggacaagacaattttgtgtatgtttttttaatcttggagaaataacagcaagtttgtgtggttatagaaacaacctagtagaaaggaaaaattgatgtagaagagagaggagagctgctagaatgaggtctttggcttggcggttgagggacatctaatgcagattattcttgttgtataacagcactggacttatttttttcatgacccatcacagtctattgtataataaacaaaccaagtgaaatgcaaacacacatttaaaatcatcagagcatattcattatgaatcatatgagtgtttgccaccatttgcaatagattttactaaataaggccagcttttaagatgtcattttctccatttcaatcacgtttgaagaaagaattgtgttggaaaaagtagtgatggggagaagtaggaatatacaagaaggttaattatgtttatcagaagctgcatcttgaagaaacatagttcaagagtcagaagacccatgtttgagtttcaagtaccactgactagtttttctacatttgcaaagacaatactccctctaggtttgattttcattatgaaaaagaaatacattctgttgatgatctccaaggtccattctaataaattcaatacaaaaacattccctgaatttctgctttgtataagagataagatataaagctggcaacttgctaccagtgaggcagcagaattatagttaacaaacagaaaattagagggaaatacatctgtaaaataaggtcaagcaaccgggtataaagcatccaagggggatttgggtctcaaatataatatgcaccttctgccttctctcattccttctcttcatttatcaatccgtcagtagactttaattctcttatgcctaattctgttctaaatatacattagagagctttggaattaagaagtctcttattttaacggattcccagcaaacagctgatttagacaccagcacaatctggtttcataaatactgtgagaatttatgggtgtctggaataaaggatgatgtgcactaagtgtctctttcagttaggactttggggatgtcaaatattcttcttctgttgaaatgtaaattcctgcttctactcatggacctttgaatttaaagccagataaaatttaattcattttaccaatttttattcctaaaggtttgtggacttctcatgaccttttgtcacatggaggatgatcttgtatgtaatcattaggtctgaaatgaggaaagcttggtgagaactttgaatggcgttagtcactatgcctgggaaatcatatataaggtccctttgcagctttcagaagacctgaaatgtggctaatgattttaaaagaccatataagaatcagagagcagtgtgaggtagcaagtgaatgagggaaagaagcaaagtgattaaatataggtcttttggctataaggtaccacaataaaattattaaatcagaggatgtgctgctcaatagtttttaaaataaaaaaaaaaaatgacacagttaagagggcaatagtgcagactattttaggttgaccctgtctcaagcaattggaatatatttgacattataaaggcattataaatatatttattgattggacttgagtctttatgtctttccttttttttcccaggtaacatctttacctaccacaaccatttctctgttctctatttccttttacatttctattctgtaatgctttagaatttgcactttccaaagagagaaactatttctctggagttcagctgaacagaattcttcctgtgaacaggctatacagaaaaatatgagatttttctataagattttttttgttgctattttacaagcaagaaattaaatcacatttctgaccacaactactggaaaatcttttgtttgaagacctttttgaaacagcatattctcctattctttgcattgctgttcaaaggtacttgtaacatttggaaaaacatattatataggcaattttttcttatttaggttatattgcctgttgtctatttaaaaatatagaccaaaattatttatattatgctatttgcttattacttttccaggtaatgaaattatttgattttaagcagcatgtattctttttggtgctttaaaaatataattgcttactataatgaaatcagaaaagaatataccaggtatcttgctatgtatatctataatactttaataaatattcctggaaacattttagccttgttcatccaggaagaatttggaaaagctgattttaaataataaaaagctcagaattaaaatgaatgtcatatttttgcctttacagagaatcaattaagttgcaatcctgagtatgtacttgctaactatgccaatagtcataaaagaactgattggctcccatgctccagaaaaccaacttatctataagcttagctattctatatctcagaagtcactccaaaaacccagagagaatggtagaactaaaaagtacatgttgagaagggcctgcgcctgaatcagattcagtctttgtgattaatccaacacctttacattctgaataacaatcattaacgtcattaagctgcttgtttcttaatcgcattcttgtataggaaactcaaggcgagacgaaccaactctgagaagcccacaatcaaagttgattgcatccaaccttactgttgcacctctattaacctacaagctgtttgggcagggcttctaaaaacaatttcaggataaaaactgtctccttcagattttgctgcacttgcatttattatgaattttctggaaattatgaagcagaacagctaatgatcccatcatagacagccattatctcaaactgtgaatactggttgtcattttcagagtcaacagatgttgaccttagggtggcaacttttccttcattgtatgaacctaatcaacattatatccttcagttttctataaaatgcactatccaattagaaggtaagctttttaaaaagagaggtctaaggttaaaatctcatttaagctgcattagtctaaatgtggctttgggctatttttattagctgaagctatttatgatttttctaaggaataggaaaggacacttcggggactacaaagaaattgatttaatggtatgcatgacttcacattcaatttctataaaaatgtcccctgataagaggttgtgaagatttctaacaatctctctcttttcatctctgtcctgatcttcataaaaacagtgtttgcaaacacatagctaaattgacaaagacttacctaaagaacaattctgcagcatggctgggattcaataattattacccctcccaattaaactgaacttgaaaccaactaaacctagtcattactcacatggagatgtggtatgaaatcctgagccctgtctactttctgtggaactcatatacctcatttgaacttggttctaagctgattttcttcagatgactttcccaattaaattccatttgatgctgataatgactttattgacatctgacttcgtttgattttcatgcatctattcaatcatttttattcagcaggtgtacggagtgcctgctgcgtggaggcaatatgctgggcttcctcaaaaaagtgaaagaagattcagagacacttactttcacagctactacagattagagaaaatgtagaaagaattccatttcaacacaacataattataacttaagaaaacatttttatatgttttttgcagatagtctctagtaaggatgcttcagtgatctggttacagttcattttacaaactaaaaatcccatgtgttttcatggcagaagtcagatttcataacaaaaatgatgttttcaaatttaatatttgtggtaagtacaatgtgtttagattttaaatttccttttaatggaagtgattctaaaaatctgacagttgtttgatatttttcattttgagcattggacagctgaaaaagactatttcctgtagactgacagttgtataatagatgggaaaaaaaaaaagatgattggcaaagccataagagagaaacaataaaaatagggcagtccttacctcaatttaacagaagcaaataataggaaaaagaaatctgaatctatggaagcttttaccttagacttaggcaagtaaaatcccatttcctaaggggatgttttaagcaaatttatactaaactctttttcctgaaaataaatattgaaagatttgattaggctaagtttgtgacaaggtctatgggagtgtgaatgcatatttatttacatctctgaaataggtaaattgggaaattatctagaagtaaagctgataatgagaaaaatacaagatgtgaattaagtataaagaaataaagttatttagtagcaaaaataacaatctagtcatggtatcaaaattaatatgtaaaggtaaaatgttatttagcaattataagttattttcattgtattatattttctataaataatggtaaattcctgcttgatgatagatagctttacagtttttaataatagatacattcattgaaaaagatttccaagtgtattatgtgaggaagtggatttgataagtcaagagtactgttattcagaaatatctttcacttggtgacagggaaatatagcttaaggcaaagcactgaagccagatgtgtacacagaaattaccttaaattctactaaaacgatgtaaaaagaaagaactgcagtgccaaatagagatgacttggttaatatttgaatacatggccaaatattttcagtcctgaggttctcaatatattgcatataaagggataatttccaggaagaatacagctaatcatgtcatgtttaaatccattttagtttttgtcattagaagtgcaggtaatttgggggaccctataggtcaaaggcttacaactcaattgtaataggaacttaaatgcttataaccattcttttcgcatataatccttacagttgaaaatgcccaggcttttctcccttcaattcatttgagatcattaccaccggggatatctttcaaaaatatcaattcagtcatgtcatattgctgcttattaatattcaataattccttatcataatatttaaagctgctttgaatttatttctagattagtattatcttagtgtcctatattttagcctttcctggcattcctcaattttatacctgattaccttgttcatagtgttttttaaaatgcaccatggctctttactgccagattcaattctactgttgatctttttttttattgatacataacagaggtacatgtttttggtacatgtgataatttataaagatcaaatcagtgtaattgggatatccatcactttaaatatgtatcttttcttcatgctagaaagatttgaattattctcctctagctattttgaaaacacaatatattattataaactacagtcactctagtgtggtcttgatctttcagtctcaagattaagcatactatctttctcatgtccacatggaagattagatttctcccttggtagctttttgatagtaactactattcaattaaatattatacaactatttatcagggcctaccatgaatgagaaaacttctagaaatgggcatacaggaataaacaaggatagaaaccccctagcctcctggggtttttctcatatatgttggatatttaccataataattcataaactccttttggaagagccaacgttagtcattcttgagtccaatcagagagagtttagtggaaaacatggcacttgttcaaatgttgacttaaaaaaagatcgagtggaattaaacttctataatattgttaattcccacttggaaaaccattcctcttttatatcacaagtcagtaacacagggagggcatcgcaagggatggcaaatatgtggttgggaagtaagtatatattatacattcatacagtatttctatagtatttcctcaaaagcttccgtatttatgactttttgagaaatagtagcagattctccctttattataaataaatatataggcatataaaacacaaataagtattgggatcctaggaaacatacgtaaggttttgcctcatactttgttaagggaaaaaaacaacattttaaaatatcaaccaactaaaaactacaacacagtgtgatatctacaattcaaggatgatacagttcaaggatgaaatgtatgagagcaagaatggggtcccttgtggtacttcattgtcaacattgtcagaaaaacatcaactaatgtgtcttgtataacttcatttctaaaagatatatctgtcccagatgaataaaaaagggcatactctctgttcttgaaattcacttacccctaagaacaatttttagttgactctcaaggggccaatacgtgctcacagcctgccaatagaataactatccattgtttctttaaaatctataatacttttgaagtctattaactaggatttccttgatagaatagcaaatgtgttgatagttagcaggcttaacctattgccttttgaaagtgatagcataaatcagctatacatttctatggagaattcacttttaaaagaaaagaatagatagaataattaagtgtaagaaaacctttcttattggtgtaaagagtggtcagtggtggaacgtagattcttgtaaatccttttatcaaatgtttaaggagttatctaattaacaggaggcagctccagtttattaaatactattaatctcccagtttattacccttttccttgagagttctggaactgtgctaacaaaggaagaataattatcaggaaatcagtactattttgtgctttttttttttttttttttaactgtacttgtggtcacattagaactggatatgacatatctttttttggttgtttcttgtttttgtcattcaaaatagggaatgataaggccacaagagcaattactgatcaacaccccaaaaggcatctaaaatgcctctcagaatcataacaagtcttaacattctagatagttgtaatggacccagatttagaaatcctcatatacaagctggcatcatatcccttatacctgaagaacaaaatctcatactaggagatctgaaacaaatggattctcaaacatttctatctctattttacttagaaattaactatattttgctatgagttgtagcattttatttttaaaggttaggaaaaaccattatgtcgatcataaattgctagaacattggtgtagtttcagcttttaggggactgagattggctctctgttcaaacaaaatcttaggtgttagtacaataggtaaagctcatagatgcagggtttttctagctaagtggaagtggtcttggcacataggcagtgtgtggggcctgaagctcaaatattcagcagcctttcctacaggtgaccactctagattctctaagagagctttgtgagcctgtagaatctccacaagcaaaaacttagaaaccatcgatatatttttttcatcaaatacatttgacaactgagggaactaaggtccagcgacagtaaataacttttttggtgttgatacttaattatttactttgcattatagttttaagcatttttccatcttattaatgaaattataaaaaagtgttcatcctttgtaattcattatatccccacactgtctgacacacggcattttatggtattagttgaaggctaataccactttagaaaacattttacataacttctataatactttacatatttacattatcagtattgtttaccaatattttcatgtgccgatcttcagatcaaggcctattgcctctcttaaatcaacatgaaattagctttgggaatagaaatattgagtctaaattgatagactgatcgtttttctctgttgtggaattagctgcctaacacagttttatatgcacataaagtctgtgtagaagtattcactcagaattcatatacaggcactgttctataccctggattacagtagtaaacaaaattgtgaagagaattttcccccgaagtgcttacattctaatggagggagtaagacacatatggcaaagagaaagtatgtcagatattggtgagtgttggagaagggaatgtattttgagacatggacagttgcaattttaaagaaagttgttgggaaggccatattagaaggtgatatttgagcaaattgttgaatggtatgaggcagctatccctgcacatatacgagggaagagcattctatgcagaaagaaaagtcctaggctgagaaacggtcttgagtggcagaggcacagtgaggattatagctggagcagaaagaaagaggaaagttatggaggcaatggagggagaaaggaaaaccaacagtgaggaaggaaaaacgagcaaggaaaggtcccatttatataaagacctttaggctgctataagaattgtggctttattcttagtgagatatgaagcagagggttttgaggtgaggagtgatgtgacctgacttcatttcggaaggttcagtttgtgctgtgagcagtgttgagtgtggatggaataaaaacagattaggtagaaggccctttcaataatccaggcaaaacctaatggtggcttagactggagcagcagcagagaagggtgtaggataaggttaagttctaggtacattgagattgtacatctcacaggattctctgatgaactggatatgactgtgagagtcaaggatgactcccatcttacctgagaaactggaaacatgtcaccgtcataccctgtgctggagaacactgagtaatatgtgctggggctcagacagaggttaaatactatcagcagagaggacaaatacaaaatattggatcacagctttttaaaattgttctatgttacagggaagttgccacttagcttaagatcatgtgtctctattatatgaccagagatattgactaagcctcatatccagcagtgagatttaaaaggtagtgttttaagtgtgtaaatgcaaacatataatctttcacatatagttggtattagccttaatagagactaaagattatttttatgcactgaagaaataatgtctttattcattcacctctattttacaatttttaacagaatattgaaaatataaacagttgtttaactcatgaattccctaattgtgcttttctgctgaggatgttggcctgctttctacctttatctgaggtagttctataaaattccatttattgcaggggagtatggccaatacaactaaatggacagctgttcatactggtttaaaatacattataatcaaaagcttttaataaatgtctatgttttttcaaagcaaagattatagactattaaatgggcttaaatagacaggtcaagaaaagatcagccaaaggttttgcctccttccttgtgtgctgtcgacctacagcataacccagtctctctatgggtctctcaaacagacatttttcacaactaaaggcctcatctccaaatctataacccttagaatatctaaactctagttatattatacagcattcttaaaatgatgaatataaataaattaattcattcattagaattgtggtaactgaacatagttacaagaaaatattattttgatgtaaatatagcatggatctttgcagatattaaactataatattataaatctttacaaagatattctgagtaaaattctgccattgaagttatcaaagttctgaggctacaaaaattcctaggaataagtctattgcatgagaattcaaataccctacctatctaatgaacaccagatcatatatggaaggaactcctgtgaaataattaccaactgaccaattttattaacaaataaaactaaaaaagaatttagatttattaggttgcataaccgactatatatatggcttacacctgagtgttgtaatttttttaagcagggattctttttggtgaggatttacgagacgttttattttctcctttgaaaagtattgattttgaaagctttataaataaacagcactgacctatctattcttgaatcattgagagtaggtcacctgtggacagcaaatgattttcatttcctggaggtaaattttattgaagagaaagcaaaagaaagggaaagcttaatttataatgccaagtgagattactgaaattcagcattttaaaaacttctgctctatagggtttgagaaagcactagctcctaaactgaaatgaataggctggttctgtttaatcagacagaaattttataaaatggccattagtaaggaaaattacaggaaatagaaacatatcatccatcatcataccagttacatttcttatttgacactgattttagtaaatgaaatatgcaatttaaaataacgaatcattaagaatatggaaaaattcttccgagtaaaaaagaggttacaaaaaagacaaaataaggtcctcattattagtaaacatacatgtaataaaaatgaatagagctaaatacattaaggtaaaaaaaaggtcaactgatctttgggtaaagagatactgactttttttttctacttttgtgtatttcctgaatttatctcttcactatgtataactggttttggaaataaaaatgaaaaaaattacaaaatgtcctgcgaaatttggtagtaaaatgaaacaaatctcaggatattgtaatacattgaaaaatgataaattttaagaaaagtttaaaaaataaaaaccctttgtcccacagaaaatgagtttttgatttataaatgaagaaagctaatataatcagtgttacgtggggttatttatatttatacatatttatgctaaaatttatattctgatgaaatgttttttaaagtttctacaagggagaactagaaatctatatagattacagtgggggaggtggaattcactagaagttaactggaaggaaaacaagaatacaggtaaaagtatcatttcaaggacatcagattttagtattttacagtaaataaaaggaaaaatatacatattttgaaaaatgtaaaatattcataagggacaagagaagaaagtcttctttcaccacattgacattttggcctacaattatattgtatttagtgaaataaactctctcccaattgtaagtaaagttacaaatgaaatacataaatttgataacaactttggatgtttttccaggtacaggatctgtactgttcaactgaagtctaatttttgtatatattagaatgagtaactatcattggaagtttggcattaaaaaaaacagtagattgccagaagttaaatttttaggctatacaaatgggagctgtttccatcaaaactgccagagacgtgttcggacaaaaaaatagctccaatttcctgggtgtggagaggctatcacaggctcacatattatatgctaactcgaatttgcaaagcaatctgagaagcaccaaattgctgtaataagaaaaggtgacatttgtacaatctcacagtctttttatgtattctgttcctagaataagataatagaggtctattttctgtctcttccaaaccctgtcataagggagagctactagcacacatgagtgcccaataggtcatatgaggaacaactgggtgacatcgtatatgttgacgtaaggacagctcagtctggcatgattaaacttctgaaaacatattattcatctttatttagggccataaactactcaatatggatcccatttcagtgtgtacattttatttacataattcggcccaaatttgattttaagtatgtcaaaaactgatcaaggcccatggggtaaaacgttagacctgcatttatatcctacttcttccacttattaaccaagtgaccctagtaaattcacttaacattattgggccttatctccttcaactttaccatagaaattatgacttgagcctcacaggattttatgaggtttatatgagctcacatgtgaatgaaatatactagcataaatcgggcataggaaaagacaggtaagataataagtgttagtccattcattccttgttaggaatctacatttgcatcctttcatctactacaacactctgagagatgtaacatatttcctttaggctgagccatttactgtagcagtgattcttacaatgagtgttggggactgatgtccctagcaaagaatattaaagtcagagagaggctaggttgaggcaataaagatgacagtttgaaaaagtcccaaagattattcttaaatgtcccactcttagggggaactcttgaaatcattttggtggactaattcagttaaaggtaatgacactgaataataaatatgaacctagggtaggaaaaatattcctatttttagggtattacaaacaaatgctgcaatggatatctttttttaaattttattattattatactttaagttttagagtacatgtgcacaacgtgcaggttacatgtgtacacatgtgccatgttggtgtgctgcacccattaactcgtgtcgtcatttagcattaggtatatctcctaatgttatccctccccactccccacaccccacaacagtccccagtgtaggatgttccccttcctgtgtccatgttttctcattgttcaattcccatctatgagtgagaacatgcggtgtttggtttcttgtccttgcgatagtttgctgagaatgatggtttccagcttcatccatgtccctacaaaggacatgaactcatccttttttatggctgcatagtattccatggtgtacatgtgccacattttcttaatctagtctatcattgttggacatttgagttggttccaagtcttccacaatggttgaactagtttacagtcccaccaacagtgtaaaagtgttcctatttctccacatcctctccagcacctgttgtttcctgactttttaatgatcaccattctaactggtgtgagatggtatctcattgcggttttgatttgcatttctctgatggccagagatgatgagcattttttcatgtgttttttggctgcataaatgtcttcttttgagaagtgtctgttcatatcctttgcccactttttggtggggttgtttgctttttttcttgtaaatttgttggagttcattgtagattctggatattagccttttgtcagatgggtagattgcaaacattttctcccattctgtaggttgcctgttcactctgatgatagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggatttttatggttttaggtctaacacataagtctttaatccatcttgaattaatttttgtataaggtgtaaggaagggatccagtttcagctttctacatatggctagccagttttcccagaaccatttattaaatagggaatcctttccccattgcttgtttttgtcaggtttgtcaaagatcagatagttgtagatacgcggcattatttctgagggctctgttctgttccattgatctatatctctgttttggtaccattaccacgatgttttcgttactgtagccttgtagtatagtttgaagtcaggtagcgtgatgcctccagctttgttcttttggcttaggattgacttggcgatgcgggctcttttttcgttccatatgaactttaaagtagttttttccaattctgtgaagaaagtcattggtagcttgatggggatggcattgaatctataaattactttgggcagtatggccattttcacgatattgattcctcctacccatgagcatggaatgttcttccatttgtttgtgtcctcttttatttccctgagcagtggtttgtagttctccttgaagaggtccttcacatcccttgtaagttggattcctaggtattttattctctttgaagcaactgtgaatgggagttcactcatgatttggctctctatttgtctgttattggtgtataagaaggcttgtgatttttgcacattgattttgtatgctgagactttgctgaagttgcttatctgcttaaggagattttgagctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgtccattcagtatgatattggcggtgggtttgtcatagatagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagttttttgatgtgctgctggattcgttttgccagaattttattgaggatttttgcatcaatattcattaaggatattggtctaaaattctctttttttgtttttttctctgccagcctttggtatcaggatgatgctggcttcataaaatgagttagggaggattccctctttttccattaattgtaatagtttcagaaggaatggtaccagctcctcctgtacctctggtagaattcggctgtgaatccatctggtcctggactttttttggttggtaaggtattaattattgcctcaatttcagagcctgttattggtctattcagagattcaacttcttcctggtttagcgttgggaggttgtatgtgtcgaggaatttatccatttcttctagattttctagtttatgtgcgtagaggtgtttatagtattctctgatggtagtttgtatttctgtgggatcggtggtaatatcccctttatcattttttattgcgtctatttgattcttctctcttttcttctttattagtcttgctagtggtctatcagttttgttgatcttttcaaaaaaccagctcctggattcattgattttttgaagggttttttgtgtctctatctccttcagttctgctctgatcttagttatttcttgccttctgctagcttttgaatgtctttgctcttgcttctctagttcttttaattgcgatgttagggtgtcaattttagatctttcctgctttctcttgtgggcatttagtgctataaatttccctctacacactgctttgaatgtgtcccagagattctggtatgttgtgtctttgttctcgtttgtttcaaagaacatctttatttctgtcttcatttcgttatgtacccagtagtctttcaggagcaggttgttcagtttccatgtagttgagcagttttgagtgagtttcttaatcctgagttctagtttgattgcactgtggtctgagagacagtttgttataatttctgttcttttacatttgctgaggattgctttgcttccaactatgtgatcaattttggaataagtgcagtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctgtgtaggtcacaaaggacttgctttatgtatctgggtgctcctgtattgggtgcatatatatttagggtagttagctcttcttgttgaattgatccctttacaattatgtaatggccttctttgtctcttttgatctttgttggtttaaagtctgttttatcagagactaggattgcaacccctgtctttttttgttttccatttgcttggtagatcttcctccatccctttattttgagcctacgtgtgtctctgcacatgagatgggtttcctgaatacagcacactgatgggtcttgactctttatcccatttgccagtctgtgtcttttaattggaggatttagcccatttacgtttaaggttaatattgttatgtgtgaatttgatcctgtcattacaatgttagctggttatttactcgttagttgatgcagtttcttcctagccttgatggtctttacaatttggcatgttttcgcagtggctggtactggttgttcctttccatgtttagtgcttccttcaggagctctttttgggcaggcctggtggtgacaaaatctctcagcatttgcttgtttgtaaagtattttatttctccttcacttatgaagcttagtttggctggatatcttttcaagtggaatcacttggtcaaagagtaatgcacactctccattttgagaaaccttttaatattaccccacaaaaaataccagtttagagtctcacaaaatatgaagactttcttcttctacatctctgcaaacactcaatgttatgtatctttaattgccactatctctgatgccatgctcaatctgacagtttatgttccttagccatcaaattgtatttttggaactaatagttttcacagaggctgtatagtacaaaggttaaagacatggactgaagacctggactttctcagttcaaatacctgttctacctctttttaggtgtgtaatcgtggacaagctacttaaactcccagtgcctcagaatcctgctaaatttggtgagagaaataagtcaatttaagtgactttctataatttatatgcaaagaagagtacctaacacctagaaaccttgtagaaatgcttgttattagtatttgtattagtttcttagtgctgctgtaacaaatcgcatactacataattagtggcttaaagcaatagaaattacaattctagaggccagaattctgaaatgagtcttatggggctaaactcaaagggtattcaggactggttctttctggagtctcccagggagaattaatttcttgtctcatctaacttttggtgactgtcagcattccttgacttatggtcacctcactccaatctctgattctgccagcacattgccttctgctcttctctaatgaaatctccatttccttctctcttataaagaaatttgtgattacattagagcctatcaggataatgtcttcatctggaaatctttaattgcttttgcaaagatttgactatgcagggtgaaattcacaggtgccatggtttaggacttggaaatctctggggacttttttcagcccagcccagtgctcttttacattttatattggaatacttgcattattttcatgtatttgttaattttttatatattatggacattatattttatcaattatatataatgcaaatattttctcttaatgtgtcttttaatttggcttacggtagctttcataatacaggcattttaatgagcttatcatttattacaattaacacatctactagatggaaataaattaagaaaaatggtacatccatattatggaattgtacgcaaccataaaaatgtgcatctaaatattaacctaaaaatattccagaaatattaagtgacgaaaaagacagattttatgtaaagtattccatcatatatataaaatgatagactgcaaaattctagatagctgccaagggggacaggaataggaggtaaaataaataaactgttactttttaatctatattagttctatttaaaactttttataaggaatatagttatatgtaatttctataattaaatttttaaaacaggaacattaaagtcaaaacaaaattatatttaaggtgctatagaatttcaaaagaagaagataattacttatttctgggaaaattgaaaggagcaacatttgagaaaataaaagcagttttaactataacataaagtaaaagcatattccagaaagtagtttaataggatgaagctgaatgagggtaataaagtaaggtaaagtaaagggaaataatgacgaaatgcttccactgaattaagtcttagaaggccttaatgtaagacagtttacatttatttctcccaggttaaaaccctcaatacgttgtaacaaatggacaaactctgactgttcagagtattgccaagtttacctaagctcttgtaaaacaatgcatatacaaagaacaaggcaccagcctgagagtgccccagggccatctttgtcttacattgggcaaggtctgaaacatcaccattttcatctttcaagtctcctaaatgctctcatggtcttaagaccaatcatgaaagaaattattgttattaatatcctacctgcttatcaataacaataacagaagggacaaagaaatttgaatttggcttgatataaaagactttttaaagaattggatatcatgagcaaaaatatcatagagattcagtcatgctctcaattactagaacttttttttacaaaatagaacagattaaacataggtctataaccaaactctgtgtgtgtatgtgtatgtgcgtgtgtgtgttggcacatgtgtttcaaacaaaacttgaaagaaacatttttgttaatatcataaattttctacatcatactgaaagacaatgtctgttataccaatgttcacagcagcattattcacagtagccaaatgtggataatccaccaatgaataagtgaatgaaatgttgtgcaggtatccaacaaaatatgattctgccttaaaaaagaatgaaaatggctgggcgcagtggctcatgctataatcacagaactttgggaggccaagtctggcagatcatgaggtcaggagttcaaaaccagcctgaccaacatggtgaaaccccatctctactaaaaatataaaaattagccaggcatggtggcatgtgcctgtaatcccagctactcgggaggctgaggcagaagaatcacttgaacctgggaggcggaggctgcagtgagccaagattgcgccactgcactctagcctgggcaacagggcaagactccgtctcaaaaaacaaacaaacaaaaaacaaaaaagaatgaaaatatgatatatgctataacataggtaaaccttcaaaatattttgctatgtgaaataagtcagaaaacaaagaataaatatggtatgactccactcacatgaggtatctggaatagctgaattcatagagacataaagtaggatgatggttatcaatggcagggaggaggagttattgtttaatggatatgaaaagtcagtttgcgatgatgaaaaagtccaggaatggataatgatgatggttgcacagtgttaaaatacttaatgccactgaatggcacacttaaaaatcggtaaaatggtaacttgcatgttacacatattttaccacagtaaaaataaaataaaatgtctgtcaggatttaaaggccattctccttgtaaagaaggtagtgttaagacattttcataatataaagcgcaagaaaatgagaacttgctcatcattattatttagtagatcttaacattctactataccatgattccttttgattatgttacgtatttcagtgttaaaaaccattgaataatttgtgttgagtgtatgggcttgaaaaaagtcttcattcaaaatcatttttctactataatctatatgtataggataggtaaaattgttttctctatggcaaacaaatgcctggatgaccactaatgcaagactgtttgctcaggtttgagctgcctcagtttcaccctcctataaaatttgactttggctatagacaacttaatcagtgattactaaaaaccaaaccttcctccatcagtcaaattatcctttaaattacaacatgcatgcaattatttcatgaaatgtattgacctacatagtgtttaggactaggaattaaatttcacctttgagcccaagcccattaacttcacttaaaagaaatttggtgataggtatttaattactgatatcctacagaaattgacatttaataaagtgaaacatttcctaaacactgaagagctttaagatatgaaatgaaacagtctatgtcttgaaaatgaatccagtcttaaaaggaaaaaaacattaatagagtcatgttcaaaagcttttaataggactgtaagactgaaatagaacccctcgggtctcttattataaagcagtataacattttgttcacagtctcaggatgaaaaaagaaaggcgggatccaatgaaacaccaagttatacataaaacataatgtggaaaatatatatcctttagtattcagtaactttctcagtaatcccatcttaatagacactaagaaaattccaaaaaatttgggctaggagaccaaatctcagatctatattctagggagcactcaatataaaaactgaaaattttaagtctcttgtctgcagggaatgtggaaatttttaaaaagcatcatcaagctaaaggaagaatttggctggagaattgatgttggctatggcaacatatatttttttttaatttcaaaaggagttaaaacaattttaaaataaaacatataaaaacatccagttataaggtttttatgcataaactaatcatgtatgcaaatacatgtccatacatagatatatatgaatacagtatctttgtgcatttagtatagacattgaaattactataactatataaggaacaaaacagtagtcctccatgaacaaaaaatacgtcttgtgctaattcttcctggtatagaatgccacaaataagatgttttcctgtgattatcaacaattttcatcaagcatcttaaattaaaacattaatatttgtcagcaagtgaggatcatagaaaaataataatattaatttgttgagaacttagtatgtgctaagtcctttatatacatcatctcatccatatatacaactctgtaagtttggcattattattgatcctattatcagagaaacagaggctttatttggatatttgtttaaggccacatggccagcagagccataatccaacccccagctttacataaaactaaagcttctggaatggatggatgactatgaaaaatcccttcagacattgactacaaacagcttaacagtggcccagttaagcggaaaaatgttggcacagatgaaacaaggtgggtggtgggggctcagggggtggtaaaagtagctacaggaagtgagagaagtaccacagttgagacacggcagggtcatacctattaggcatacttcttaaaataatattttaactctcaagaagaaagcacctcttctagaagatttttgttttgttgttgtttcttaagactatttttttttaaagagtagttttaggtttacagcaacattgagaggaaagtacagagatttcacatatactccctctcccacatatgcacaacctctcccatcatcagtatttctcaccagactgatatatttgttaccgataatgaacctccattaaaacatcgttatccaaagaccacagttcacattagggttcgctcttggtgttatacactttatggatgtatattacagagtagtttcaccaccccaaaatcctctatgccccacctaatccacactgcaacccctggcaaccactgatcgttaaatatctccataattttggcttttccagaaaatcatatagttgataatacagtatatatctttttcagatggcctttttttcacttacgaatacacatttaagtttctccttgtcttttcatagcttgacagatcatttctttttagcagtgagtattccattgtctggatataccacagtttatccattcacctagtgaaagacaacttgattgcttccaaattttggcaattatgaataatgctgttataaacatctgtgtgcaggttttctttgaacatgttttcaactcatttgcataaatactatggagattgttgcatcatatggtaagagtatgtgtagttttgtaagaaactgcaagctttcttcctaagtagctctaccattttatatgtctactagtaatgaagcagaattcctcttgtcccatatcctagctagcatttggttttgtcagtgttctgggatttttacattctaataggtgtgtagttgtatatcgttgtttgaattcacatttctctaatgacatatactgtgaatcaccttttcatatgcttaattgccatctgtatatcttctttgctgatgtatcccttaaaatctttcacccactttttaattttttcctattgttgatttttaagtttcttatatattttggataaccgctccttatcagatgtatcctttgtaaatattttctttttccattctgtggcttatcttctcattctcttgacattgtatttgaaaatcagaagtttttttattttaatgaagcccagcttatcaattatttctttcatgttctgagtctttggtgttataattaaaaagtcattgctatattttgtcatctagaattactcccgttttattttctctgagttttatagttttgcatttatgtctatgatccatttgagttaaaaatttttgtgaagggcataggtctatgttgagatatatatatatatgatatatatttgatatattttatatatatatatatatttgcctgtgaatgttcaatgtccctctcccatttgttgaaaggattatctttactccattgtattgccttttctccaccgtcaaaaaccatttaattgtatttatgtgggtctatttctgggctctctattccataaaattgatctactttcctattcttcgtccaataccatgcagtctcgattactgtagctttgtattaagtgttcaagtcaggtaatatcagtcctccaactttgttcttctccttcaacattctgtttgccattctggatattatttctctttatataactttagaatcatttcgtcagtatccataaattaaccttctgaaattttgattgggattgcattgaatctacagatgaagttgggaagaactgacatcttgatattatatcttcctatccatggacatgaaatatatttccataaatttggttttcctttgacttcttttgttatagttttgtagttttcctcatatagatcatttattttttgttagatttctacctactgtttatttctgaagtgtgctaatgtaagtgttattttgtttttattttcaaattccacttgttcattgttggtatataggaaagcaattaccttttgtatcttaaccttgtatatggaatcttgttttagttgcttattagttctaggagttttttgattcttttgtatttttgcatagaaaatcatcttatttgcaacaaagatattttcatttttttcttttcccttctatatattttaatttcgtcttgttacattaactaggacttcaaatgtggtgtttaaaggtgtagcgagatagggaatcctttcttagttgaaaacctttgagtgtcttaccattaagtttgaagttagctgtaggttatttgtagagattctttatcaaactgaagaactctccctatatccctagttttactgagagttttaatcatgctagacatctctctagacactactttcactgcatcccacacattttgataagttgtgttttcatttcatttatttcaaaatatatttaaaattgtcttgagatttcttctttgacctgtgtgttatttagaagaatgcaatttattatttatatatttgtttttaattttaatttttgtgggtacacagtaggtatatatacttatggggtacatgagatgttttgatacaggcatgcaatgtgaaataagcccatcatggatctcctcatattttagaattttccagttatctttctgttattgatttatagtttgatttgtgatatgaaagcagacatttcttaacttctatttttaaaaagtttgttcacgtgtgtttcacagcttagaatgtggtctatcttagtaaatgttccatgtgagtttgagaagaattttttttgccattgttggatgaagtgtctatagatgccaattatatccaattgatggatagcgttgtcaacaacactatgtacttgccgtttttctacctgacgtgtctgactatttctgatacaggactgtcaaaatctctatgattgtggattcttccatttctccttataattctatcagtttctgcctcttgtattaatagtttaacactctatttttaggtgtatatatgttaataattgttacgtcttcttggagaattgacctttttatcattatgtaatgctcttctttattcctgatacatttatttgctttgaaatctgctttgtctgaaactaataatagctattcgtatttcttttgcttagtgttagtatggcatatttttcttcactcatttatttttaatcgataaatgatttttatataaatgtggcttccctatagacaacatatagttgggtcttatattttgatctactctgacaatctctgtcttttaatttgtgcacttagaccattgttcttcaaagtcattattgatatagttgttttaatactattaaatttgttactatttttttctatttcttgtccaagttctttgttctcatttgtgtccttcactcttttactgccttgagtagttttaattgtacatttatacgattcaattttctctcttttcttagtacatcagttatgctttttttttttattttttttttgacagggtcttactttgtcacccggctggagtgcagtggcataatcacagctcactgcagtcttgacctcttgggctcaagtaatcttctcactatggcctcctgtgtagctaggactatatgcatgcaccaccatacccggctaatttttgtatttttgtagagacagggtttcaccatgtttcccaggctggtctcctgggctcagcaacctacccacctcggcctcccaaagtgctgagattacaggtgtgggccaccacgctcagacagctacacttgtaaaaagtgtttgtttttttttgttgttttgttttttgttttttgtttttgtttttttttgtttgttttttagtggctaccataaagtttgcaatacgagtttgcactatagctttgttatgtattttgaaatcaagaagtgggatctccagcttatgtctttttttccccaagattgctttggctattttgaatcttttgtggttccatgtgaaatttagtattgttttgactatttctgtaaaaaaaaaaaaatcattggggttttaatgtggataacattgaatgtatagatcactataggtagtatgcacattttaaaaacaccaaattctccaatccatgaactcaggacatctttccatttatttgtgtctctttacatttctaccatcaatgctctgtagttttcagtatatgagtttttcatttccttgtttaagtttattcctaagtattttactcttttttgtgctattgtaaatgggattttttttcttaattttctttttgaatgattcattcttagtttatagaaacacaagtaatttttatatgttgattttatatattacaactttgctaaattcatacattagttctgatagttttaggggaaaaacttcttgacattggttttggcaatgacattttggatatgataacaaaagcagaggcaacaaagcttatgcacagcaaagaaataatcaacaaaattaaaaaggtcatctacgaatgggagaaaatgtttgcaaaccatatatatgataaagggctaatatccaaaatatgtaagaatctcctacaactaaatagcaaaaacacaaataacccaaatagaaactgggcaaagggcttgaatagacatttccccaaagacaacattcaaacaaccacaaggcatattaaaagatgcaaaatcaaaatgaaaaatgagatatcacttcacatctgttaggatggttttattgagaaagagagagagagaataagtgtccatgaggggacagagaaattgggactcttgcacattgtaggtgggaatgtaaaacagtacagctattatgaaaaacattatgcagtttccttaaaatatcaaaaataaaacttatcatatgatttggtaatcctacttctggatatacattcaaagaattgaaatgagaatttcagagatatctacctcccatgttcattgcagaacgattcacaatagccaagacacaaaaacaaccaacctaaatgcccaccaatagataaatggataaatgaaaatgttgtatatttatataatagaatattatgttgccttataaaagaagaaaatcttgtcatttgcaacaacatgggtgaatctgaaggacattatcttaggtaaaattccctgccatgtcaccaccagactgtgtttctatatttcttaaatttgggaattatatttttagatcaaaataactttttatgaaatcctaccatttttcttttgtgatttggcacttttcaggttttgtgctattatataactttcatatcatttccagagttattctccaactagactatatactccctaaagacaagaaaattgtcctattttttctcatactatccaatgaaccaatacctgctttaaacatattaaacatttaataaatatttaaaattttatttctgagtacaaaataagtaaacagatggcagaaagcatactatggacatacaagttcaccatgttatatccttaagagaatttgtataatgtgatttacaaagtactaactgaacttattaattctagaataaggaggccagaaaatatcaccaacttgctcttcatcatcctgagtatattatttgattgaggcaatgccatgtttggaaatgtcttaatgctttaagcaatacattattaaagttaaatgatttggctaagaaaaaattgtgattcatatattgtcactttttatatctatgcttacatttatttttatgaaaagttatcataagcttttatgcggtaccttaattatatttattggtaagtgtagggtaagtcctgctgcagtagcaaacaggcccaaatctcaagttaatatttatttctcccttacgctaaaattccagagtccctcagcaaggacgttcagctcacaatggggactcagggatcaagtctaatagaagagtagctaccttgaatcctgataatcattgttccagaaagaacaaagcattctgtgtgtttttgcaacagtaattcaatgcttgttccagaagtgatatctaaccctgctcagtatattgaccagaactaaacacaaggccctgtgcacacacaaaaagtctaataagcataaacctatatacgagatacagtttgccaacaaccacattctattactaattatattgaattcaaacaatgaagggacattaaaaacttttcacatacttttttttttgcttatagatacataatttatattttacaaacaaacatatatctcagtgtgttacttacataaaatcagtgaactagtaggtatagaagatgatgaataaatctaggcttctttggattttcggtgtaccatgttgtgtattgtaaaattttgtgtgcagtttacgtcaggtataaaaggttttatgttgaagatgatatttgagcagaagactaggctttttttttttttttttttttttttttttttttttttttttctggtgggtcaacaaccctatccaagagatagttcaatgtagaaacatcatttttgtatgaatctaacactaatcacctggtatgttgaggtcgagtttttgagctcttgcagtaagtattcactacatttttatttaacttgtaaaatatgttcctttcatggtcttggcacttgtaacaacttttctaattaagccaactcctaaaaaataaataaggagattccttgacatttaaaaactgattgctttcttaccctggttgttaatgtttcttgtaacttgtagttgttggttgtttgccaatactaataaaatgagctccttgatcactaaatattattatacagactttctattatgatgaattttctcattgctgcttttttcatgcttcactatttgttttcagatttttagtgatatttctatttggtgactgttgcagaaaacacccttatggaatgagacattagaaaagaaagtgcctctgaaacaattatgcattctgaaactctcaaacactttaaaaagttgttcatagtatctctcataattgattgagcatatatatgttcaatatatcattttttctaaacagtgtttcaaactttgaagtatttatattttttctatcaggtgctatttgggcaataggaaatttatttcctgactgaagctctttcataggttgaacaaacacaggtcttccaacataatgccaggatgtagacataatatcaacagaaaaaaagaataatgaacccacatgttctgtcttcatttaccaagtatccacttgtctgaaagcctttaaagtaatttggcattttcacctatattcatttggactttcaagcactatgaagacagccagaaattttagtcaaacatttatttgccacagttttcctccaggatatagactatttttcttccgtatgatcaacagtcttcaaaacgtggtcccagagagtaaaataaacaagaggaaagtgagataaatgagaggaaagcgaagtactagacaatctttcacaaggatctcaaaatgcttacagattctacttttgctttaagcctaacctgggtcagtaatcacaggaaaccaatcctttcatatatattttcaggaaagtgtgtgaaataaagttaccagtcctttcagtgagcaagtatttcatccataaaccttctagctactctgtggcatggctatgtgcatgcttgtgtggatgcccagactggacaaaccttagtgaaagtgaatacaggcaagaagaatgatcattctcagtatgctgggtaagggaacacccattaaaccatgtacttttctatgtatttaatatacattaactcatttagtcgacataactttggggtgaatgtcacttttaaattccgctttccatttgaagaaataatcttgtaattaaagtgaacagtccaaagatacatagaaggtaaatgttagaggtgtcatttaagcctaactatgactccagtcttatgttcttttaaaatatgctgtatcataaaacaagtatgaacactcaccaggagcctcctttgtatgtgtatctatttgcttctggaatagctgtgttgggagatttcagaagcccagtatggcctgcatcttatatgaaaatacttacctaagggaaaattttagacttcctactacaaaaagaggcaactatttgtttaccccaagcttaggtgaaattgtattacctgagtcctagtctgtaggcttagttacaatgacagcgtccaatatatgtttccaatgacatgcatcttctagatttcccttaatcctatgtgactggaatgaagtatgtgagcccctggcaggcatgagtctacagactcatgaaccacatggggattcatcacctagggttgctgacctgctaaaatgcctcacattgaaccaatgaggtacggcactgagaaaacaacttcaaatgcctctggtatgtcaagcaacatattttagtagagaagactccagcaaataagagaatgaagagtgagggtagatcccggtaaaacgaatggtggttgcattagcctttctggaagcttcaacagggcagtggtgagactcttggtaatgattaagtcttccaagtcaatcattttgaagactaatatgcattttataacaatggttattatatatatttgtagaggaggaggtgagagagttgtagcaaaatgcattttaaatagcaaaatatgaggaaaaattaaaatatttcctaattttctaaaaattaaaaccttcacatgtacataaaatcacacaaatattatgattaatatttctgtgttcattgttaaattaaccctctggatggggaaaaaaagataataaaggcaaggagtaggttatagtttataggtctgaggcttcatggacatttggatgtactctggtattttatgaaataaaagggaactgaaggtccatctcaggctcctgagccccaacacagaggcattttcccttatctaaagggagaaatgaaacaaccctttatgcaaaatctacagaatgagaattccaagaatttgtgtcctaacagctcagatgagaaataacataacttatttaacgctcagagggactttgatgtgagtgcaggtgctaaggttgattatttgttctttcctttgtcttagccagaatggccaaagacctacatttacaaaggcttacattggaatgaattttctgcaacagtaaatggaacacagtacttcagctagggcatctctaatgttttcagtgtgtgtttatgtgaaatctagtaaagacccagagaaataaatgttttatccttcctggcaaagactattttaataatacaagttggtttttcagatttgttgagagaatttctattaagcaagtggaagcacagtttagggctagagtgtctcattttggtgaatgttattttttttctttagattttaattaagttatttcttttgaaattaaaataaagttattgaggacatttattcgtttccccttttatacctagagtacagacttttttctttttaaagagaaaatgtttttatttcaaccttatttttgaagggtggtttcactgaatataggattcttggctgaaaaaaattccctcctctgcttttattaatactttctagaaatatcacatatcttctttaaattaagtgagcagaaaattattgtccattatggacacttcagaggcacttctgaaagtgatagtacatgctattatttgtcacattgaaacaggaagggttcctttgtccccctctcagggcctatgggatgggggcatggctcacttcttcagctccccactgctcaatcctctaggggagcatacagatgggcaggctgtggggctccgaccctatggcaatgtctgtggtaaaaatgaatgtttttcatttcattttcattatggtaaaaatgaatgtttacagctgaagccccagtgggcatgtgttacagggtgctcttttagtttcccacctataggtggcctgtgttaaccagcttaattagaccccccttccttatcacaaggacagagggatttctgtatcccggagtttcttgccttgctgtactggaagaattggatcacacgtgggcttgggaaattagtgcaaggttttattgagtagaagtagctctcagcagatgggggagccagaagggaaactggttttccccatgaccagccgcttgtgtcttcttccattgacatgttcctcttgctgtccagcaacttctgtccttaccttgctagggtcttgggtttttataggcccaggatgggggttgtggcaggccagggtggtctttgaaaatgcaacatttgggcacaaaggcagaagtgcctgtcctcaactaggtctgtggggatggagctttagccagggaccacacactcctctactcagcacttcccttcccctcttctgtatcatttaaagggaccactctcttcccttcccagcactaatgtatcaatatatctaaatgcatagcatgctaataattgcactgggagaagagacatgaactaggactgtccaagtaaactaagatgtatggttaccttagttttaagcaacagtcaggtactgaagagaaagcaatggtgaatgattctaaggcttcattcaatcacaggcttgttctcatatacaagtttatgaagaaacatgactaaaaaaacagattgtaccaggaaagttttaaatatacgagctgaaatctgccataaaaaaattaaataaaaatattttattccagtaattataggtattagtctaaggaaagtaagtagcatatgtatactaatgcattttgttaatttctccaagataatttctcaaacactcagaaagaataaataataaaacaggctttctgagataatgagtataagggaatgcaataatattgccagtctcctgaaaaaaaaatctttcacagtgggcattttaatcaggatcattagggagagttggtgctgaacaataaatcagtgtgggagaaaaaatatatatgcatatatttcagtttgtaataggagtctatgggattgtctctgactttgggcaagtaactaaactttttctgtgcctcatttttctcatttatgaaattgatataataatagtgcctccattataaggttgtggtgaggattaaatttgataatatatgtaaaacatgtaaaataggggtaatatatctagcagcatactgcttaatgattgcttttattatgttctcaaaaatagtaaaacgcagctgggcgcagtggctcacgcctgtaattccaccaccttgggaggccgaggcaggtggatcacctgagattgggagcttgagaccagcctgaccaacatggtgaaatcccatctctactaaaaatacaaaattagccgggcgtggtggcacatgcctgtaatcccagctactcgggaggctgaggtaggagaattgcttgaacccgggaggcagaggttgtggtgagctgagatcgtgccattgcactccagcttgggccattccaactccatctcaaaataataataataataaaaaaacattaattatgttccagtaatttatctctaattgcaataactttaagtttcaccttttttacttgcctcataaaatgagatataccaaccattgagaagccttgaatatatattcatgtgtattatgctgtaaagaaaaccatttgatactgtacctaacagacagtcattctagcaacagctaagtagggaatccttgaatagagtcctagaatattcatttacttgtttatttctataatttgactgtccatttgtgcaacaaatagttattgaacattcactctgtgccagagcctggggatacaggaggggatattctaaacaaagtcaatcctttcttatggcttccctagtttctatagattctagtattaaaggctggacaaataaatagatttatcaaaggcaaggtaggtaagtgctctggaggcaatggaaaatagattaagagcattaagtgggataagaagagacagaggtgggagaaaagcattgcggtagggtgacatttcagcagagacttcaaggttgctaggggaagtcacatgctgttatgtgagaaagcactccaggtacagagagcagaggccaaagtcctccagcctgacattggttggggattcctgggacagcggggaagccggattatcttaagcaagtgaaagaggaagatggaggtgggaaaccatgtcagacaggaggttaggtgatgggcaactttgaaggccattgtaaggacttggctttcattctgagtaagattaaggatccattggagagttttgagcaaagattatgtgaattagaatacagaagtacttagatttttacttttaatatacttattaagagaaatgggaaaacaaattcctgggctccatgaaatactcgtccactctatcagtcaatggtagattctgtcttgcagttctccaggccctctgaacagctatctaatgtcctaaagtattcatagaaacaataaaagataagagagtaagagaaaagaagaaaataattttaaaaatttaaaaatgtgttattattgttattattgccttaggacaggtaaaagaggtaagagatcaaggagataactcttggacaagtagatctcattacaacttttagtacagtcacagatgctttacatgatcaactgaagcagacttagtgttgcttttaaggaggacagcaggcacagtcttatcaagttctgaatttcctcacttggtcaagcagttgctgtgtgactttgaaagagttattaatacattagtaatctgtgtttgtttcctcatctgtgaaattcagtaaatccatcttacatgctggttgtgaggggtagtgacctggcaaatagtaatcacaggcaagtgtttgttgtcattgataacaagattggatttctaagaagatggtgttgattgcaagatggtgtttatcaagatatcttgataagatagtttttattgtgagatgcattattaagttgagctttgctttaagcataagagactgcattaagtgcactaattgacttttaaatctatttaattttcagaaatgtcaaatatgaataaaaatatgaaatgaatggagggtttatgatcagggatattctatgttacacatttactgctttatcatttaaaataagcccccaaattgaaagtgagtcaacatttgacatatcagtattttccaaggaataatttgtgtagccagttttcaaaactagaggctataaactactctgatttttaaatgatattgataaacaaggagacatttcattttttaaatgactaatgtgattatcaaaataaaagaataaaaaatataagacttgatttgactaatgggtaaaacatgaatgccactaggtaagactatttctatcatgacattaccttaaattagaaatcactaattatgtatgcatgtgccaaaatataactactctagcaagtgatgaatttgcatatacaatgattttaatcaaggcacttctttgattgtacaattatctgttttgcatacacaaaatctgaattctgtacatgtgagtcctcatttgtatatgcaccaaattattttgttggtgcaacttagaaatctctacttgatatattagggcattatttctcttccatttatagtaatatgttttcagtttttattaagtagtaaaaccaaactccctggaaaaacatgggaggtgggccctgcctctagtcataatagagggaaatgccactgtatttctattctgtgttaagaaaaagcaaaaagtttcttctacacaccgtttgttcctttctgccttcttatttggaatgtatctcaaaatttaaagaagactttggttcacagagagaacccttgagtggtaatcatattgagttcactcaattttccacattgttagtctgtaaatgatgagagtagggtgttgatccttactactcttaagcaacagagaaaatttagaggtggtggaaagtaccaaatttatagtcctagagacaaatattctctgtagagttcctgaaaaaagaaatagccggaaaagcagtgaggcaaaactcgttatttcattatggtcttgctggacaactgagactccccttggccctcagcgagagcagtgtgctacatacagtaatctgggcacattgatgaccgcagtgtaaagctcttagtaagtgggatgtttgttttgtagttaagtcatcctgacaggcccattgggtcataaacctgcttacaatgcaaagttattcacaacctcaaaatgagacttctgtacattacagataggtcattggtaacagcagaagtcttagctttttaatcattcaaatcaagatcttttctgcatatttgggtttggtcttgaggattcaactgagataaaattgtctcatatcagtagatacaaaattaccacggtccttctgttgtctacctgcctgcagatgtgtccttgcaagaatgggatcctatgttaggtcaagagtagaattctagcttgtaaattttcagttttgctacctttgctgtgactctagggtaatttgataatcaggctataaagagatcctttcaaagtctctgaattttcgaactttgaaccttgcttttacgtaacactgaattttctataatgcatttcttcttggctacatagatgacccactgttattggaataagcccaggtcaaatttgtctatgatgtctcttcaacaatattttgtagtctgttttcttccagtcttcactttcaatctcctcagggagggaatatatagtaatgaaactatattacagtaattagagtcagccacattgagacagccaagcaaaaagggcttcctggagaacctctgaccaacctgcacactgggagaatggggtggagccatggaaattcctgtcatttgcagaggggaggagcctggtctcttaagttcctgtgtgatggggcgggagctggttaatcggcttccctcttgctcagctgaaagtttttctctttttccttttttacccaataaattgttattctcacccttctatgtgtccacgaacctaatctttcctggccatgtgacaagaacctggttttagctgaactgagaagaaagccctgcaacaacatctggtgtgatagactgaaccatgcctccaggtatgcgtatacttgtcatctttctcattaactctgggtttgttcatataacttattttgaccaatgggacattagcaagcttgataccaggagaggcacttgcaatggggattctcctttgcaaaactccttggagctgagctgcatgctatgcgaaaaaccatgctagtctgctatatggaaaggatatatggacagccattggaaggtgactcaccatatagaaagaggggccacatggaaaagaactgagacctccagttaatctcttagctgaatatagttgcatgagatccctattgacacttattggagtggaataactgcatagtcaatccactctcagcatcatgaggaataacaaatttttattttaaggcactgagatttagggtggtttcttccatagcaacagataattgatatagttgggttaaattcagcctccattatttgctgagctatgtgacttggtgagtagtttaagctttctaatcctcagattcttgagctctaaaatacactgttatttccacaaggctgcggaatggattaaatactgaatataaataatttagcacaaggcctgagctatagtaagtgcttaataagtggtagtaattaccatcaatttcatcatttcagtcaacatcaccattatcacaaatatcataactattagcacccatgccaacacgaactccgcaacattgccaccaatactttcctgatagctagtgctttcatgatgcccttagtgtctactgccacggagaaaatcaacctttttcattaagacatttttaaaccatacatacacacaaaactttaattttttaaaccatacatacacacaaaacttttattatcctaaaatatgatgtaataaaaataagttatttacatgtccctttacatcatttaatcagattactaaacaggtaaagagatttgacaaaatcattcagaaagcaaatggaatggctatatttgaattctgtgtcttcgtgtcattaatgctgagaccttttaaaaaattctggttgttctaaaaataagagcttgcatctctcactagaaggacatctccataggggaagatattttattgcctttagtgctctattcctagtgccttaaaaattgcctagtatataaaagctcctccagaagtgtttgttgaatacatggatcaattcacaactgattggaagtttacaggacatgtattgtgtagccagaatatctgagtttgaatctcagttctaacacttaccagttacgtaaattttagcaatttaatatttttgtgccccagttttcttatatgtaaagatgataataatagcacatattatctaggattgtccttataaatatgaaactctgaacagtgcctggcaaatagtcatcaccatgtagctcttgttattatcattatcttgttatattgagctctattggtgcatagaatagtatatatacattattgatttaaagaacgggaatatgtagcatattgaaagaaagtcaagagagatggtgttgtgtggtctaaaacaatggcttccaagctccatttttgattaaaatcatctgggatgattattaaaatccagatccctgcccactctactcctccttccatgctctatatttgtaacaattgcaccaaagatcatgtttgcatagtcagctttggaatgcagtgaaatcaaatgaattttaataatgcatgttcaggtaccatatgatttaattagagaagctattttggtacaggggtttttccattgacctataaattcaatcctgtggggagttgtgcattctaccatgtctccaccatgtgccatttggatgtctcctctctcctttcttcctttcccttcctcccctcatccatagagagaagatgactactcccagttgatgctgaccctcccaggaacatgaaacaaaaaaaaaaaaaagtatggggtctaataggtccttgctactcaaagtgtgatccacaaagcagcaacataaacatcacttgagaacttgttgaaaatgtaaaatttcaggccctaatgtaagggattttcaactccatttcctgatataatcaccagggagctgaagcatcaaagtttagatgttaggcttcatttaccttgagagactctgagttaattggtttgggtactacccaggtctaactagccttttcgacttcacagttgattctgatatgcaacctggtttaagaaaggagagttttagcagaaaacttcaattgattttgaaacttctacttccatggccttcttcaagcacctacaagactctgggtttcagaatattcttcagatttccttgtaccagtggaccagtggcagatttccttgcaccaatttcctcttgaccccattattcatggttactaaccaaacctgccaactttggcatctacccccttttctcagtaatcttgagatctgaactagctgaacaaatagactggaaagcattcacaacgtcagtaggaatgtggtacgaaaccaaaagcattttatcacattttcaagcaaaactcaagtactttcaagcataataatgacgataacgtctacttgtattatggttaggactatctacccccacaaccattgttgttgctttttgtaatcggactattgcaaagtgatatgattgcctttgaatagattgcagtattagaataatatatttatatttttgtaaaatcttgtattttgttcactcacaaattacttgactgaaagagactgactttcttcaatcctttacagtttaccctggaataattaggtaataagagggaaaacagacatagaagctagtcaagacccagttctttttgtatgtgactcaacaaaacagcatttttgctgtaaatcttaagataatctttgaacactgaatcaagagcactaaaagtcaaaaccaaatcaaacgtttgaaaaattaatgtcttgattgaagtcccttggggagccgtcaaaggaacagagttatttatatactaccttactatttacagcatggtctttaaaccagcagctttgtaccacctaggaactaatagaaatgcatattattgggccttacttcagctcagattctaaatcagaatctgcgttttgaaaagatagcccacattattcatagacatattaaggtttgagaagcaccaatgtaatatacaataaggcttttaatatttttttccaacatttgctttttcttaagtcacaccacatacagcatcccatacagttgatctattatttcttacccaaaacctatgtaaatttttttacgccttcaaaattgttatcttcctgccaaccagctcccactctggccatttcttattttaccaagcagtctagtctgagggaagggggaggatgctatacaaagacactctttcataacattttccttatcgcaattgaataagaacaaaaaatgcaacactttctctcaatctgctctaaactggtaaactctcaagaagtaaaatgagtaacaattttatgtagagtcttctttctctaagtctggcaatgtgcagagaatccttgaaaataccagtttaccagtactgtgaaagcacacaaatatgttgtgtttattcttccaagagagacataaatgggtagcaacttctccagagattaactatattgttccaagttatatccactcatcttagtttccaatgaataatcatagcaatataaggcaattatgtaagctaaggaatgtaaattcttttttcttctttctcttatggtatggatagtagagaaaacaaaaaataatttttgtgtcagtatccactgggtattctgctatcaatctaaaaactataaagtatttcttgtaactactaaaagagtaactaacaacaggatattacttttctagttgattgagagattgttaaagtttgagtaagtgaagcatttgtgaaaataaacatctctgttgacaaaatctggttgaaaactaaagtcttacttttaattgaaaagaagaaacaaaacatcctaaaatgcctaatgaactgccagaaggaaactcattcaaagaattttaaccaaaggttttataggtaaaataaaacctttagaatatcaaaaagaaaagtattccgtgcagacataagatgagcaaaataaacttaccacagttgttcagttaatggacaggcaccatcatctgaaacaacaaaaatgtattttgatattgtgatcataaaaactaccaaaacctttcaaattgtcttcaaacacatgttatggacatatctatagaagcaaaataaaattaagtaagcaatgaagatacgttatctgacctcaattatttatttcagatgaaagtgtttcatcaccaccatttaaggagtaaaaaagatattagttgtttattcaaaaatcttttttataggcatacctggcatatatatgtattgcaccaatattttcttctgatatatatgtttaaaaggcaggcaaaaatacagagtcatctctttaatacaatcttggtcctggcacaaacacaatcttgaattactggtcctaattctcagctctgacagtgccatatacaccaccttcctgagctcaaaaattctctttgttgcctacctaaaacaaactaaagtgtttagcatagcattcaggagctttagtaggttggtcctattctaactgtttatgattcttttccataattctccagtgcatactcatgctacctttcaagtttatctcccactattttcccttgtacactagtctcgaatcataagcccaccttcccttcctccctccctccctccctgcttctctttctcccttccttccttccatacttcggtttacttcatttgctctgcctcaatatttttttctagccattccttatggccagctcaattaacatttcttcaatagaggttgtcttgacacctagagaagaaattattctctttctagatgttcccaccatattttatatgtttattacagtatttatcagattctattttgtgtgtttagcccatattggtgtttatgccttaaccctgttcattgttccctacccagaagacttcctgctatgcctctgaaataggagatgtccagaagattctagttgagctaaaggagacaatttatttagtgtatagatagcatatggtgcacattttccatattttgtcaatcattctttaagtgaaaagtgcaatttccattgcagtttctggaataaaacttgactgttaaagtcatagtaatataccctatgaacaaaacttcttagtttaacaaaaaaataaagaaattgagggtgaagaatgtcctttattgataaatgatttttagaaaaattctttaagactttttcaatcatatgggaatacattttatttttatattttttagatttaaaaaacatgttttttccccccacagggttaaattttgtataaaaagttagtgttttgaggaacagtgatagatttgctttggcctatgaacgtggtcaccccagcaccaagatggaagttactggcatcatcttagaaaagagaacttatcttcttatggaaaatgaaataataacattgccttgttgctaattttatactcctagccaactatgctagatcagactctgcctatatgaagcatacaggtgtattacatacccacaatgtctcatacttcactattcttcagggcccacaaccactttagacttcaaaatgttggcaaacaattttgtgtagttactcgtattaaggttttctgtgtctaaaataattataaatccactattctgctatttcattaagaacttttcttactgtttcatgcaatatattacatatcaagagaaggtattactgaataataaaattttaagtaacagaagtaaaaactttagcataagtatttaaaataaaagcactggtttcttaatttggtaagagggaggactttattaggttctttgtacctaagcatagaatgtgatagttcaacgttcagcttctcagattttgtgcttttcattccaatcccctctggttctcatcataggaggaacatgacctaacacacaattacaatttttctctaaagtatttgtgatttaaagacacccctacagtagaatgctactcagtaatttaaaatgtgctggtaagtctagattattattggacattttcccctccaaaggtcaaagttttcaaagtgttctgatatggcttggctgtgaccctacctaaaattcatcttaaattgtagctctcataattcccacatattgtggtagagatccagtgagaagtaattgaatcatggggggcgggtctttcccatgtggttctcatgatagtgaagaggtctcatgagatctgatgattttataaaggggagttcccctgcacacgctcctttgcttgctaccatgcaagacatgactttgctcctcattcaccttccgccatgattctgaagcctccccagccatgtggaactgtgaatgaatcaattaaacatctttcctttgctaaattacccagtaaacagctttcctctactaaattacccagtcttgggtatgtcctttattagcagcatgtgaacagactaatacatgttctaaatagaataatcagaaatcatggaagtacctttggaaatattaataaaagtgaactgaatttttgttataattattaatacctatcatctatattattttgactttctttaaaaaatagagtgtggacctaactttacctactagttttttttttttttttttggactggcacaggtagatgagtaaatagaaaaatatgagttgtaagtacccattgatttattgctgacttgcacaatatgttaccttccgtgccagaggtaacatagttgggtaaggaacagcagagatctatggcttcctacaaataatgactcaatggcagtcgtctattttactcaaatggtaaccaaaatttaactaagatactctccccagagagaaatataaagcagggaatatttaaatgtccccagtatctgttctgaggacatttaaaaggagattttctttcacatgattgaaaacaccagataataggaccaatcaaaatccgtccttctaatactacaacatattttcaatgacgtataattgttaactgtggatctaattcgctacctttatctaaccaaaaaaaaagttttttttcagttcaattatcttttccattcatttccaaccacatctccccaccccctacagaattttgattagctcctgagagtggcatctggaaaatatagaaatccttccagttaaaacagataattactaaatatataactattgattgagagaagaaggaagatactgtaaacaattttggagcttttgctttgactctagtgatgctggtaagagtgaggaaatggagtcaaaccaaatcaattgatttatggatagcatatgcacctacagaaagtttctcttaaaagaagtttcctgagaacctttcagatgcaaatttattcaaataacctttagaattacccatccacttctccatattcgaccatttaattcttataaagggtgtctattttctataaaagaatcctggcatttgaatgcaggaacagaatactaagttggatattgtcccaatattgtgatcatatgatttgttggaaaatacagtgaagaaaaaattaaatatatattattaccttctctgtatatctgtactaggcaggtggtaggaataaacaagctatttcagtattgacttgtagaaccaattatagaaataattataaaaataaatgcaaataggtacccattctgggcatagaaaattatttttgcaatgaaattcttatgagtttcagtaatatcactgaaatacatacatgcatacataataatctctgtctctattacacacacatacacatacgcacacatatatacagatatatatacacaagtaatcagagaaatccccctcttttctaattacatcagatttctctgtcctttggcatttcctttttctcataccaaaactccagtccttatttctcatatcagtcaggactaagtccaggacttggactgaagtggcaaaaggtgaatggtaacggggaaaggaactgagtatgaagggtaattggtatgactgaccttactatatatatattgtttaaacagcctgagccaaaaatatagaccagcctttctctgtaaaacaagaagtccaaatgttatatcttattttttttttttccctgaaatacaaataactcttcctccagtcattgatacggtttttctacgtacccaccggaatcgcatcttgaattgtagtgcccataatccccatgtgtcctgggagggacccagtaggaggcaattgaatcatgggggtggttacctctatgctgctgttctcctgatagtgagtgagttctcacgagatctggtagtttattaagggatttttccctcttggctcggcaattctttctgccttcatgtgaagaaggacatgtttgcttctccttccgccattattgtaagtttcctgaggcctcccaagccaagcagaactgtgagtcaattaaacctctctcctttataagttacctagtctcaggcagttcattataacagtgtgagaatggactaatgcagtcataattgtgagttcttcgtgtttattacagggcaaacataaaaatacaaacgaaagttggttcatttttgccaaaaagttgtgtcagatattgtaaaccgacagtaaacgatcttaatgcaaaacatatttgaaatactggaataaaatatgacaaatgctgtaatgcatccttgaaaaaaatatagtacagaaatgtccagtggccaaaactgaagaaaaaagtggaaatggttaatatgcagtcagtgatatttggatgttccctgcaacatttgtcaatcttaaagaagagccttgggatctctaggagaagtgataaaaagtctctcctaaaaatctgtcacaaatgtttcaggtttgaatttataccacccacaaggacaaagaaatcctaaagggagatttaacaaaaaatttcttcctgtgttgttacctcatacatttaatcaccaaatttctctggaagggtacattctcaacagaggacacttaggatttataaatataaaatcctgttaagtacaagctcaaatccatagttataaaacacatgaggaaatcttgagtgaaagtcagtacaaggatcaagatcaagattagaaataccaaaacattgagataatgcaattccaaacatagattatgaaatgagtatttaaaattattaaaaataaaagatgtctgagcaagtatgtgaaagacatatcaaaaaaaaagacaattttcagtgggtacccattttcagaaaaatgaaataattgaaactgagtaaataaaccaatatattaaacacaactaaaggaagaattaatgggcaggcagagctgaagaaattatccataatgttgctcagagaagcaatgaaaaataatgtagtgagagggcatatggtatgtgaaaattacggtgagatggttcaacatttgtctaatagggagaaaaaaaaaaaaaaaaaaaaaaacaccaaaaaaaaatgaggtgccaggcgcggtgtctcctgcctgtaatcccagcactttggcagccaaaggcgagtggatcacttgaggttagaaattcaagaatagcctggccaacatggtaaaaccccatctctactaaaaatacaaaaaattagctgggtgtggtggcacaaggctgtaatcccaggtacttgggtggctgaggcaggagaattgcttgcactcaggaggcagaggtctcagtaagctgacattgtgccactatactccagtctaggcgacagaggaatactctgtctcaaaaaaaaaaaaaaaaaaaaaccaaaacaaaaaacccagaactaatcttaaaagaataatgtacgaattgtgatatcacatgtataagttgtgatacatttctaaatattgttatattttctctctctctttctctctctctctccaggaagcaaatcatatccgaagtaagatgcactccttagattttgaaagcactgcataatcactctccacacctccatgcacttctataaaaaatgactctatttcatttctccctgttctcttacattgtaaaaaatattttaaccatgtgataaatccagtgaataaacagtggtgtaatatcaaacaaatcagtaagtaaatacagtgggataaaatgagtaagataatttattaatttttttattaattaaactaaattttaaatgtttgtttataaaacgaatatttttaacacctaatatgttttgtattctattttaggcattggggatatagtggtaaccatgtggacatgtttcctacttacattattgtggcatggagaggcaagagaaagaccatacacagctaaacaaataaaggaataagataatttcagataattagtgaaatggagaaaataaaacatgtaatatagctcaaaggaggaatatttagattggatgggcaggcctgagcaacacagaacaagccagccatgcaaggtaagaagacagaatgtttatgtaaaggaacagttagtacacaaggacttgtgtacacttatattcaagcaacagaaagaaggccaatgtgactagaatctagtaagcagaacagagtggtaaaaaatacatttagagaggtaggtggccagattaaggagtgcaagtaggccagtgccaagaaatttgggtttatattccaagggcaatgcaaagtcattggagggttttaagaagttgagtgacattatggttttgtcttaaacatgcctccggctactctgtagaaaactgaaagccaaggaaggagcaaaaactgggagatcagttttgaacctttccaggcaagagctggtagtggtttatactaaagtgtagctggagatggagaaaactggagagattggtatagatctggaatatattttgaaggtggaacaagacttgccaatggattagagagtaatgagtgaaaaaaagatattaaggattattgctgctttggaatattagtaactaagtggatattagtggtatttactgagatgagcaacactggaataggaaaaatacacgtttactgtatctgtatcagctgtgttgattagcgtcaacacacattttagccattttaagtgggacatatattagatacatgagtacaagtgtcaagtaggaagttggatgcggaaacctatagttcagtggagagtctaggactagagataaacattgagaatcattatcacagagaacatgtatgaagtcaagggaattggagagtacataggtagcacattagagagtttaggccagagccccgagaagtcctgatattaagagtgggaactgaagacatgttgcaacaaaattatgtggccctgtgctagatgggatggtttaattcagtcttttccaagtccctactttatgccacattctgtgctttctgccccagtgaacaaaatcaactggtttgtggtttagattccctaaaatcatgtttatttccccatcatttctggattcaggataacatcccggtggcaccctaatgatttgtcaattttaaccagctctttattattccagacactaagcatttcttataggaaacactctccttcatttcctcccaattcctttcaaaatctaaaactcacaatttcttcagtaggaataaataaaattatgatattgattttctctgctatgcattttgggaaaagcagatacaacaaatttacaatgtagttgcagcttaatatttttctctttatttgatcctatttttgcaagttataactgaacatggaaaattgcaatggctccttgattaaggtgatggattctcaggttcctcgagggttaccaattaccatagaagttgtaggcaaagcaacaatgtccatctaactccggtagaagaaatcaggtgaaaataaggaaaatcattagaatccctttaatcctaaattaaatagaactgtgtagatagacatcactagaaacacacttcatgggaaacattctgctctggggcatgctttataacattagcctgggtaaatctacttcagtttcaattaataaaattgtaaattcaggacttgtgctttagctaagttatagttcgggtttgtgctctgttagattattcttttttaaagcaaaataaagctgtgaataaagcatgctctctagaagacattattgtggttggtgcaaaatcgaatttttatcctgtaccttgggggagacagtttaacaaaatgtattttcccccattatcatcattgtttccatctaagaatgttttccaacactgaaatcatttttatgtagccttggaatgtgtattgatgtttgtcctttggcttttctctttcttgagataatttgtaatttgcttaaacattgtaaacactagagctttgcatattttctgcatgtttactaatctgtttgtgctaaaaaaattgcaagtttgccatttaattttgctattattttccctgtgcattaaaaatgtattatttggataactttggtttggaatatgaagggctaatgttaaaatttacctttgcactctatttaaaggaataaaatatactgagaaaattgaatagctaaaataggattttaaggagaatgtttgcatacctaagaagacaaatgtttttgaaacacattaaaattatcacctgaaaagtgctgttaaaaagatggtaagggccaatcattgtttaggccattactttgatttcggcttagggactttcaaaatctgccttcttttgtctctgtctttcactctcaattagaaggcttagaacattaagcttgaagtaaacactaagctgaagttctattccatgaagtaaataaacagaaagaattaagaaagtaagagatagaagaatactacatggttgaaaaatgtgagccttcaagaaatattaagaaaagcaccctccatcttttctacaaacttctaccttttcactgaaatcaagacatctcacatttacgatatttactcatttatccactgtagatcagcctctttctttcttcacaatttcaaactgataagagggagaattttgatatatttgatatgttcttgagttttcaataccattcccaaaagcaagaggattaaagcaagtttttgagagcagggagcaggattgaaagagtgatgtgggataagagagactgacaaagttggatgcttgaggaaagagtctgtggggaaggagaatattaatgagcaattttatagtggagataaagaatatgtttaaggaacagtaggcttgaaaaaaatatctaatatgaactctttcttctttctttttttttttgagatgaatgtgtcttccgtagaaaaggcatttttttctgattcttgtctattataatgctgagcactggagctctggagctcaacagattagatttgaattaggagtttgccattagcattgtgaaaattagtaaattacttaccctctctgaacttcagttttctcataagtaaataggaatagtaatagtacttatttcataaaatactgtttttggataaattagataggcttaccaccaccatttaagttcaatccctcattacctgatttataatactgtagattggcttatcgatatctgaaatttaaacaaatcacctaaaagcatgtctgtttttggtgtctggcttttttggctccatttctgagcatcgaccatgatgacatcatatatgataattgtttactcattttcattgctgtgtagaattctaatatatgaatatacaatggtgaattcatccaatttactattgatgacatttaggttgtttctacctaacatgattataaataatggttctataaacatatttgtacgtgtttaattgtgatacatgtaaaagtttgttgaaaatataaacagatagggtatctacattgagtataccagatttatcaaaataaaagtggatacctctgaataataggatatgaagaaatttttgtcctatcctaaattttccacaatcaacacaaaatctatttttttgaaattgttataccatagtgatttagaatatagagtcaaaaagccaaatttcacttttagtgccactgtttattccctctgtagtcttcacgctgctaagactcagtttctttacttgttcctctgtaaaatttggaatcagagtatctccctcacatgatttttgcaaggaataaattatctaacacacataaactcatttcagttccttgtacacgctaatcattccataaaagctagttgcaattgtattactatatttatgataaaagaactttgtttcctttcctctcacgtaattatcttgtaaaattttggttagatataaggaaaaattatagtgtagtaatttttttaaaacccaaatacttggaaagtggaagacttttaatttttattgaccttataagaacagggaggcaatctgcctgtggggtaagttacccagaagtacagctaaactggttaattttaagagacaggattctgcaaatgcatgaacagaagctatgaaagtaacattggcagtagagagaaaaaaatacaggaaatttactttatcagtatagtgattgaatcattactgatgcttctcacaactttgtttttgtttttcattgttttcttaaacattctgacagcaaaggaaattattatatgtgcaaattgggtatcacttcttaaacttttgaatcagctggaaactgcactcaactgaaccagagaaatctaaaacaaataaaataccatttatgagaaagcatttaagaaaatcataagcacgacaagcattttttcccaacccatacagctcaaatataaatgattctaaaatgtatgtgccatgtttacaaatgtgcccttattgagattcatacctgcattacttgtttgttcagagccctaaaacattataataaaattgaaactctcactctcaattagcggattcatttcaattaagaaaggaaagcaaaagaataattttcatcagcttccacttacttcttagtaaatgctgtgataaaatatattttaaggaacccgacattacattaagaggcattatattaaggaaagaatagggatctgggttatcagacagaacattgtttgaaaatcaatactgccatttactagttttagattttgggctgtttttcttatctttcaaaaataacaattgtgaagattaaataaaataatgaacataaaacatccctcatactgtctggcacaaagtgcgttctcagtaatcatattttctttttcctgtcattctattttttaattatttccttctaagtaatataaatttcccaatattggtattagtctggtgtgttagagactttttatatcatgcaatgtattgcaaaatatattaaggccttttaaaagatcagtatttatcaagaatataagagactgaactttctttcatcaaaacttagacacaattattgaagtataacttttctgaaatgtgtctttattctagaatattcttatctgacaaagatagatgagtaatattctcatattatgctttcttattttaatataaagacaaatatatgtgtgctgagcttatctcagtatactgttcctacaatatttttataaagtcaggggtattctatgataatattttatgcacctgccactcctcttgcatatataatctaaaacaatatccaatagcaagctttaatatatcttcatcattgaatgtattacattggaattaggtaattttttatgcatatgaatattttattttaccttgagtttctccaaatctggaactgtttgcttgggccactcctagtaacatggtccagtaacctgacatggaaatcatttaccacttcaaatatgcagtattaaattaaatataattaaactaattcaagaccagtaacacagctggtgagtaaacagaagtaaattcaaaaaacaaattaaaggagactgctagaactgagagcacttaaaatttctactgaaaaacaagtcactaagatgagctcaatataaaaagtacaagccacaaaagcaaaggaacccaccataagggagaatcagtaactacaataagctgaaaaatttacttcccaagaaatcgtagaaaagcccaggactggttactttcaaatcccagtagagtaccatgggagcagctgattttcaaatttgctgtatgtcagtatctcaatgattttaatccatatataaactcatattttagatgaaaaatgtctaaggtttctaatattttttcggcatatacaatacagataacgataagaaactttggtctaacattgaatctaaatattttatttaaaagcatatgaataaatgaaatgtgtaatatgttggcctgtctgactaccatcttttactacctgcaagaagaaaatatgaaacacatttttaataaatgttttatcaaacacatttgtaaggtaatatggcacaatgaaaattatagtaaggttcactaagcagccttatacaaattcaataaatgctagatgtctttaaagacagcatcagttgcttagataagtgaagtagccttcctgaccagaggttactggcacaaatcaatacaatgaaatatgcattcagtccatatggtatttcagtaatgggtgcttgaaattcagtacacagctttgctataaatcacagacagaaattatattaaaagaaagttcgttctgtgatttgaactcagaaatcaatggaaatgtataccaaaaataaaatacttttagacatatacatcaaaagaaaaatgatttgtgtcattgccattcatatttcatctttttgtttcctatgtccagcttacattggatcctttccatgtctccctttccccacacagaaatacacaagcattccccattgggaagaaatccacacatgtgatccttattaaaaatataagaaaagcaaaaaccagagtagccagaacccgactatgaattccttgctaggaaaagaggggcatgtggcttttgctggtggagggaaaagaggctttgaaacaggaagttttagggattagaattagaaaaagacaccataaagcaaccatgatgctggttcattgaaactgtattttagttttgttatttatacacacttaccctaggagttgaataatgacaacattttactactgtatattaaaactattattgccacatgtcatgggcttcccaacatgctttcctgcatacacatgtaaacaagaaacacatgcagcagaactctgcgaccacggttgtgctacaaacagaagctgctgtgataaactgactgggtgatgttcagtgacctaaattgaggcttagaataagtgtgggcgcgtgcctgccttcatcaaatgaaaagtaggccaaatatacatgtttgcttttttttcccaccacagctgcaaaacctctttgtgtgtgtgtatgtgtgtgtgtgttggactagaaaaataaatatgccattaacctgaaaaagaagtgaaccacaaggtgggtttccatcaaaatagacataaaatagattacatattaaactccagattgggacatagtttgtgttcctattcaattcccaataatatattagagtttgcaataaataataaattccctgaggatacatagcattgtgtctttttttttttttacgataattaaggcaagggtgaaaacaaagacttttgtctcataaaattgtgccttctaagattaccacccaaatataaaataaatcctaagctagcaaactatgttattttcttctcaattgtaagcattttctgtgggtttgtgtggaaatagtgcctatgaagatcatcatcaatatccagaactgtctaaacaaaagcagccaaattactcttttactctaaaatatggttggatgtaatacaatgccacttactactaggcatcattgaaatcattaaacatgaagtggaaatagccttttgctaacgtttccgaaatgagagctaaattgttgtatgctgcgaagttgaaaggaggtatttgctgtctgacacctgaaaaaaggacctaaacaggcaacttccattaccaccagaggcaaatggcgagaatgcctgcctgttaactgagagcatttctcttaatgttttaaattaaccaaagaattcacaacacagagaatttcagcactatgcacacacaaaaaagatccctagggaataaatgtgtgtttttgaaaagattttctgtgtagggaaatgaaatactaaatgcatagtgaccctatgaccctgcaagcaagagggacctgtggaatcacttagaccaaccctgtcattttacaagtgaagaaactgaggccaggaaaaggtcagtgaaggatgccagggccacatagtgaatccatgtcttatgaccacattcacgggatctttctgctatgcctagatgtctgagccagcagagtagaaaaaagcgattatacagccaaattttatgtaaaactcaattttatcccaaatcatatatagcactttttttcttttcttttctttttttggccagaattacctagagtcagtttctgttttacaaacagacaaatgacccacttttatattttaataattatgccttatttcaaatgataataaattcgctttttgtaaatttggtatttgtggcaagtgacaagtgtaatatgataccacactgcatctcaaacacccatgcctactgaaattgttgcctaattttctatgtatgtagcttcctgtcacttgactttacattgccagcactgcagccactgtggttgccttcccagcatgcagcccatacaggtctgggcacagatagagactctcatcccccaaggccattataatctcagtctgttctcttctttagtaatctccctttcacatttcctacagttactttcccagcctcaggccactctcctcaaggccctcatctcatcccagtcactacgcgaaggggtttagactctcactccaccaactccaactttcatcccaaatttgtcttcatacacacctctcttcgctctattaaatatatttttacttgtatttgtttttctcagagtaccttatggaattctctgttctcatgcgccatcccccaaaagagtagctctcttttggcacaaaatttcacatttttgataagacagtctaataaattatgggctctggtgaaccaatatgttagcaatttctggggcactttttgtactctctcaagaacttctgaacacagtgtcttaaaacagatgaataaatctcactaaggatatttcagaggaaagatcaatggagggatatagttttggcagtggaacttagcagtccacctcatattataccacaatgcatcagatactccatcttgatgtagggttgttattccatgcagctatttgtgatgaggacagtcattttgggcaaacaagttataaaatatcttgcagcttctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggtgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgcagcttcttattttaaatcatgtttctacatttaactggttagtaataagcaagaaatgatttgcacaaatacaattaaatggaaccttataatggactatgctgtcagaattttattattaaaggcttattcatcattatccaaaaaaacaaagaaaaccaaactagaaattatataaactctctgttttgaaaaagtctatgagcccatatcacctatttgtttatcagctgaacattggtggcaatcttggttctgtcctttttaaactttatgaacttggtcaatacataaagtttctttaagctctgatttccttacttgtaaagcacaggagagggatatctgtctctgaggattgttaagataaaattagataacatttttaaagtagtaatcacactgtctgccacatgacagtcacttaataaatgacaggtggtattatatttcacagtgagtttgccctttacatgtaatacataattactgataccagtccaattttggactttagggaatgaatccacatttataaaactgagagaattttcagggaaagagtagaattttcccttgcaacaccttttttctttttcctttagaaatgagtattgcatagctctattgagaattcacctcctattatttaaaacaacgtttgattgggttcaaactctctcctgacatcttctcaaaggacaatccaaactcttcaattatctttttcacatacatctcaaaaggtattctgagtgcctgaaaggcaataattcttttcccttaaagttttgaattccatctgatgaagatattacacttagtggaatagtaccatgtcacagaaacaatagcttaaattaacctctcactgtgttcagtcaggttctttcttttccttcataaaagttgattcaatgcttttgaaagaggcaagattggcaaggatggagaattaaggtctttgcatcaaaaaataggtactgagtagaatgagtagcaatatccttaaaattattggctacagaatatcaaatacatttagggaaggacggccttaaggaggtggtggtaattgagtcttcctggtacgtttagtccagggatatatcctagggataataatcagctctattcaacatggtgagtgttggtttttaattaaaaacaaacaaaccaacccatcttcatcatctcttagatacactgtgttgcaagattagaaccatcatatcaaattacatggaagaaagttttgacaggacaatttaccctcaagaatttcagaatgtgagactcaaacctaaaataattctttaatcaacaaatacttaccaggtagctatcatctcccaatcttttatttcccatgaggcactgagaataagacaggcatgctccctttttctatggagttgaatggaaagagggagagacatgaaagaaatagaaacacataaaatttaaaagataattacctgctggccaacattatgggcatatgacgtatgtgatcacacagggctctgactttagaagggccacacacttggcttaatgctttacttttgccttcctgaaactctttataacttttaacgagaggactgcattttcattgcattttgaactggacctaattacgtacttgtttattaagtattgtgtaattatgtagtcagtcttgctcagatagcaataactgctatgcaggaagtaaaacacagaaatgagatagagaaaaacaggggttatgagtcacagagttccttcagatggcataaaaaagacctctcttcctgtaatcccagcactttgggagacgaaggcgggcagatctcgaggctaggagtttgagagcagactggctaacaaggcaaaactccatctctactgaaaatacaaaaattagccaggtgtggtggcatgtgtctgtaatcccagctacttgggaggctgaggcacaagaattacctgacccctagaaacagaggtttcagtgagccaagaatgcgccactgcactccagcctggatgacagagcaagaccctgtctcaaaaataaaatagataaataaaataaaaaaattttaaaaaaccctctctaatgagatttatgagccaagaattaaaatgtttgctaaattagtggatctcacttcattcccttataagcaactgaatataaattcaacagacactgatttaatacctaacctgtacaaaaagccataagattaccctttagggattagtaataggacaaaatttttgacccagtaaatttaaggtgaaaaaaagtactcaagtagttctcaatctgttctttaatagagacactgagagatatgagtatttcagtagtggaagtgaaagatacaagtgtttagaagagcaagaaaagcctttaaaagcaggaaagattgatttcattgtcccggttagtcgggtaggacggggtagcaagcacttcttttccagggaggacagagcatcattgaagtcccagaaggaaaaaaagcagagtgcttttgagtaacagtgagtaatgtctaagtttatttacaggataggatagatgtaggaaatgtttttaaaaaacaaacaactgggtgcattctcgtctcctgcttttctcttctcacctttacctaataaattgccaagtccagttgattctgtcttctaaatatctcttgagggcattgcttctgtcctacttccagcttccatcctctcatttctagatggctgaatcaacttcccaactcatctgtcttcaattaggcctcttccccagatcggttctcttgtctgaaattagagaactcattctaaaatgaaaatctgatcgtctcatggttgggtttgaaatctttccatgcagtgttatgagtgggtaagtcttgattttgaaataagacagaatgtgatttgagtcccagctctcccacttaatagctgtgctctttaatgagcctcatgtcctctctgatccttggtttcctcatggggagtttatgataattaaataatgtatataaattgataacactgccttgtgaacagagcgtgctcggtgaatgttattgctgtcagaacacgtccaattcctttgtgtggcttttaaggctctaacttagttggtttctggtttcctctctaatgttattccttgccttattctccacttccacaatatgctcaaggacgtgctctcccttttcctcaggactttaacatgctctgctttctcctaagaatatctgtcttccatgacttatttgtactattcattcaatctattgttgttctacccatttgataggcaggaatactcagacactacttggcccgatgactttttcaaagtcacatggtgactagcagaataaagccataaaccagcttctgttggttcaaatcctgttctcatttcctgtaagacctattatttcacaattttcagatgttcactgggaaaatatttgtttttttccctcaatacaagtactttcacaatataaattgtgtctgctgcactcatagttaatctgggtttctactaacagcttatgtataccaagtaagatcagtgaacaaaataaaccaatgaacaaaaacctggatatactgcttccccttccaagcataatcttcaatttcggggttaatgaagctgttatcccattctttggcggacacataaggcagccatttttaagtttcacttgcttcagctataaaattggtgctacagaagcagactgttatttttaaggcatttagggaaagctgtcacagatacaaatttaaatggaatgttaatctgcttggtaaaattagagttttaatcttaaagtctgaggtaaaataaattcagattgatatagattcattccacaaacatcaataattttccattatgttaaaatcaattctaattttacatgcaaacaacagattcaagtaaaaaccttagaggtttgtgttctatcacaagcatacttattttgggtctgtgcaaatccaaaaacatttggaacagctgcatgttctccttgctaaggaggggacaattttgctttgatgcctccaattctaaaaaactccagttcattctttctaattagccatcatatttagtttgaactcagggtcttaaaaaaattgaaagaaacctgagggaagttgagttaaaaaattatagtcacaacaaaacttgattaaaagcacataaaattatctggaagtagcagtatttgtagtgacatgggaaatgctagtctatttttttaaaattgcatttagaaagtcatttaacctcttcaaaactcaagttttgtcatctataaaatgagatcaacttgccaatttttaagactttgtgtcaggattaaataaaatattgtgaaagcactttgaacatacctatgctaatcaaatataatgtgaaatcatttcatttcatactggaaaaggcaaataaatccttcatttctcttttctgttgataaaatatccaattagatcctgtttccaattgtcatctgattttggtttcacctgaaaagttttcgctactctccactcaaattctctaaaaattcgttttctctatgaaatgttctgagtcctacagcttttgtttatcctttctcatctgtgtaagagcatcttttcaacttcaatccacatacataagacttgcatggcatctcattttcagatcctttagaacagaacaactttcacattgcctctgggtgcctggcaaagtgttaagcatgaaggaaatgctcaatgatgtatttctgaatggatccattcacttcttgagaaggccaactgggttttctgcttaggcatcctgatggttattcatagtttcttatgtctaaaatgaatctagcccagagttagccatgtggagattagtactagagaaaaccgacataactcactggtcatgttaggatttaaatatctcttgcaccttatattaatgacaataagagctcttatttgaagattaatcttcagtgagagacattcattaacatggggactggcagtagactgacttatccaacattttctagttattagccttgcaacttttgaaagcgacctagctatttcgtatctcaattttcttatctgtaaaatggccatgctattacctgcctcagcaagatgttgtgaagtttaaatgagatagcatacatactattggctacaagtgttcttaatgtctacatcataagatacctgagcaactcattcatttatccatttactgtctatacaaatatggattagacatagtctttgctcttgagcattgaaagtgagatcaggcctaaaatttgatcagtagcaatatcactatatttgaaccagactggtttaagagtacaagagaagaaatgattaattttgcatggaacttcaaaaggatatgtgctagaaagaaaggttatttgaattgggcttttagttgataagcaagtttgttttaataagcagaaagagtgtagtggagaaggaaacgactttctagataagcaataaatgatcatcagggcttaattttgcagaatattttgtgcaaaaattgaatgagaacacacatatgaagatgctacaagagtattctattgtacaactgggtaagcttagttttatgaattctaaagataggccccttatacacacacacacacacacacacacacacacacacacaagcatgatatatatatataaagctaaatatagtctgtatcatttatctgtaacataatgacatatacctggaaaatgaagacagtctcattgtaagaaagaataatatattcagataattaaaaattctatcagatttaatcaagctatttctaaacaacaaaataggagtagctggttttaaaatagcttatgatttatttgtctagtcatatttaatagaaatactgtagggttatattaatgactcttcaacagttttattttagttacttgataagtgaaagtaatattatctctttcagaaataattaacaatgtaaaatcaggtccatgatgttgggaaggtttgggaaacctataattctgcttagaagtaaacagtttaagaaaagccccaatatgtatattgtttataaactttaacagaagcagtatatcatcctttctttgttcatgtttttgatattataagaaatataaaacccagtttattagttactggaatttgtcaaggacttttcatggctggacctacattaacacagatggcaaaattacaatttgccttcattattgtgttcattaacagcaagaaattcattataaagatgactgcaaggaaaacaaaatgtaattattagacttttgtatgtaaacatattaaacacttaatatcatatgcatttaagaaaaatattttatagatatataaagcattttgctttatttatcaacaactgaacaaagtataacatcaaaatacttttaattatctttgatccagcaccgacgtaagactttcatatgtaatatctaaattttgatggtaaggaaaggtagttactcccaggttacagaaaaaatatatatatttttaaaattctgtaaccaagttaaactgatcttttaaaatgcacatagtgtaatgactaccagacactataatatttataaaatttctccttgttaaagtttacccaaaattatcaacagattaatcactataaagcttaatattttagaaaataactataattttaattgacacaaacaaaatatcaactaatattctgtagtggatctgaagtgtaaactattttagttttcacaagattagctttatctaatgaacagcaaatatttagtaaacttttaaaatataaagcatatttcttcattgctgaaaataggtagtaaaggatttctatgtgtgttcaactagctgttactgcctcccctattgtttatcatgataggttctagcacatattggtgatagttcttaaagtagtacttctatactactgccattatattttaaaatacctacactgtaatcggggaatacaaatcaaaattttacaaatgtgaataactttgggtctaacaatttggtttgaaaacagttcagatagttatacaaatatgtgtgtgcactgaatgtttaatgcaagcttctttgtattagtgaaagttggaaacaacaaatatccattgatgacactgagcaaataaagtactcacctctgcatgtatatgacgacgtacaacataaccaccaaaataattatgtagctcaatatttatgacatggaaagatgcccatgatcgattaaattattaaaaaacagtatatcaagtcaccaaatagcagtgatttcacttatgtatctatatatttgtaaagaaaaaatatcttttcataaatgcagataatttgttaaaatatttgaccagtccttaacagtggtcttttttctcagtggtataatttttgtgatatctcttcaatattttatgccttcataaggctgccatttggttgtgcatgccttgtccataatagaaaaatacacagcttctgcaaacactttacttccatctatcagaaaactgacaagtttaatggtcaattacatatttgtaaatatacaatttatgaggtctaacagttgatgatgctacttagagttgtcccatccataacctcgagagccataaacaatggccctgcctttatatattgcctttaacaaacactaaatattatttctaaaataaaaacactttaattctaaaaagtccctaagtagcaagtaatagtactgtctttgtgaaaaaaaaaaaattataccagtgttacatacaatataaacaggaaatatgcacgtcaaaataataaaaaaattaaatatataattccaaattatttctctctccctatttcttaggaatcacgagaaagactaagactgactaaaccataaaatatttctgaaaacgagttgttaagatttgaattgcttgaaatgtctttgtgtgcctcacctgtggtactgccaatttcaaatacaacaaaagtgttttcttattctttgttctgggcagaagataatctgaacttagaaatacaccccatgcctctggcttagcaatacaccacttgggatttaatgttctattttaatagaggtttgtcacatcattttataatgaacactgaactggccaaaggtgaaaatgatactaaccaaaagaaaatattcatgcaatacagtcagctgtacccttattgaaaagctcgtttggtattgtagctaataggatttgacactggcgtctcagcagtcctggcacattcttggcacatggtgtgcactcaataattctttcttctccctgatgatgaaatgatgctcagagatagtatattgatgggaaatgaaagtctgatccagattgatggaaaagaatggagaataaaaaacaaacaaacaaacaacaataacacaaacaaaaactgtaagtgacaccagtattgaaaaaaaaaacaaaaaaacagtaaagaatgtgaaggagtaatgaaagcttttgacatctatggacaggtatttaagtcacatatttgagaatatctgtaaacatgttttgagtgtgtactgtgtgattggtactacactaagagctttgtatgcatcgctttgttcactattcacaaatatgtgagataagtacaattattatctttattttaaagatgagaaagctgagacacgaagggcacaaagaggttaagtagcttgctccaggtcacacagctaaggtcccagttctgtacgatttaattcttggttcttagccattatactatcataaagaagggggtgtgaagtgaaaatcaaaatatgagttgcattattttcatttctagctatgatggagtagcttgtagtagaccaatcacctgcttagagctactagaaaatctttattaaaatacacacagacaaagaagcatttttttaaagcactggagagctttgagcttgctaggatgttaggacaaagatcccggaaggacggtaaattcattggacgtaagacatacataaatactgtccatttttctccttgggacatgagctattttcttaagcagttaccaggtagagacagtgatgtcagatagacgctgccaccaacagaagctggtagagctttctgcactgtcaaatagctagggagacaaaaagttagggtgtatatctattaagatagctacgaattgagggattgagatcctgacgagagaagagaggaacccaggagttagcccagctctttgagatagttttccttgagacctttgcagttcttaagccttacaaggtaaaaggctatgaacctaaacaaacaaggagctgaaaagctgactggagctgctggcacctttaagttgttacagacacaaaaattagatttgagagcccataaggaaggagagtccctgataaacatgtcaggcccttagttgggtccctcttggcgtataacacaaagtttggggaaaccagaacaaagctgagtctagactttgaaaattctaaacctcatcctcttcctcatgaagttcttgtttggagggatatattctgattctactccatctgcctgctagaagatagagtgaatcttctctgtagcttctacagtttttcacacaatgtccagtatatgaaatgaaggtttgtgtcctcctcgaaatgaagccttaacccccaacatgatggtatttggagatggggctttggaagttaattaggtttagatgaggttagtatccttataatcacagaataagagaccagggttctctttctctccactacacaagtacagagcaaaaaggcagccttctgcaatccaagaagggacctgtcaccaggaaactgaatcagccagcctcttgatcttggacttctcagcctcaaggatttgaggaataaattcctgttgttaaagctacccagttaatgatattttgtatgacaacctagggtagagaattaaatgcaatatcaccaggcatacaaaaaatgccgtgagaataagagacaacagaaacatactcataagtgatacaaatattagaatttccagatacgcactgaaagtaaatgtgttaaaatagtcaggatggcaacagagataactgcatcagagaaatggaatctatgaaaaataatcaaacaaaaattctaaaatgcaaaaaactgcagtaactataattaagaacccaatgaataagttaaattccatattagacagaattgaagagggaattggtgatttgaaacataaagcagtacaaaatattctagttgatatacagagaagaaaagaataaataatgcagaaaaaaatacaaaacttacgagaaacaatgaaaaggtctaacatacttttagctggaatcctagcagagtggattctataatgcaccactccaagattaaggcagtcattctcccaagtgctggaagtattggcaactcaagccccttggccaaatcctactctaggaattttccttagccaaagatatatattttgctcaaggctgcattccatcttggaaggctgttgacatccagtgactagttgatgcaatgacatgaagatctggaccacttgaagggacatcctagctccagagctgcccgtggaatggctgaaaaatttgttgccacttcatcacagttttacttctctctctgcccattcagacttctttactccttatataaatgctaatgctgagggcactccccaaattcttatctcagagtctatttcctgggaaactaagacagttggtgctggtaatgttcgaaagaagcaaacactaaaatgggattttggaatctgtcaacctaccagctggctggcaacggtcactggttgaaggtgaagtgctgaatagcccacggcattgtgtagaaattccatagttcactggggtgaagtggggtgggatgacatgtagaagaaaatgctgttgcttgtacaatctctcaggtttttgagaatttagggatactactaattacaaagataatagaatcagaaggcttctgataaatgccaattatgcaatggagaaaaacggtgaaaggctaagggtgactaactaaaatcaaaattaattaaaaacaaaagaggctttctttcacagcacataaagaaatataattgtctatctagcctgaagaatctactgacaactgttagaattaataaatttaggaaggtcactagatacaaagtcaatattttaaaattgcacttctacagaccagcaaaaataaatcatttagaaaacgacaatttaatatatgcatatatactatgatggattggctgcaaagaaggtcaccaacaatttcttcatcctgtatacctatatcaatgcaccaatcaagaattaggttatttttacctactacttaaagctggactgggtctgtgacttgctttgaccggtagatttcagcagaagtgttattatatcagttcttagtttaagcttaccaaggtcttgcactgctgtattcatttttgaaagtaagctaccaaacatagaacttgggctagactgtctaatcatgacagaccatatgaagagagtaagaggccatatggaggaaaatcaatgcatcccagacaatagccagtacatccattttattgtggtgatgcttggctcccagaagaaccatggcagctgtcatcaggagagacataccaaatatgctgagcctggcccagttccatgacgttcagaatcatgagcaataaacctaacaaactttgatgatggtgtgtagtgcagcaatattacatgtgcatatatataaaatatatattataatatcttatacattatataatttataatataaaatatataatattataatatcttatacattatataatttataatataaaatatataattatatatatatgtttggtgcaaaagtaattgtgggttttgccataaaagtaatggcaaaaatcacaattacttttgcagcctcctaacatatacatcagaatagacagttcacaggctgacacaatgtggaaagcagcgtaagatcacaggtacagagaaaagagtaaaccatgccatgaacttacattactaaattttatacttgaaattacatttaacaatgatgcagatatagttttgagcaaaggtagcttcttgagatatttctgcatacagattcaattacatttggttaggaaaatcagcatcttgaactaataacaaaactggaatttcttcaccactaatttaagaagaggagataaaaatagtgttgagttgatttttatataataataatgtgaagaaaaaatgaatgcaacaataaaaagaatgaaatcaaaaagaaacactgggggaggttccaagatggccgaataggaacagctccagtctacagctcccaccatgagagacacagaagatgggtgatttctgcatttccaactgaggtaccaggttcgtctcaatggggcttgtccggcagtgggtgcaggacagtggatgcagcccactgactgtgagctgaagcagggtgaggcatcgcctcacccgggaagcacaaggggttggggaattccctttcctagccaagggaagccgtgacagacagcacctggaatattgggtcactcccaccctaatactgcacttttccaacagtcttagcaaatggcacaccaggagattatattctgcacctggctcagagggtcccacgcccatggagccctgctcagtgctagcacagcagtctgagatcgaactgcaaggcggcagcaaggcttggggatgggcgcccaccattgctgaggcttgagtaggtaaacaaagcagctgggaagctcgaactgggtggagcccaccgcagctcaaggaggcctgcctgcctctgtagactccacctctgacggcagagcatagctgaacaaaaggagcagaaacttctgcagacttaaaggtccctgtctgacagctttgaagagtgtagtggatctcccagcacggagtttgagatctgagaacggagagactgcctcctcaagtgggaccctgacccccgagtcgcctaactggaaggcacctcccagtaggggccgactgacacctcatctggctgggtgcccctctgagacgaggcttccagaagaacgataaggcagcaacatttgccgttctgcaatattcactgttctgcaccctccgctggtgatacccaggcaaacagggactggagtggacctccagcaaactctaacagacctgcagctgagggtcctgactgttagaaggaaaactaacaaacagaaagggcatctacaccaaaaccccatctgtacgtcaccatcatcaaagaccaaaggtaaataaaaccacaaagatggggaaaaaacagagcagaaaagatgaaaaatctaaaaatcagaacacctcttctcctccaaaggaatgtagctcctcgccagcaatggaacaaagctgaacggagaatgactgacaagttgagagaagaaggcttcagacgatcggtaataacaaacttctccgagctaaaggaggatgtttgaacccgttacaaagaagctaaaaaccttgaaaaaagattagacgaatggctgactagaataaccagcttagagaagaccttaaatgacctgatggagctgaaaaccatggcatgagaactacgtgacaaatgcacaagcttcagtagccgatttgatcaactggaagaaagggtatcagtgatggaagatcaaatgaatgaaatgaagcgagaagagaagtttagagaaaaaagagtaaaaagaaatgaacaaagcctccaagaaatatgggactatgtgaaaagaccaaatctacgtctgattggtgtacgtaaaagtgacagggagaatggaaccaagttggaaaacactcttcaggatattatccaggagaacttacccaacctagcaaggcaggccaacattgaaatcaggaaacacagaaaatgccacaaagatactcttcaagaagagcaactccaagacacataattgtcagatttaccaaagttgaaaagaaggagaaaatgttaagggcagccagagagaaaggttgggttacccacaaagggaagcccatcagactaacagctgatctctcggcagaaactctacaagccagaagagagtgggggccactactcaacatgcttaaagaaaggaattttcaacccagaatttcatatccagccaaactaagcttcatacgtgaaagagaaataaaatcctttacagacaaacaaatgctgagagattttgtcaccaccaggcctgccttacaagagctcctgaaagaagcactaaacgtggaaaggaacaaccgttaccagccactgcaaagacatgccgaattgtaaagaccatcaatgctaggaagaaactgaatcaactaaggagcaaaataaccagctaacatcataatgacaggatcaaattcacccataacaatattaaccttaaatgtatatgggctaaatgttacaattaaaaaacacagactggcaaattggataaagagtcaagacccatcagtgtgctatactcaggagatccatctcacgtgcagagacacacaggctcagaataaagggatggaggaagatctaccaagcaaatggaaaacaaaaaaaaagcagggattgcaatcctaatctctgataaaacagattttaaaccaacaaagatcagaagagacaaaaaaggccattacataatggtaaagggatcaattcaacaagaagagctaactatcctaaatatatatgcaggagcacccagattcaaaaagcaagtccatagagacctacaaagagacttagactcccacacaataataatcggagactttaacatcctactgtcaacattagacagatcaatgagacagaaagttaagaaggatatccaggaattgaactcagctctgcaccaagtggacttaataaacatctacagaactctccaccccaaatcaacagaatatacattcttctcagcaccatgtcgcacttattccaaaactgaccacatagttggaagtaaagcactcctcagaaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataaagaaatgaaggcagaaataaagatgttctttgaaaccagtgaaaacaaagacacaacatacaagtatctctgggacacatttaaagcagtgtgtagagggaaatttatagcactaaatgcccacaagagaaagcaggaaagatctaaaattgacaccctaatatcacaattaaaagaactagagaagcaagagcaaacacattcaaaagctagcggaagtcaagaaataactaagatcagagcagaactgaaggaaaaagagacacaaaaaacccttcaaaaatcaatgaatccaggaactggttttttgaaaagatcaatgaaattgataggcagctagcagactaataaagaagaaaagagagaagaatcaaatagaacaataaaaaatgacaaaggggatatcaccactgatcccgtagagatacaaactaccatcagagaatagtataaacacctttatgcaaataaactacaaaatctagaagaaatggataaattcctggacacatacaccctcccaagactaaaccaggaaaaagttgaattcctgaatagaccaatagcaggctctgaaattgaggcaataatgaagagcctactgaccaaaaaaagtccatgaccagatggattcacagctgaattctatcagaggtacaaagaggagctggtaccattacttatgaaactattccaatcagtagaaaaagagggaatcctcccttactcattttatgaggccagcatcatcctgataccaaagcctggcagagaaaaaacaaaaaaagagaattttagaccaatatccctgatgaacattgatgcaaaaatcctcaataacatactggcaaaccgaatccagcagcacatcaaaaagcttatccaccatgatcaagtgggcttcatccctggaatgcaatgctggttcaacatacataaatcaataaacataatccatcatacgaacagaacccaagacaaaacccacatgatagtctcaatagatgcagaaaaggcctttgacaaaattcaacaacccttcatgctaaaaactctcaataaattaggtattgatggaatgtatctcaaaataataatagctatttatgacaaacccacagccagtattatactgaatgggcaaaaactggaagcattccctttgaaaactggcacaagacagggatgccctctctcaccactcctattcaacatagtgttggaagttctggccagggcaatcaggcaggagaaagagataaagggtattcacttaggaaaagaggaagtcaaactgtccctgtttgcagatgacatgattgtatgtctagataaccccactgtctcagcccaaaatctccttaagctgataagcaacttcagcaaagtctcagcatacaaaatcaatgtgcaaaaatcacaagcattcctatacaccaataacagacaaacagagagccaaatcatgagtgaactcccattcacaattgcttcaaagagaataaaatacctaggaatccaacttacatgggttgtgaaggacctcttcaaggagaactacaaaccactgctcaacaaattaaaagaggacacaaacaaatggaagaacattccatgttcatggacaggaagaatcaatatcatgaaaatggccatactgcccaaagtaatttatagattcaatgccatccccatgaagctaccaatgattttcttcacagaattggaaaaaaactactttaaagttcatatggaacaaaaaagagcccgcattgccaagacaatcctaagccaaaagaacaaagctggaggcaccagactacctgacttcaaactatactacaatgctacagtaaccaaaacagcattgtactggtaccaaaagagagatacagaccaatggaacagaacagggccctcagaaataataccacacatctacaaccatctgatctttgacaaatctaacaaaaacaagaaatggggaaaggaatccctgtttaataaatggttctgggaaaactggctagccatatgcagaaagctgaaactggatcccttccttacaccttatacaaaaattaattcaagatggattaaagacttaaatttcagacctaaaaccataaaaatcttagaagaaaacctaggcaataccattcaggacataggcatgggcaaggacttcatgtctaaaacaccaaaagcaatggcaacaaaagccaaaattgacaaatgggatctaattaaactaaagaacctctgcacagcaaaagaaactaccatcagagtgaacaggcaacctacagaatgggagaaaatgtttgcaatctacccatctgacaaagggctaatatccagaatctacaaagaacttaaacaaatttacaagaaaaaatcaaacaaccccgtcaaaaagtaggcgaaggatatgaacaaacacttctcaaaagaagacacttatgcagtcaacagacacatgaaaaattgctcatcatcactggccatcagagaaatacaaatcaaaaccacaatgagataccatctcacaccagttagaatggcgatcattaaaaagtcaggaaacaacaggtgctggagaggatgtggagaaataggaatgcttttacactgttggtgggagtgtaaactagttcaaccattgtggaagacagtgtggcaattcctcgaggatctacaactagaaataccatttgacccagccatctcattactgggcatatacccaaaggattataaatcatgctactataaagacacatgcacacgtaagtttattgtggcactattcacaatagcaaagacttggaagcaacccaaatgtccaacaatgatagactggtttaagaaaatgtggcacatatacaccatggaatactatgcagccgtaaaaaggatgagttcatgtcctttgtagggagatggatgaagctggaaaccatcattctgagcaaactatcacaaggacagaaaaccatacagtgcatgttctctctcataggtgggaactgaaaaatgagaacacttggacacaggatggggaacatcacacaccgcggcctgttgtggggtggggggaggggggaggggtagcattagaagatatacctaatgtaaatgacaagttaatggttgcagcacaccaccatggcacatgtatacatacgtaacaaacctgcatgttgtgtacatgtaccctagaacttaaagtataataataataataataataataataataataataataataaaagaaacactgaaacaaagaaagggcacgcaatatatatatcatgcattgtgtgagaaagtttaatcatgaagcagtgtttatagaattagttctaaatcaaaagtagaaggtaaatgggattgaacatctggcaatctagtattaaaagtggggagacttccagaatcagacactggcttatctatttctgaagcatgtcagtttctaatttatacagtcttaattggcagactgttgggccactttcctttaaggttaaaatgtactttgcatgcttagttaatatggtgagccaaaggaactaaaagacaaacttacaattatttttaaaatgcttctatagacacctgggtggatgtactattatttgtagcctaatacctcagtttaaaaaagggcaatattgatccaacaagaaatagcctaattttgtgatttactgaagagttttttaatttactttgcagctctctctgaagatcttttattcttttgaatcacattgaaaaataaacccaacagtgcagacccatgcctctgcctaaggggaaaatgctttgttcaaacagaaattagctatttagatatttaggatttcacaatgctaagcaatacatatggactttctaaagtatcatttaatgaataatgaagccactttaatacctaagaaaagaataagccctcaaacatttcaaagaatcaatttaatttgatttcttatatttcctgtggcataacaaagaaaggattacagccaacactgaggagaaaaagtggagttttagagggatcaggaaatcgttataattcccagagttgcagacaatgctttactttcaaatattcactaagagcatccctcagattcagaggccgctgaaatagtcactgtggtagaatcagaggggtataatatgtgtgtgtttccgaatgcaagcgtgtgtataagagtgtgtgtgttaggaagggcacacaaaagataggacaaggtagataaggggcatccagagaagaagaaaaagtaaagaaagtggcagagaaccttcaaagcaaacacatgctttatcctcagagatgattttgcattgccagacctcctaccaacatgctttttgaaggactcgagatgccgatacacttaaaagaagtttgtatgtcatcaggaacagttaaagcttattgaagtgttgatctgggatcagtaggaagtcatccttttcagactgaactgacacacatgaagttgagtcagaattacgttgaggatttataatgagtattgcagaaaccatttttcaggacaatgtttatacttaaagtggctttattaagaaggcttatacatgtaggtcacttattcaatgcaatcaacaaggattcttctctttttatttttttaaagtgcttgtttttcctgttttgactttagaaactaattaagtaaaaagtggaaaattaatttattatgaggaaaatttttattttgattagaaacttttccctaacttactggaaatcacaagagtcacaataagtcacaatgaagcaacagtcacaatgatacttcacaaaatagattttacacagatacatttctgaaaaatcatcttcttgattattactgcatacatatttacaagtcgcaaaagaatagcatgccactttaattttagtaccaaaatggccattgcatgtaagaccacagcattaagtcaccaaattggataatttactttaaaattttagtgtcaaataaagttgtatctgatagagacagatctgcaacattcctaacaatctttgtggctgagggtttggccactttttctaataagctcaaaaacgcagcgcagttttctttttaacatgattcagctaaacagaaaaatcattaaaataatttgcctagacaaaggcaatcctcattgcagaagccccagaatatcgctttacagaggacattctgtcagtctgcggttttgcatatactaaaaccacactttctggaatgtgatcaacaaatggctttacctattgtaatatgagtcctagagtaaaaactgaatcaatgaaaactaagattaagtattctaaattaatgtttgtacaaacagtgcctagatctctctgagcttcttcactagagaataaaaacaatcttaaccttagggttctctgtatttaaaatagcttatttaatgcacttaaccagggaggtgaagtatctctacactgaaaactataaaacactgataaacgaaatagaaggaaagataaataaatggtagggtatcctgtgttcatgcattggaagaatgaataatgttaaaatggctacgctgcccaaagtgatctacagattttatgcaatccctatcaatatgccaatgacaataccaacttcttcacagaaatagaaaaataaggttctgaagtttatatggagccacaaataatcccaaataatcaaagcaatcctgagcaaaaagaacaaagttggaggaatcatactacctggcttcaaaatatactatacagatagataaactaaaacagcatggtactggcataaaaatagacagaccaatagaacacaacagagaacccagaaatatatgtatatacaacaaatcgtaccccataaatatgtacaattacaatgtgtcagttatgcacattttatttaggttgctctggtctcagtgacattcattgttgttactcaaagccagattatatattatttttatatagtataatatataatctataatatatattgttatatattatataatattcttatcagatagttctgatttaaagtatcctctgttttcattagactttgataataatacctgtctcttcatagaattctttgtcattgaatgaataaaatgttaaagacaaagagtatttaagaatcaagttatggagtaaactgataattaggtccagataatttaaactcttttaatgtatttcctaaaattttggcaaattttagaccccgctttactttctttattatttctattatcattattttttgatcatcttggccctgacacccccaaacaagaattgctagtaagtgggaaaaagtttaaactttaaaacgccaggacccggctggttgcggtggctcacacttgtaatctcagcactttgggaagctgaggtgggaggattacctgaagccaggagtttgagacaagcccagtcaacatagtgagaacccccccaccccacccatctctacaaaaaattaaaaaattagccaggcatggtggcatgtgcctgcagacccagctactcaggaggatccctcgaacccaggagttggaagctgcagtaagctgagctatgactgtgccaccacactccagcctggatgacagagcaagaccctgcctttttatttatttttgtcaacagattttaagtgctaaggatttgttttattacacttcatcatctttggtaaagatttcttttattggatttttcaactgcctttcataactattttccagcaagcacatgtaagtaaaagttgcatatatcatatttatctatgaattattggagataaaatatgactataataattgaatattaattaatattaatatttggttttcaatacttattacatgtaatgtcttagtaagctttggatcctttattagaaacctgtgggatataataaactaacttatcatttaagtaatatttttacccatttttaattaccagcaaaagatttaatattgttgaaaagcaaagtaatggaaatcagatgtctggcacaaaaagtaaatagtgtatgtattagaaacttctttagccctgtttcccattcaattagctcacctttttctccatttctgcctgctcactttcctgtagatatataccctgacctcacctctacttctgctctgacttcctgatccttccaacacccaaccatgtattacctagaaatgcaagggaataaatattctgtaggatgaccctgggtcaatgggggatggtagctggcaaataaagttccttcttctattctttgggtgaacaattctgaggtgtatttcttctttaaaaaagtatctgcatgataagcttctagttgccctaagctgtgaccccctatttaactcatccttcaatggattttcactctttctcggtttcactccttctagttccctcctattccctgagacccaaaataggactacctgcacataaggcccttcttaggctctgcttctcaggggaaaagactaagacactggatatattgaaccctttaataaggatttatagttaacactgactgattagatacctacatactggcaagaattaaactctccctaatttcatccttgatttttggatggagtttacagatgcatcctaaaataatttcctttaaatttattggtaaaatgtaaatattttaatacattttatacttaatgaaagtctgttaattattagtactcttatacaaaggcatatgtgtcattgttccctcattcaaaaatggcacatttcaggaattgaaaaaaaaaatctctctacatgaaggaagtagaagttggaatattttatgaacatttaaataattagcagtgtcattaattttacacagcacatatgcatacattttcagtcaagcaaatctgtaccgcagaattttccacactggttcctggagacttcaggctggtgttatctgtctctttttgcttatataccaaacaaagttactaaggcaaaaaaaaaaagcctgtctacgatacctgaacccatggcaatagtatgaataaagaatgtcaggaaagctgctagcctctctgactactttcttcacccttctatccgttgtttgtgttatgtagtacaatgcagatcttttccttcattggaaaatatcgtcttgctttcttaaagcaatgtaataaactctaatatttttgggcagcgaattcactgggacactatattcagtgcacattctgcctttattggcagagggctgagagggcgatgttaaaagttaaacacaaacaacgaaatatcagagaatgagctcttccacataacagattttatcatataactaaagatggctctttgaaattctagatttttatttttaactcttcttcttggaagttttttcaaaatgtattattacttattttactgatgtctttcacaaaataagctgaatataacttataatttttgattgcactgtcaccaggagctattggctagatggctgtaatcacaatgatgccccctgagagtaatgaggtgtatcaggtttttttatgcccatgtcaaagggtctgagactgttgcgatttttaatatattttaaaatttcataactacattcttttctctattatctggcagatttttctgttttagtagtcctgcttgagggttcttccatcttgggaattagactatcacacttcttgggatcagctgaacttcttttaagatgtaaattattcaccaacttctgaatcacattaaagataaacagattgtggcatctcttataacttgtggtgtatccatggtggtatatctagagcagtgtgatttgacacgggactgagatctgctgctctgggttcaaatttcacagttaacccgaggggatatgctgatccctccctgaacttggcaagtctgtcagtcaacaaaggtttaattgtttactcatttcaagtatttctgcttcttatagtgctgtattagtgggaggctaactcaacaaaaattcattgtctcacagttctggaggctacaactttgaaattgcggtgtctgcagagttggttccttgcgaggcctgtgaagagagggtctgttctaggcctttctccttagcctgaagttggctatcttcatgttccgatggctttccctctgtgtgcttctctctgtatcctaatgtcctcttctcataaggccacagttatactggagtagagctcaacctaataaattcactttcacttgataatctctatgaagatcctatctttagcatcatattatgaggtattaaaagttaggattacaacagaatgaattttgggaagatacaagtcaacctatagccagtgcctacagcaaaagactactactattcatttaacaaatattttaaaataacgtatccaagaatcatgttagggataagggacacaaccatgaagctatgttctgtggaactgagaaataaataatctcatactgttattatagaatattaattggaataaagttccttctgacttctttctaaatatgcattgtgtgaaagtcataatagactccactttactgctatgaaaataatttatatatgtacaggcagttcacaaaggaatctaaatgtgttagcaaattgtataaatcagttagttgtgtactgggccaaccaaagcatctatccctctaagtctctggactatgatgccgagctttatcaaaatgattgctaattattcactatgactactactggatattatgaattagtatttaaaaagttaaacattatctttacagttcttccaaaattgcaatttgagaagaaaattatgtactaatattagcatcaacattctagtgttaaataattaatgtatgtgagtactaatttctttcaaagtataaatgcaatattctaaattgaacataaatgtatcatttgtataaatgtaagtttatataaacttttctatgtatcaaatataaaatgggaacgctctaggacagcatttaaattcaactttatcattatcagtctgtggtgttaatatggaactaagtcaatatcctatatgaaataatacactcaaataaaatgccaagtaatatttctgtgcaatgttccataatcattttataaacctcatctcattctcttcttcctttcaaagataagaattcataaagtagtataaagtagcattaaaatatatatggcttatatgactccagagcagaaaacagtttaaaaataaacaagatctgttaatacattagatttttttttaatcaatagaagtttgaagcataagaaagaaattagtgagtactctcccacaaatataatcatttcttagggtacagcaccccacttattagaaaattcattcatgcataacatactctgatgaagatactttgatttccaaggctaccagacatcccaaagaaactgaggatcaggagtcttaggtcttatctaacaatttatcaggtaggacaactgataaggtggaataatgtgataaactattgggtatcagattctgttttcattttactctgaacaacctgctgcaaggagactaccggaaacagatcattttcaacaagctcagcaacagcatgtgagtaaacacaataggaaactgcttcatcagccctttcagcccccagattagaggtgcattccattaaaagccaagaaaagtgaactgttcttcagatcccttactttggtgtcagataaaatcaagtttggcaaagggctatttggcaaaacagtgaagattcttaccttcactacctaaagactatcactgtgaagacgaagagcattaatggtaatcatagatactgacactttatttgtataatttcattttatcaatccagtaattctaggaagttggtacaatttttatcccattttgtagatgaggaaactaagtcctatagtgagtaaataatttttccagtgtcttgcagctgggaagtggcagagcaggattcaaacttgatgtcaaaacccagcctatttatgaccatcatcatgacatagtaaagtcactacaagtcaaagtctatacctccagcttcatgaaagcaaaaggttaggttgtcatgcagtctagaaaccataaaaattccttcaacttaatctgattgaattctgcattttaatacagttcaatgaaaatatcattatatataagcattagataagaatcagaagtccaatctcatggaggatagaagtaatgttattgcataaattcctaaaattattaccaacttcagcttttaacttgtaaatattcagcttggaatgtttatcaaatttgtgtacgcacaagaaatttactgtattttatttttaaattatttttcctttggtttgtccatttgctttgtcgtggtttgtacttgttttcttcttcataattcaggcttattttcatctatcaaattgttaaatgcaaaagtgaaaaggtagaaaggggcaattaatttgcatggtgggaaaaaagagacaacagtacaaagagggtgtctaggagagtcaatagaatttgcaaaaaagcaaagccattattcaatacatatctcttaggcagaaagtgtggtccataacagttgtcaccgataacttcagatggaatctttaaaagtctccaaggaatgatactggattcagcagtatctatttaccgatggtagacattcttccttaaaacaatattatcccaaaattctgtcttcaagaaatctatttgttcattaatccagccattaattattccatatttattgagtatctacttatcttcttgtgttaaacagagataaaatgatgatcacaaaattgtttcaatcgcaataatatggcatggcaagaccaaggtataatgattcatgattatgtttagcacatgggcttttctgagttggagtttagaatgcggaatatttatcaggggctaccctaggatcagcatttgaaggggacgaaggaagtatgatgggcagagcgtgaagtcaagctgatcttcaggcctgctgttagcctagtcaatctacagaaagttccagagctgaaatgtcctgtgagacttcccctcattgggccaaaatggctgggtctttatatcattatctcaaccaataatttaatatggttcatcttaccttggaaagagtgtgaccttgaatgaggtgtctctctacagcttaagtgataccaaagatgctatcaactgagcactacctgacgacaagactccaggcagctgagcaacaagcctatcctcgaagcggtgtgggaggcataactatgtccatcacaccagtttctaaggcagtgaggtgcaggagggtatgagttagggaagaagggcttcttagagtaaattaagtttgaactagaaagatgaataggaagaagacaggtaaaaaggtagaaataaactgctagacaaaagaaaaagtatgtctgaaattctctattggaaagataatgctgtctatggaagtggtggaaagtatttgagttcagctggagcatagagtgctgaggcttcaaaaggcaaaaggtgatgatggagggagaaactaggtgatgaactaaatgatctgttctctgctgtttatgaatgagatactcatttcaggaattatcatgctgccctttccatggagacatatctgccaggctatcaatataacatgttacactaaattctgaatcaatgaggccactttagaataatttagagttaaaaccgaaaaaaaaatccacttttccaaaatgaatgaatttggcattaatgtcccttttgaatatttatgctaaaatgatatcattatgtacagtgctatttgattaccactcaagctttgcagaatggtgtcatgctaaggacaattgttataagtgataaaattgcttctgctgaaacatcgcctatgtgatatggtatttgagcaatagcaggggtgttctcctttgcttgggattctccttactattcccaaaataagtaatggaacatatttcaagatatatcttattcaaaatgttctcacttccagagcttgaaaacaaaaatctgtatgttctctcagagtcagaagtctgtaatgcgccgggcgcggtggcgcgtgcctgtggtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagaagtctgtaatgctactggtgtcccctaattttcttatagccacagttcctttcgcctgagctcattacagagacaaatatccattagtgacaggtaacttttcattctaatgcgcctgtagtactgatgtctgggcctctgagatattctattttgcacctgaaattagtttctgtgttacagctctgaatttgtgataagaaaacagatactgtaatttagataaactccactaaatggcttgactgaaataaagcccaaatgaaggtataaatgactgtcaagttctctggggtacagttagagaacaaaatagctgatggattgttatttatctgtgcatgtgagtttgggggatttaattaaagatgttctattatattttcaaagtctttctgaagctgtaaatcaaaagctgaagaaacagagaatgttgccattgatcaaaaaaccagatctctggccatactgggaatgtcttcttttggcggtggttttaatgtttctgtttagtgttttaccctaaacatgactataaagaaataaagggaatctttttggtataattatttcctaaaggattatttgagccattgtggtgtgcatctgtacatttttatccatacatgtaacatgtatgtttacatatgtttatccatatgtatgcacgtacatatatatgtgtgtgtgtgtatttgcttttcttagtgataagtattctttcttaaattggctttaaacataaatccccaaaatgtgccacaagtagaattatgcaacaaaatctgcatcacagaagaaaattgaacccaatataaaatgaatttcaaaaatagggccattctatgttcttaatatccattcctctttaaaaaaaatcttcaactgttactaaaacataatggaagtattatgtgagctaattatacctggaaaaatcatatggcataaataaataaataaataacagcatggacaggatcccaagggtcaactaatctgttctctacttctagttagcattgtgacatgtatactattattaaaccacttcagaaactaaacagaaactactcttttgtagaggattaaggatggtcacagttctttgatattacttgcagggaaatataaagtctgtttttggtcgctttgaatccagagtggcctgtaatggtttaggccaacagaatgtaacagaagtttgactttgccagatcaaggccaagcctgtgtgtgagaaaactggcaactttggctggcctcttcaagccctgggttgttacgtaagaagtctgactacttgtcagaaagatcgcttggagaagccatgagaacacatagagaagggggtagctcagctgacccagccctctagctgttctcaccaaggtaccagacacatcgctgaagctattctgtatcttctagtccactccagttcccaactgatctagttggcacccatggaatagaagtgccaagctgaccctctggaggtcctggtcctcagtatcagtaaaaaagatgatgctttaagctgctaagtttacagtgtattgttacacagcagtggataactggaacaagcttgaaagcaagactgaaacatgcacttatattcattcatgtttttgaatgcatagggacttttttgtctactatacataatgacaatttttctaactacagtggcaaaataaaatcatatggactttatcttcattacagctcagtcaagaaaaaacaggattggactatttcttgagtaagtcatcctgtttggccaaacactgtataatcaacttgaatttattaaatttttagaaagttttgctgttgatttatactgtgtaccataccacttaacatgttctttggatttcgtgcatctacttttttttctgaacaactaatttgataggagagttctataatatgctttacttttttgacttctagttttttattttaaagaagacagagacctcattagagattaaaatgataaaatgagtccgataaatatgaaaagatttgatatctattttttgtgagtctttcatctgagttatgtaaatccttcaaacaataatctctcctatgtgatcccatctttaattctcagacccaaaggactagaactatgttctgtgatattgtgcctagcatggcattttagagtttgcagatgctccataaattggtagaatgaattaacttgattcaaatgattgccagtgctctaataaacacagatgtttttatggatatgataacattttagaattaaggtataggagatagtcaatattcttggcccttttctattatttccaaggagactttctgaccccaagttagactggggtaggagttacaggtaataaaaagaacaaccttttccctttcttcatactactctaagaagctctttaaatatatgcttttagaaatggtgcagcaaattctagtaacttttatattttaatttttgatagctgcaaattatgccccatgtaagcaaatacttgatctctacaactattagatttatcatttaaagaatacatgcctacttgcaagttaaatgtaaattgaccctactttctgacctattttctctatccttcatttgttccatttgaccagttttaacctaattttcttgctctattatgtgtatcttcaaatagtgttttaaattatttcttgatcaaattttaaaaaaatgagtgagcaacaaacacacaaataaatgaattggcatgtgatatgacaatttgtaagatttttgcacttggtaatatttcacaagtttagttgatggatcctcattggtatcagttttaaactagagattattctggataataaatgggtaggtcaaactgtagcccattcacatctgtctctatgagaatcctagaaccaagcaatcatgcctcttacctaccatacttatctgtcccacgtttatccctgcaaatggacaatacaaattaaagctagtcagttatgcatgccattgatggatctgtttccttgagatctggaaaaagtggttcttcctttttacatttctttctcatggttggttaatccttagagaacaattttcacttggcacctgtattagtccattctcatgctgctataaagaactgctcgggactggataattcataaatgaaagaggtttaattgactcatagttctgcatggctgggaagacctcaggaaacttacaatcatggcggaaggggaagcaaacacgtccttcttcacatggcagcaggaaggagaagtgccaagcaaagggggaaaatcctcttatcaaatcatcagatctcatgagaattcaatcactatcacgagaacagcggcatggggtaaatgcccccatgattcagttacctcccatgattccctctcctgacacgtgggaattatgggaactataattcaggatgagatttgggtggggacacagccaaaccatatcagcttcatatagattacttgaggtctttatagacagcagaaaagtatagtggtaatattactttgggtgtcaggaactcttgtgcttatgcaagttcaaatgtgtaagaaatggttccttagcacagttgtgcagaacattgtttagacaaaaggaagtgagaaacaatttaggcaagcttttccataaagttaattcaactgaatttaaagaactccactttaaattatgttctattttttaattcatttgttttggataaagattattttatgaaagccatgtggtaagaaatgacataatattttgtttgatatttgcacgtggcacctccaagatgatccttcaaacaaaacaaaacagaacatgatgacaagaaagtcaaagttcaagaaagactacacttaagaaattccctgagagttacaatcatattaaggttaacacaaattcctaaagaacttatacatctgtcctcccaagtgttgaggatttaatagtggcctaaagataggtctcttcacagataaaacaaggaagagaggataccttatgttccattgtgacccatctacttaatatacctgtgagggaagaaaatcccactgtaagaatgctgactaagctcagtcttgtatccaaactgcttcacacctcctgagactttcgtgaggttttaacattaggaatcaatgtggcctttggcaaatcattccacacaactggaactctatttctttattcaattcactgtctcttcaattgatatttattgagggcacattattgagcacccagtcaatgttattgtcaatggtgccacagaagggaacacaatagattaaaaatccctgacctccaaatgggatctaattaaactaaagagcttctgtacagcaaaaggaatggtcaatctacagacatcttacctacataatagaagtgaatgttcacaaactatgcatttgacaagggtctagtatcccacatctataaggaacttaaacacatttacaataaaaaggaaaagaaccacattaaaaattgggcaaaggacatgaacagacacttttcaaaagaagacatacatgtggccaagaagcatatgaaaaaaagctcaatatcactgatcattagagaaatgcaaatcaaaaccacaatgaggtaacatctcacaccagtcagaatggctattataaaatgtcaataatataacaagtgctggcaaggctgtggagacaaaggaacgctatacactggtggtggaagtgtaatttagttcaaccatttgtggagaatagtgtggagattcctcaaagaccaaaaatcggaattactatttaacccagcaatccgattactgagtatatacccaaaggaatattaatcattctatcataatgacacatgcacatgtatgttcactgcatcactattcacaacggcaaagacatggaatcaacctaaatgtccagcaatgatagactggataagtaaatgtgctatatatgtaccccatggaatattagacagccataaaaaatgagatcatgtcctttgcaggctcatggatggagctggaggccattatccttagcaaactaacacagtaaaagaaaactaaataccgtatgttctcacttatatgtagaagttaaatgataagaacacatggacacaaagaggggaacaacagacactgggacctattggagggtaggaagtaagagggaggaaggagaggatcaggaaaaataactaatgggtactgggtttaatacctggctgatgaaataatctatgcaacaagccccaatggcaaatgtttacctgtatgagaaacctgcacatgtacccctgaaattaaaagaaaaaaaatttagttctcaagggacttctacatgttcccttaataaaacatgtgtcatttgattacaattgctatggggtgctagggtacctcagtatgtgaaataggcagaatatggaagaacgctgttctagggaagggaaagatgagtctgaagacactgacgtagaaatgtgtctggcatgttcaaaaagcagcaaaagaggtcagtgccgttgggccagattaaagaaatgactgagtgatgaaagatcaaggagatgctcagaagccaggccacatagtcttacagactgcactagctttcatttttggtgaaatgggctactattgaacggttctgaaaagaggagtagcacgaactgacttgtgtttgaaggggttcattctgctgctgtgatagaaacaggttttggagaagaaaggaagggtatgaagaccaggtaggagccccatgcatttaaatcagggtagtaacaatggaggcagtaagaagttgtaaaattttcaaaaataaaaatgatcaaatcacatttatacacttagtcaaaaagcacttaatgaacactctgatacggtttggctatgtgtccccacccaaatctcatctctaattgtagtccccacacgaggagggagggacctgtaatcctcacgtgtcgagggtgagaggtgattggatcatggtgtcagtttcccccatgctgttttcaagatagtgagttctcatgagatctgatggtttcctaagtgtttgcaagttcttcctttgcagttcattctctctctctcctgctgccttgtgaagaagatgcctgcttccaatgctgctatgattgtaagtttcctgagtcctccccagccatgtggaactgtgagccaattaaacttctttccttcataaataacccagtctttgtatttctttacagcagtgtgaaaacagactgataagcattcactggatgccctgctctaagagttacacacataatagggaagaaaacaggtcagctcttacttacatgggcatgatatttaatggagtcctttaagaccaggtcagcctacattcttggtgtagttcaaagagatccaggaaatttactgttttcagcagggggattaaacacacacatgcacacacactgtggtataggttgtgattaaaaagcagggtggctaatggatgaggttgctaatcattgcctcgtcttccatcagcaactcactaagaagccagtgaaaaaagagaatgttgtatctaaaaaatgttagttatttgcacagatgtctgctctctctgaggaattcctatctccactttcagcttcgcaaagcatgtccctttatggaccatgttattaatgaaatggaaaagaatgtgcaagaaagcctactgttgtctgaaattatctttacttctatactgccgctggcaataactgtctcttctccagaattccagaacagtgaattctttcttcacgagattaaaagcaaaacaataaaaacaaaacagaacaacaaccacagggagaaaaataacttaccattttggaattatagatattgtattttgagttgtgctgatgtgtactacttctcagcaattcaatctttttttattaatgtaagattatctcaaacattattaacagattgcctaatgaataaggcaattctccatcttgtacattcctccaaacccaataaatcagtgagaaattcaaattgctatatatatatttttaagctaccagtagtgaattgtaattgctgattggatgtcacctgtttaacagcaggtcataatggtctggaaaactgagagaatataaggaacctgccctgatggagtacagcctctgtgaaggaaaaagtaactagttcatttgagtcctccagcagaccctttgtctagaacctcgtccttgcaaacatatagtgtgtaagcagggggattccacatttgctcattcacattgtctagaaacttatggctaaatgatttttggatgtgtattcagacataacctcaattatatcttatagcagtcattctttttttttaaatttcaatagttttgggggtacaagtggtttctgattacatggataagctctttagtggtgatttctgagatattggtgcacttgccatctgagcagtgtacactatatacaatgtgtggtcttttatccctcactccaacccacccttcctcccaagtccccaaagtccgtcatatcattcttatgcctttgtgtccacatatcttagctcccacttataagtgagaatgaacgatatttggttttccattcctgagttactttacttagaacaatggcttccagctccaaccaaagcgctgcaaaggccattattttgttctgttttatggctgagtagtattccatggtgtgtgtgtgtgtgtgtgtgtgtctgtgtgtgtgtgtgtgtgtgtattacagtttctttatccactctgattgatgggcatttgggctggttccatatttttgcaattgctaattttgctgctataaacctgcatgtgcaaatatcttttttgtataatgacttcttttcctctgggcagatacccagtagtgagattgctggatcaaatggtagttctacttttatttctttagggaatttccacactgttttccacagtggttgtactagcaacattcccaccagcagtataaaagtgttcccttttcaccacatccatgccaacatctattattttttgactttttaattaaggccattcttgcaggagtaaggtggtatctcactgtgattttgatttgcatttcccatagctatttttcttaatcaggaatatataccagaattacttttggagtttgttataagaaagacatatgtaaattcttatcatagatatgaatattctgattcagtaaatatagcatgcctgagacctaagcatttacataatgaaaatgtttcctagaattttgttttcgtaacttgattgacacaattcaaaaaactgtatgaagaaaaattaaatatgtattaattgtacatattatgggggggggtgtgtgtgtccctgtaaaattatcttttaaaaaagagaacaaagtaatagagtttactaccaaccatttttcactaaaataaatataaatcaaaataaatctttccaaattgaatgtctaaaatccaagaaaaaatgatgggcaaaaatactggtgaatatttgagtacatctaagtaaatacatacatacatacacacacacacacacacacacacacacacacacacagacacacagtcaaataactgtatcctttaaaatacatcactgagctagcaagacaaaaaagtccacagaggtcaaagaataaaaaagcaaaaattgtagaagttgttcagtaaatgccaaagtcagcattaccctctctaaatgaaatcttgatatccttgagcatctgtttatataaggtgcaatacacagaaggaaaagcccaagttttaccccatgtatggagaacactagaagacatcatgtaaatctgagaacctaaggaacagcaactcagtataaggtttaaagagaaataaacacaaggctataggaaaacacttcatctgtcttgattttagcattaaatagaaatattaaataattcaaaattaaaacaaaaaatgaaaccacaaaattttaataacaagaattcatgcaattttgcagtttgtttccatttttgtgttacctattgagcataaaagcaccatgagaagaattaaatcaatggcgaattttcactggacaaaatgcaacttcaatatagcctcaaatggtttacccagtaaaatgtttcctagaaacatgtccctgcagtgaaaaattacaaaataaataaggcagcaagttggtatgaatgagagaaagtagaaatagaagaaaaatcaaactcacatagactttttatataaaaattaacaaccaaacaaaaggttatgtttcaaaaaaacccttaaaatatgagcaaggagttagaaagcattaaattaataaagtacacttgaaaagcaaccaaatagtttttttagaaataaaaaatacaaaaattaattttagaaagttagaagaatgggttgaatttgcgctatagatacaactgaataaattagaagatgaatgagaaaaaattcattacagagagaagaggagatgaatagtttgaaataaaataatatgaagagaaaattaaaagttatgtctctttgaatttctagaaagagatagcaaaaagaatagaattatcatacgtacagtataaaaaatatttctagaattgttggaagatataatacctcacacccagaaagcccaaaatgtctctagcaggagaaacaaatatataacaatctatacctagcagtttataataaaaaagctgaatgccaaaaacaaagagatatcacaagtaacaaaatagaaaggataaatcaacttaagatgtgtcatttaaaccaataactatcattttgtcagcaaaaatggaaaccaattgacaatagaataatattttcagtgtgttgattgatgacaattctcaacctggaattctatactcattaaaaatatcttttaaaactgagaacaaagtagtagagtttactaccaatcatttctcactacaataaatttaaatcaaaataaatctttccagactgaatgtgtaaaattcaagaatgaataatgggaaaaaatactggtgaatgtatgggtatatctaagtaaatatggaagtatacatcaaaaatgaatatgataagatttggggtaaaataaataagaagtaaagaaaaaccacagaagttggcttaacttatgagaaagagagaaaaaaacttcccatagctaacttactcatctttatacaattatcactcttaaattactttgagcattaaatagaaaggatttgctaaggattcacagacttaaagattctttgtgtaaatttagtaaaagttaaagtcaattatcagatatatcacataattataatatgaagttcacatatccctaaaggaaaatgtaaaataataatttgcttaatatttacaatgggaaatgcaatttattaaagaacactaagctatttctaattcaataatatccaaaattttatttgctcaagctcttgagataaatcacaaaacaagcacattctttcaaaattaaaatacagttttaacattaaaactccctcttttgaatctggacttcatatgatttttctgtatacttaaattttgtgtgacatttaactgaagcctattttattttttttttttgctccatatacatactggaaatttaatatccataagatgtgaccactgatacatattaattatccaaatggaatggaaattaatattgctgttaaaacaagactttcaacgcccccccacacaatgcattgcctgcaaacttaaataatgttatgccggacatatttgttagtatgggtaattaaacatctttacaagccatctatatcatgtagttacatgcttaacctcattttataatcattccatgcggttgcatattcagaggctgccacatttatattaataagcaaatattaaaagtaaaacagaattatttagatttccaaataatttctgaagtccaaaaggcaacataatatcataatattttataaaatattttttaccacatcattatcaccattttattgttgaaagcacatctgtgtcggggaaatattcatagaataaccattcaaagaaatattcagaagattcaaggttgccttattaaattacagtctaaggggattcttattactaaaggtaactcttggtaattaccaacatgaaaagaacaattccatttatatttcagtcaagtgcaggaatatgaggtgtatatgtttgtttactgttctcttcaatagcttacaaaaatatggatatatcttaacagatataagtaacataaactaaaaggtaaattgctttaaattaatctgacatttttggatttaagggaaaaggaggtttcaaatatttgtttaaagcatttctttagtgaagcccataaggagatataagggcctaaagagctttcaaagagaaactcagaaggataatttcatgagtgccacattactcttcaatccatcactgctacatgtgttagtatattactctacatgagatccacttctaaaaaatgtctttccagtacttcatttctctatatctgtcatatttccatgtcatcctcttttctttaaaatttcagttatgttccctttttatattttccttatttatatttcctgaaagaatttcacgacagattcttacagaaaaaaaagtgtaagacaatgtttactatgtaaaatgagaaaaatgaaaatatccatttttaaaagcctaaacaaattgagcatctttgagttgttagatatttccagtgatgagctaacaaaggtttaaaagctggctttctggggaacaaaaaaagccctgatttgtagcttttacccattttcttgaggaaatactcccggtttggctcttttgaagccaccaatgtgaaatctatggacatggaattgggaagacataccagccacccattcttgcaatccagtatgagttggctctagcatatcactgcagtattttgttataaaatggctatggttctgattattcccaggcactacagtaatataaaacaattatggtttgaagaacacttcacaattaaactctagtacaattacactgaattccccactactgatcagaaattcaagtgttcccattagttcagtaagaattttcaagataagcattttagaattgcaaaaggttttgaatagccaaaagaaatttctcacatgccaaaaccaagaacagcatactttacacaactgtaactgtaaattacatatagtttattcttaactgtgtatatttgtatagctattttgcattacacatactgtaaaagttaacaacattctacaaacatttagcaccgactatgtgttagtctcaatactagatgttggcaaaagacaggtgaatcagatgtaaatcatgtctcatatatacatatatatatacacatatatatatatacatattatgcatgattactggttattaaatgtatgtaatacaagcatttcattgtttaaatagaatctgtataatcatggcccaagtgagaaacttgaagaagagtgcctaagggcacagatttattctatttccaaaaagaaaaaacaacccaagtattgcgttttatctatccccatttcctgataagaattttaatggacaatgttgaaatataaaagaagtaaacattaaaaatgttttgttttccttaaaagttttactttcataaatgtggtaacatctggtggtagcatagatggttattctgcagttgatattctaagtaaccctctttttttgtttaacagatatattagatgacattgagagatgtagatgggaaaatgaagtaattaggcaccttgcctcattttttaaaatattaatttttaaaaatattaatgtacatgatacagatatgcagagaatgaaaattatgcacacatacagtgataattatgtctctctagtttcattttgatttttatatacaatattatatatttatgtaaaatataacatcataacaataccaacagtgcagaacattaacaatcattccaacacaggttaaataagagatctgtaatcttatctcagtacagctactctaaaagtctggagtttacttttacaaggcccccaaaaggcctttcaagattaatattatcattactcagctgtgttaattagctggtgaatcatttaagcctaaatggagatccaagtaactgaatcagaaatttggagctttcccaaagaagcaaagaaaataatcctggagtttctagattgttcaatataaaggggcaaaagcatggaataggttgtagaaaaaaaactctttttgacttcaatatactaaatattataaaaacaataagctactgtgaaatagtttttcataaagttcaaacagaataagcaaacacaaatggatgctactagagcagggaaagagggaccacatgaaggcagtgagcaaggcattgattaagctgaaggttgttcaataactgctccttaattgattaaaagaaaggccaaccttgaacaatcaatatttaacccattaatattactacttgccatatttattgataaatgttgccaaagttaaattggcaacaaccaaacattaaagaaaatactaatccaagcctgaaatataacactttttccaataaactgttacaggtagaatacgtttatttccaaatccaacacatagaatataatggaaatttaattataacaactgaggcatgtttagtcacattgttaagaacataactcagttttaatcatctctgtagttcaatgaaacaataaactaaaggagttagagtggactgatctgattattgaaaactacaaacacaaaccccaatgtctgctgatgtctaaatgcttccaggtattgattaggaataaaaaaatatagatcagataaaccgtacagattgctttagataaagattaaatacaaaaccattcaattcctcccaataagttggtaaatgacagagagaaagaatgtcagtcttattttctccgcttttattcatggcttccctgttcttacatattttcatttaaaaacccaaaccaaaccagatggcagaaagaatatagagttaaaaatgtattacttatatgcctcaaggtctctctcaggtcactattagcctctaactatcacctctaaactttaataagtaataactaatgtttatggagtgcttattatgagctatacatttcatacatatctgtattttttcatttactaatcttaaactgctacatagtaaataaaattaatagggtcattttatagatggggagactgagaaataaagaggttaaataacttcttaaaagtcacccaactggtaaatgtgggggttataattttaactcctgaagttttattccagaattgagaccttgagctctttactaaaatgtgatattttcaaaagaagagaggaaggaagaggataggaaaaaacaaagtaaagagtagtgataaataagacaccacaatatcacagaactactgtaacaggcatgacaagtttggaaaagtaggtccaaatggcatgcccagtcatagggcaactctctctgtaaggacaatgagttgtctcctaggatcagtaagaaaatcattccaacaggacagcaatagggtagtgagtaagtgaagtactaggtgaagtacaagggagcaaaggaagacaaaagaggaaacagtacaattggtacttatttactctgttaccctccttgcttattaacatgaagttccattctgatgataaaaatagattaatatttgcctagacaaataaaccccaaaaaaccctataaattcaatatagtcctttatgataatcggtctctctaaactcagttctaagatccaaaaccagatttatcaaagtcctctcttgggcactgttataattcctatttgactaagtataagaattaattgaactgaaagtttaataatggctgaaaaatataattctgtgttctatatttcagtgattggggttaaagaacataaaattaaacactctgaatatcagaacatccaaggaggctatgcaaaaatttagggcatgatgtattatactttattctggggaagattttatggggctccatttgttcttttcttcctttatgggaaagatttcactgtgatgtgagttttagagacatgttccaatatacagtttcttttgtacaacatgttacatatatttaactctaatatgcaaccattaggttttttccatacattcagtcattttccaagtatctatatttttaaatgttttcccccaaatacagggggaagataagttttactgggacaaattatgtatgttcccctctcataactttaccccagggcattttttccccaaagggcatagagcagtccactaacactataaattatatccctactaccatcattggtggtgtttcccgtctaacattgtcatgtctaaaaattatttaaaatgcaattttgaagtagaaaaagtatttcataaataataagtggtttcacattatgtttaaatgtgatcattaatctataaaatttggtgagacaattatgctttgaaagcagttactgatttagttagattttctttagaatgttaagaaaatatggattagaaaatacataatccatacaatgttttcagagcatagaagttcctttaaattacactctagatataatctaggtacgattagtggtaaagtaccatgtaataacatgagactttaataaatgagtaaacaattcaagtgtacaatggaaaatatatttcacttcatatgttcattattataaagaaaataaaaatgtttctgtatctgtcaagaagaaatccaacattgtaccactatttttttagtataaaacgtttattttttactaacattgtatggttttaacaaaaaaaaattgtaaatggttttgataggttgatttaagattttattcttttaggctaactttgtataatgagtgtgcatgtctttacttcaaaatgtatgaagtgtatgaaatgtatgaaaagtgaaaaatattgtgtcaggagacagaattataaaagcttaaaaaaaatcatgagttgtttgttgttgttgctgttgtttccccaagatggctaacttgggacagtggatgccagctatctcagaaagacaaaaatgaccaagtagagtggctcactccttaatcccagcactttgggaggtcaaggtaggtggattgcttcagtccaggaatcctagacctgcctgggcagcatgtagaagccccatctgtacaaatgtacaaaaattagctgagtgtggtggtgtatgcctgcagtcccagctacttgggaggttgaagtggaaggattgcttgagcttgggagggagaagctgcagtgatgtaagattgcaccaccgcaatccaggctgggcaacagagcaagaccctgtctaaaaatgaaaacaaacaaacacatacacatacacaaaagaaaataaatcagagttgcaggtgaatggtcatgctttaaatggaaaactgagccaggacctatcagagagcccacgtgaagaagctggggtgtggaaaaggaaaccagaaagtctgcagaggtggatgcctgagaaactcaaagccccatggaatggccccacaggagatagtgtgttggctcatatgtccagtatatcactacagcaaagcagtatttgagaaagccaccacacaaaagctatcaacaaccaaggaacccatacatcatactgaatggggaaaagctgaaagcattcccactaagaacagaaacaagataagaatgtacacttttaccactcctatttaaaatagtagtggaaatactggccagagtaatctggctagagaaagaaataaaaggcatctaaattggaagagagaaagtcaaattatctccgttttctgacaaaatgatcttatatctagaaaactctgaagattcttccaaaagactcctagatctgataaatgatttcaataaattttcaagatacaaaattaatacacaaaaatcaattccatttctgtacatccaccattttcgagctgagaacgaaaccaataactcaatcgcatttaaaacagccacaaaaatacctagaaatacttttaaccaaaaaggtgaaagacctctacaacaagaagtataaaacactgaggaaagaaatcacagatgtcacaaacatatagaaaacatcccatgctcatgaataggaataatcaatatcattaaaatgaccctactttcttaagcaatttacagattaaatatgatccctatcaaataaccaatgccatttttcacagatttagcaagagcaattcaaaaattcatatggaacccaaaaagagcccaagtagccaaaccaaacctaagcaaaaacaacaaagacagaggcatcacattacctgacttcaaactatacttcaaggctatagtaaccaaaacaccatggaactggtacaaaaatagacacatcgatcaacagaacggaagacagaacccagaaatacagccacatacctacaaccatctggtctttgacaaagctgacaaaaatgaacaatggggaaaggacatcttattcaataaatggtgctaaaaacacctggctagctatatgaagaaaagtgaaatgacccctatttctcacgatataaaaactagctcaagatggattaaagacttcaatgtaagacctgaaccattaaaaatcctagaataaaacttaggaaaaactcttctggacattgacccaggtaaagaatttatgactaagacctcaaaagcaaatgcaacaacaataaaaatagacaaattatacaaaagagcttctgttccgcaagagaaacaatcaacagagtaaatgggcagcctgcagaatgagagaaaacttttgcaaactaaccatccaaaaaagaactaacatccagaatctacaaataatctaaacgaatcaacattagaaaaaaacaaatccattaaaaagtgggcaaaggacatgaacagacacttctcaaaaggacataaaaatggcagcaaacatataaaaaatgcttaacaataatcatcgaagcgatgcaaattaaaaccacaataagataccatcttataccaaatagaataactattattaaaaagtaaaaaatagcatgttggcaaagatgtggagaaaaggaaacacttatacactgttggtgggaatggaaattagttcaaccccctatggaaaacaatatggatgattctaaaacaaataaagataaaactactattcatcctagcaacctcactattgggtatctacccaaaggaaaataaatgattttatcaaaatgatacctgcactcttacgtttattgctgcactattcacaatagcaaagtcatgtaagcaacctaagtgtccgtcagtggttgactggataaagaaaatgtggtataaatacaccatggaatactatgaagtcattaaaaagaataaaattatgtccttggtagcaacatggatggaactgcgggccattatcctacaggaataactcaaacagaaaattaaacactatatattctcacttataagtgggagctaaacaatgggtatacatgaacataaagacagaagtaatagacactgggggatctaaaatgtaggagaatggaagtagggttgaggttaaaaaaaaactacctatttggtactatgttcactatttaggtgatatgttcactagaagcccaaaccccagcattacacaatatacccatgtaacatacctgcacaggtacttcctgaatcggaattttaaataaaatcatatcattgtctaattttacatagagaagttgtctgtattttttattaccaaaatatgacttttaaattaatgtccccaaatcagcctctctcaagtcaagtagcccagggagaagatttaatggaattagagtagataaagaaatgagagaacatggaaaaacaaacacacgatatacaaacagaatggaagaaagttaatatgaaaagggttcttaaccatttgagggtatttgaaccatctgaaaatgtggcaagagctaggggtctattcaggaaaatgcccatatactcataccctcaaaaggtctacaaaattgtaagtctgcattattcctagagaattgtacagcctcacaaaaattgttcataacctctatgttaggaatttatgggccagattgaggcagcaataatccagacctagagtgaaggcatttggatgttaaacagtaaatgaactgtgcagagaatagaatctatgagcctttctgtaggcttctctcctcgttctcctcacggatgacttctgatccttcaggtctcaatttaaatactatctcctcagcttctttaaccattatatttaaattgggacttctaccttattcctccttccttgtattatagtattaaaccaaattactttgttgtaatctattatagtagttgccataacttattaatgtttgcttctctatttttgtcttcctgatctataatatctatgtcttgtttgttattatgtctccaatatgtgatatattgatctgcaaatagtcgactcacaataaatatctgttgaattaaaaagtatgagtgagtagactttcaatatcgggaatctaaaggacttcaaagtattatataattctaccttcagccaccttttaggatttttgagagaaaagggagtttagaactagagggctagagttaatagtaatttctggcagtgaactatgcagccaagaatggaactgacattcatttgaaatgtgaaataatagttctcatttgtcatagtcttgggtattcatattcatgtatttgtaactaaaagattttgcagaaaggcaataaatgattcaccagaagtcattgtcataaaattatatgtttaacatattgaatatgcacttaaaattattttagatttaatatatacagataagttaaatcagatttttaaaacagataatttaataagagtagaaacaaataacaatccaacaataaaaaccatgcacatgactcctccagggtggcctgttctagttgcctcgttgttttgcagatccttctcccttatgttcaagccccttctttaacttttccttttcgatctccctaaatgctgtacttttccagtttgtgacccaaatcacctaacagggaaaaatgacagtgctcacacttcggagtatagcaggtgacatggcagatgatcaatagagatggaaattttggtgggatctataaattctcctcctagacactttatccctcttctacccccttagtctttaccaaaagttcttgtctgctgtgacccacaaaaaatgaaagaatcatcacatcagttttctttgtcaccgattgtatagtttaaggaatttaaacattttcagacactatgttttactgaactgactaccaaaagtaaaaaagattgtttgtggcatctagtttccaagagactaaataggaacaaaagcctttgtggcacctagtttcgaagagactaaataggaacaaaagcctttgtggcctcttcagactgaaccacaggtcctggtattaattcaactttctaccttggctctcccagttgtgaggtcatttggatgaaggattacagcaacattcctttggaaatttgctttaagaatcaggcagctagggatcattgaatccttgaagtttaaatttggaaagataaacaggaataattgtcacaacaacaaaacagcaaggacaggctacattaaccaaatctagactccttcactacttctggatgagagagtgggttggaagagggagggaggggcaggaagagggagatttggagagagctccagagagagagagagtgcaagagagcaagtgagcaagcaagcacatatgagcaagctggaggtggaggaggcaggcaaaggagaccaaaatataaccagagtatgtaattagaagtttagagtcactttcctatcacctacttcctttaatttctaagactgaaaaaatacaatccaaagaaaacatacaattttttaaaaccttctatttttatttttattttttttaaattttacattcagagggtacatatgcatgtttttttacatgggtatgttgtgaaatagtgggcattgggcttctagtgtacttgaaactggcccaattttctgatagagctgatacttttcgtttcttttgaataaacacagaagtttactatcctaagtcttaaaacttgagaaacttggatttgtcttatctgagttcctttcttaggaaatcaaccatcaggcctcccaaatagtatcaaggaactgaagcttaccagatcaccacatttggacagtgagacaccagacccctcactcatcatgactgcataaccagctacctgcttcttgttaactaactcctctttctttccactccctaattcctgttttctcaaacatggttacatttattcccaactatattaacccttaattttagttcgttgaagagatggatttgagtctgatctcacttctcggctgcagcactttaataaagcctccattccaggaaacactcattgtctagatgatttgctttctctccagtgagcaatgggacctagactgaactctggcattttggtaacatacccatcacccaaatagtgaacatcgtatccaataggtaatctttcaaccttttctccctctcaccctccctgcttttggaatccccacagcttattgtttccaaaatgtagtaaaagtataaatagtgagtttgattaattctcttactacttatttttatttagatttgtatagttactatcattgcattttaagctgtttaattatagaaacaaaattatcattaactcttgcctaattttcatctcctgtgactatatattgctctgtgtttaaaattaaggcctttctatgagtcgcctgaagtctaacacagcatgagacacatttagtggtatgttttattgcttgaatttatgaaagtttctgttattcctgcttggtttagttcttaagtctgatcaccttaacattggagagtctatcaaattccatctgttagttgatttccaccccgggaatcacattatccagtcaaatataaaatccatctgcagtaaacatgagtttttagcaatgagtacctttttatttatttattttcttccttaaccatgattattcctccagtgttttgtgtcctttcttacccaggtcttaaaggtacagcaaaaagtgacttatgctcctcaattccctaggcttaaccttatgggatgttaattaagcatgtccaatgcaggcgtctagagcattgtgcatgaaacctcatgtgctcattttgcatattttagggtagggttgtaaagtacagaataattgaagtttcttgtgagacaattgaattctggttattcttaaaggtattttccatatttacaaatattactggctacagagatctcctgccccaatggctaagctctggttcttgtattcccttttgtggttttcctcatgatctgtatagttttgatcttaaaatacagcaatatagtttaataagctgtagaaatgtaccaggtaatcatcaatataacagctgaaacttttctagtatgagagaataccatcactcttccaataaaacaaaagccaaagaaaagatgcaactcttaaaactttgcaataaaacaaataacaaatactttatccttaagatatggaaaatgtataatgaatttgcttgaatccctcctaggcataaacaagatggtattttataaggctaagagccaaaaaccaatatgcaaactgattgtttgagtcagaggagtccattactcaagtgtaagaatataacatttatcactaatacataaatgggtgagagcaatataaatttaagtagctatatcagaattcatactggaaaacaaatacccgaaagacaaagactttttctgtctctacaggacagtttagagttgatttccaaattcctgatttttgagaacgatcctctcttccatctttttgcctttttctatgccccaaacccaatgcgttctggatctagaaaaggcaccaaacatttaatgtgagattttgcttaatgaaagaccatttaagctgtcatttcttgctggtgacagtattgttacatctatgtcaggggtgggggaagtggcgatttgcttccatggaaatcaagacagaatgctattggtaaggaggtgggtattagccatgtgctggatcttggtgggtttctcctaatacacccaatcggccacaaccattgcaatacatatcagccacagtgaccacaaattgtgcttattttttgccagagatttcacaaaaatatttaattccatagcattgtatgaatcacactacaatataaaatctagtagccaggtgtgatggttcacacctataataccagcactttggaagctgagatgaatggatctcttgatcccaggagttcctgaccagcctggccaacatggcaaaacctcctctatataaaaaaatacaaaaattagctaggcatggtggcaggtgcccatagtcccatctacttaagaggctgaggtgggaggattgcttgggcctaggaggttgaggctgcagtgagctgtgattgtgtcactctacttcagactgggcaacagagtgacaccctgtctctaaataagtaagtaaataataaaataaaatctagcttatcttcttcccagatcagtgttctagatgaagttgctattatgaatcatatactatacaattcaaaaatattcatctgtagtgaaactgcagagtacaaatcactgtagaaaaaaataattctgaagtgcattagaaagtttacataatttaattgaagcaaaggaactcgctgatgaattattttcatttaattaagggagtgtattcaaaacacaaatctgtgtttcatacttacttttcacatgaatgaccaagccttccccatttctccttgaatgtgtttagtaagacttagggatattctgtatggatagacaacttatttgatagttcatcctttctccaaatatttaaaatatattttttcttaaagcaagtttccatatctattttttcctggactttttgattttctatcagttaatctgtgcaaaatgccttactaattttaattgctacaatttgtgatgtgttgtcttcttctcctcagtctttttttgtcttccaaatagtctttctaatctatactttttgttcttgcatgtaagtttgagttagcttgtcaagtactgagaaaatataccatgttataattttgagaggattttcttgaattttttgatttagccgaatagctgaatttaaactttcctaagtctttccactcatgtataagatgaaatttattttttacatgatgatatcatagaattttggtaatgtatttctcaatacctattttttcattacatttccaaacagttgttactaagatagaagaggacacatttattgtgtcctcaccatcctttcctagattttgtataggaataatcacatcatatagagatgatggttcatttatcttttttttttttttttttttttttaacctaatgcttcccagtttttttttttggtcttctctttggccaaaatctatcctagaagttgaacaggctaggcatggtggctcacacctgtaatcccagacctttgggaggccaaggctgatggatcgtctgaggtcaggagttcaagaccaccctggtcaacatagtgaaatctgtctctactaaaaattcaaaaaatagcaaggcggggtggcaggcacctgtagtcccagctactcgagaggctgaggcagtagaattgcttgaacccaggaagcggaggctgcagtgagccgagattgtgccactgcactccagcctgggcgacagagcgggactccatctcccaaaaaaaaaaaaaaaaaaaaaagttgagcagaaatgaccgcatctcttatctttcataaatagcatgtttactatcgatttcagtagatattcttgtgttaaatttctctcttattttgtacttctatagtttatcttttaaaaagttttaagtaggtattgacttttctgcatgtatttaggaaatcacatagtatatttttcctttaatcagtttacgtggttaattacacaaatatcaaaccacttaattttctgtaaatctaattggtaactattcattttaaaatacattgaggtatttggtatgtcaatttttaacttaagattttgcacacatgttcataagacaggttagcctacacatttttttcctgtaattgtccaactttactattaaacatcactatccttgaatagtgatttaggaactttataccatgcttattttgtggagcagttttgcatttgaatgtggaaatttacttcttaggatttgtagaacttactcctactagacctactgttagtttcctctttccttttctctttctttctctctttccttctttctgtgtaggtagtatttaactattgattcagtttttttatcggtttttattttttctggaatcactttcagtaatttatatatatttagaaacttcatttcctataatatttcaaaaatgttggtaaaagtttataatattgtctttggatttcaaaaaataatctatatgaaatacatacatttcaaaaaataatctttactaagatatctatgtagttatctttgtatagatatgtgcatttagttatatctgtaaacacatacacaagtatacttatgtgtgtgtgttgtttcctgtctttatcctagtcttccaaatatcttttgatatttttcactttcagcactcttcaggcttagctactattctttttctaacttcttgattaggacatatcagttattaatattcaatgtctttatttcataaacatgcatttcagtctatatatgtttctctaattgtttcagcttataaacccagtactttttttgttagttcaaaataagtgatattttaaaattttaattctaaaaatgcatatatatagttagaaatgcatattgtaattttcacatatattgaaaaatggtttggttatatttctgaaattaaattataattttatttttatcagagaaagtcatttacgtaatgccaggcacactgacaggtttattctcaaggcttagtgtgtctatttaaacctatgatttttaatcattttgatcagggcaaattctcatgtgtatgtagagtaaaatatctccataaaggggttacatcaaaatctcacagggaaactgtaccattcaatccttcatcaaatatttatatgtgactttagcatcatagctttagatgactaagagctacatttgtggtcataaagcacttgaaatgtttggcccaaattgggatatgcttatcacatacaatatataacagattttgaagacttagtatgaaaagaatatatgaaatatctcattaacatcctaaaatattatgtataagttgaaatgctaatggatatatgttaaataaatattatatattattaaattcatgtgctttttacttttgtaaatgcagctattagaaaatttaaattatgtatgtgacttgcattatctttggatagttctcatttagaaataatctgaaactgttgtcttctaggagcaatgattttaaggataaagctggcaatgttccccagagaacagccttaaatcaaaagggctcactgggtctcacatgaccgatgtacttgggttccagaaagcctctgtggttaaaaacccatctactgagcttgagacagaggctttctacttagagttggtttatagtaacaatacttcctatttcaaataataatgtgcaataaaaaagaccacatgattaactgatgacagatgaaaaggcctattgagtgctggcaactaatttgagcatatacattctacaatatatattacggtggatgtgcagtagagaaaaatacaaagttggtgctttctaacagttcaaggtgggtatgtttcttcttgaagtttttaaaatgcctgaatctctgcctgggcttcctaagggaagtgtctgttcttattatgcttatatattatatgcaaattgacttgcttattttgtatataatgaaaaatcaaatgcagtcatggcatatgtccaatgaggggtcagaataccgtaagttcataaaaccattcaatcaggaatcattctcaggctatggggaacattatttggatgtaggcagaagaaaggaggtttttgctttgcctgattgttacttctagtaaaagaaaatgaatactggggtggatgaactcccagaggacagaaatggtagagaataaagaggaggcttttatctcaagtgcatacctttgcagaagctgtaataaagtgccagtggtggccaggctgtcaggtcacagtgggttgaatgaactagtggtgttaatagtggatgtgtaatatgatgaggctttttaactgcatgggatattagatttatatttgtatggtcacttctaggattttctctctttatatttgcagcatttttgtagatgtttctcatattcacatttggctgtttctgaaacctaccatcttcatcttgaagtactggaaacagcaagataccacctattggaagaagtttcattgatttccaagatgttatattttgtacagtttcaaaagtcaatatcacattaaagaataaataatattgttatttagcagaaactttgaattctttaaatgccttaaatacaaagtattttattaattagaattggaaaaatagaattttagtcaactgatagagttggaatagaagggttttctaacagtatacacttagtaaaagggggaataaacattttgaaataaaggcagctgtcctcttttccaatggcatggctccattttgattggactgaagtatatggtaccaaacttccaattcaagtgaagaaatctacattctctactaccttaataaattgccatatggattgttttggtattcaggggataggaattggaaatcagtgtaacaagagcctccttcatcatttgtctggagggacacgaatcaatgtgaagctgccatgctgtctcaaatgctaacttattaagttcatatggggaggtttaaaatcaggcaagataaaactacagatttaacatgaataggcttattcttcaatcataaatgattggtgggatggaaacttagactgtagtatctggatcttttcctcacaaatgttttatagaccagaattccaatgggtgcagccatctatcaatttccatgggaaatatcaggttgtaacatgcaggtcttggggtctaacagaactgataaatctgtaaaatgtaaagcattaagtactttgttcttcagtgtctctgcattttgtatccttccttggtcctatagttgcaaaataatgtatcattttcccagacatattttaattcacaatttgactacatttgtgtgcatctatatgtatctatctataaataccaacatatacatatatatggacacacatttgatatttctatgaatgaaggccaaaggaaacaactggatatttcttctagctgaacttattatactgtcaacagtgacaatagcaataggagaatttctcatggaacaacctacaaagcgatcatatttcattggtgacttaataagaatcacaatccttcaattataaataataaatcaaattgttgacattttaccaaaatcaatactcttctcatttcaaataaaaaaatgctccctgaatgaacattaaagaatttattgcttaaatagaagtgagtcactataaaatagaaatgtcaaaattgctatattttaaaattattcctatttattatgtttttgtattcctgatcaagttttctaatcttactatattttgatttttaaatttcattataggagatgtattgctctcatgtacttattttgaacaattcaatgcatttcagttactttatttttctttacacaaacttttaggctaattagaatgcactttaggcattcacccccattatatttcatgcaaaaatgcaatttatataggcagcattgcagcattcatacttctatttttatacatttaaatggtcacatttcatgttttgaagggataagtatatcttgaggattacattttaatgatttttttaactacagtttactcctcaaatcctgtttcctataaatgaaaaacacattgcaattaccagaaaattccatttataaaatatagaccattacctacttatgtatcaaatattttaagtgtctaagtggtatattgacagatataagatggtgatctatgccaatattttaaattttctattctaccttatcattttaattacaaaaggacgtgtctcatttacaagttaaataatacatgagcatgataatctacccctactccaatctttttttttttttttttctttttttgagacggagtcttgctctgtcgcccaggccggactgcggaccgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggccccctactccaatctttaggcacttgcaatctcacatacttgagggaaccaacgtaagctgttcagtttgcagccaacctcaagtttctacagcatttgagggaaaaaaataggctaaaataatgattcacaaagttgaataatgcttgctgtgaccagttatcactataaagcaggtgtgtaaaacatcattttacacactcctgaaaaacaactcaattttaatctattagagttttgctttttaagttcccttaatcggcataaaatcctaacaatttaaaactgaaataaaacatttcaactcatcttatccattttcttacttttattctcttatttttagttgacatattaattgcacagatttaagggatgcagtgatatattattacatgtatacaaggtgtaataatcaaatcaggataattagcatatccacacctcatatatttattatttctttgtgttgttaacacttaaaatccttttctagatttttgaaaatatatatgaaattattgttaatgaactctacattactacagaacattaaaatttattcctccaatctagttgtaactttatacctgttaaccaatgtatccttatcttcccctctccctacacttcccaccttctaatatccacaattctactctctacttctgagagatgatttttagttctcacatataactgagaacacatgaatgaaaacatgcaatatgcctttctgtgcctgacttatttcacttaacataatgtcctccaggtttacgcatgttgtattgagtgacaggattttattcttttttatgtctaaatggtattccattgtgcatatataacacatacttctaggcatctgttgatgaacatttaggttgattccatatcttgtctattgcgaataaaactgcaataaacgtggaggtgcaggtatctctttgatatattgattttctttctttggaaaaatacccaggagtgagattgctggagtgcatggtataatagttctatttttagttatctaagaaacccccatcctgtttttcacaactgctgtactaatttacattcccactaacagtgtgtaagagttccctttccttcacaactttgtcagcatttgttagcacttcattctcttgatgatggccattccaacaggggtgacatacttcatcactgtggtttttattttcatttgatgattaatgagattgagcattttttcaaatatctgttggtcatgtgtatgggtttatttgaaaaatggatattcagactttttgtccgttttaaaatcttttttttttttttgctgttaagtttttaaatttcttatatattctggatatttagtcctttgtcagatgggtagtttgcaatattttctcttaacctacaggttttctctttactacattgttttgctttacggaagcttttttgtttgatatagtccatttgtctatttttgttttctttgcctgtgattttgaagtcttatctataaaatctattagatgaacgtcctgaagtgtttcccctatatttacttctagtggttttatagacttgggtcttagtttaagtctttatgcattttcagttgatttttgtagatggtgagagataggggtttaatttcattctgctgcatatggatatccagttttccagcaccatttattgaagattgtcctttccctaacgtatcttcttggtacctctatagaaaatcaggtggctgcaataggtaaattaatttctgatttctgtattcttttccattggtctatttttctgtttttataccaatatcatgccgtattgattatgatagctttatagtacattttgaagtcgggtccagctttattctttttacacagtattgctttggctattcaaggacctttgtggtcccatatatattttagaatttttaaaaaatttcagtgaagaattccattggtgttttgatagggattgtattaaatctatagattgctttggtcgttacggtaattttaaaaatattaattcttctagcccatcagtacaggatatcatttcatttgtttgtgttctcttcaatttatttcatcagtgtcctgtgattttcattgtagacatattttgcttcattagttaaatctattcctagggttttttttgtagctattataaatgagattactatcttgatttctttttcaaatagtttgttattggtgtatagaatttctactaattttatgttaattttgtatcttgcaactttactgaattaatttatcaattctaggactttttgttggagtttttatagatttttacatatgtaagattatgtggtttgcaaagagaggcaattggattccttttttccaatgtggataccctttctttctttctctggcctaacttctctagctggaacctctgttttctcaagtttttacttttttaaggaggaaaacagaccagccaatgtagatgaagtacaggcttttaaaaataaagaatcctgctagaagagtgcacgatcactctaactatagccaggggtgatacatactaccaactgaagtcaggcaatggttctcttaacatagtttctaaatatttctattatacaatactacttatgtttactattttactttctcaacatccacagcaaatagcaatagctaatatattacgaaatctgcaattatgtagggttgactctcagaatatttaacaagcatatgacatgtacagcaaccatccaaaaccaatactagaatgtcattaaccaataaaagggataaccataaacaacctgtatagcctcactctttttacatataaccctatggcactaacagctgttatggaagattttgagtaaaacattgcattagctgtgacattttccatcaggagaaatcgaacctaaaaaagatgaagcaaagatagattttatcagctcataaatccatgattgtgctagtttcttatgtcactgatccatggatcaatcaatgtcatcaggactcaaaactctcttttttctgtcacccttgctcttctctgtgttggattcatgctcagacagtgtcttacgaaatggtagggatcatgtcacctcattttcactacagatgtccctgactagatagcttccagttaaataattcctgaatgttgattttcattagactatctgcatgtttattgaaaatgcccattctaacattccacagagatttgaggtcactaagtcttgtgtgtgacttggcaatctgaagtttcagcacatattccaggttcttctgatgcagatggactaagatcacacagctctagaaataggctttggcctatgttatatataaactgctacctccgcagtggtagtttcacacattgtagggattatcatcacttcttaaattaaaatcttaggtagaactccactacattaaaaagagaaaagaaaagtctcatagactgtacattatatctactgatatattaaaagggccatttatgaatatgagaattgaagttgagaatccaaaaattcataatctttcatcttttggtgagaaaacaggcgtagtgatatgtctgcctcaatgttgcatagtgagctaggtatcagaacagaatccctcagttcagccggctgactcctagtgtgtctatctcttcttgatgtataaactcctgccatatatattttttactggattttgaggaaatagatgattagcaagcaaatatttctattcactctgcccattttctttttaaattgtgaattacatggtgtgaacaaatctagccaggggcctattctcagaagagaaacaatatataaggaatatataaacaaacaggataattgaggattataacagattttgtaaggacaatgaatagtgatgtgttacggggataatcaagggtaggaaatacttaagtagctttcatgtcagtttacacatttgtcttcttagcttgacagaaaactcattgatgtcaaggaccagaacatctttatgtttggttccttcactgctagcatgtggcctctataatataacttatgtttataaatgttgaattttacctatgtataactcctctgctcatactaatgagtatacagatagaaatctgaaattttacataagaaacctaataaacaaagcactgatttttattttttattttttatttttttgcgatggatttttctcttgttgcccaggctggagggcgatggcaccatcttggctcaccgcaacctccacctcctgggttcaagtgattctcctgcctcagactcccgagtagctgagattgcaggcatgtgccaccatgcctgactaattttgtattttcagtagggacggggtttctctgtgttagtcagggtagtctcgaactcccaacttcaggtgatccgcctgcctcagcctcccaaagtgctgggattacaggtgtgagccaccacacctggcccttcataccattatttctaaaccatacaatagcaatgcaaaaaaggtactatttacctgcagtcattaagtgagtgattcagcaaatggtccaagaatgtaggccattggaaaagacagtatttatacccaggactgtctgactccacaatatttttatcccataaaccaaattatttatcagtttactactattcaactgtagtcatctcactaccttcagttctgatgtgtacttgcctctaaccgtaaaggtaggttctgctctatgatgatatcacccattgagattaacagcatgaggatgctcatgtttctcataagtgggattccttttcttacaaactgggaccatttgaaggtaaattgaggcattattagtaattaaactgggacaataatattaaatcaaaactatctgaggcataagaggaggtgtagtcaccccactcaaagaaaatgctttttaaagttctgattattcatttccacacattatttattttactatccatatcactgatatgaggctggtgttttttatcttaatttccaagttgaaagggtaagacccaaaacaagtatgacaatgattattaagtaaaagaactgatatccgtgcaaggaactactactggactctgaaacgtatttcccagtacctaataataataaaattggtttggtcacttattacattatatggtgcaagaatgtaataatgataatgagatctatgcaaaggatgctattagaactgtacattttcttgacaaacgtgtttcaaaaaaaacaacacagccaatgttaaggaagaataatattgcttaatctttgttgattctcaaattgaattttataacatctgtaataaatagttctcaaaaactcaggctggagattgatttgtgtatcttctaaaagccacccaggattgataaccactggtctcaaaaatttaataacagtaatgaaaatattacatttacatttgtactacacatggaccgttctgaaaaatttgtggtctatgaggttatttgttttgattgtctcaaataatttaggtttttttagattatgcgtaaaccttctttggccttgttacagttttagcaataagtaaactgccctgttaataacttgaacatttaagacatttgtgcccgggtctttctaatacttgtgagatttatgctacagattaactgcatgggtatcaaacaaggcaccaatgactgacttcaggcaagtaaggaaagaagtaaaatgacagcatcttcttagttctgaaatgcctttaaggtcttggattctgacattctgagaggttaatagctgaataacaatagtaaaaataaaaacaatgtcatttatcacttattgagcccattaaatgtgaggcatagtgctaagtactttgcatacattatctctaattctaacaacaaacttcattctgaaaatgaaaaatagtgaggatgaaagtggttatgtaaattgtccaaggtcacgcagtaagtaaacagatcttgccacacatttagatctaaccatttatttcctactgtcctgcatccccctctctctctatcccaaagagttagccttttgtaagtgttaatgccaacaaaggttcatagagtattgaataatattaaagttgaaaattaattaatctttttaaaaatttgatgctcaaaatgttgaaaaaaaattttaaaaccccaaatatttcaagtgcctcttctttgttaaagatgctgctcgagtttaatcctcagaattctgctctgttggaggtagttcaagggtgcaagtgagttccatctcatgtttgcttacgcagctgatatatgagctgctttcacataccgggagaaattttttggcaactcttggtttgtcatagtaaacatggcctaaaatatgaataattacatcataacacataatacacaggctaattagatgtggctttctggattcagagaaaataatcacacaatggttcataaagtctgtttttccttatgttttttttctttcataatgtgtactttactcattgcctttagaccattttgcatctaagaagaactagatggtcatttttattgtccaaaaatagttcttatatgaggagataaataagtcacacatacatacatacacacacacgccccccccccccccacacacacacccacctctagcatttggaattataaaacatttctagtgtgtttcatctccattttcaggaaagcaaataaaaacatctcatgccttcgagaaaatgtgaaaactgatgcacacacacacacacacacacacacatacactcattgctgtttttgtatatttcttgaaaactaactcagaattatttcccaataataacagttaccagttgttgaggacttgattcttttcaaaccttgtatcaattaagtccctgacatcattacaaggtaggcagtatttctatgccaattttacaagtactaaaaacaagtcattggatttaattaacttgctttttctatatagaattcaaacttgcaccaacacttttaagtattattagataccattcttccaaataacagaaattatttgattgataataaatgatggcaatcactattgttttatagattgaaaaccttaagtaatttagtcagcagcaaaaacaaaaacaaaacaaaacaaaacaaaacaaaaaactcttaaattcccctatttgtcctctcaggaagatacaaattatttggaaagcactggagttttaaacatcaagtaagtataatgtcaattttctaatgaagatggctgcaggcttatagaaactgacaatactgaatggttatttggtatataaactatataataaaagcaaatctgacaggctactcagaaagactgtcatgccatggactgctacatacttaatttcttctcttttcatgagcaagaataatggtaaagtttgatggcaaaatatctgggatcaattgtcctatcacagaatgttgctatcaaaaatgccatgaaaatactgcccacaaaatttgttcctgggcacattgaaagaataagggcattcatatgcttcaggtattaaatccatcagtccaagggtgcatggataaaatgtgaataattccactgaggtgaaggagatggtgattggtggtattcacagttttcttaaatcatatgctgacattaaaagaaatacattttctcttctaagttaagttcggcttgagacattgctcacaagggagaaaaggcagaattgttcccataaaagaaaacatatattcagttaaagctgaaagcatatttgaaatataagttccttttcaaatataaaagaattttcttccagatctcaaaacacaatgaaagcttatacattcaagaagttatatgcaaggcaataaaactgagctaaaacaataccaagaaaatggtgaaacattttaaaaagcaatatttaaaaaaaatgttagatttcaaagtttgtattgatgtttatagtgtctctttttcttttagtaatttcctgctattgctccaggtttagtaatgtatattttttcaaatacatgatatgtagtacgtaaaaatatataccatatattttttagtatattaagtgctgtggccacagaaaatttccttttatttaggatgcaatagtcttgataaaaatacaacattaacatccatcaataattagagaaaaataaaaagcatacaactaaatgctaaaacatgtggtacgtggactgtctctgatatcatatttgaaagaagaaaggactgctaagagatggaactgtcaaaggattaatcatgctgtctacaggcttccttcatatgccacatgctacccactacctgggtcaacttggataagttattctgtttctctgggccctacgttatctgttgaagacatgtaataatgcctatatgatggatttaattttaaaggcaaataaattggaataaattagaatgtgcactcagtatacacttccatgatgatgatgatggtgataatgatgatgatgatgacagttaagtggtaaagggtggagtgtagcgaggatgagggcagactaggcagtagacactaaggaaaataatgagatatttttagtatttattacctagtaaaaaaatcagacttggtgaggtagaagctggagggtatcaaagtccaacagaggcagattcaattcttgactcacaatcatcactgtgttttcaatcaatttgattagccttgctgatccttagttttctcaacatgtaacacagtgacaggaacatcaacattacagggaaattttgaagataatatgtcaaaatagcataattttctgttgtgctcagcagggctgatttacccatcagacacagtaggtaggactagtgtctagtgcccatagtacatttagaggtctacaaaatgttttaattttaatttatttaaaatcagaagaaaaatgaatataaaaataaatatataatagttaattcaagctggattatattcttttttaaaacaacgcaattgtaaaacatacttggtagtattttttttaatgaagaaagaggtccatgaaggcgaaaatgcctagagctcgcaaatgtcatattgcagtgctggcgttcagttctattcttgccccatttgacacctagtcaatagaagagggctaggccaagagaatcacagaaacagagtttgagctctgctccatacctgaaacctggtagcccctgtccttgcagttatctaaagaaatacttttgatcattttagtcagtttttattgcattttatctaacccaaagaatcttaatagataaaaattaataaaatcaaatctgcttgaattatcacaggtatatttcaatgtttcactttcatcataagagaactctcccagtcaacatgttcttaacagtctctggggagctactctgccacatgaatcccattcagcatctgtatctggccctagcagttccccgagaagacaggtaaggaagtgatcaagaggtacagacaggtgggcgaggttgggagagtaagatcttttggggagaggtggggtgctggaaattttaatagacacaaaattttaataagatctcctctttatcatatacctggacattcctagatatttgagaaaaaagtaagtaaaccagttcagtgaaatgacttaaagtataacacttgttttaacctagaattctagagtcatggtattctaagcatactttgattcaacaatatctagtcttgtttaaaaaattaatgagctttattttttaaagcagttttaggttcacagcaaaatggggtagaacgttgaagtgtctatataatctttgtacccacacatgcaccatttgaagaattgttcttttctttcattgtccagatacttgagaagaggggagtctggcacaaggatgagaaaagccaaagaagcatcacaagtaagcacacattatcttgtaccagcactacagatagaatcatagttcaggtatttactgccattctcttctgaggacatcagctattatccgtagatggcagtggttctaagcacaacttaaatagcacatttatgcttaaaataagcttgtttataaacagaaattacaaatattcacagaagataattgaggctatgaagagacaattaaggctcctccttagggcagcattttgttttgttctatattttactgaaggatttaaatagcaatatcacaattatgcaaataagtaattgctaaagttctagtttgcaaggaagtttaactcaaatgcttctaacatgtagacgctactctctttaaatagtttcttaagtaaagccagtaaaattattggcaaactgcatatttaaaagttgatttttcttctccatcttaatgaaatcattttaaattctgcagttctgtgataaggaaaaaaatctgcattcagagtatgactaaatgctttctaatatattgatatctaagaataagatctatcctttaaaagcattgtggtacaataaatgcttctttgtcttagaaatcatgcatagaacatgacagcagaaagactcagtggagacagaccactttaatttttactgataatatgatgatcacaggtgcatttttaattatctcaccacattgctttccccatcagctgtcactagtaatttcatacagcaagtacgttgcccttatgacattacagaatacaatttagagtcatttaggatgcgtgaagattgacatgtggcttcaccatttgtcaggatgtaaacaagggagtcaatggatttaggaaattagatgccaatcatttttgcaacctagaggtgaggaaaagcatgcataaagtaataaaaatacggaagttttcaacagttgagtgactactgctaagcttactagagtctaaagacaaattaggcaaaggaagcaacttgtgggtattggttgggagatggagagaaaaacatcacattttggtctttgtctcattgctagagggcttatagaatcctcactaggtagcacttgcagtgagtgataataccatgaacatagaggaggctctggatgctctgagcccaaggaataagtaactcatttcctgggctcatggtgttacagaaaacaaagaaagtaatgtcttctttctttttttttttttttaagtcatgctataatcctctctgtgaaaattcgttctctgtttggacctgcctacttctctgaagttaaaattttgaaaatcaacaaaacagcaataaaatccctttgtatcctatcacgtttatgttatattataaatgcttttctagaagtccctacctacaggttttctgtgctaaaaaaaatccacaccatataatagtattttactatcttctataggtgactcatctttgtatcctttttataaactaatgaccagctgcattttatatttaagtaaagaaaaatctttaagaattggaaaaagtaatgggttaataagagattgatttaaactaattataattaataggaaaataaaaattttaaacatttaaaagttctattgtatataatagaatactatacagcaaaaaaaaaataacaaatgaaaccttctggtcatgtaagtcagtctgatgaattcaaaaaatgtcattttgaatgagagatgccaggcattaaggtatacatattttaggattccagttatatgaactccaagaatagacatggtaatagaatcagcatagtagttagttcaggaaaagggaatggggtattttttaggaaaagaagacaacataacttcctgggcatatgaaaatgtactactatatcttgatctggaggtggctacatggatgtctacgtatgcaaacagtcaaattgcattcaagattcatgtttgttgctgaatgtaaatcatactttaataaaaagcagaacaaacaacatttgtttatggttgttattggtttacattcattcagtgcccatatacattatttcatttaatccttgcaacaactctatgagaaagacactgttattgggcccatttttagatgaaaactgaggtacaaggaagaaacaaaattttacgaggtcatataggtattacattgcagaatgaagatcagaactcaaagtgtctggttctggagcctacagtcttgaccaccaagcaatactgcttcttcctattaggtctctatatacccggtttttattttgtagagaagcttcatgtaacagtaaacaataggcttctacagagaaaatgagttattagaagcatcaatgcattggaaattgaaagcaaaaactatcaaagtgggtttctgggatttaaataatttccagtttatgaattatgcatatggatgtgtaatgcttttaactgtaaatgtcacattgttccccaaagtgcattcaagataagccatttgcctcttgcagtttttgaaagatcaatggatgttcaaatgtgtcaaacagctgtcgtttcaggacttctctctccactgtaaaaataatctataatacattttcagaaaactgatacatgttttgaaaacaactattatgggtaaaaaaattgaagcataatccactaattctagacttaatatctaagcatgatttgtaaagtagtaaaacatgtcattatatctctaaatagaaataggttttaggctttagagtactaaatttagtaacatttagaagaaacgttttggaataaaaaataatattcataaatgcagctggttaaatcattatgaatatagcacctctacttatctgtatcaatcttaaattttgatcactttgcttagtgcatagctcattttcaatctttcttctctgaagttccagtttttagtgtatgtttatataatattcactgcattttttccaatccttcaacttccttagttgcttagtagataatctagtctcttacttaacaaagaaattacgtgatcaaataagatctgctcaattttatgccataattccacaaaattctctgcatcttcttctattattttcttctttcctcttctaaagtattgcgattctggtacaagacttatttctccaaatttacactgaacctatctgatccctaactgtccctctcattcagtggattattctgttagccattctagggatatcactttctccactagacccttcccatcagtgtctatgtctgcccaaatctctactgccttcccttgggccgggtggggtggctcacgcctgtaatcccagcactttgggaggccaaggcaggtggatcatgaagtcaggagtttgagaccagcctagccaacatagtgaaacctcttttctactaaaaatacaaaaaatagcagggcgtggtggcttacgcctgtagtcccagctacttgggaggctgaggcaggagaatagcttgaatccaggaggtggatgttgtggtgagtcgagatcacgccactgcactccagtctgggcaacagagcaagactctctctcaaaaaaaaaaaaaaaaaaaaaaaaaaaaaaaaaaagccttcccttgaagtcactatgtgagctccctcctatgcatttgttttcctttcacagagaaccttgaataagtagtcaacatcccttacctttgcgtcttcaaacaaggatggattgttaggctgctgtttcagtctcttttccaccccatcacttccctgcaaatactattcccaaggcaacagtattcttattgcttccaatggactttaacaaaaaaacaaaacttcatgtctttcagatttccagcattatttgatgctatggaaaattcccttcttgaaatattttcccttagttttagacacatacactcttatgctttttttttcctccctcatctctatcgctgccttcttagtttttcttttcttttttgttcttgccccttccttctcaaatgttcaattctttattgtttgcatccctctcatagtcttcaaaccatattccgtctacaaacaggctatgttggcactggaatccaccttctcttaaataacgtacaatcttcagatctcagattaaattttgcttcttcccaaagacgttcattgaatctaggatacacaccctccaaaagctctcttgaaatgtagtatttcccctattacaacacttaacatcatacattataattacttgttcttttgtctgtattcaaaattttactctccacctctataaaagtatgggtcatgcctgctttcttttaccagacacttcacccgctcttatcaccgtgccttgcaaatggcaagttctcaaactgtgaagagatatttgtcttttctggtgccagtaccatattattttaaataaattatagttttaataataaaatagagcaaaccagtcattactcattttcttttttattattattatgatactttaagttttagggtacatttgcacaatgtgcaggttggttacatatgtatacatgtgccatgttggtgtgctgcacccattaacttgtcatttagcattaggtatatctcctaatgctatccctcccccttccccccacccaacaacagtccccggtgtgtgatgttccccttcctgtgtccaagtgttctcattgttcaattcccacctatgagtgagaacatgtggtgtttagttttttgtccttgcgatagtttgctgagaatgatggtttccagcttcatccatgtccccacaaaggacacgaactcatccttttttatggctgcatagtattccatggtgtatatgtgccacattttcttaatccagtctatcattgttggatatttgggtcggttccaagtctttgctattgtgaatagtgccgcaataaacatacatgtgcatgtgtctttatagcagcatgattcattttcttaattcaaaaaaatcttagtttttcatttgcactctcagatttgctttaggaaatgacttccaaatcaattaacaagcccattattttcaatcataattatttattgtagaaacatgataattaaaataatattaaaaacaacccatctaagtaagcatatgttcctcaactgctcttgatatagactttgattctttacaatatatacacttagatttccagtgacagaaggactttctgcttcagttttgagggtcaaaactaagtaatatcagaaagtatccctaataattcccagtatttgatacacagaatctgacagaagtgatgtggaaaatgcacatgtacttcatgaattgaaagataatgagttcttgtcaaaataatagcttgaaattaaataaattctgagtatttttcccatgaggtattttatttttatactatttgtgtgccataaacctatgaggtagactttcctggattgttatatatgttgatccactattattgtaacctttattttgcagcagaagaaatggagacagaaagataatgtagtatctgtctgatgtaaataatgcggaatatttttctcccagtgtcaagatgaatatgtatttccttacactattcacctacacattgcttcacaagcatactatgagacaatgttcatcactccatcactctctggaatatagttactgctacagtaattctttggtgtaattccacagtttaatgtattagtggtctacaatttcttttgctgcttttcatcaagaggcctaattagacccttcattttgatgccatactttccagtatacgccaagacctgctgcctctaccttggctctcccactcagttgtacctggaaagcaactggagaatagtgtttctgctctcaggttctttcactcagcttcctgagttcagagggcaatgaagtcctcaaatctggatgaatttccaccgtcccattagatttttaactaaataaaaataaggctattatttttaaagttaaaagtaactggggaagaggattctaggaagtggaaaacacaaggaatttgtctccccacttaggagaatgcacttgcagagtatatctgatgtaaacattttggaactctgctgtctatttaaggcttgcaacttccaggtaaaggctcagactgggaattgcagttaatttctgatgaatttcaatgctcagcacagtagcagacactcattctccacccctagccacactgcaagcagctgtggacatgttcctgaagcagcttgcacccagattgcaagagtcaggatgggcaaaaagaaccccattctccaaatatatgggatctttgcttggattgctgattgctgcttctgaacatagcagtacaaagaggcaggaggccattattgttgcactactcactattgttataaggccctcactcttggcctaagtgatttccaggagacataaagggccagcactctttttactccatttttctcttttaaaagccttatgaaaagattagggcattcataaataattgcatatatgagaaacagtaggaagtaactgtatgcccaggaaatgacataggcgcagaaaaaatctggaaaactttaagcttacacctgcaactgatccttggaactgacacagcctataacaatcaaatgaaataaaacacgaacattccaaaaaatagcagacgctgtggaaaagagaatctgagttccatagttactacattattagattcaattgcaaagctttcaacaaataacccacaagacatacaaagagagaggaacaaagggaccattcaaaagaaaaaaataaactgtccctgacaaagcttgatgacacatctactaaacagactttataacaaagtcttaaacatactcagagaagtaaaagaagatggggagaaagtcaagaaaacaatataggagcaaagtggtgatattgatttagagctagaaaacctaaaacgaaacctaaaagaaattctggagctgaaaactataataatgaaaattttaaaaaaaggatatagagggcttcaagggaagatttgattaggtagaagaatcagcaaacttgaaataggacaaaaaatatcactgagtctttaaattagaaagggaaaagactgaagtgaacagaacctaatgtatctgtggagcaccatgaagtggaccaatatacacactgtagaataaaagaagaaggaagaaaaaagatgaaaaaatatttaatgaaatagagtctaaaatgtttccaaatttggtaaaagacatgaatataaacatcaaataagttcaatgaactttaagtaagttgaacaaagaaactcgcatcaagacaggttgtcaacaaaatttcaaaagccagaaacaaagagaaaatcttaaaaggagcaagagaaaagcaacttgccacatataagagatcctccataagattatgtgcaaatttcttatcaaaaactatagatgccagaagctagtgggttaatatattcagagtgctaaaagaaagcaattgccaaacaagaatgctatagttggcaaaaccatccttcaaaactcaggaagaaattaagacattcacagataaacaaagttgctggagtttgttaccactaaacctaccctgcaaaaaaagctcaagggaatcctggagggtgaaaagaaaagatgcaacacaatagctagaagctatgtgaagaaataaagatctcaatatagataaatatataggcaattataaaagctagtattattgtaatgacagtttttaattgtatttgtcgctttccacacaatttaatgaactaacacattaaaacatatattactctaaaagctagtattgtaactttggtttgtaactccacattttgtttactatataatttaagaggcatttcaaagaattatttgtttatgattttgggtacacaatgtataaaaatgaaattttgttatatcaacaaccaaaaacagtggggacatagcttttaaaggagcagaacttttctatgtcatgaagttaagctggtattaagttaaattagagtgttataaattcaggatataattaccatggtaatcacaaagaaagcagctataaaatataaataaaagtaaatgagaaaagaacttaaacatttcactacaaaaaattaacacaaaggaagacagtgatgcaggaaatgagggacaagaaaaactatgacacttatagaaaaaaatagcaaaaagacagaggtaagttattccttattagtaattaatataaatataaatgaacgaattgtttgttgaactaattaatatgaatataaatgtactgtctaaatgaactataatgaactaatataaatataaatgaacattgtctaaaagttagacaatggcagaatgaataaaaattaatgatctaattatacactgtatataagagactctctttagattcaaagacacaaacaagttgaaagttaaaggatggaaaaaaacatttcatgcaaatagtaagcaaaagagagcagggggtggctgcacaaatataagattttaaaacagattttaaatcaaacatttacaagagtcaaagaaaaatacattgtatattaaaaatttcaatacagcactaatatatagcaatgaaacacttttgcacctaataacagaccatagagacatatgaaacaaaaactgatggaattaaaggaagaaatagttctacgataatagttggggactttaatagtcaactctgaaaaatgggtagaattactagacagaagatgtgtaaggaaataaagaacttaatataatttaccaactagatctaacggaaatgtacagaatactcttcccaaaaacaacagcataaactttcttctcaagagcatatgagacatttttaaggacaagccatatgttaggttgctaattaagtctcaataggttagaaaatagacatcacaccaagtgtatcttcaaaccacaacaggataaatttagaagttaaaaacacaagtaaaactggaaaagccacttatttttggaaaataacacactcttaactaatgggccaaaggagaaatcagagagaaaatttaaaatatttagagatgaataaaataaaaccacaacatatcaaaactcatgtgatgcagaaaaatttatgaacaccttaaaaatgagaaaaaaatcaactcaacaatctatctttacaactaattagaaaaagaagaacaagctacacccaaagctagcagaaggatggaaacagtaaagagcagagatcaatgaaatagataatagaaaaacagtagagtaaatcaatgaaaccaaaaggtgattctttaaaaggattttttaaactgacaaatctttagcctgatagactaagaaaaagagagagtatacataaattactaaaatgagaaatgaaagtgggggcattatcaccaattatacagaaataaaaaggattataagagaatactatgagcaactgtatgccaacaatttggataacctagatgaaatgaacaaattcctataaacacagaacctcccaagactaaatcatgtagaacaggaacatatgaatagacctataactagcaaaaagattgtatcaataataaaaaaaaaacctgacatatatcttctatatataaaaaccctggacctgatggactcactagtgaatttactaaacataaaaaaaaaaaaaaaactaacataaattctccaacttttccctaaaaatgaagaggaaaaaacacttcttaattcattcaatgaagccagcaccaaatccagcagcatgttaacaggattatgtaccacgaccaaaaaccaatgatgtttattcctggaatgccaaaatggtacaacatatgacagctgattaatgtaatataccaccttaacaaaatataaaacaacatgatcaaactaattgatgtagaaaaagcaactgacaaaattcatcatcttttcataataaaaacattcaacaagttagaactagaaggaaagtattccaacataataaaagtcacgtacaggcataccttgttttattatggttcactttattgcacttcacagatttttttttttccagattggaggtttatgacaaccctgagtcaagcaagtctataaatgccatttttccaaaagcacgtgctcactttttgtttctgcatcatatttcggtaatttttgcaataatttaaactttattattatttatatttgttatgttggtccatgtcctgtgattgttgatattactattgtaattgttctggggcaccatgaacccaacccatataagacgacaaacatactagataaatgtatgtggtctgactgctccactaattggccattctcccatcactctccctctcctcaggcttccctagtccctgaaataaaacaatattgaaattaggccaatcaataaccctaaaaggcctctaagtgttcatgtatcagaataattttacatctctcactgtaaataaagagctatagaagccaatttcatttaccattctgaaaatcctaaggcccttaagaataatgcttaaggtactctgcctgtgctctagaaatggaaaaacaaagcctgtatgacaacacatttgttacactgtagtaccaaatttttaaagcccattgtggagaacttctgctcagataaaaagatttctttccaaatattctgttaattcaccaggaacagagtctactaagagctctgatgaagatgtacaaatatatgaatgttgttttcatggctggtaccacaataaccattctgcagctcatggatcaaagagtaactttgactttccagttttattatttaagaaatacattttgtgtccgggtagggtggctcatgcctgtaatcctagcactttgggaggccgaggcaggcagatcacaaggtcaggagatcgagaccattctggctaacacggtgaaaccctgtctctactaaacatacaaaaaattagccgggtgtggtggcggtagcctgtagtcccagctactcaggaggctgaggcaggagaatggcgtgaacccaggaggcagagcttgcagtgagccgagatcatgccactgcactccagcctgggtgacagagcaagactccgtctcaaaaaaaaaaaaaaaaaaaaaaagaaaagaaaagaaaagaaatacattttgtaaggttatatctatcatagatagtaatttctctgattgacctggataaaacctaaactgaaaaccttgcagaaaaaatttagattttattccaaatgctattaagaacatttgtaattcatgagagaaggccaaaatatcaaccgtaacagagtttggaagattattccaatcctcatgaatggctatgaggggatgaagacttcagtggagtaaggaacttccaatgtggtagaaatagcaagagaaatagaactggagctggaagatgtaactgaactgctacaacctcatgataaaacttgaatacatgaggagttgcttcttataagtgagcaaaagaatgtgttttcatgagatgaaatctattcttggaacaagctgtgaatatttttgacatggcaacaaatggtttagaatattacataaacatattgataaagcagtgacatgatttgagaaaactgactccaattttgaaagaagttatactctgggtaaaatgatatcaaacagcattgcatagaacaaaacttttgtgaaaggaagagtcaattaaggaggcaaacattcattgttgttctaaagaaattgccacaaccaccccaacctcgagtaaccaccaagctgatcagtcagcagccatcaagatcaaggcaagagcctccaccggcaaaatgattaagatttgcaaagtcagcacataaaattcagttgtacttttatacactaacaatgagcaatttgaaataaaaaataaaatacttgggaatcaaggaggtggaaaatttgtaaaaagtaaactatgaaatattgttgagagaagttttcagaaagaaatagaaatatgcctcatgttaatggattggaaaacttcatgttaaaatgtcgatatgacccaaagtgatctatagattcaacacaagtttaatcaatatcccaaataagtttctttgcagaaataggaaacccaaccttaaaattcatatgggatttcaagggaccctggattaccaaaacaatcttgaaaagaaagaagaaaactgtaagattcacactgcctgatttaaaaacatactgcaaagctatagtaatcaaaacagtgtggtactagtataaaaacaagatgcttagaccaatggatagaaaagagagctcagaaataaacactcacatatttggtaaaatgatttttgacaagagcaccaagagcattcaatgggggaaactatagtcttttcaataaatggtactgggaagactagatagccacatgcgaaacaatgaacttagaccccacttcattcattatacacataacttacctcaaaatgggtctaaatgtcagacctaaatctatacaactcagagaagaaaactgaaattagtaagtctgatgatgatagaaacaggcagcagagaaattctaggcagacagggatgggtacccagtaaaatcccaccttcaagccaaaaaaaaaaaaaaagcaacaacaacaacaacaacaaaaacccaacagtttgaaacctgcagcccaaagtgagaacttctattcctgttttcccactctctcccaattggttctttctgaataatgcctttttaccaatcaaatgttgccttttccaaaaaccctacagcccgccctgcccctatcctgtgcctataaagaccccagactcagtcggtagagggagagacagctggacctcagggagatggctggaccttgagggagtgactagacctcggggaagagacgacctgacttaggggaagatgatctgcccttcccatccccgccccgactcccctctctgctgagagctgttttcatcactcaataaaattctctgctttcactatccttcaattgtccatgtgacctcattcttcttggatgctggacaagagctcaggacccattgagtgcaggtacccaaaactgttgtcacactgaccctttgccctcactggcagagggcagccaccccacgtgatgaggcaatgggccaactgagctgctaagatgcctccatctgcagacaatgaaaccaacagaacactgtaacaccccttgtggggctttggggtagcaggcaccccaacttgggtgccacctcaggccccgcatgaagcttgctcctgtgtcagctcccgtagcagctggctggatcctacacttgctcactcacatgctccctccttcaaggttgagcacagcaggccaagtaaacagggtgcccttgctgtgagtctggcaaaggggccgagaaaaatcctgtctcaatgtgtcacaacttttgatttgacagtgttttcttggatatgacaccaaaaacttaggcaacaaaattaaaaaaatagacaattttgactttaggagaattctttaaaattgtacagcaaaatagaaaaaaggagtaaaaaggcaacagagtaaaaagacaaaccagataatgagagaaaatatattaaagtcaaatatttgataagagaaaatcagatatccagaatctatagagaactcctaaaactcaacaacaaaacccaagtcaaaaatggccaaagaactgaaatagacatttctccaactaggatacacaaatgtccaataagcacatgcaaagatgtttgacatgactaatcattagaaaaaggcaaacccaaactacaatgagatatggtaacacacccataaggatggctactatttaaaaacaaacaaaaaacaaaaacaaacaaacaaaaaagagaataacaagtgttggtgatgatgtggagaaaccgaaacccttctgcaatgttggtgggaatgtaaaatgatatagctgctgtggacagtgttatggttattcttaaaaaaattaaaaatagaattaccatatgatatagtaattctactgctggaaatatatcaaaaatacattgaaagcagggtcttgaagagacatttatacacccatgtttagtggcattattcacagtagctaaaatgtggcagcaactcaagtgtccattgacgaatgagcaagtaaaacgtggtttatacataaaatagaatatcattcagccttaaaaaggaaggaaattctgacatatgctacaacatggattttgaggacattatcctaaatgaaacaagccagtcataaaaaaagacaaatactatatgattccacttatatgaggtagttaaagagtcaacatcactgagacaaagcatgcttattgttgaggggtgtttggggaggcagagaatggggaatccttgttcaatgtgtatggagttttagttttataagatgagaagcgtcatggaggtggatggtggtgatagctgcacaacaatatgaatatatttagtgccactgagctgtacacttaaaaatggttaggatagtaacttttatgtcacgtgtattttacctcaatttaaaaaataaagtaaatgagatagtagtgggaactgacttaactatctggtcactacagtccaatctatcaaatttcttctctagtctatattttggtgcatagaagagtccattttggaaatagatttggcattcaagagtcttttagttattgctgtttttaaatgactcactttgatagagcagctcattatcatccccctccaacatgcacaatattgacacgcattcactcaaactaagtttataaacaaaattatttcacaattaaaataagggtgtttacgaacaaatatttttatttggactggttttggtaagaacatttgtccatgtcaacgatcaccatctgtagatgactgttagaagttatctcaaaaagaggagaaataggaacattatctcatttatagagatataattaccacctttatgcctccaccactcaaatgtgtagcacagtacaagtcacatagccagctcaatatatttaagatataatatcataatagcagtaaagtttatccaaaagtagcactgttatggaatgaaactctggaatggtcactgtattgactttgtcaaatattgacttcgatcttcagccagaatcttcacatatcagggcctcagttttctcatctataaactgtgcaggtcaatttaaatgattcacagtgcctttcaacattaacattttgaatttctataagatgagtaatgtattttgcttgcctgagataacagttcccagttttgcacattcaaagggatctttaagtgttttaattggaatccatgaaggagccaggaagcagtttacttaccaagagaagtttcctctcctagctcctgctttacagtagtgcctgcctctgttcaacattgttttagcggcacagttgtaggattttgaattaaaaataaaattatgctctttgagtggcattctgcaagagaagtgattttattgcttaagttccctcttgtattacgcagtcttgtaagccaagtatgaatgttgacataaatgatgtattgcacaagtacaggcttcacagatagagctgtaacttctaaagatccggaaagataaaaagtaaatccatgctgtaatttaaatccaggttataaacttggacttcacctggggtttcatttagatttgataaattatcatatctcagctcagggaactttctccagagcctttcattctcacttcattgacatttcagtaaacagtatttaagaagtagatatgaaattctccttgtttggcctttagtggcaggcagatttactggggttgagaaaagaaaaattttatacagtgtaaggagaaatattttgaggtagtagaattccatataaatatttattggggtaaatttaaatacctcattagaatgatcattcaggaatattttgccactgacttgagaaataaaatgctgtacaaatagaacaatgaacataggcacactaaaatctagtgaataattgtaagacaggaaatgatctgtgataaatacacaaaaattacccaattagaacatatctgtgttcttaattcaaaagtgtccttcattaaaaaattcacaatcacaattaaatcagatccataaatacttttctttaaagagtttaggcttattttttctctctctgtctctctctctccctctctcacttgctcttgctgtctcactcttgctctccctctctttatcaattgtttctctgtcagctcaaaagagtagacattgtagccattatttaagaatttggaaaatagcactaaattgtttctcaaggcaacacagtaaatcaacaatgagcatagattggaagaaaaatcctattgtttctcttcaaagataatcacgacattcagatagtagaatatatatttttcatcatgttgataaaaacattgtgatgttatcaagacgtatgatgttatcccctttttaatggatgaagaaacaacttctgaaaaattgaaaagactgctaaaatatatgtgcattcatggcagggaaagatcatgaattctgacttctccttctgtgtgcttttcactgtaccactcaccactctgtattttcttatatttactgtttctagacatttaaaaatatattgccgaactatagttcatcaaatggaaatctattgttattataaactttacttcagctatcatatttgtgagttattttggtatatatacaaaaactcatttatcttcaaacatttaaaattaagacattatttttgctggtaaagttggctaatttgacatagtattcctatcagtattatttatcagtgaatcagactggtatatgggcaaacattctgtacacagcaggaactcagcaaaacagcctgtttcttctcacagttaggacctactttattcaataatgctgaatgaatacttaaaacaaaacacaagcatggatagtgttaatgccctctagtgtacagaactctcccaaccaaaaacagtgcctgatttctttccttcatttgacactgtctcataaataaaagataagagactaatgaattatagtttgtaaacactagagccaaataataactgctgattgccaataaactgcaatgaaaactgatccataccaagcagaagtgatactgcagcaataaacatttggaagagaactgtaaattaataacaattcttgggctgccccttgaatattaattcttatgaacacagcattgtttaggagtaatttgcagaagtattctttgaatgggctgtaaaaaactgccaaaaacttacttttcctccatttctcagttgcttttccattcctagtactttttgaaaagctacttttcattcaggagctattttatgaaaagtaataaaacattaaattcaaccatctaaagttaaagtgtaatctctcctcccagccatgatagagaaagtcacaccaggcttggcctctcgatgtaaacaacaataaagtagcacacaacatatgaagcgagtatttcaggcactggacgatatgcattccagggtaatgatttttgaaggataacaaaatgaattaggttctacatttccttggatttcttcccagcagaattttcctgatagcagtacaggaaggtacagctaaagaacacagcagtgccactgagttgagactatagatattgaggtttggtgctgctaagttgactggatttggttggatagggtatcaggtaggagagagctctgcagatggcaccacggaggcttgagagtgggttccctgtggaacactgggctgtatataaacagacttgtactaaagaaatattaaaggaagttcattaagcagaataaaaagtattacagatgaagatttggatccataagaagaaataaagaagactggagataataaatatgcaggtagatatagaagacttttttttctattctcttagtttcttaaaagacagatgaatgtttaaagcaaaaataataaagttgttttgggagggtgttacaatagatgtagaattgaaacatttgatcaaagcacaacggatgattctaaatggacttattactgtttttatactactctattttatgtgaaattgttcaatattaattgcaagtacacactgataagttaaggataaatattataatccctagagcaaccattaacaaaatacacactgctatggctaaaaagctacttaggaaataaaatgtattactaaaagatattcaattaacaaaacacaattcaggagaggaaaaacaaggcaataaataattaatgggccaaaaaaacaataaaaagcaaggtaaaaacttaaatataataatatgaataattacttgaaatgtgaatggattaaatattcctattaaaagccaaagattgtcaaattggacaaataagagtcactaaaatgaagtgtgccttaacaagttacaccttaaattttaaaacacagattggaagtaaaagaatataaaaatatttgtcatgcaaatagtaagcagagtcagaaaaagtaggcttctaaacaatataaccagaggtaaaagagaaatatttattaattataaacagttcaattcacataaagacataacaatcatatatgtgtatgcacctaataacagagtttaaatatctataaaaatggccagaaaagtgtgaaatagacaactagcccctcaaaaaatcagtaaatatataaatgatcaaaataacacaatcaacaatcttgttctagttaatgtatatcaactatgcccaaagactggagaatagattttctttccaagtgcgtatgaaatatttactaaaatagactacagactgggcaataccataaaactatacaccttacaaaagattgaatttataaggtgtattttctggatacaacatatctaaattataaataactaaaaataagattcagacaggaccaaaatatttagaaatgaaatggcaaaattttagactaccagtgagtcaaagaagatatcacaaagaactttagaaaatatagtaaacggaaaaatattattaaaaataacacaaaaacaacacagagaaaacttggtgggatgcctctgaagcaatactttggagggaactttaggaaatctttttttgtttttaaaccctctttattgaggtatgattgacatacacatagtctacaacttgatgagttggagatacatacacacccatgaaaccactaccacaatcgatgtcataaacatattcatcacctcctaaaggttccgcttgctctcatttatcatcattttttgttatatgaacacttaagagctatccttttagcatatttttatacaatacattattattaactatagacaccatgctgtacgttagatctctaggacttattcatctggcataactgaaactttttaccctttgactaatatctccccctttctccctctgctgagcccttggcaaccaccattatacgctctgctgctgtgatgttgattgttttagattcttcatataagtgggatcttgtagtgattatctttctgtatctggtttattcacttagcatgtcatccaggtttatccatgttgcaagtggcaggatttccttctgttttaaggctgaataacattttaccatacgtatatgtatttctgttttgagtgtaaaatgatataactctttggactaatactttcttatgaccttacacattcactgagtataattcagtgattccaccactaagtctttaaccaagagaaataaaaacatttgtttatgaaaagaatcaagcaagattgtttatagcagctttattcataatagccccaaactgtaaacaacccagattttcaactgcagaatgatgattaaacaatttgtgaaatattcatgtattgtttataaaaaaggagcaaattgatgatatataacaacatgtatacatcctaaaaacattatgttgaagcaaagaagctacatgcaaaagaatatgcaaaatgagattctatttatgtgacattctccaacagacgtaactattctatggtgacagaaattagaacaagcttgccttcacagtgggattagattgactgcaaaggagttaaagtaatctttctcagtgatggaaatatcttgtgtcttgattggtgggcagactacacaggttaatatgtttgttaaaattcatcaaattgtgtcaaggtctgtgtatttcactgaaattttttgccttgattaaaatagacaagcaaataagtaaataaataaggtcaaagaagggacttggttggtagttgttttaaatgtatcttgtcaaaattgtaattttctctcagatactcctttttgagagttattcttattttagttatagctcagtaatgttaccattggatttttaataggctattttcagttctggtacctataccaaaaaaagttttttttttttatttttcttcttgttataggtcttgaatcacagcacatcatttagatgagatgtgtgggttatgctctgataacaaagtgactcacattttttagtgtctttatgaaataagatctgtttctcacactacacatgccacacatgtcaatagggggcttaggttcaaatgggcgctcaagtatctgggctcataactgtaagaccagatgaaaaaatgtagaggaggccatggaatgtttgctgagtactaccatttctgccacaatgatcatatggtttagtcaactacagtaaatattgcataggaatcaatggtggttataacagatcaaacctccgaatcttgtagcaagactatggtagaagtgtgtaagttctcagaatcaaagtagagtcacttgtgtcaaactctaacaaaaagtaaatatataaagccaggaggctgagaagggagggccctcacacacacatgcctatgattttacaaaggctctctgaagcattcttgggcatgtatgcctatcacagaagactgcaaaaaccataactttacataaaggccattgccaccttacataaaaaaaaatacttctgagaggacatctgctcagcaactacatgtccaaccttggaatggtgccacttttgttatccattattttatccaaagacaataatctcaaaacaattatgtaatccttctcattattcctttaaaaatctttgtcttcctttacctccccaaatgcaccacatagttaccatggcaagggtattctcattgcaataccctattccaaagtaaatatcattttcctttacagagtctctctctattatttgggttgacagttgaaaactagagagattgtagtctaaggctttttctaaaatttataaagacattcttaaatggacaagctttggattttgtagtactttctaagtttttgctctatatttctacttatttgacatctgttttatatgtctttacccaatatatattgctcaaatatgaccacaaaatattccagatatagagatttcatagtcccattgttcttagtagataattcttatggcttatgatgacctacaaggccgcaaattatacaacccttgtctccattccaaatgtatcttaagccatatccccaacacacatttactatggtttcaaaaaacaggtgttaaagaaactcacttcagcacaatacctaccatgtgaaaagcctgcagctaacatcaccatcaaaaggaaaaaactgaaagcattccctctaagatgagatacaaggcaaagatgcctacgctcaccatttctttcaacatagtactaaaagtcttagccagagtaattagacaagaaaaagaaataaaacgcatccaagtctgaaagggagaaacaaacctatctctatttgtgagatgacatgataatgtatacagaaaaccctaaaggtgtaacaaaaacctattaaaactaataaatgatttcagtaaaattacaagattgaaaatcaatatgcaaaaatcagttatatttctttacaaactgttcaaaaagtaaattaaaaaacaattctattcacagtagcaacaaaaagaaatagaatacttaataatgattgcagtagagaggctaagaaggcatcattcttgggcaatccagaatgtctttgttgacagactagctcaacaactacttagactagctggaactagtagtcaaggacacttcctcctaactttctaaaccttgctccctcactcagggtcaagcttgcatcacagtttgattgcccttctggacttttctgactttctatttcctttgatataggtatttcccctaataaatcatttgcatgtttaatcctctcttgatctcttcttggaggacttggtctaccacaatggtttcatttaggactagagcagccgactctcttagattaaataattaatcagcagtagatccatttttttaaatccttctcttctttatagatcatttcatatcgtcacgtcatttttcaatcgtgttggtctactttgccatcagaattttactttcctcttgcaaaagtggcccagattcattgctcaatataggatgtaaatatttagaatccacagattagaaagacttttagcctgactgaattctgaaccctggaataaatttgatgccagatttagtatcagagaaacgtgtagctgtcattattatttgaggtactcaaatattttaataaacttctttaaagatatggctcaagaagcaaaggatatattccttgtcaagtcaatggccatactgcattctatgataggtggcaaggtttcatctaggcatgctcacacagggaatcaataaagatgaaataattataccagggaaaataattgggtactttttgttgttgatgttgttctcatctacttaaaaatgtttaatatatttataacagtgataaaccttttaaatttatttatgatcccaaggaacaatcaatttttaggatatgcttaactacttcgtttttctttctaacatgggacattacaacacaacaatggactacagtgacgggacaatcaccaataaacatccaactcttaaatcggaaatactctctcatccctaagtaggcagaaaaaaaataatttgagagtagataatctcataatctaaggacacaggtctgatttttcagattcaagacataggggcttaaatgataaataaaaataaaaataaactcaacattcaaatgtctttaagtgatggaaaaccaggctaaaaatattcttgttaaattttcaaagctggtttgaatacatttcaaatagtctatagtatttcacctataaagatttttaaattcacgcagcaacctatataactgtctccatgtttattatacattgctttatgcaacatgattcgaaatttccccattcatactgaggacaaaaggaaatattgtacttaaaatttgtagaagcagtagaggacctttatcttaaagggagagcttcagggaagaagagctgattatatagctaaaaaaaagactttcctaagaatcacaatatcttacttcttggagattagttccagtgagatgggtccaatcaatctttagaatcctgcctttttgtccttccagatttatgattctaagatcatgcttcttatatgggtttcttgatgtgaaagaaatgggaaagttttgtttaaataatgtctagaagataacagaaatggcctagagatgaatgtatcagattgtctctagatatcatttctcagcatattcctttttttaaaaattacctttggaatactcaatttgagatggcttagactaacctagatagaagttgaggaaatccatatattttagtggaaaagcacattaagaagttatctggagtaatgcaagttacaaggctctgactgagacatcttctaccagtggtgtttaaaggtatttcttagttgagtcctctgaatgaaaaggccagaaaagtcacaggacctaccagtcttgttaacaaggctggttaacaaacagcaaaatttggaaagcaataatgattatgttttaagattatagaaaattaagtaacccagtaattctatttctagaagttaaaggatgtactcaaagattatatacaagtatacttgtcttagttccatatgtcatagtccaaagacattcaaacaatacatatatgaaacaacagtaaatggatgaacaaattatgttcctgccagaagtttgaattctaggaaataataaaagatgaaattttaaaaagaatttgaatggcatcaagagaatgattctaatataaaattaactgattaaaaagcaggatagtaagcattataatgtcaattttgtctgaaaagaagcaaggatatacaatatatattaatttatctatctatattcacaaacacacaaaattgcagaaactgggattaaatttgttatatattaagaatgctacctgggtaataggataaatagtgctttttattggcttctatatactttcttggattgtctgaattgtatacaataaaaatgtaaggctttgtactaagaacaaaatataatggttttcttagagaaaaataaaaatactcagctgaaaataacctggaaaagaagacaagataaaatgaattataaaagaattagattttctacccatggaaagggagaacagaaagtaaagctagtatgatgattaaggaagaaaaattatgaatgttttatattttacaggaatttattgcaatcagtcttgtgattctattgaattgtgaactaaaaataattatcattagtaaagacaattaggtcatttctgctgtaacaatgattgtagtgttgttataatgtaaataactctaatcttagtgtatgtaacacttaatgatccagatgcagataaaaatctgtttataaagatgatttaagatatagactcattgttcaggttgctatggtaattaaaatctcgactgtgccttcataaaccaaagtctatttgatttttgtcattcgtgtcttgggtagctctgtattcagagaaaacttaaaactcatttcagaaggggaaaatgagctcttaaaaatctatattctttattattgtatcaatagcctaatgcttctatactatcacacataaaattctcaatatttaattgattacacataatttatgtgatattttaataatttataagaaatgtcagcaagttcatacttcagtattttactgttatgttttgttggtctcttgctcttcttcagacacacaagtaaagtacacatacaatcatatttccaaacttataaatgggatgtttttgtaaagataatttttaaatttgtggtttggaacactgtatctattttccttatacaagaagcgctccagtggcccctaccactaatgagcaatacacaggcacaaaagggaaagccaggaggtaacacaattctttcaacgcgttgtttcttctactttccattccccaaaaatgacctttcgtgagtagaaattacatggctattttttccataatgaaagtaaagacaattagatttatgtatattttacagaaaaacaatacaacccaacaacttagaatagctttttctccatatatttctccccataatctactttccgagcttgctaatgtttaaacttaataatgacatttctcctcttacatttttgatgagtttcccttgctttccaactaaagcccacattttataaactatcacttaagtttgcttctttctccactacattttcagtcttctttgagcctcaaaaggtattatatgttctcattttcaattcattgtacttatggatcaatctacctggaagaacattcatccttcagcaactttccctgctcttatctccttccttttccctggctgtctcctattcttcaggacgcagcaggatttaaccacttttgtgaaatcttccttgaatgatccattattaacaaggcattatgtggtggccctcttatgtatgctcaaagagtctgtatatcacccttgcatttaccatatatatattaattacatgttactgcgttcgctaaatatggttgtgaaaccgttccaattgtccaactgttattgcatttactaaatatggttgtaaaacctttccaagaaaaaaaaatcttataaattattaaaatactacataaatgaaatgtaagaggaatgccatgattaagtttaaacattagcaagctcagaaagtagattatggggagcaatacatggaggaaaagccattctaagttgctgggttgtatttttttcctgtaaaatacacatatatctaatttaatttaattatgggaaaaaaacccatgtaatttctgcacactaaaggtcatttttggtaacggaaactgatgtttatggtttcttttgaataaatataaatatagaaattgaccctcctactattaaaacttgagaaagttaaaattgtctaatctgaattcctttctcaggaaaccagccagcaagcctcctagatagtgtcaaggaactgaaacttactagatcatcacaactggacaatgacacaccagacccctcacttgtggtgactgcctaattgatcacctgctttctgttgaccaactcttcttccttagccctccctaattcctgttttcccacatatgattccatttctttcttgctatataacaaaccctaaattttagaccatcaaggagatagatttgagactgatctcccttcttctcagatacagcatgagaataaagccgtattccttggctatcttcattgtggcagtgattggctttctgtgcagtgagtagcaggggttacaccaaactcctggctttcagtaacagttgcatttaccacagtttattgaaactacctttttatttaaaaaaaaaacattaaaaaatattttgctgtcctatacaattactttccagatcatttgcctatttggccttagctctattctctgtccttactgtgtgccttgtatctaatgtaactgcattccccagtttccatttccaactggctgcctgatagtccctaacaagaggccacaaagcaagaagagtgagaaatcagaacacttctccttgtctttcctgctcagtgacaaggagcctcaaaattgctacatctcatccatgtctgtttcccacaggatcacctttacctgtgtatggccctacttcctactgggaacttcttcacattggttccatatgggtggagtagctttctgtttttcacaaatcaaggtggcctcatcaacacttatttggcttcccagcttttgtattttaaacatgatcctacattaaagtcatttttttttcttttttggaactacttagaatagtatctcttttttttaactgcattctgtaagacacactataaacttttaaaaacaggatgtcttattcttttagtttttatcagcaatgagcaaacttcccagcatatattaggcaatcattaaatgcatgttgaattaaattgtgatttacgaaacatagatttcttaataaggaaatatttaaattaagagggatagttagttgctttaatacttgaaactatactggtaatatctgtcacttaaggtacttcattttcatttcaaaatattcagtctcaaaaagaatgcttctgctttaaaaaaagtttggtcctttacttttaaatatcttactaccagccattaagaaaaggcaaaattacttttttttttttctagaaaaaaacatttgccattcctttctttccattggctctgcccacctatttgggcggcctcaccatgatctcttcaggcataatcatgcatccttgatttaccacctcattatataataaaataaaatagtggcaaaacatattttttcaatttggaaaacaaccttaaatgccttaaaatttttactcattttacataattgacaaaaatatcccagagcaagaaaggaaagtttaatcactacttggttttaattttctccatttaatttttctaattaaagatggaggctgaaagtagtgggacctctgggagacactacagatagcaacatttctgccaaaattaatgaagtcgagcaaaatatccactccaaacaaagctcttgtacaatagaatctatgaacaaaggccatggcaaatgcttttcaaaagaaatgtgtgtgatttgcagatagctttttgtttatttttttcctaaggttggactttgttgtattcaattaaaaatatcacactgtatattctgaaaaatatttatgactatgtagtaaatggagacattttataaataccctcatcctctatggtaaagagtacacgtactgatcactaaacaggtattgacaaattggtaacatgcaatgcaaagcttttggtatgaaagaagaatctggtagctgagattcaatacagctgttgtctttaagcacatagctgatgctaggtgaatatctgtaggccatattttcagctgtcaaatggcaaaatcatttgttatccatgtaataaatatctaggctgatagaaatttataatacatattgtttgcctaactgaaaaaacaaaaatcttggtatcattctttgaagatcaagcaaaaggaaggatttttatgaaaatttacaagtgtcaaacgttaaattaaaataaatacagcaacatcaacatcatatctcttgcattgctttaattcagtatgacttgagttctcataaaaatatggaattatatttttattctttctcaaatgtttattaattctttaaacatatattaatactttcaaaattgccatagtttatactttagataattgtattcaataccaaagatctcttttattatttgagacatttctgtaatgtaggtcaaatgctcagagacattttgcaaaaagccaaagttaaactatttccaaacaactttaggttttcccctaaggatgagcaaatttttcatagaagacctaaaactgctatttgcattcttcctatttatccttctctactagacacatggtacataatctaggaaataggtcataaatgcgacttacagaaaaaaatcccatctagaagaacagattatgacatattttggaagtaacttcaatccagtttctatggagccagagatatgtttttcctctcattgcatctcactataagtttaataagagaaacagctaaggacttgttgaactcatgatctctcttattcaaagagacccaacagtgtctagcaaagacgtaattacatgattagcgattgaaaacacaaaagccattgcttcaattagtatgcaagctttcttctgacagaataaatgcagaaatcaaagatgattgagcaggtgattatttctatttttctgggtatatgagtaagggggtaaaaggttatttttaaaaggcttctaagcaagaaaaatataatctttttaaagagataaagtatgcccttgaaaaggtagaagggttatcttcacataaagtaacagtcttttactcaagacagttactttttaataagctgacactatttgttttagcttacagagaatatgtaaggcatttcagtgataaaaatgcaatttcgctttccaatcaaaaacgttaataactatcttttctcatttcgtgagcctctttttggaaaatgtatacaatgacaataaaaatcatggcatcttgtattcacaggagattctttcttaaaattttaaatattaggagatacatgagtttcttttgttcctctaaccctggggactatacacaactatcaacatatctgtggccacagggataatttgactggctccatagtacccatatgtctatggcaaatcttaaacttgggtttctgggctgctatgctgttctctttagagtgcaagaccagatcttttgccttctatggtgatgaaaaaaaaaaacacaataataatcacgagtaatcattactaatgagaaatataacagattttcatgcattctttcaatgataataacaatttaggaaataaattcatttcttccttttagcaaataaaaatctttcttttgggatctagatgtgttactggttaacacatctactactggcctgtaattagtgatctcataaattctggcagagggactcatcttctaacccactaaaataacaagatagtatatgtctgatttatttcctattaaacagtatcagtaaatggccacagtcttttcaagggatataactctacataaaacccaactaggatttcaaacaactataaaacaaagtgatgacttttacagataaaactatgtaagtgctaaaatgtctcacacagtgtgataaaaatgttcacagttcatgctaatatctttgcccttctttttattccatgtgttgctaaattgattactttcctatgtgttatgacttgactatactcaaactatttcaaagagaaaggggatgtttttactcatgtgtatttaacaatagacaatttcattttttaaaatgcttactatatataatgtagtttttatatattaacattttgctttttcttaaagatccaaaaattatttatatacattttatttcatctccatgtactcagtaataacctgataaagatatataacaaaaaaaaaacaaataaaaaatctcagtctcatttgtgcaatattcacactttcctgaatattcttctccttccccaaacctttcatgaaacacagacatgaagaactgaagtaaacaaacaggtttagccaatagatagcaccaaaattccataaaagaatattatctacaatgaagttaaagaataatgggacctcaatgatagtcattgaaagggcaaaactcttgtttattaggaatcaaatatcacctgctggtttttattagcattttcttcctcaaataaaaagggagcgtggataaatgttgatggcagaagagagtaaaaatgtcttgtgaataaggctgttaagatgggagccaagctggtaccagtttcaggccagaaaggctgtggccatctacgttgcctaaacaaattgctttcctggagagccttaattctatcaagtccgaatctgtgctaagtaccccaaagcaaaaagtcccttgtttttgtgctttgaacattgtgaaaatgttgttgcccccaaatttattttggccttttggtggatgacagaaacagacatgcaatttttaaattaggaaggaattttttctcccctggaataaaatttccctcctggttagggctctgcatcagcttcatgaatcctccagcatgagtggctttaacaggatctatcaggttgaagaataatgagaatcataactgagtttttttgatggcatacaggaatacctgaatacacagggatctggatagttatagtggtcctggcaactgtcagtttggagctgtgtgtgtaaaacactaaacagaaagatgaagctagagcaaaagacaagtacttggaattccacacactgtaattacattgttccttaggaagtagacagagaggactaaattttatcacaggagagaaattcctgccttccgaggagttcttgggtgattaatgtccaagttaaaattgctaagtcccattaacttccttatactccatttttagaagaaattgtcacatcatattcttaaggagaattgagatataaacagttacttcgatttccatttttcaactgacatcctaagtttaaaaatgaaggtcctcctcagtgccttactggtaagtttccttgaggacttccttttctgaggactgttcctcctgaccgatggaagctgtacactctgaggcttcaactgcctttgcagcaccgtaaaaaataagcctactctggaaatagctccaaagtgcctagttctctccctttggtggtctctcattaaattgctctgtgtcatacctaaacaaatacttatttgtaaagtgtctaatcaggggctgatttgaggactttttttaaaaatgccaaaccttcatcaatgcaagaggtcatgaaccattttatcatttcttgacttctgctttaatactacatttatatgttgggtagcaaaagtccaacctggtttctctcaatcattcagggagctaaaatccttgattttccagtaagtctcaattaataagcttggtgggttattgttattgaccgtggtggaggtgctggtatagaagtcttttgtaaacacttcaatctatgcctgtagcttgtatgagtgtctgcctccgcacataccatataatcattgcttgcctactctgtttttgtataatatcatgtttttttatttgtttggagtctccaagtttgaatatctatgagattttaaaaacacctggctatatatctaaacctcaatttgattttaatcttaagggggcactattcccaatgcagagaatgaggataactaatttacatttccagattcatttctatccatcaactactttaaaatgaattatgaggaagaaaagataatctgtatacagaaagtttttctatgtatcactacatataagagagaatggtggagatggaaaaattgttcttttctcgaggtggttgcaaaatgaattaaattatgtattctcaacaattatgattacaagatatggaaaaacatgaagaaatatgtaaggtaattataaattttgaaaaccatatattaaataaaattatatctatatgttaataattattacacagatttgcaaatatttaataaagactgctagaaaacatgaaaaaaagtttgatgttcttaagtatggtgagataaaggtgacttttttcctttctgtagattctttatttttgttataatgttctttgtatggtaattaagcaataaaaaagaattactttaaagagaattgtattataaggaaattgaatattgcccccagctaactgacatgagaatatttatgagattagatttcacatttggaagaccaaatttcagattattatgtgaatgctgcaattggaactaatttatttgtacccatatgcaagcattcaactgttgctcaacattcaagctttttgcttaaccttcaagttcttgggataattttgagtatactctaactctaatctttgaaaattaaaattgatttttcctctctgtcttcttgtaccactggatcttattttgtttataccaaaggaaaaaagagtaccaaaatataaacaaaaggaaagttaattctacagtccatctaaatctattttaactcccatccatatttacttaagctaaaagaacatattgtaatgggagcagtgacaccattcagcttttgttgtcttgtgagaaaattatccataactctaaaaagacagacagttatgacagcctctacgttgtgtgaacttgatcgagaaaagatgaacaccttacataaaagattcttaaattctctaatggaagccaacttcatgaggaatatcatttataaaaccataaacttgtttcaaaaaataaaatatatatacatatatatttattttattttattttattttatttatttatttatttgagatggattcttgctctgttgccaggctggagtgcaatggcactaactaagctaactgcaacctccacctccagggtgcaagcgattttcctgcctcagactcctcagtagctgggactacaggcgtgggccaccacacccagttaatttttgtatttttagtaaagacggggcttcgctatgttggccaaggtggtctcaatctcttgacctcatgatctgccctcctcagcctcccaaagtgctgggattacaggtgtgagccaccacaatatcttattttaggcttctggaagttaaattacttcagtccattttatctacactaaaaattaaacatatttatggactcaaacaaaatcaagaagcaacaagctacccaatcactataaatttaggtgatggcccaaaaatgaataagaaaacaaatgatataaacataataaatgctgtaacttgaaattagttgcagtgaaatgaaaccatatcaaatgaggagacagaaactaaatgttagttcaataattagagatattaacactaattttaaaaacattaatttatgctaaattatgcaacatttaaacattcatttatttattctcataacttgtgaggcactgtgccaggtgaagggaaaatgttcctaaggagactctctgtgtatccactacccaactcactgcatagttagaaacaagagacaataaaatatgattagcatataattcagtttgtatggggtagggagacgccctggaaatagtgatgactaatttgaaattttagtaaggggatagactttgtttctgtaaagatgaggtaatgtgacatagatatactaagcagaacaaagagcctaggcaaaaacactgagacgaggaaaagctagagttaattaaagatggcccctataacacaactgttcactttcacacctccagctttcttatcctctgcactaataaataaacagttaatgtttcttcctacaccaacagcagtgaaaaaaaccacttagagtattagaaacactggcatgtggcttgagattcccagtgaaacattagaatccaatttacaaagtataacaaatgaggtcatattgaaattaaaaagcaaggggtcattgaaaaacatcattatttctttttctcttggaatttattatgtaaaaatttccagaaaaaaatggtgcatattaattggtaattacaaattttaacacatatgaccctaattttgaaaataattcaaaccacctggggtgaatagacaatgcttacacaagttatagaaagatttacttagaaaagaaacttctaattcaaattccttgaaacaattgtaataatcttaacctgtgttgtatatgcagaaatatactttaaaagttaaaattattaatttttgggtttctgtaaagtattacttttatactcaatgcattaataactatatttctctatatttactttctaatttttgataaacattgatacttttatagttgtgaagtaggaaggaaacttcaagtaatgactctgctcataaaatgttaaagttctccctaaaacacttaatttgggatttttaacttttagaagcaaattaggtggtaaattcaggatcaactttctgtgatgttgaatcataaagtataagttagagacaaagcagaccatgagtcttcttatgtaatgttaacaagcataaactttatccttaacatgatgagtgaagtgtttcttcctaatatagaaaattcttttttaggctacgggaagattctactcacactagtgaaaatatagtagcattgtcaaaatttgttaggtggatataatgtatagatgtagatgtgtaggagataggtgctttaaaatttcagtcatataacaaaatgcataatgaaatcacaaagcaactttaatacaaatctaagaaggaaggcataatagggtaggtcaatgcagaaattgatattctggcaatgtagttaaatgtagaaaatattgcagcactgattctcctgcctctaacatggaggaatagcaaaaacctgggacccgaaagggcattaaatattttcctcaggaaagacatagttctccactttaaattaaatatgacagaattgtgtgaaagagttttaatgtaatgcatgccagtttaacagaatggacaaggcagcacagtagaattctaagacagaagaaaagcataagaaaaacaagtaagaaagattcacctaggaggcaggtagcttcctatcacatctctctgcttttatatgacggctaaaagatttttataatatatgtccctcccttgattaatttgctctctcttctccatacttaatatgaatatgtattcttctataatgagggcattgttctttctgtatgtggaccattagttatttctcaaaaaattttaaagaattgaaataaaatataattacagtatgttaatctagatataaatagaccaaaaacaattaatctccatgtgtttgcaaattaaaatacttctatataacccataacttaaagaataaatcacaatgaaaatgtataaatattttgaaatatatgatactgaaacattacccatctaaatagtgaaatacagttaaattatgttcattggctattttgagactttaatgcatacctaggaaaaaacaaaggctgaaaatcaatggcctcagtggccatataaaaacaggaaaaaaaaatcagtgtaataaactatacaaagtagaagaaagacaatgaaaataagaacagaaataaatgaaacaaaaaaaaccagagagagaaagaatcaacagttacaggttgattcttagaaatgactaatacaactaagaaaatcctgaaagcctaatcaaagaaaaggaaaagaataaaggcatatataattgataccaggaataaaagaagaacatagcttttgagactacagacattaaaaagaatacaaaaggatcgtatgaacaactgtattcaaaaagttggatgaaataaatcaactcctagaacacaaaccaaaataccaaactaaagaataagcataacaaaaggtatgcaaaataactacaaatataactataaaacacatattgacaggaatgaaagaacatataataaatggagatatacaagatggttcatcaattgaaagactcaatattatcaaaatgttgattcatctcaaattgttctatacattcaacaaaatccataaaaatcctgaaaagttatcatataaaaccgaacaagttgatcccataatttatgaggaaacagaaagggctggaaaagccttgctccactgatgatcacatcttataaagttactgtcatgaagacagtgtggtattggtgcaatgatagacaaataaaataatggaaaagtacagagcctgaaaataggcctatgtatgtagactttctttagaataaagttggtacttcaaaacattggtagttcaaatattggaacttttttcaagtgtttagtttttgtacctactcgtacaagagatgacaatgaagtaaaagtgttctcacctcaatctattttatgacagggtttctgttgaaatgtaatgctttacatttatttttaatataatgttctctgccccagagcacataatttttttgtatttaaatgtaaaaatagactcctaaaagttatatatatatatatattaagttatatatatatattaagttatatatatataagaaaattaataatatctgggaatgaattttagaacatgcatgaatactatgacagaattatctttgtattcaaacctgctcaagtatagtacatgaacagttaataacatatggaaaatacatctccattaaactgagggagacggagcatttaatttacacattcccatgcatttgtgtgttctcataactggaagaaatacagtgtcttttttctactcagctgtttaacattttatgctcgtttgcttgcttcacaataactttcaaaggcgcagactaattttgaaggaatatggtcaacaaacagttatcgagatataaattattttccatttttggcatggtctatcttgaaagtaattggcagctggagaaaccttttataagcaaacaacttctcaacttctctcattttaattgaatgccaataaaattttcaatgtcagcatgggttacagaactgtgggatttcattaaagcagtctacgagtcgtagaatcaagggtttagcactatttaaacaaatctcagcaggcagcaagcagtctatgacctgaagaagcaaatctttaaatccttcagccagtttttcttagttccagaccaactgcaccagaatcatctgggaggcttgtaaaaattgtagatttgtagctcacacctgcatcagatggggtactgaaatcacagatgatttttatgcacactaaatttaaagaatctttaattaaaatgtaatcaaagcccctaatcttttgtttgggagatttagaacctctccataactatttaagaactaaagagcccaaacctgttctctggctgcttgagaggtgttactgattcaggtggtgtttgatccctcacccctgaccccatgtgtgtactgaacaaagtcgctacagcagaaatggatgactaggtctgcgtgatactttttcctcttagctctcaatttcgtggtctgcattccaggatgtttcagtccctacttcttacttgacattccacctctgctacttagtaaacacttacaatccatttgtcacccacattcagctacttgctagtcaactcccaatcataaggactctaaaaagacaaagggaaaaaaacctggcagattattacttcagcatttcccaggtatatcatctgcatcttgaaactggaagaaaccttactgttctttccaagaatgcattgggaagtagtgcttcctaggaatgcactttctctaaaagcaagtaactctgcatacatgaaatcactgttttcctgaacaggggaggcgctctaagtggcaaatgaaaaagagatttcctttaggaaattaaagccctatgcctcgtaaatgacatacacatgtatggtcagaaaaatgaagttctactaaaaaaggaaaaggttaacaaagtaaatatatattatgatcatttctaaggatgctgagacattgctattctgtggtactaattgcactgcaactataatggacctgtttagtgttctttgggggcttataaatactacagaaaaaaaatggtctgttctggccaggtgcagtggctcacgcctgtaatcctggcactttgggaggcagaggcaggtggatcacctgaagtcaggagtttgagacgagcctgaccaacgtggagaaaccctgtgtttactaaaaatacaaaattagcctggtgtggtggcatacgcctgtaatgccagctactcgggaggctgaggcaggagaatcgcttgaaactgggaggcggaggttgtggtgagctgagattgtgccattgcactccagcctgagcaacaagagcaaatctccatctcaaaaaaaaaaaaaaaaaaaaaagcttaaatcagtctataattttgcatattcagaataaagttgacaacctttaatttagatccttgttatttcatttcatgtatttattagtttgctgtttgactagtatacaaattacctaaaggtaaagtttcatttctagctaaagcccatagtagatggaagggcacatatgttgtagagggaactctgaaagatttctaaagggaactatctggacataatgaaaacataacccatttaaccagatagaacgaaaacaagtaagttcagctatagtaaaaacttgaaaggacactactgatgtgttgacagacaacccccaaaaagctttaaattacctttcaataataatagattctgcagagtaggtcttagaaaaacaaaagaatctggattctatcccagtacctgagaaacaagaaagaaaaaagccaagggaaaaaccatgctctctgttggtgtaatttcctgcactcttttctctaatcataataaaaaagaaaaaataaatttttaaaaaggcttttactggagagtaaattacttaaaatcaaaataaagaggtaatcagttgagagttttgaattctgaaacttaaggctctttagattttggaaacaactagagtgagcagcataaaaggaattatgaattgagggatttctccagctgtgccacctccctctggctaagtagcaagttgcctgacatttacaacctgaaaacacagctgctttgcacagaagatttgacagggaaggtggaaaagcctaagggtccgaccatctatctatggaggaggccatgtatatagcagaaaacaacactaatattcactatttttaaaaagtgacctaacttaatcataatttatttatgttgttaaaaacatacaaatgctttcctacaactgaaaaaataaaataggcaaagtccagaaacataatgaattttaagttttataatttttaaaaaaatgcttttttatttcttggagaacaatatattgtcatagaacaataaatttgtggataattggtactttaggcaaagattatatttaattactggtaaattttctttactatcccttgactgatatcttcctgtacactattggaaaaagcagttaccactacatatgaaaaatcacatttgctaaatatgtaggtctcctgtatattggaggggagatattgggtttaatttattcaaaaagattcatttcataaactgaatgaaatttgctgagggcattttagtaataaataaataaataaatattggattatagtgtgtttaatcttcccttgacacaacatatttatctaactcctgttctatctatctctttgcttatctataattcctaagatgtcttcccttcctcacagaagtctggcttctgctttcactgaaactgcccttgttaaagtccttgactttccaaagcaaactatgaagggctgttttcagttcgactcatttacttgaggcacttgacactcttgaccgctccttccttaaaactatcttcaacctctgagacagcatgtggtcctggtttacatctctctgactcctactctgcttttctctctattttacttctcagcttattcctcaaatcttcatatttctcagaaggaattggcattagctacttttgccggcccattaccccgtgtcctttcttttgtaatactcctccccaaccctcagtccatgtgcttccgacgggctgacttcaggagcgagcaggtgacctaagatgggcccaccacagcattgaattccctcagccacagccatcaatcattcatggatggacaaattcgcccagggcagtgaatgcaaaacagaatcaagttatattttgaactgtgggtttctaggctggggaaggtgtactgtatgttaccaagaggaaagacccagcttgaaaacagagccagcaaagggaaagtacccctgagagacagagagagacaatttctggaggtgagtatgggagcccttgggtacagctgtgtctgaaagctgtattagggcttctgcttaccaacagtttgtttctttcctcctttcctctttcccttccttcctccctctccagtctctctctttcttttgcttcagtctcaaaaatcacaacactctaacaaatatgtctaggttctacctttcaccatttagttctcaaattctattttgcttatttaaatattctccttaattcctaaagatttattgcttaatactaataatgcaaattttctaatccgtacgttcgtgtactctatcatttaaactgtagaaaagtcccatagggtactcaacatttgttagaaatgatctgagctcaacaagaaagcttactttccttttgccagattttctttattatttcatattgttcctcaagattcctagaaaccaaacaccatattggtctcagatctatgagaacaattattctatccttaacgtatagtcattttgtctttattgatcctgactgtattatctttgatattttccagagattttaatgcttttcgattttacattgactaaattttatgcaggctgtgcatagaacttgaaatctccgaataatttactaattttggattgattttgggtgataggagttttgtttgcttgcttgtttgtttgtttgtttgtttgttgagacggagtctcgctctgttgcccaggctggagtacagtggcgcaatctcggctcactgcaagctccgccttccaggttcacgccattctcctgcctcagcctcccgagtagcggggactacaggcgcccgccaccacgcccggctaattttttgtatttttagtagagacaccgtttcaccatgttagccaggatggtctcgatctcttgacctcatgatccacccgcctcagcatcccaaagtgctgggattacaggcgtgagccaccgcccggtcgggtaacaggagtttttatagaaactgaatatcatgcacaaacatcatgttgtcttttggaagatctgggtatctggtcctctttgacatttcatagtcctggatttctgccctttttctctctgtagactatattcttgccactaatcacaaaacatacaagaatcccatcccagaccattatatttcaaccaaggatgattaacgcttattgtatattgctaatcttcagtatactgcaatcgatgttccttttacataaagtaaaacttttaaaaaaagtaaattaaaaaaatacagcttccatgagttagagggatgtttcacaaattaaatggaatgccccataaagaaaaatttgtgtttttctctattgagaggaataaattattaataatactaagagatgaaagcaacttatggggaagttaatggagctgtgtttgttaaataattttttttttcaaatacaagtgattaaatcataggttaatctgttcaggaatctaaaaagaaatactttatatttctatagtaaataataaaaataaggcagagaaagtcaaatatctagaaatatgtataaaagagtttgaaaaccttttatatacctaatattagtaggtattcatatttcttaaattttatacctttgtaaacttttttttttttgtacaaacagggacacatgtgtcaaacacaacttgactgctttacaaataggtattcatccatgtaagcatcacctaagtcaacataaaaaacattgcctcactctagaaatcctcatatgttcctttcaaaccatcattgtttctcttcaccctgtgagaatagcatcttaagtagtatagtaataattcacttttcctcttcaggtagatacgcataccaaaggatgaagtttagatttgcctggttttgaaccttaaaaaaaaatacattatacatatttttaagccttgcttctttagcccaacttacatttgtaaactacagttatgttgagtgtgtcataaactatttttattgttctatactctgatattgtaatggcaaaaaccacaattaatgtatgcagcctactgatgatgagcatttgagcttttcaaactattaatggtgcttttatgactatttacatacacgtacttgggtgggcatggacatgattttctctagggcacttatctaggctaggtcatagggtatgcctacccacatgttacgtatattaaggccaaagtgctttccaaaggggttgcaccatggcattatgtaattttaaaaataaatattttatattcgcttcataaataaaattactacgagtctatgtaagatatttaaaaatacagactagagtttttatgcagatgctttactatagtccatctaatcttgaggaatgatagaaagttatcagaaatgtgtaagcaaatttgtcctgtaattggacataactttaatgccacattaaattagtaaagatctgatgatgggatccttatatctttggaatgtacttttatctgaaatatgcttctaagaaagatataattaattatttagagcatttcacaatctttgtggaatttccaaatgagtttaaatagtcaatattatcagaataattaacatgatgagttctgatttctggtcacctaaagcttggcagtttaacttataatgctttatatacctgtagttttcactataattcagatgttcattttatttttattataaaattgcttattttaacccagtgaactgtcaataaaagttggagtcaaggaggtatttcaagatgtataaggtcaaaggtcttcagtttaacatctccttattatttttaccttgccaagtaaaatataatatttaatgagtctgttaaaactctttatggcttgagagctgatttaatttgtatcaaattcaatcattttatatatggatgtgagtgtctgtattgaacaaatgaaattactattcaaagttttgagtttacttttatgaaaggaatatagattactatcttgaatgttttctaatcttaaatcaattgactcttacactacactatggtagtatcacctataagtgtctgttgtgaaacctatgtcaaattactgtgcctaaagcaaggtgtattttgttattcagaacttaatgacagtcagaaataagaagtttaaaatgctccctcctgcctagacaccatgtgaagcgtgggcacttgttgtggcaccatgtcactatcttgtcagtaagaacaaatgtttggtactaactgtctcttcatcagaaaataatatatgttttaaaaaattgtaatcaaaaatttgctagattttttaggggaaaatcaggacaaacttcttgcattattttctaatcaattatcaggatgactccaaatttcttagaattgtttcagtttttgtccagcatgattctctactatttaaaatcttgcttctcttatgtataataactcttcaagcatctatccttagtcatttttatttcttttttatatgttctctttcccaataaggagtttatttatctaccttcaattactatagttacagaagtaattgggaaattttatataaaatatgtctctctttgagtactgtgtttgtccttttagacttgttgctagatattctaccaactccgtaaactcagcatgttagatcagaaaacttctggctagaatgtaataacaaagactcttctgccttaagcaacatagtccagatatgaaataacgcttttcaggcattggataacaagtagtgtaggactatgatcccaaaaagaattaaaacaaaagagccattcaattataccaaataattgcctatagggcatttctaggcaagcaaagggagacaatccagccatcttgtgaaattgaggaaacagaaatcaaactgtggagagtgaaggaaactagattttacagggcagagtaagagagaggagtaagctgcagagagagataattctgtagatcttcaagggactctaccaagcctttcactgagcaattgtctgtgtattcatgagagaaaactaccagagatcagggaaacaaccaaaagaaagaagcaagtaaaaatattcctggaactgtcagagggctgggaataattcatgtttctacctgtgacagtagaaaggccccataatacataggaccgacatcatctagcaccttcagaagaatatttctttagtttggaagctaaattagcttggtctaaaggattgtcaggaactgagaaagctttaaaaaaaaagattgataacaatgtaaataacatcaatttatgtcattgagttcccaggaaagggatggcaaaagtagagaacaaaatacttgaagacatattgcgagaattttcccaagttgctgaaaactataaacctacagaacaaaggataaaaagaaccacgagaaaataaaaataaagaaatcactccaagaagtattgtaatggaactactgaaggtcagtgacaaagagaaaatattgaggtagatgaagaaaaaggaaatattgcatgcagataaaaagaaagaaaggaggcttctcaccagaaactattcaaaccagaagacaatggaaagacatctttatagtactgtgggaaaaaaaaaatccatcattcaagaattttttcccattgaaaatataaaatttatacaataaaatataggagaaaaatatgtgtccttgaatttaccagtttctttctttgtttgtttcttttttttttttttttttgaggcagagtctcaccctgttgcccaggctggagtgcaatggtgtgatcttggttcactgcaacctctgcctcctgggttcaagctcagcctcagcctccagagtatctgggattacaggtgcatgccaccacgcctagctaattttttgtatctttgatagagatggggtttcaccatgttagccagactggtctcgaactcctgacctcgtgatccgcccgccttggcctcccaaagtgctggaattacaggcgtgagccaccacgcccaccgaatttaccagtttcttagattgaaatctaaaaactccaaacaaaaaaaaaaaataataaatggattcattaaaaaaaaaaagtcagtctttgaaagactagtaacaaaataaaaggcaagccaaactaaggctgggtgaaatatttgtaatacatgtatgtaataaaggacatagcactagtatacaggatcttataactcaatgtaaacccaagaaacttaactaaacatgtttttaaagtcattaatttcactaatgaagttatatgaatggaaaataaacacatgaaaagatgatcaacatcattagtcattggagaaatgcaaaacaaaaccacagaaaatcacagtaagataggactacatactcattaaaacagctaaaattaacttctgttatagtaccagattttactgaagataaacagcaactctcactcattgctggtggaaaggaaaaaaaatgccagtcactttgaaaaccaattagattattttaaagttaaacatgcactgtcatataatccaacaattcctctctaggtatttacccaatgaatatatatataaatatatttacatgcaaacaatacataaatatatttacacacactatatatatatatttaaatatatttacactctatataaatacatttacacaaaatatttgagtatttatgcagctgtataaataatagcaacatctggacataaagtttgacaaatgaaaattaaaacacaacataccaagacctatgggaaatagcaaaagcagtgctaagaggagagtttatagcagtaagtacctacatcaaacaaatatacagatttcaaataatctaatgatgcatttcaagaaactagaaatgcaagaacaaaccaaactcaaaattggcagaaggaaagaaatgataaagatcatagcagagctaaatgaaatagtgactaaaaaataatacaaaggatcaatgaaacacaaagttggtctctgaaaacaataaaatcaatgaaacactttccagacagaagagtgaagacccaaataaacaaaatcagaaatgaaaaaggagacattacaatgatattgcagaaatacaaaagaatatcaaagacttttatgagcaactatacactaagaaattggaacacatagaggaaatggataaattcctggacacatacaacctaccaagattgaatcaggaagaaatagaaaaccagaacagaccaataacaagtaatgacattgaatcagtaataagaagtctccaaacaaagaaaagcccaggaccacattgcttcactgctgaattgacttaactttcagagactctgcatcccatgtttattgcagcactattcacaatagcaaagatacagaattgactaaatgtccatcaatggatgaatggataaagaaaatgttgtgtgtcacacacaatgacacacaatgaaatactattatgatgtaaaaaatgaatgaaataatgtcatttgcagcaacatggatggaacagaggtgatattaagtgaaataatccaggcacagaaacacagatactgcatattttcactcatatgtcagggctaaaaatgctgatctcagggaggtagagaacatgcaatgatggataccagaggccagggaagaatatgggtgggaggtggatgatgaggaggggttggtgaatgagtacaaacatacagttagatagaatttgtaagttttaatgtctgatagtagagtaagctaactatactaagcaatgatattttgtatatttcaaaataactagaatttgaactgttcccaacacacagaaatgataaatgttcaaagtgatgtacaccccaaatgccttgacttcatccttatgcattctatgctgcaacaaatcctcatatgtacccccaaaatgtgtaaatatgtaaattacatatcaattttaactaaatgagaaatatgatatatccattctgtagaatgctactcagcactaaaaaggactgccttacttacgggttcatatgacaacatggatgagttacaaagatagtgtcatttcagctctcagaaatgacatggacaaggaaattgagggctgagagaatatgtggcatataataagtacctattagtaattggataagtgattattactcttgtgtataagtgattttgtttgaatgtgagacacaagatactggcagctcatgatatgattcagtgtgattttcttgcaatgttcgaaagaattttgttggggcaatgtttgaaagaattttgttggggtggcaaaaatcttacagaattattgtaatgattacatggtgcatccgtgttctagcatgtatcggtatctcattgtttttatggctgaatagtactcctcgcacagattatgttatattttgtttatcaattcagtgggtgataggcatttgggttgtttctagctttggggtattgaaaatagtgctgcaatgaatatttgtgctcaaggttttgtttgaacacctatttttaattctcttgggagcaggattgctgggtgatataattctatatttaacttactgagaacagttctttttaaataagatgtgttctttgttgtattgatagtatggctgatgaggttacagaagattgtaagtatagatacatgtagatattaatgccttgatataaatctattactgatatatacacacatatattatatatatatttagaaaaaacttgttaacattaaaatgttttaccaatattattagtgctaataagcaaccaccatatgacagattccatattaaatggtaaaaatatgagcataaataaggacaagtctcatatatggttctcgaccttaaaaaaattaaaatctaaatgaatataaaccatatgcaggagagctaggaagaaacacaaggtgaatgtgactcagagtgaggatgggtaaagaactcttatttgtatggacttgagagagaaggtctgtgtggtggataaaatctgcagagatttatatgagggtagaaactgtacacttaaaacattcagttaccaaattaacaaaaacataaagtctgggacaaatgaaagctggattgtttcagagcctagaagtaaattctagcaatctgaccttaccaaaccaagacccaaactggcgtcctgcccaatcctctctgaaatttggaactggactttctgcaggctggctttcaacatggaatcaagctttggttaggtccccacccagctggaagcacagatgtaacagtggtcaaaagattcttctgagactgacacatcagatttctttgagaattcaggaaagctacatgaaaaggctttccaattcattgcatctttgagtctgtgctgctgcttcccatgacatgggagagaatggattttgtgattcagatcattttgcaggctaagagtttgaaacccataacagatggatgattagtgatttatttcaggaaggcttccatttcaatcttgcatcccagtcttccatcccagaagtacacattagcacccttggagcaatcattgaaaaaagtacttacaactgtcaaattatcttcataataacatggcacagtttatatgactggttgcttatgaactactgaaacctctcttaaaatggccattgtggactatttaaaaattttggttttaccacattcattccttcagttgtttaatagccatcaaataatagtgaagaattcagtgaagacagtgcagaagaagtttacagagatgctcaacatccttggcttttttatggatacaaactctggcatgtgtatataataagtgagcagcttatagcattttgcatatagatagcagtgctattacttgtttatatatttctttctcttgatagtgtgagggctccttaaggagggcatatgttttcttcatttctttagcccaaacagtccatagatatcaaacctgctggcaatttataaatgattattggtgagtgaatgagcatacaatgtatagatttcttaatggttccagtgatgactttcaggtaggtctctagctgaatttttcttttcattgtcaaacaatatgccggccaaaatgcattcattactgccacattgatattagcttttgctcagaaagatcaaagaaatgatttgattacctcttattgcaccatggcattatctgtttaattttgatgctctgggttttatttttgttttcttttgggtattttcttttcaggctgttttaaattttttctgtaatttttctatttttcaaatgcattattcagagctgtgtttcccttgaataaaaacaatatttgaaatgaccttcagattttacaaaaatggtatgcttcaaataacacttaatttcatataataatttgttgtatctaattttcacttatttgttcttataaatccaccttaatattaatgatgatctctcagtcactaataatataaattcatgaagaccattgagcaaaggatatttgtcttaataatgatgtatacgtgcatgtttttctgtgggacaagagagtggaatagaaggaagaaggcaaacaaattcagagtatttttcttactgtatgttgaaaaaatttaaaatatacttttccatatttatctcctttttactgtatccttacttaagatgtaattcaattcataataattatatgatgtgtcaagctcatttaaaaaatatgttaaaattgctaaataaacagtggcataggcacacaaagacacacaaacatactcacacacactagcaataaaaccatagcttaagccagcaggatatttaaaaataggggcaaaagagagtgctcttataagttgctcatcctctcatacatcgtgttgctatattcgttgttttgtctagtaaggaagatcattctgacagctataacttgttaatgtttctctataaaatatgatgagaaatattatagatattcttatgatctgtttgacattttaagagtattatttatacaatattgaaagaatgaggacacagtagtcacatgttctttattcttcaaaattagtcatcctcaattacctccatggcagcatttctcatttggctttgtttagagaggtaaaatctctcacgcccttacattcaagtgcctaaaagcacaattgggaaataggatgctaagagacatgaggtgatatttattgacaaaggggatgacagttttatacaatggttaatactgacataatacataaattttttaaaattatacaccagttagaaacaagtgctccattttaacttcaggttctaaataacattgtaagacaccacgttttatttactaactaagctttgcccaggaataacgctttttaaagttcactgagtaaagggaaaaaatgtaatatctattactagcctaatgccagttcataaatagggtagagaaaagtggaaacctccctggaatcattgtacatagtcatgcaggaccacttttagttatctatgtccttcttatttttacttttgcctctatcatataccatgtaattgtctttaaagtgtgactacaactctagcttccattttactcacagctgctaaagacagctatttatttattcagtgcgtatctgctgtgtgcttactgtgcagtcccgggactgcaatacaactgtaaagatgaggaacaagttcccaccgttatgaattttacagactaaatgtagacagcgaaatgtccaaataaaatgcaagatataagtggcagcatctttaaatatggaaaagtagatttgcttttcttttcctttgagtggctaatttgcacacctgcagcctctggactgacacactctgcctcgtgaacttctgcccgtctcaggagtaatttactctgtggatttgttcccccagagagacgagactcaaacacatactgattcatttttgaaaactttgactgaagatgtaaacgattctagctttatttgcttttaggtagaagtttaatatttcagaggctacagattagagaaaatcaagttttaaacgatccaaaagtgttaaacttgatcaagtgctctgaaaagacagcataacacatgaacttcattgaaaggttgtgaacctattaccatcttcaatttgaatgttagtttggtgtttgatagtgtgaaaaaacaaatgtccagtgacttaagctcagaacagcactgctgtgtcaccaaaactctatcccagaggggagggagctttgaaaacaatgtacacatacattaaaaacagatttatttttttaaaagcagccaatgtggtgaaaatattttttttctttcacaatgtatatagttttaaactctatttacccatatacttattacatccattagagtttaatgtggagaaacaagctgagcagaaatgtgagctcacgttaaagggcctggaagtgttacagaaaaacattttcagaagggatttcctttctatgtcattaagaacagaaaggctggaccacttcagtgtataaagagttaaattgtgtgtgggggaggggtgtgtgtgtacacacaggagaaggaggtacaggttaggagaaatggtaatgccaattcctcaaaaacattttcacttttgctataagattcgctatttgaatatgcttgtttaactactcctaagagaaatcttgttcctaaccaagaaaggtaatgtcatatcaacataaatattcagccatacatagaatttgctgatctggtaatcagggacaaggatactggttagatataacagtatctgttactgttactatttctgttactgtcttcctaagacatatcaagataattgctttttgtgcttcagtaagattctatgcatactatttcacttgctgcattattttataactacatatttttgtatgtatctctctgcttaaggacagggaatcttatttgtgtttccattcccggcccgtacctcagtgcttggctaaagattagcacacaaacaatgtggactcaaaaatgggtatgcttactggcaggtcaggctcctctatgactcttcaagttgtaagattctttctttaaaaacatttaaaatagaatttgcatattaaaggacaggaattaattattaattatttgcctaagaaacagcatttggatggcatgaatctaatggaatcagtaatatccatgcatctgttgaaaaccaatcaacccgtttaagatttcaaattacgatctgaaatgtgaaaatgattggtagattatcaaactcactgggctggacagagcaatatgtcagcacctttgcccacgtccacagcctgaaagcttttgaaggtaagcagcgccgtcatcattttggcattctattttagtctaagcctacatcagaagcctgccagggctcagtgctgataacaaagcactatcgcttttcaaagtgacagagcacagtgacatatcaacactaagacttaaacgaaaagccccttctcatttaactgggaatctgctgaagctgtattcagcccagcactcgttttcaattaaaactttcttgtcgcaagagaaaagtttggcatatccttttcaacgacagttatggaagtgagtggaaagggtagtgtagtgtagagtatagatggtccaggaacagctaagtacgtatcagcctttttcatctactaattgcagtacctatggttcaacaaaagttttacctaatgactcatgttgctgaaagtccttcctctcaataccactgcttttccaggaatgctactcacacacagcatataaggcagtaaaggggacatgatgcatcaataactgagtacctgctatgtgccagctactatgagtaagaaggtggagggttcttacctgtgctatttcatgaaattcctaccaaggtgtatgatataaataagattcttttcattttttttatttttatagaaaaaaacgaagttttaacgaacttctgtacagtcatacatcttttaagtagtggagttggaatatgaatgtgcatccatgtcgttagtccagttgctataattttaaagtggagaattatgggtaacatcaacacagtgacatcatcatacttttctttttaaatgttatggcacattcaacagcacattttcttatcgtggagttcctgaaaaagacttagtccatagtctaattttgctcttaaaaccagttcaggacaattcagcaaaacaaatttcaaatacaaatctatcacacatcttagaatctgtttttgagaactttatttgggtgcctgttcttagactaaggcatagttcaatagaattcccagtgaatttactgtaaagatatggctaagggtgttgtttagatatcacctaatagctttatgaagccctaagacagatgtttctcacaaacctcactgttaaaaataattctgcagcttaaaagtaactgatattaaaaactttgtatctcacagataccacccattatataactaagcttttaccctttgtgttcagtcactaataatctcagggccaaattcatttacattttaatgagcttattaatttttttcatatttaaatttatacttagattggttttaatatttttctttctctgtacctttgtatccttatcctcattcgttctgtgttactatgcatatttttacaatctcccctactacttttgggagtgggataaactattagtaacaaactaaacagaatctggactggagtcagacaaagggtgtaggccagacttcttggtacactttctataccactagatcaaatcagagcatctttcaaagtatttcctcatatttcgcagtggtgtttcaaatcactaaactgaaacattgtgtttttctttagattgctagcagtgaaagaatagactttcttacttcaggggataaaaaccctcactactgttgataaaaaataattttagtcacacacacaagcacagcaccagttaaaattttcaaaggagtatttccctttagggataaaaacaagtttctggcaatttgtctccgagacaaccattaagcataaaaagtgttttacatatatatgtatatatttagtagagcttatgttcctcccttagaacacatttttcttcaaaaagtattttagtggattggctctacatcaaatctctgtcgtctttaaaatggcatgagtcagtctgccatcctttgattgatcaaaacttggaccaaagaagggcagccatatggcacccaactcagtaatgctatgctgcatactgcagaatctggaatcagcaaatgccaagaagcagaatgcatagtgatgtatgaattaatgcaggcagacaggaataaaaatattgatgcatttttaaatcgatattgatacatatacgtcaatgaatagttaccaaattatttttacttcccaacaaatgctctaatgaaagactatgaaaaaggctttggttcaaaaaaggagtcaagtagaactgaacctacattcaaattcatacttttgttttggtttaattttttcttttggaatataataacactggcataagagatatcatatggatatgtaattcaatcatttagtaaattattttctgagtacttcctagtgccagacacttttctaggctctgatgatagagcagtaagtaagacagccatgttcctgttatggagcttaggttcaagtatgccagacaaaaattaaaaaagagagttctgcacaagataatttcacataagtactatgaagaaaacagtacagggtgatgtaataaaataatagcaatgggtaaagaaggagttacttaaaacagggtgctcactggggacatattttttgagacctaaatgaaaaggagtcaattataagatatgcagatgggatgcacactgaagaatcagtggcaggtacctaggcccttaagtgggaataaacttagaatgttgaatcagtaggaaagcttctgtcacttgagcatagggaatgaaagggggtaggtgggagttgaaaaaaggaaagacatcgtgataatatgggaggcttctgttgaaaatgacttttgtctcttggacaagcaagacttaacttacctggaccttacatttctcataagtcatgagctgatctttgggggtccaactctaaaatattctgataaaataattcttcttagagtcctagttaggctttgattattccttcacattaactatgtgtggcctttagaaacacgctgtctttaactaaaagtgttcatccagttaactgtattagcaatgtactgcattttaaaagtgatggataaaatatacaagtaaaataagttctcccaaagtgctcactgccattaactgggagtgttgtccatttgtggaaactgcattaaactcttttaggatgttagaatgctactcactaaattgctgctttggttcagcatataggaaaagcatttccagttagctaaactctaagcacataaaggtgaatatataaaagcaataaacatttaggaatccattttttaaatcaatggttttcagcccttttccaaatgtgataccattctcacatccatttccattagtaatattccttaatgggggaatagaaattaccctacacggatatttgaataattttatcccattttgagatgaaattcttcctagggaagtatactccccctttcactcttcccctagagttattcttttaaagttattaattatacaaagaaatccactaagttactaaatgccttcttacctactactgcatatgtagctttgcattcataactttggcatcttagtactccatcacttggctaatatctgccacccagggctttgcaatatgctggtgtgacaggatcagatgagatatgttactcacacagtcattcatttaacacattttactacgtaaacactgagtatagggtactattctttgtgctagggatagaactgaggtaaagagacatgatttctacctcctggagatcatggtgtagtatgtgtgtgtatgccagatataaggtgagatggttacagacagcagccatctttacagacagattacagtgatgtacaatgtacagtaatgaagtctatgatggagaaagcactgagtgaaataggagtaccaaaaatgctacctagcacaggttgaaacagccagagactatccagaacaagggacatttagacagaagttgagaaaagaagtggcaataacacatataaagtgggacttgaaagaggagacttccagatggattattttttaaaatcctgtggtaaaaaatatgttttattagtttattaatattaggttatattactgcatttgtcgatttggtgacaggaagttgagataaaatctcctcttttggtttctacttcctctgtgccaccagtaaatgaaatcatctacttaaagggaaaagttatgggccctgaagtattaagtataggtgagaaagtatgaaatataagtagtgacattggttccacttaccgctgggatgcaaaacgttgccataaatttttgttcctatcctaatactaagaacaatagataagctaaaagactgtagatttcttttttatttttaacttatcagatagctgaagatattaaaaaaacaactaaaaaggactaaatagaaaacaaatacctcgttctaggagcaactatatctgtagttactttcataccttgctgagtgacaggaagaggagaaatacacggtagacctcaagaaataacgaaaaaattactatggtggctcactatgaaccaactttcctaggctaggaagttccttgaactttggtccaggcaaagttagaagtgttatataagtggagccttgaaaagcacttttaaattagggcttatctttttggaacactccctacaggacttcagttgccatgatataaggaaattgaggttatactactagactgagaggtcatatggaggcgctctggaagatgaaacaccatgtgaatatagcagtcacatggagaagaatatgaaggccccagaaataggagagacgccatcttggaacttccagcccaacccagctacaaccatgtgagaaacctcaacaaatatcatgtagagcagaaatgcctgaacaaccagaatctgaggaatgcaaatgtttaagccactggtttcatagatatctgatctggtatatcagtttaacctttaacaacgttttaattatacatatgacatgcatgatgaattagaatcacaaggaggcttagctatagaacaagcatgaatccagccacaaacatttccccaaaggcatttaccaagtgcataaagtggtatgctgatggctaggacagaatagaagagctaagaatgtttccactgaggcacgcagagaatatttccagagtaagtcagtggtctggctgaagagtggcagcagggcaggaatggtgaggtaataactatggtgtattttggactttcactgagtaactattgaatgttgggtggggaagagaggtatctaaaagaagaaaagtctaagataatgactcaagattctagagaaagaagttagcagaataagagtaaagtaaacccagaataaggcaatattcaagataagaggagaggtcaacaaaatagaaaagagacaacacagtagagaaaactaaagtgaaaaattggttctttgaaaagatcaagaaaaatgacaaaccctgagttactctaatcaagaaaaaggagatacttacagaaaaaaacgaaaaaagagaagaacacaatctactgctatcagggaagaaagattatcgcaacaaaccctggagacagtataagaacaattagagaatatcttgagcaactttatgccaataaattgggtaatttaggtgacaaacaggtatcttaaaaaataaacattgattcctgtctcacttaatgccaaaaaagatcatggacctgtacgaaaaattaagaatatataggagaatatcttcaagctttgaaggagtccaatatttcttatacaggacacaaaagctcttacctttaaataaaaaacactaacaataaaaaagttatattgaatttcatcaaaattaacaatgccaaatcatcaaaagatatcattaaaaagatgaataagcaagtcaagctacagactggaaaaaaatatcagcagtatttatatctaacataggtcttatatacaaaatatataaagaacttgacaaatcaataatataaacacaaatgacccaattaaatctgagagaaaaagaataggcacatcctaaaagagatatatgaatggtcaccaatcaagtgaaaacggtactcaacatcattagtcattacagagatgcaaattaaaccacaatgagatgacatttcagtttactaaaatgcttaaaatcaacaatacaattcctagtgttaacaaccatgaggagcaactggaactcttacaaaattctaagggttttgtgctgcaggagcatgaaatttaataattattttagagaactgcttgccacttcgttataaagctaaacataaccctactcagcgttttctagcaattccagtaattctctaacagatatttacctgagatacatgaaaacgtatgtccacaaaaatcttgtgtgagaataatcataccaattgaaaacaatgcaagtgctcatatacatggaaataaacaaattgtggtatattcatacaacgaaataccgcttagccataaaaaggaatgggactactaataaaacaacattaatgagactcaaaaacattttgttgagcaaaataaaacatacatgaaagaatgcatattttaagattccatttacatgaattttaagaatagacataacaaattatggggatgctattcagaaaatgttgccactggtggatgttagagttgtagaattgattagaaatttgcacaaggctactttccagagggatgcaaatgttctataatttgcttcatttgtaattccaaaggtataaggtataaacaattgctaaattctctgggcttcacattatatcaatatcatgtatcacttaatataattgtttttattttatgtaaattatatcataataaagattaggtaaatttcaaaattttaattgacttaagatttactaagttttccaaggtagggtagatttaatgatagattttttggtgatggataatgcaggtacaaataacttgctgagaattatgcaaatctcagagcccattttatgtcacagataagcctaggatcaaggccatcaaccttgattgttactgaaaacaaacaacaaaaacaaaaacaaatcaaagaacaaatgaattttcgttctaggctacttctttataatctagtctatactatagtgttgcacacttgatttttctaaaaggttattaaaacatgaaaataactgcttttgggaaatcaaaacaatacgtgcttaactattgttaaaacaatttgtgtttattaaacgtatattagaagctaccattttccagaacttttaatacaaattttgctttgagtccaaattttatcaggtaactgtcagattagaatccctccaccttcaattttgtaagctattccaaatttcataaaacctgacttaatctcttctcttgtagaaaatgcatctaagctattgcccatatctctgtgatacacttcaaaataaccttggtttgaattaaacttaaggataaatggtgagcattaggaagcctgtttaataccaaactattttctataaaacagtacttttatttatatccgtggattttaccatttctccctaaaaattgtactataagaaccaaatgtgaaaagcaagtattaaccatttgtaatattaatttctgcgacattttaattaattgaattaaaagcttatttttaggtttccttatcagaaaatatcatttaatcaatgaaggttcccaaaataattactttgtataaatattttaagtccgacttcattttgattttttaggtacatatgacacacatttcttaacctttttaaggtttagatttaattaagatatatttatttcaaaataatctcacttgagggcctatatacttaatgcaatgatgctaaaagcagtttgagaacatctctcgactgtgtcttcaaatgtattctgaaccacaaagaacatcagtcacctgaccttataaaaacattttaaccaaaaatattttaatatctacatgcactttttgctttcatacaaattaaagtcatacagccatttttctaggctcacaaaattttccttggatcataaaaagatagatattttgagaaaacactaataggtctaagctttatgtattttattataataattttattttatacttttgttttagatttggtattctgctttagaattttattatagttcaactataatagtgaattaaaaagtaggaaatctgagcaaattctagccgatagcccacatttctagttgggatgggtttctgactatacctgaatatgtgtggaggtttaagctaatctaaatctcatcttgttgttcttgattatttttattttttagaggagttttacattcacagcaaaattgagaggaaagtatagagatttcaaatatacttcttgtcccacatatggataaggttgcccccattaccaacatcccccaccaaaatagtacacttgttaaaattgctgaacctatgttaacatcattaacacccagattcctttgtttaccttagggttcactctatgcatgagttcaaactcattctatgggtttagacaaatgtataacgacacacacttgccactgtagcatcatacaacatagttccactgtgctaaaaatcctctgtgctgtgcctattcatccctccctttctctaacccctgacaactactgatatttttaatgtctccacagtttcgtcttttctagaatgtcatatagtttgaatcatacaatatgtagccttttcagattggctcttttcacatagtaatatgcatttaagattcctccatgtttttaaaattctattgtttagatgtgccacactttatccattcacctattaaagaacatcttaatttctttcaaatgtgaacaattatgaataaagctattttaaatatctgtgtacagagtttttgcatggaccaaaatttttaactcttttaggtaactactcttggtctattcctgatttctttattctgttacactgatctgtacatctgttctttcatcagtatcacactgtcttgattactgtaggtgtattgtatatcttgaagttcgctgatgtcagtcctccaactttgttcattattggctattctgggtcttttactgttcatataaactttagaattagtttattgatatctacaaaataacttgctgagattttgactgagattgcattgagtctatagacgaattttagaaaaaacaacttgaatatattgagtcttcctatttataagtatggaatatcttcccactttttaattttttttattctatcagggtttttcagtttctcacatagatcttgtccatattttgttagacttacacctaagtacttcattcttttggtagccaatatacatggtattgtgtttttaatctcaatttccacttgtttatttctggtatatagaaatatatagcagtttttttcactaaatatatagtttcagtgaaattttgttttgttttgagttttgtgcattaatcttagatcctgaagctctgctataatccattattagttccaaaagttgttgtggaatttttggaatttttacatagaagatcatgtcatctgagaaaaaaaaatagtgtgttgctttcttctcaatctatataccttttatttccttttcttgtcttattgcataagctagaacttatgcaatttttatagcaaaattaaataccagatgtttcttttctgcacattctcatgtatttctattttatcttctttattcatgttcagtttttctaattaatgccattatttgccctccttaggtgattttgcatagaatctttgttcttttctatgtatttatcttaattttcagttttgtttacctctctagtagtgaccatattccaccgacaattactactacctttatgctatataaattatcccttttatatgtaaaattctggcagtaatgcacaaatttaaaagtgttcctcttataccagtagattctgtgtttatagtaataataattactaacttattgaatgtttataatatgttccactaagtactaaatattgtgctgtgctttatatgcattatgttatttaatctataatgaaaaattttaaatcttgagagtcatataatttatgatcttaatatagtggagtaattaccaaacagtgttcctcactaaaagagcattaaaaccaccaggtaaataatggaaccctattacatgggtagtgagttaaagacttgtgttaaagttctccaaatcaaaatggagtcactaatgttaaaaaaaaaaataaaaataaaaagacaaaaaataaaaaataaaacctaatagagcaggggaagactatgaagagagggttctcatgcttgtatgcttggtaacaacagctatcacaaagactctacaaaaaccataaaattgcacaaatgccataccaaacttacacaaaaatacttctacaaggaaaccctgtctaaattggactgatgtcactcttgctatcgattttgtagccaataacaattatttcagaaaaagtacgcagtcatcctcatcattccttacaaacctttgtgttcctttacctccctgaatgtgcagagcttactacagtgtgcatattccatttgaaatgctctacttccaaataaacatctttttcttttggaaatcctctctccctttttatttaggttgccattcaaaatatagattcagtgaaatttttgtttggttctcagagccaggacttaattaggaatcaagctgcctagcctgttgaaatctcagaatgctcacttgtaaaacatcgataataatagggtctactttcaactgtttgaggactaaatgcatgtagagtgtgtgattcagtgactgacactcatagtaaaggctgaataggtcatagttgctttagtcttgtgatgacatgccataggatatctgtatgacaaggatattttgtacatcaggatatttagcccttctgacaatccaaaagaaaaagtatttgaaggctattttccaaacttttccaattgttttcccaatttgataagagctataaaaccaaaaatctaagaaagctcaaataaacacaaattcacacacacacacacacacacacacacatcaggaaaaagtccaaggcatataataagcaaattgctaaaaatgaaacataatgagaaaaatgtgaaagaagctcaagaaaaaaaggcttattatatcaaagagaacaatgataggaattttttctgacttttctcacaaaaaatgcaagacaaaggacaatgaaacaaaatctttcaagagttgaaagtgtaaagaaaaacactgctgtccaatattttttatccagctaaaatgaagttgaaataaagatatttgctgagcaatgtaatacaatttgtcatcagcagatatgcacttcaaagaatgataaagaaaattcttcaagttaaatgaaaatgatactagatagaaaattcattccaagtgaaggaagaagaaagctggaaatgatcaataataaaagtgactaatagaagataaatagcaagaatacagacctaaacccaaatttattcacaattgcattaaagaaaagagactaaaaatgtaagctaatcattcaattaaagggcaaagattgccagagtgtatgacagagcttgattcaattacttgctacgtatatgtgactttttttcttttttttttttttttttttaagacggagtctcgctttgtcatccaggctggagggcagtgacatgatcttggttcactgtaacctccgcttcctgggttcaagtgattctcctgcttcagcctcctgggctacaggcgtctgccaccatgcctggctaatttttgtatttttagtagagatggggtttcaccatgctggccaggctggtctcaaagagatacacttttaaagtaaagacacaaaagagttaaaagcaaaagtatgataaaaaacgatgtattataagcactgatcataagaaagatggagtgccgtattagacaaagttgactttaagataacgaatattaccagagataaaagagcatattttataatgatgaaatggtcaattcggcaagtagacatagcaatactaaatgtatatcccttaaaagaaaacttcaaaaataaatgaagcaaagattgacaatacgaaaggaagaaatagaacatttttaccattatattcagttatttttcactcttgctctcagtaattgacaggaaaatcaatttagttataaaagatttgaccaaccttctcaaacaatgtaactgatacttttaggacactatatcaaacaacttcagaatatatctcttttcaagaggaaagcataggcaactatctttgcaatcttgaagtaggcaatattttttagataagaaatagaaagcacaaacttataaaagaaaaaaagcttaaaactcgggcttaatcattttttaaaattcaccttatcaaaagacattgtaaaaaataagcagccacaggttaggagaaaattatacatatatatgtgtataatgtatatattacacacacagacacacacgacaaaggacttgtttccagaatatataaagaactcttataactaatcaaaagacaatccaatttttaaatgggtgaaatatctgaaaagacattttaaaatgaaaccatccaaatagccaataaactcatagaaaagtgttcaacagcattagttatcaggaagatgcaaactgaaaccatcataagatgccgccacatctctaccaaaatagatagtcaacaagactgatctcattaactgctggtgaagatgtattaaacttaaacagtcgctatggtccagcaattccatgcctcgttatttacctaagaaaagtaaaaacatgtcataaaaacacttatacaaaattgtctcatacacatgcttcactgatttttgacaaggagataaaagcaattcaatggaaaaatgattcaacaaatgatggtggaacaattgaacatacatagaccaaacaatgagcctcaacttaaacctcataccttacataaaaactctcaaaatgaagaatagtcttaaatacaaaacacaaaatacaaaacttttaggaatgtatacaaaacacacagaatatcttgggatctagggctatgcaaagatttcttagacatgacatcaaaagaatgatggataaaagtaaaaataaataaattgggctttctgcccaatagataattggactaatttttagtgccaaattggttagactgtagtgaccagttgtttggtcaaaccccaaattaaatgttgctgtgaatatatttttaaaatgtgattaacatttaaatgataccttgaataaagcagattaccccccataacatgaatggaattcatcttatcagttgaaggccttaagagaaaagacttaggtttaccaaagaagaaattctgcctctactgtagcatagaaattctgcctaagtttcagactttaggctgcaatatcaactcttacctgaatctccatcctgccagctttccctacagatttcagacttgccagctcctgcaatcacataaaccaatttcttataatctctctccctctctctatggaaagaagtatatatatttctcatatacatatagttctctctctatatatatgaaatgtataattttatatataaaattatatattaatgtatattatgtatagtattatacgtagtatattatgcactatatactatatatatggtatgatatgtaggacaatatattatgtatagtattatgtatagtatagcatatatatattatataatgttaatatatatcccaatttatcctattggttctgttgctctggaaagccataatacaaagttcataaaaacaagaacttttgctctgtaaaaccccgcatgaaaagaatgtaaagataagttacttcctgggataaactagttgcaaatcacttatctggcaaagggctagtataaaaaataaagaactctcaaaattcaacaataaaaaaatagcaaaggagcaaaagacatgaacagacattttactaaagaggatatagagagtatataagtacatgaaaatatgttcaatatcattagccatcaatgtaaattaaaatcacaagaacatatcactacacattaactaaaaatggctaaaataaaaattaatgatatcaccaaatgttggcaagtagagaaactgtatcactcatgaattgctagtaggaatataagttcctagagttatctgaaaaatggtctgaaaatttatcatgcaaatttaatcatgtaaatactacatgaccccatagttacactcaatttataatttaatgtatattcttgaaaaataagaacttatgttcaccctaaacctgcatatgaatgtttcaaggagctggggtagtatggaggggctcatttatagtgataatcaacctggcgctaaataaactgcataaattttacctgagaaggatcagtaaatgcttaactgaaaaatcttataaagctgacaaacggaggtcaaaaccttacaagctttagaaattcagtatttaaattaagggtctctaattattccctaaaggtgaataattccagttatctattcgaatattctagctttccagtggtagtactaggcaacattgattatatttaattttacatcaatacaagtcttttattctatacataacacattagtgaaatggtaatagaatatatatatatgaaaattcactctgtatctacctactggagttctgacacaggttcgcataaagctggatttgatcttccagagtacaggctgaagatattacattaatgtttggctcctatatggttctcagtacatcctttgttcttctttcatcaagccttctttaattccattggactttccattttaatggtgaattagtacatgccagtcctactgcatatagcctgggataaaaagctgatcttagaaccccacaaactaagccccaccagattgtaccagagtaagggacactgccccaaaccaacttatgtatctgctagtggactgtaatttaggatactgtaagttgctccccaaaaggaaaatgtggaacaatgggatcatctctcagtgagtttgaattaaagacatgcagaaagaaatcagagttggctgacatagaagtgagaaaaaaaaaatgaggaagtaaactgaagccatgaggcaaaagaagcaatccataagcaaaagtataaagacacataagcccaactctttatcaccatcacctgaagggctttctaggtgtcagactctcctctcactttcataatagtcaatattcatttactcctcagttaagacaggtattagtatctcacttttaccaataaagaaacaaaggctcagagaggtaaattgatttacccagtctgattcaaaaatccatgccatttccattattccacgccatctcttaacaaaacagaaggaaagcagtacataaagagtattgaagaaggaagtgattttaatttcaagtcagtcattgtttttgcttttgttggataatttcgcagtcaattgccattttctatatttagtcatattttgagacattagtaaaactttcaaacctctaaaattttgttactccaaacgatgagcttttcaatcaaatcttgaaaagtattgactattaaataattttaacttcctaaatgtagttctttataacttacttcagcttatgaaatgaattgtgccaatttttagtgggacttcttttatatgcaaatacttgcttctctgtagtaagcctatagcaaacttcttctgtctaatgacctaagaatgctctgagatttatctagtgttttgcagacattgcttcttgggttcaaggttagtgctcaagaagactagattcctcggttcaaggttagtgactgggaagactttagagatttctgcatttttgtggagcaaaatcacattgtgacatggctgcttttcaaagatgaatgcttcattcagcactttgcttcatttcctaatacaattgaaaagtcatttgctgacagtaaaccagtggcaggtgtgctttcgtgttgacagctgctattctgacatggatcacagacaagctctactgacagtgctagaacatctggagcatttggtcagatttcaaaagctaatttaagtggactgtcttcttccatttcaaaaaatgaaagcaattatggacactgggaccatatttacattgtgatagtataataatttattcaatttcttttttattaaatatggaggcaaaggcagcaaagcatgccaatacatctaatgtctgggaagatagtttgtaatgtagcttactgcagtcgcctgctcctattaagatttcctttgatattgtgaaagcaattgattgacagaaaatgaactaaaatttcatccctataaatatgtttctgagaaattgttatacggatttatacaaagaaaacatttaatatttattgaatgaatgaattcagtttatttttttctaatttcttattaataatattcattgccaacacttactaagcagcatttctgccaacattgtacaaacctaatcacttaatctccagaaatacccttcaaggtaataacaaatgacataattcccatttaacagatgaggatactgaaactcaaataattaagacaactgcccaaactctataagtagaaggtagaaaaactcggattttttttttccacattggtattccaaagatcatgctctttctacagtgttttggtgtttctaaatgacagtatggataccccttacttactgaattaataaggttagtaaagaaagcatacaatttttctttactgaaaagtaaatacaaatatgcttgactatattgttgacaataagggacttcctagcaagctattcaggtaggaagaaaatattaagttttatacttggaaattgttagacaaatgaagcaaaggaatttaatgtgtttcaaagttcaataattacatttagactaagaaaataatgcttacacattctcacgtatcagttacttaattgctgattattgggccctactggagtgaaggaggaaagttgacagctgcaggcatataccctctgacaacaaagcttacatatgtgagcattgcttgctacagattctgggtattttaaaagcaatgagttggacaatgatgggaacatgacatctgagaattgatgccatttatgaacattttattatggatgggctagaaaagttagattgaaacttcaccttttacgctttcatatgacagtatttcatgggatatgtgggcaagaatccaaaaatattaattgcaaactcaaccactggttcatgtgggtgtatgaaatatggaaaacactatcaagtaatttatcttcaatgttgtgccaataaggatgtggcctctcacacactgcacaccagagaatgtccattcaaatgagatttgagcattttatgggtgaatgtctgactaatggatagagactaatatattcttctgcctcaatattataaagactgcagtatttacttactagtgcacactgtgacaaatggtcctgttttatttttttttttctttgatcctactcttgtttttaggttacactgggagctatttagaaaaaatgttgacatggttcgggggagtgggggtccatgtcaagcaaatactgtagggttaaatatcttgaaagaaatatattctggcaccatccaagagaaaatgaacaatcacactcctctggcacctgaagatattggtcgttgtttggcacctgaagaaattacccatgaaatgaacacttgaggcttgactcattagaattcaactccagtgtcttcaaatgaataagaatctctacacggatactgagaaatagagataaaaagaattgcagaggaaacgtcaacacttcttaactacgcaggaaacttagacttaatggaatttgccccataatgtacataatgtcaaggtataatcataggtcaataaagtgattacattccaagccaggaaaaactgcatattcaattattcaatgaaataaagtctatctgcaaaatgtggattttaatttgcttgcttatacgtctacatattctatattatacaagctattttatatctatgattttgtctaatgggttagaatttttatcatttgtgcaaagaggaaaataattctatattagaaaatttagactcagttctaaaagtggtttgtttaaaggcataagtgcataatgtgaaacatttcagagttttgagcatggactttagaagactgtgtttgtaatactgccaacatgtatgtattatgaatatgttcatttttttacataatatttgacgtatgatattatttcttatgcttctagaagactttctaatataataaaatatcttattagggcagatatatggccacagtcttttcattgtttacctatataaacctgaatgttccccccataattattgaccagtcacctgttgagcaacatcacacattattgactgagttcaccagaaaaagggagaaagctggtgtttatagagttagacaagtataaataaccctgtagagtgattccctaaacctgtctttatttatcgtattatagtttcatcaactctggaaacacacacacataaacatatacacatgcacataattacatgacacttcatatattgtgccactaaaattcagcattattgtaggatggaaagcatcttaactgatttctttcctgtttgctttctattttagaaataggctaagttcaatatgttgtaaatctagtacaagaagaaaccacgtttggcatttaagtaggtcacaaaatatgtcctgatttcttatgtttctgaatatacagataaaactacaaaaaacattagctataagtacctttcccattatattatatgagaaaattatatctaaatgccttataagagattaaattttttaatgcaaatattaacatttaataaatgcaaaactaacgaatacacctgaaagttcaaaagattgtcctcctctagaaattatgcatattaaaactaaaatagaacctttgcttccttttaaatttattttttgtgtcttaaattactccttttatggccttagattgtacagttgacccttgaacaatgtgggggaccccacaggtagccaaaaatctttgtgtaacttttgattccccatgaacttaactatgaataacctattattgaccagaaaccttactgataacatagtcaattaatacatattttgtatgttatatgtattatatattgtattattaaaataaagtaagccagagaaaagaaaatgtaattaagaaaatcattagaaagcgaaaatatatttactgttaagtgaaagtggatcatcataaaggtcttcatcctcattgtcttcacactgagtaagttgaagaaaggaggaagaggaggggttggtcttgctgtctcaggaaagcagaggaaaaagaggtggaggaggtagaaggggaaggaggcacgtttggtgtaacatttattgaaaaaatttacatataagtggacctgccagtccaaatctttattgttcaagggttcaactctatttattattcataacagtcataaatagattgtaaattcctagaagtctatcaattgtgtttcacactttgaatctaacttgcccccaattttcttgcctggtgccttcccacattgtagatcctcagttaataattttcagtaagttattgttgctagggccccatctaagataaatgaattgtttaaagtatataactttgtctttgtatctctgagagctaacacaacccaaatccttcaaatttagatggtcagatgatcaagttacatccaaacttcaaaatataattcctggcaagaaattgagagctctgtggttcaaaatcttgatgatgatggagtgaagcctcaaagatttctcagtgccttgcagggtcctttcgttatcagaaaagaacaaaggattagaaacctgtattctaatctcagacagtatcttcaattctactgtagaaaagagtaaagatttcaactgagatggacatggtggttctgtttgttactctatcactttagggaacttatccccctgagactcagtgctttatccacagaatgctgattcattattttgagtgtgagagataacgtccatcaatggaagaaaagtagtatcctttcagcaaattgtctgggtttcattgccattgtaaaccaaaaacaaaattatagctcccgcaattgacttgtatgtaccctcctctcagccaaggcattccaaattaaacttgaaaaactagttcaggccatgatggaaggggggaagggtgtccagacatacctaaatgtagcctcctacctttggaattcaggcacaattgatcagcattaacattaaaacagagatcttaagaatgacaaagcagactctttgtaccaataagataccgaactccaacctaactctaacatagcattgcatagcagatagcaagccctggaagaaattgaagtattttatcccaaaataaaattttttgacatattttgaaatgcactgcaaagctctctctcgggagaaaaaaatctacatgctatagagaaaccccttccctttccagagcttttcctaatccaacagatattaattaagaaactggtacctttttagatctgaaaagagactaataccatccattctttctgaagactgctacctagagacttcatctgcataagaaccttggtctccacacccccttatcttaaccaaaacattcctttctattgattccagattttttgataattgccagttagaaaagctttgaatccacctatgatctggaagcccccttcaagttgtcccatgtgtcaggtcctggagtcctggtccagcccatgctgaagtctgaggggagtgggtggatgggcagaaagaacactcaggggctataggcaggtgaatatggttttattcagcggcagctctcttacacagcttacttaaactagctttctcattagcagcttactttcacactgtccaccctatcttggctgcttgagccagcagcctgcatgcacagcacacagccagcttttacttgccttcagggtcagcagcttaactctttctttctctgagcacgagtaagctgagctgtgacctggctccctcctgtccatctgcaagatggacagctttggctctctctgtctttctctgggtgccagcgcgcccaccatgtcaagccatgttgagccgagctgaacctcaagagccaagcaagcctgtacagtgttagcagggcagttgtaccttttacagacaatagtggcacagagccaagtaatggcctttccatgttatggctacatggttgtgataacaagtggagttatacatctgtgctctaaactcactgagtcatgcagaatgtaaacatcctaacttggcctatccttgactaaggcacagccatattccttacactccacccctttggccgagggagacatagggcttggacacacaggtttgatacacaggttttgtcacacaggcctgccatacaaactttgggtacacacacctgatacatagacaggcttgacccataagcctgacatacaactgggaatgcaggtccgatacatacacaagcaactgagcacgcaggcctgttacatacataagcgttgataaactgcccatctattggcacagattaccacagatgtcacctccttggtgattaccattcacactgccctgagtttagcttattagctactccgtttacacctggttttaaaccatatgttatcagtactaggctggactgagacaaaagtccaggcagaaggagcaccccaggtagacctatctgtatataatgccctattacgaattcggggacacccttcctaacagtgaaggttcaggatctaggggtgtctcaggccccatgaccttaggccccaaggccttatgttgcattaggactacaggtcctaagcctttttgtaactctgctactaagggacttgtactcagtgtacttcaatgctctaagtaggcgccccacatcactaaagtggatgtccgcacgttccagtccgggggggtagctatccatgagtgcacccatcccgttattgggtaagtcatctgaatgatgactgtagcctgtcctgccacactcttatgagcctagagggcagcatatgcagttactaactgcttcccagtctggggcgtggttacccatcaacacacccatcccgctatagggtaagttgtctacaggatgactgtagactgtcctaccacactctgagcatgaagggcagcatatgcagttactaactgcttcccagtctgggagttggttacccatgaacacacccatcccgctattactaactgcttctctattaatgaacactggcacttagctccctcccgcagctgggactaaaagcctactggcacttccaactgctccagcattgtttaggccctagccaaaactatctgtggtcacatgcacattcagttttaataggcacccctggttaactacatgtagggcttgtgcctactgaataggctgcttggctgtctcagcctcatcatccaatcccaggtaagaggggcattgctgtttctaactctgcaagagaatgagaggttagcataacatcatcaataagactatgacatatagtggagctatgcacatagccctccagcaacactgcgaaagtccactgttgccctcccatgaaggtaaactgttcctggctctctggacaagaagttccagttctgttgtcaagtggtccagcaagtctgtgacagaccgtacagctgccaacccatgaaaaacatccaccctcagaatatcctcaggcatgggagagacataagcggtgcataagtggagagccaagctgccaatgccaaggtgcagacagaggtttcacttccactgaccagcttccacagctgccaataaatgcagttctgcctggaaacttatctgggttcagagaccagtggattgccaagtccacatgtggctccggttgtccggtgccccctcaagtcgggcttctcggccagttctcttaccaaacagaaaaaaactacacttccaccaaccacagcaggtactctttgaactggaatgctagggcaggactgggttgcacagcaatgttcttctctcagacgtcttgcactaagtctgtacatgactgtggaccttacttacttaactcccacaactcagccaggacacaggcactagaggaagtacactccaccacagtaggtggtctctgggaccacccctggacctaatagcttctcatgctctattttctggtggaatacagggcgagcctgcaagaacatatggtggtagattctagaaatgttgcatcttgcagggactaggcatgtatttcccgcagcacagttacaaatgcctatccgactttgctggcaaagatatgttcctccttggtgttgtgcacctcaggtgcttcagcgcctcctccacactcacagggaatctgtccactgcctcccatgtttccattgaggctcatccaagcagcaccactgccaccgggtaccacagcccatgctgcagccacatggctgaccgggcaagcctcaggggctgaagacccactcacttcatcccacccttattgccagttgtcaggtcctagggtccggttccagcccatgctgaagtccaaggggagtgggtggatgggcagaaagtacactctggggccgtgggcaggtgaatatggctttattcagcagcagctctcttacacagcttaaagtagctttctcattagcagcttactttcacactgtccgccctgtcttggctgcttgagccagctgcccccatgcacagctgtgcagcaggttctcccttgccttcatggtcagtagcttaactctttctctttctgggcacgagcaagccgagctgtgtcctggctccctcctgtctatctgcaagacaggtagccttcactctctctctttctctgggtgccatgtgcctgccatgtcaagccatgttgagccgagctgagccccaagagccaagcaagcctgtacagcattagcagggcagttatacgtttcacagacaatagtgttgtagagccaatgatggccttcctatgttatggctacatggttgtgataacaagcggagttatacgcctgcgctctaaactcactgagtcactcaggatgtaaacatcataccttggcctacccctgactaaagcacagccatgttccttacaccacgtttccagatcaaacccatggataccttgcatgtattgattgatgtctgcctgtgacttctgtccccctaaaatgtataaaaaatcaagctgtaacctaaacagtgtgggcacatgttctcaggacttcttgcaactgtgcctcacgtattggtcacgcatatttgacgcagaataaatccattcaaatattttacataatttgactctttttcatcaacactactaagtaaatggccactgatttatcatcaaaccatttggggtaaaattagattttcacaaagaacaagcaaatggacaagtataaaaagaatagcctctctctattttcagaactacagttagaaatgtgcagggaaaaaggcatttaggtttaagccttaactgaaaaaaacactcttactttccaaacaaaagaagggtactaatttataaaacatccgtgttggtaaaaatctgtttctcttcagaggtgatgagatcttttctcttagattgaaagacatcacatacttttctttctctttctatctactggttgtaccttctctcatttgttggttccttctccttccaagctcttattgttggaatggcccatggctcagacttagacattttctctctatgtatacatgctgctttaaggatttttctctcattttatggctttaaatgtcatctctgtgccaccaacattcacttttttaatcttctggactgacatttcttccaaaatgaagcctcatatatccatatgactacttgatacccaacttcggagtctaaaagacatctgaaattcaacatgtccaaaattgatctgattttctgtgtcccccatatctgttttcctcacactcatattctttattttttcttatttttattttttggtaaaaggcagctccacagttaagttcttagctctcaaatccccaagccatccttgattcctctttctcttatgtccctcaggcaattggttggaaattctgccaacaaatccttcaaaatttacctagaaaatttatctaaattcttttcattgcctcctctgccactattctggatgaagcccctattatttcttatctgcattacggtagcctttaaaaatggcttctggctttaagaccataccctatttgccattgtcaacagagataattaccttagtatcatccttctgcttaaaatccttcaatggcttctcactgctcttagtgttaaagccaaagctctacctgacctgccttcaaccccacctctgttactattctgacctcaggtcctagaactctgccttcctctgctcctattgcactgtcctctttgctatttttcaagcctcctttcagcctttgcctttacaattagacccctctccttcatggtatctatatggctaacacctttagttcctgagcaaatttgcccaaatctgttgttttggataattcaactctaagcatcctatttacaattatatttctacccaccccacatctccttatccccaaatctcctatttcctttcaacctgttctactttttgttattttctgtaaaatacataacctttaaatatgctagattattctatcaccatctctccacactggaatccaagctccatgtgggcagacatctttgccgcttgtatttacggtgtaactcaagcagaaagacaatggtctagaacacagtagctgctcaccaaatatttattgctagatgaatgactattagaacatttttaataaatcacctttttcaactgaatataaaattttagctaattgtatggttataattgtacccactttattataagaaatatataatgtgtttcagtctgacccttctctttggtaggagcagaaagagattaaaaataaaaggggcaaggggtggtcaagatatagtaataaaagttgtaaggagcaagtctatcccgataagtttgaaatgtgagaagaatccatggcttaggtgcgctgtgcaaatttgctgggttacttcatttgggaactaccttatggatagactattataaggtgggatcagaatgctttgacaatatgataactccagtatctttttaattaccttattgtcatgatcatcaaagtagctttggttatttttcttctatctgtacccaaaccatggatcactctctccttattttattctgcatggacaagaaagaaatatggtggtagattctggaaatactgtgattgctgaagaatagaccaattccagaactcagggacagcctacagagctggagcatagtaagaaaaataaggaaaccacattcagaggatcaggacagctgttgatgcttttatccttggcttttatgccaaggattaaacattatgttatatgaaaatcattctgcaaccatataaacaaaaccataaagcttccattaagtaatatcccatgcatccaatatatgatgtttgaaagagatcattaatacattggtatgcccaagtaatactcttatcttgcattctcatactatagaactagaattgactcatattgacaaccaacatgctttacctgagcatttaaatcttgacttcagttaaccttatccattgatatcctggctttcttctccacatgacttagcccaatggctctcaaaccaaatgggcatatgagtcacttaaagaggaagtaaaagacatgttggcctaggttcaactgagtaggtgagagcttgggttgttttatatttaccaagttttccagctcattctaatagctaccagtgcttgtggatcattagaatagcatgctcatctggcctcccaagagtgtatttaatgagtatgtcagccaaagaggctattagaaacaccagctgagctttttaaagtttaagtacctgtgtattaactttgtagatccttattcatttaacctgaggaggagctcacagatgtgcaaaagaaaatctccatgagtgattctgatgagctttccaaatgaaggagctatgcccaagttcttgaagtactctttctccaaattttcatcagttgtgaggaatgcttctcctgttaccctttagaaacaagttaactcagaatctccctggcataacagagttggcatgaggaatgcagggggccttgtcaatttaaatttatattttaaaaatttctgactccacattagatcaactaaattcgaatttcttaggctgaggttcgtgaattcacacttttatcagatttactagatgattctcttgcacaccaaattgtgagaacctttgggttggagctttctttttttaaacaattttcaaacttactgaaccaaaatcttcgaatcctggggtacatatgtcttaaaagctttccaagaagatttttaaaggtcattatatttaggaactcctgtattaatatgtaactcaagaaaacccatctctgaattgtttttcctaactctagttcagtgactgtctttggatttattagcacttagaaaaaatatatcacacttagattttacttctgaagatatttcttgttctgcctccagaaatgtaagctgaacaaaagagagacttgaatcttctgtttttttttttttttttttttttttttttgcagtgcacctaaggctaacctgttatgggctatgtactatttgcttcataaagatttaaatgaatgacatgcagttttcaaatttacctagtttcaaaattatctcaaggtctccaatgtcctgataactaacttaatcttacataatcccataaaaagaagcttaataaagtgaaaagttatattcaaatattttattaaaacttactaatatgtgtaaaaggttttgtaaagtggaaaggattatctgaatgagtaattgtaaactaacaatatattttattaatttacctcactttttgcaactctaaacaaacctttttaagctcactaaactcttgcttcatctgttttgattaggaattttctgatctgaaaaaatatgcggtttttaaaattaacatttatagactatgtagaaatggagatacacttctgatgagtgaaatgtttattaaatttaaaattgcaaaaaattgcatgtattgaatgatgtaatctaaatgcaaatctaaataaggattggaaaggaaggtataaaaatcctttttattttgatacctcacaatctgaatgcagaatgatgatggatttctgaagaataatttttcctttctttttgttatttatattgcaagactttattaatgtataaaaatgcttttaatatttttaacatataagaaatataaagaaaatgctacaaatagccacacgttcagaaataaactacaggtacctttattttttaaatcatttttacatttttttgtaccttaacatattcccagaaactgttacattattattcattttttgtgcatttaggaaaccagacaaatgtccttgtaaaaaaggaaacagaacattaaactttggccccgtttcctaggattttgaagaatttatatgttagagctgtcaaggatggaatacagagaaatgagataaatgaaaatgaccaagtaaccctacttaaacccctttgttgatggtgtcttctatagtagggaatctataatttcatttttttactctctaacaggccagaagtgtcagatggatttataaatatgctatgaaggacacaagatgaatcatttattggctgcctcctcatttgtgacaacttgaattctatgctgttagggcttgcttttttattcctgcacattttttcttctccagcaatttcatcttggtgtatatatatttttttcttttccagtacttattaaaattctcactaattacatttatacgtggacaacacaaatcaaactattgtcatattttgaagactgttattatctacttatatggatctttgaactcgataagataaaaataatttgcacatgttgatctgtcaaaaactgtgatatatatgaaggtaaattataatacacaactataagaattttatttgtttaatgtacaatgagcttaaattaattactcaagagcacagcaataagcaatggtgttgtggtcaaaaatttaaactcagattatttctctctgtacgtgcttttcgattaaacttgtgcgagagcttataatggtttgcctaggatatcaggaaaaacaatgtaattcttgctggagaatcagttttacacaataatacctaaacattcttatatgctaaataaaacctggatgttttattacatagactatgtatttaacataatttaaaaaggctaaacactataaaatataaaattagcacaatttacaaagattaaacaccagcttttaagaaaagcttacactcgtagtggggtcataactaattatatttcatagatcatcctttgtcagtaaagttttggggcagtaaaacctttggacatttgtggaaaatattgaaaagcgtttcttcggcctatcttactttcttctcatggaaaaatgaaagaaatgctccgaacattcgctctgcttatgtacactgacactaacactattttgttgcccaggcacatactctagcaaacacagagtaaaccttaccttatgacagtgattacagagtcaaatactaaggcagcaagggcaccaattttaccctcaaagtgtggaaagtccattgccgagagaggtcaagtagatataaaaaatataaaataatcagtctaatggaaatatgttgaaggtcaatgggaaaatgaaagcgcacataggtcacctgaagattcatgaaatactgcataaggagtgtggcatttgagctgaaatttgaaggaatgaaggaatagcagtaccttttctgtcagtcaaaggtgtgtgagtgggtcttggtcaaaggaaaaatgcagagatgattgattgtgggtgggaggttctgctaggggtgggattgttgtgttattgagagaacaggatgggtgaaggcaccagattgagagcaaagaacataggtatgccggtctcatggatggtaacagagcagcaaaactgagggagaaaccccattctgtacatttttatacagaaattattctcttgaagatgaaaagtcactaaagaattttgagaagagatgtggatgtaaacaataacaattgcctacttcctaagcaatcacctgtttaatttgatgtgattatccctggggacttcattctaaagtaaactcacattttatctattattgcctcagggaaaataaaagtattaattcaagaaggatgtagtacaccaacaaagcataataactataacagataccactggttgcctagcaaagaaccatttctccttttctgcttcttaagggaacttgaattttttatccccctccatgcttctctatgcagccttgagcttccatggaagcagaacacatttttaaatgcagagggtaaacacaactggtctaagccaatagtaaatgatccttataggctggggcatatgacacatttgatagaagagatgtgaaaaggtatttgctggcaataggcagaagagtggggattgtcataaaatcttaatcttttatggcataaaaagaaggcaaaatcccctttttttttctactgggtatctcgtgcctagatatgtaacctataattacggcagacatctttcaatattgagggattctggccaaggacaaacctaagataggacattgggcacaaagatgaaaagaacataggtccctgattatgtcattgagtcatccatgaaattctacaacttcttaacttcttatttgtataataagaagcctttcttaaagcctaagcaagttagtttcctgttatttgtggctcaaagcatatcaactgacataattagaataattaaatttaaagcttgaaaggattcaaaattcatagtgcacatccttcttgttttgtagtagaacacatggaagacttgagaaaataaatgactgaggtgggaggtcaaacgattaattataagcagaatcaggcttcctaagttccacaaatattctgccttctcatctttaatacatttcagatttcttagaagatcattatacaaataaaaccatccagaagagtatgtgacatgtaataaatactgaataatacctgactgaaaatatggactcttatttccagctttgcccaactagtgaacagttttgatattaaccatccaattatgacagtgagaaaatatatgctacttacaactcactgagtcatacatgtatggatttataggttttcctacatgctttcctctatgacgtttacacatttttttaaacgataatcagatgctatgtcccttcatctactaattataacttaatgggaggtagctcttaattttccactgatgggtaactaaagttttgatggggtgataaggatatacacatagtatagaggacttcacagatgaagacctttttgtagctggaggatgactgtagaccctacaagctctccaggactataaatttcctatgggtccctgttagctgactgtttcccaatactagcccaatgcttagtacatacagatgcttagtgggttttgttgaataaaataatgggtatctacaataaggagttgtgaataaaagagagaaaaaggcaaagacactggggaaagtcagttgagaaaatgcactatgcccactttctcattttgctaggtaatggccattatacagagtttaaagtcaattcattttcttaattcttactctgtcattgtcatcatctgcagcgagtaataatagtaataatcctctaactatctgcacatgtatcaacacagatgatacgctagtcatttgcgaatgttataagtgtaatgaaattaaaaccattgattaaatggcacaataatttctacagagcagaggggaaaaaaaaaaggtatttaaagggaagaactgagccacaaagtaaagcttactttaaaatatacatttgagtttcaagtttaaaaagtcagtcaccaaagatttgtatcatgtgataacagtggcagtttattaataatctgtcatgtaaagctgacatattagaagctgaattctgctcagctttacaataaaatcccatccattttattgctaccagaattaaatatatgccattgaaaggctttagtaagcttaaatatgttctaaagctctttttttttccctaacacttcgttatcaacaagtcaaatcgacaaaagtctaatctcgattttcccagatatccatagtatatcaaagagggagcaagataacatacacatttttatagaggttgataaagtttgcctttagacaaataggaaagtcttagaaactaaattacttgttcctgacatgtcgggaacgggggaaggctagatatagtgtgtaaatcatatagagtaagtattaaaagttaagcctaggggattcacagatggataatttatttaatcagaattatgtgtgagctagccagataggaataatctgtccaaaggtgtgaagaggtgataatccatatgtattcagactaaaggatttaggtgaggcattttgtaacaagtaaatatcactgaactagtttttcagaaatatcagttgaaagtgctcatcagaactagaactccatttttcccatatattttttagggaaaaaaaataaccccacagaactgcactttaacaattctgtgtaatcaattcattattgaataggaagcaaaaatttccagaaagtatttgtgcatgcagtgatctcaaattcaaacttcatttatgttaccaaaactttttacccacgtctttctaactgtattatcatcattattattattatttggacttcaaacggtgtttgtgacttcagattagacttctattgcataattcagtatttaaattttgggtccaaataatgcacagtaattcttcagtttccactattttccttcatgcaggatgttacttgtatgtcgtttaacttcatttttccccaagccctgtcaccactgtgaaaataaactaagctaatttaactggcatcaattacctctatatgtggtttgtgtttcttaactggatttttccctttaactatcacttacattcagggacacatgaaataaatcctgaaatatttatttctataacttatgctctatttctcagataagctcattatttatctttttggaatggctggtggaggataagaagtattagtgctacttaaagtcttagaaccaatcttcaagacagctatttgtgttttacctttgttctccctgctttcattatgacacagagatcgataatttagaaaaagtgaaaaacatctaattagctcttgattattgcgctcaatatttcatcatgtttggctacctaaaacaggcaagaaagcagaaagaaaaaaacaggcaaccaaaatcttctgaaacaaatcccaagctcttcaaatatccaagtatatggattaataaaattccatctttagtttcaaggattttaatttataaaccccaacatttctttattacattgtttcaatattatgaagaactgaaacacgttagctaactactaaaataagatactatctactttgctgttctacttccattgtgttacattatgagttactcttaaatcatgacatggcttagactaaggacccagagatgaaaaacaaacattctaagaacgtatttaaatgaagattgttacttcatgaggaaaaacacatgcaattctaaaaaggtgtatactgcaacctgtggcaaacacatgtatgtttgcataactgatacaaaatttttaaaaataaacaatcctgatttttataccatcctttctatcagacacaaaataagttgtgtttttggtgaaaattttaaaacaaacaaaaaaagatatgtatgtctctctctctcttctctctctatatatatctcacaagacaagtattaaataaaatcttaatgaagcgcatataacagtattctgtagttaatacttaaggctgtatttatattatggctgttatatgcttatataacttattagacataatattttagaagcaataaatatattttaacaatgattacatttaaatgcttaaaggttagcctaatattctgatattttaatgatgctgtagaacattcatattgcatacttttggttcccttaataatatcatatggaaataaattatcataattcatttaggcttaaagtaaaataattttgttatagtgctgaattttcatttcaaaattgtggccacataactaattgttgcatgaaacttataatgggcaattcataaatatatatatattgatttaacaaaatactacatattgcttattttaatagatacattaaattattaaataactacatatcaatgtattaatatttatgtatgaattttataataaaacattaaaacatatacagagcaattacaattctaatgcaaatctatttatcttaaatgcacaaggtaataaacatagaacaatgtaacacctggagtccattaactgtaaaagtttaaacgatattatggtttagagaaaccataatatcttagtaacaacagataaggcaaaaatatcttaaataggacataaaaaactttgatcatagaaggaaaatgaaaaaaccctaataaacagaaataaatcaaaattaagaacttctgttcatcaaaatatatcatccagagagtaatgagaaaatccaccaaagagttgaatataaagtgcaaatattcagtggtgctctggtaaatatttcacaactagctctccagaaggaaaaataaagccattatttttggtgtttctcaaactatgttgtgaaaatacttctatcatgactgattttcaaacccataattgacacttccataattggctatggttagttttgagaaagtatttaagaatgtaagaatgttagtcgaagaatatatttgaatcaggattattacttcatgaggaaaaacacatgcaattcaaaaaccatacataaaaggacaatgtaatctgtggcaagtacacatttgcagaattgattctgaattttaagaaagaaataatgctgatttattaattggtagttttaaatcctctattggatatatacaatggcatatatatatgtatatatatatatatatatgtgtatatatatgtatatgtgtatatatatatcatacatatatgtatatatatgtatttatgtataaacataacccgatatgtatattatgtatgtataaacatatgtatgtataaacataacctaataataaaggacaaataatctagtaagaaaaaaaaggcaaaagttttaggacatttcaacgaatagtgtaaccacatgagaaataagagcaaaaacaaatgtttgatagcattaatattcaatatattccaattataatacccctattcacatacccaaactgctgaagttaggatgaaaaaccccggtgtcagtgactatagggagcaactgaactcttatatcctgctcctaaaactgataaacacttggtgaattgtcaatatgtactgaagcagaacatgagcatatcctatgtacacaacaaaatacatacatgtgttctccaaaaacacatgttcctgatatccaaatcaacactattgataaagccaaagtctggaagctacttaagttactatcaatattagaaagggttaataatttggtctattcacagagttgaatactacacagcaatgaaaatgagcaatttaccactgcacacaattttacaaacataatgttgagcaaaagaaacaaagcaatacctactgtatgatttcatttatagaatacagaaaaaggagcctcctttttctatattctagaagcaaagatacttcttatgttctgtatacttctagaactgaagatattgcttatgctctataggtttagtgactagaaagagtataacaggactcaaagtactctaatgttctttttttaaaaaaaaaaaacttatgtcagtattggttatatgggtgtaattcattttgtaacaattcactaaaactgcgcacttaagatataagtaattttctctatgtatataagataattaaaacactggagataatagtaatttttagaatacttttgtttcttattataaattgaaataatttatttaaaaagttcattcaggtatatttgtgaaatataatttaaaacttaaaaataagtacttggggataaaattattactcaaagtgtatctaaataatttctccaaatttctcccattatcagcaaagtcctcctggtagagcagaggaatttcactttcctcctatatgacacttgttttaaacaatcctatgttatgttgagtgtttctttaaaaagtaatgaaaaagtataccttatagttcttagagatggctgttatctacgatcattttaaaacatctttttcaagatacattgcaataatgctatatgcccaaataggagttttaatcaactgcctttgtgcttccaaggatgtcatttcccccaagtatagaatgtatgatacaaatgcccacattatctggattttatatatttattataaagtaaatctttattatgtttactaataagcaacagataaactctgaaagttggcttagtgaaaattaatttcatcagtttcaaaacacaaataaactcatatttatgtatattctgtagtcaattattaatataatccagattcacatttttgacaaaccttattgaatacatataaccacagaagttaatgaataattaaagccttaaaaattgccttagaagtcacttgttatttattaccatcttatttccatagttacatactttactctcaacttcctggagctctaacatcatgcttcatggggagacccaattttgatacatcttgacaggtgataaaataagttttactttcaataactcattgccatcaaatagacttcattatgaaaaatttaatggataaaattgttattcatgttcaaagaacagttttcagtggtatcaatctttacctttgcgggacatgccttaaaatttacatagaaatctatcaaagactatatcaaataactgtattactataatctatccaagaacataaacattttgatagaaaatatcacataatttcttcaacatttatggttaaatatcaaatgacttatttgaatttcctttacttaaaaaaaactggacatgatcaaaaagcggtaatgaaaataactctaaaattaggtaaattaattataatcttaccgtaagctcacaggttaggaattcgaagaaaaagttcaccaccctgagacctagaaaagtataacacaaaacattctttattagtactagtgttcaatttaaattaaagaaccttaagaggttagtaattcaatatgagaaatgttattatatgagtaattagtgtacatatcacttgacaaacatttttgactacagtatttgtctgaaatagcattaccagttactcatcttacatcaaagtattgtgatttgggctctttaatgcagtgatgacaaacaagcaggcaattattgtccacttgcttcttgtaagactatagctgatggataacatttgcaagcttaatgtattttgctagataaccttctctgttacattaatttaacaatgtcagatataacatacatcccgatatatacatgtgcaaacatgtacacacacagctgtggctatcataccataatcgtactttttatcttagctttatccattttaatcactaataaataactatccgtgatatattctataaagtatgtaataattttaaaggctgtacagtactccatcgttcactgtacatcctaaattatttaagatatttgatttaataattatgctagttattattattgtctttaaattgtctttaaaatacgccagttagttaccattgtgtgtgactttatataatagttactgaggccaggtgcggtggctcatgcctgtaatcccagcactttgggaggccgaggtgggtagatcacaaggtcaggagttcaagacaagcctggccaatatggtgaaaccctgtctctactaaaaaatagaaatattagccacctgtggtggtgcatgcctgtagtcccagctactcaggaggctgaggcaggagaatcactggaacccgggaggtggaggttgcagtgagccaagatcatgccactgcactccagcctgggtgacagagcaagactgtctcaaaaaaaaaaaaaaaaaaaaaaaaaaaaagaaagaaagaaaaagaaaaaaagaaaaagaaagaaaaagaaaaaaaaaaatagttactgagccctttgtaaaagttttctcattttggtgcagtggtaactttatcaacacacattactcgccatcaagtttgtttaatgcttgatagatactattttatatgaacaagaaaagaaaactaaatatttaacctctgccctcaaagaagaaattagtagtacttgcaaactctttagaaaattcataaatgactggtaggtctacaagtaggtgctctactgtgtaacctctagctaattgctatataatttaaaatagaaaagttataatagattgagtcttttatgtcaattctttaattgttggtactgttttgggagactgtgtttttctcagtttatgcattaaactgtttcaactagtttctaccataattgaagaaaatagtttatataacttcatttatttcatgaaggaataatacttcattcttaggaaggatgatcatatgtgaaagtgaatctgacagtaaaatgaaccacttgagaggtgatataaaatgtttctctttttgatgaaatgttagaggaaaacaaaatatcactatcacggaggtgtaaaggagtacattacaattcttccagtagacctcccgggctcatttgtacagtatcactttctgctttcattaaccctccaggagcaaggatagagatgatttcaggagatctattccttattgacatttgtgaaaggagaatcctctcaaaaaaatctagtgtgatttgagatgctcgtactttaaaaagtcaatcaatgaattagagtgaccttctttcttgccctccctttttatctagaggtgcagcaaattaaattttggttaaatgttaaaaggttgagtattagaattaacatttggctgaagctaaatattaccattgtagaataaacttcttggatacacaaattagaagttttaattgttattactattttattactaaaagtttaaagtcaagctttaaggttttaacattatagcgcagaaacaataatttattttagcacgatcagatgctagattactcctgcaggcactgtgttgcatatttgcaatatcaaattgacacttttaaaagaatgatggaatttcaacataaaaatcacataaagagatttatgtccttttgttctatctagaatgtttatctatatttgaaactgaatattttgatattaacaataaatccaaaagacatccttgtttgtattactgacgttgttacactgatcagatatgttgggtatgtagattgtaagtcatggctcatacttaagttcagggattccagaaatgatattcaaagtatttgactagttggtcttccaaggacaaatccaaatcagataggtaattttaggcatacaagaaggtcaaagcagaaatacagtttattccaactttaatttaccattttcaatgatttgtggagcttgactcaggcaaatatacatttaaaaaggaaagcattggctgggcatggtggctaatgtctgtaacctcagcactttgggaggctgaggcaagcagattgcttgagcctaagagtttgagaccagcctcggcaacatggagaaatcccatctctacaaaaaaatacaaaaattagccaggggtggtggtgtgtgcttgtactcccagccacttgggggcttagaaagaaggatcgcttgaaccctggaaattgaggctgcagtgagccgagattgtgccactgcatccagcctgggggacaaagtaagaccttgtctcaaaaaataaataaataaaaataaataaaaaggagtttattttaacacgatgtgcataaataactattttcagaggagagatttatgatgaatgaccagttattaaactgtcagagactttgacactaggttagagttttatccttgataaattttaagaaattttatttcacataaaattctagccaaataaattggatcagtccgggcacggtggctcacgcctgtaatcccagcactttggaaggctgaggcgggtggatcacctgaggttgggagttcaagaccagcctgtccaacatggtgaaaccccttctcttctaaacatacaaaaattagctgggtatggtagtgcacacctgtagtcccaggtacttgggagactgaggccagagaatagcttgaacccaggaggcagaggttgcagtgagccgagattgtactactgcactccagccttggtgacagagtaagactctgtctcaaaaaaaaaaaaaaaaaaaaaaaaaagaggatcagatatacttctctcatttgtactacttatttgaggaacaaccattcagaaagcactgatgttaagccaagcaggcaaaccacaaaagaaattattgataattttataattctggtatcctaaacttaccatgctgaataagacattcttcagagttgtgtttgaatgattttcaaattactacagaaatcttgaaaagttatacattcaagtttaattttttagtattattttagtatttctgtagataaatgcctttaatgaatggatttattggatctatgatgtagtgtttggagaaattcatgaaattggcatcttagatggtgatttcttcctcattaaaaagaattagagtgcattacttcctcttgacttaattttgcaaggagtccaaaaatttgggggagggagaggaaattgaataaaaattatttggaaacctaaaaattggaaaatcattttcaataataattttaaataattataaatacttcaaaatgattgggaataattttaaagacagtttgttgggtttaggaaaataatatttaatcagcaataaatagtactgtaataggatttctacattgtatctcatgtatcctcagttgatgctcagaaaagtttcatatattagagattattttccacattttcacagaagagactgaaagccaacaattgcctgaataaactacaaaaaaatcttactatcaatatgttgtaaagttaaaattgaacctgaagttaactaaattcagaatcccagttaagtcacataccaggataggataatattagtagacaccatttaccaaacatataatgtatgtaagatcctggtctcagtatttttatgtattaattcatttaattctgataattatatttttactttatagataaaactgagctataagtatattgttctttatcatacacatttttaatccaaggagtcttgcttcagagcctatgctcttagtcattacatctctatatgatagttaatcattgtacggcattcttacaagtgctatttcaatgcacatatattcatttattcttttcagttttaggagtcaagtaattatatatttattatgagtctaatatcatcttagtgggctggtcctcattaataactacagttaacatttactgaacacatactaagtgccaagaagtgtgtcaaagtctttaagttcatctcatttaatctccatagcaatcctatcaggtattatgagcatctatgttgtataagtaagaacactgactagagaggtaaacaaatatatccaaggacagagagctagtaagtaatatagttgagtttttaaaataattattttaatttttaagatctggggtacacatacaggatgtgtaggcttgttacataggtaaacgtgtgccatggtggtttactgcacctatcaaatcatcacctaggtattaagcccagcatgcatgatcttttttccctaatcctcccctgccacctccacacctcctctaacaggccctagtaagtgttgttcccctccctgtatgttcagctacagttgagttttaagcacaaactctcctacccttcagttagatgtagcttagagatacagattgtttgtgtaaatttgaggggtataagtataatttggttatatgcatatatcacatagtggtgaagtcagggcttttagtatgtcctttaccagaataatatccattgtacccattaagtaatttgtcatcattcatctccctcccactcccttaccctctgagtttccattgtcaatcaacccaagctctaagtccatatgaacatattatttagctcccacttataagagagaatatgcagtatttttccttctgtgtctgggttgtttcacttaagatgatgacctccagttccatccatattgctgcaaagacatgtttcatcttttttatggccgaatagtgttccatactattgtgtgtgtatgtctgcgtgtattacattttctttattcaatcatttgttgatagacaggttatttcataactttgctattgtgaatagaactgcaataaacatatgagtacaggtatctttttggtacaatgatttcttttccttcgggtatatatcaagtagtgggattgctggatcaaagggtggttctattcttagttctttgagaaatctccatactgttttccatagaggttgtactaatttacattcccaccaacagtgtataagtcttcccttttctttgtgttcttgccaacacttttttgtctttttgttaatagccattctgattgatgtaagatgatatgacattgtaattttaactttaatcattttctgatgattagtaatgatgagcatttttgatgcgcttgttggccatttgtatgttttcttttgaatggtgtctattcatgtccttagcttactttattttctttttttttttttttttttgagacagagtcttgctctgtcacccagacagaagtgcagtggtgtgatctctgctcactgcaacctctgcctccatgattcaagcaattctcctgcctcagcctcctgaatagctgggattacaggagcctaccaccatgcctgcctaatttttgtatttttagtagagatgggctttcagcacgttggccagggtggtctcaaactcctgacctcttgtgatccacccacctcagcctcccaaagtgctgggattacaggcatgagccaccgtgcccagcccttagcctactttttaatgggatttgttttgttgttgttgttaagttgtttgagttcattgtaaattctggataaacagtccctgtcagttgtgttgttgtcaaatattatcttccattctgtgggttgtgtgttccctgtgttgatcagattcttttaaaggggaggacatgtgaaagaaatagggggcttgcattttagtcaatttagaaagaaacccaaaattgtatcttcataaagcagatacataactatattctcagttttttatagatctgtaagaatagtaaatagattagaaagcttctagtcttacaactctaataaattataattaattttagatagtgacagccccacagtacctagctcattaaatgctaaattgaacttatgcattatttatcagacatgtcaaattctagagttttctgccaataaattttagaatacataatattgttacaaaatatgtaaattgtaggtaatataagaatgattttggcataggttatcagaaacactttcttgcaaaaccagataaccttctatccatttagaaaaatgcaaataaatgctttaaaaaataacaactttgaactcttatctttcaagactgtgaagcttatcatctcagaaacacaattcctattataattgtaggcaacatatttgggaaaaaatgtagactgtttcagtaaaaccttgcacattataaactctcgataaataatcaatgaccatctaagtgatgcaataaagaaataataactggatagacccttgggaaaaaaaataccccgtgtttaggtgttagagtttaccttatcaaaatcttctcaacgtcttaatcaatgcctaacttatttcttacaaaaaagatcttaaatcttgggaaagttggaatgactggcaagtggtgagactagcaaactatcctatgaataatgtatgtaaatctattgaatacaatggtatataatgcttgttaagtaatttatacatttattccacaaatatttactaaacaattatttaccagccactactatactataatgtgaggttaaagtcacaaataagacaaaaaccataatagatttgatattctggttactaatgtttaataactgtatattttattgccacttcaaaagctactagacattgtacaattgcattctataatctcttccgggatttttcttttggtattccaaaatctagcttgagaagttttatataagtttgagtgggtttaacactatggcagaaacttctagttatccctcaacatccatcttactttacttattttttgctaggttcatgaccacttggaataagacaaccatccttagtctcaatgccataagattaagttctggcaaaaggacacatgtagacgttgggtaagcaaagtctaaacagtgtcagtgaatgttaagaggcatgttcctctttgtccctccgtccctaagtaaaatttctggttagaatgcagaattaatgcctggagctccagcagtcatatatcataagaggccaccccaacctctttgtttatcagactcccaagtagagcaattaaaataggaggaatccagatcaaatgacagtgtggcatgttatctcagacttggatgaattatttcttgaatctgagagataaataaattatatggaaaaagaaagcagattaaagtttatcagagaataaaacgtgggaggaatggggaataactgctaatgggtaaagaattacttttgcgatgatgaaattatatctcaataaagctgttatttttaaaagttccttacattactctattagtttatctcttaaataatttaaatgcattttatattttacaaagatatttgtgtggtatattcttctggaggctcaaatttgtctgaatttctgaacctgctataatgtattaacgtgttagtatatattaggatgaataaaataagaaaaaactataatctttgtcttccattgtctaaaacctactggaaagaagataaagtctattcatgaattaacaccaagaaaaaccattaacctcccagagcatttgttggaatttcattatacaattgaaagtcatttgaaagtttacttgttaccacataacaaaatatgtgattaaaaatatctacagaaaatgttgccaataaatagtataggctggaatttgtattttagcctgttggttgtagtgcctttgatatcttcctcactgaatgaatatctgttcctaaattattctcacaaaatccaaaatgtcaaaatctctaaataaactttcatactccttcaaaaagtatacaatgaaagtgattacaaatattttgggtatcaatgatatataaaataacatcaaacaactcatttagcaagtgggaatttatgtctcttaactgaaaatttatacatccttatgtttaatattttgactcttaggcattactactcagaaaaatgccgctctaaattattcaaaacactaaaatcttattaaaatgtttgatgctgtattgaaaagattgacaacaataacctcaatctataaatgggtgcattccaaaaacgtcctctgaaccctttttcatgaatgacattgtcataattttccttagttgacaatgagccaaactaattggtaaaacctaaagaaataataatgctcatcataaagttgccttgttatagataactacgcatttaagaagaaattaaaattataaattgtaactcccagcataatatactgatcctttcatttctggagatagtaatattgaaaaatctgtaagtccatgtgaaagttcacaagattggtatagcctttatgtaaattcatggtaactatggcaacattcattttcattttacttcagctgctgcactaaagctcagataagcttggagactcagtcttatagttgccattatgactagcgggtccttatcactccctattctgaaaatatacagcagcatttgggtgccacttgtccctttctatcttactcgccatggttggctactttaatcaagccgtgaaactatcctgtattctcttcttccttcatccttaccatacttttttgccaattggcaattcagaggcagaagctaagtatacagtggtaactctcaaactcaaatgcacataaaaatcacctggatttttgttgaaatacagattctgatagttctgccttgttagaaatacagaatctcagaccccatcccaaaaacatgcatcagaagcttcattttagtaatactagcaagctatgtaaagcttcctaagccacggtttgtttatctcagaaatagtttatatatatgaagtgccctgcaacctctgtctccccttaatctcccctcactcaaatctacccaatctcatttagatgatgcttcataaaccctaccaaccttttaatttttggaaaagaaagctactacattaaaacattttatttcatcaccattattattattattattatttgctatgctaccacaaaagacctctatgttgctcatgtttcaccatcactattctttctctacagttacctaaccattatattcctaatgctgtagccactaaagtaaaatatctccaactccctcccattttgtacctgcttctctctcctgctatgacatgacttgttcacatattaagtgtatgaacgttatccatgagaacaacttcaacttcgttattctacactttaaaaatccatgtgcatcttcatccattcctcttctattactttatttccaagaaaggatctctctcctcctcgcagttttgctttcatccccccttttcagtcctgaattaccatgcaccctttatgctttttctaatgacaacaaatttctcattctcccctttatctttattttcaacctgtaatgtcaaggcttatctctctggagaactttgcccttgaccatcctgagtcttcaagctttattttcttcttgtgtggatgctttacacgtcttatgatttgcaacattttttttcacccaaaaaattctaatgatgccctttattgcacaaccacaaggatgccaagacatcaaataccatgttccttttaaagtcatcatcaccctggaaaatttacagcacacagaagttaaccacttcttctttcataaaattctctttttccaggaattacaagctgccttctagttttggattattatcatttttgtttcattatgtttttatgttctcatgattacatcttattgtttttgcctttattttctcttcttcccagtactttgaatgtaaaacttcccagttttacagcatgtttatctcagtagcagacataatgcctaggggcaaagctgtgctcagggatgtttgagtgaatgcaacaatcaaggtatgaatatattttcggatcctgtcctttttctacttattcctatgtgaacttgtacttagacacttggttgaaatcttcatctttacaagtttcatcttcaattcacatcttaactttccaaattagtatttctagacctgaatgtatttctggcctaggtgctactttccaaacttcttggtagatatttctaactatatattgcacaattactttgaattgaaaatgtccaaacaaaatttatcctcttcctgctaaaacccactttgctccttggatttttctttctattagtgacacttctaacttgtcattcacacaaacctaaaaggctagtcattactgattcttccctttcttttcagcccttcatccaatcatttttcaagcccaacaattctacctctgttgtcttcatgaaaatgaagaaagaccatccagatgtgaatacgtaggtactatttatttgcagttggctatagcaagggattcagccatgcatcatttgcatttgccagagactcaaaggtaggtaggggagcaggaaaatctaacaatgaataaaaagggaaggcttgaggtgtgttctgattggagataaattaacatggagaaactggaagcaggctaaccagaagtagagcaacctatgtgtttgctttgggagatatatttggcttcctctggttagttccgagttggaagcagtggataaaaattaaggaagttggtagtcagtgacctgaaaatgtccccaacatcctggccattctgaaccaattgcagaggttgtggtttggtttcctgggctagttgcggtggaggtggtaggtcagagttttgtcacatatgttctggctgttaaccatttgtatattcagtctctcatctctcatatttctttttccccttccaattacagggccatccctcaacacagccagtagttttgctgtagacctcattatttggttcttgagatcagattgtctcatccttctacaaccaaagaagagtataatgtttgacagtatattggtttaatgaatacttactaatacaaacaaatctagtataattggcataatggaaatgattatgtagtcataagtacgcagtaagattataattcttgagttgagttttatgtaccaggcattttttagtaataaaaatattctcattgaacattattgcttcttctgtcagttgttcaatatgaaacctatacaaactatattcaggttaatttagttaatctcaaggcacaacattatttcctacaattctatgaggtgaaacatctttagttgaataaattaaataccatttttaaaatagaaaaacccataaatactcacttttcgctaccatttatgctaaataggttggacattgataaatggaaagagatatagtcagagaacatctaaatttttagtcctgtgtacagacctaggccactctgaggtatgactgttaaaaacagaggggaaaaaagagatatatcactttgacatgatttctacaatctctgattttattagtatatcacatttattccattttatcagtgtttgaagaagtaattggtaatgatcttattcttcttcatcaattagcaagcatttattgaacatctatgttcctaagtgtcatttcagatactggagagcataagtcatcactctctcctgtgatgttgaattaaggaagccagtctatcatagcaatgttgaaaaatatgagaggaggaaatgtatgtgtatataggtaacaaaatgtgttatgtgaatataattgttgtaaagaggggagacaaaaaaattattttagaggaaaataaagctggaatcaacttcaggcttctactattttagttgtattacatccagcaagttacttaacttaaggaggcctaaataataattataattgttaatactaatatataagagataatagtaatgatataagcaaacacatgtgcacattacatgtgttttagggtttttaatacactaatctatgaaatcctcctaacaactctaagtggtaggcgcttctattatatttattttatagacaaattaacttaggcacagaacaatgaaactacttgcccatgggcatagatctagataggagaggggcttgctaatgacacagatttatatgctgttagaactattaataggtaatttaattgaagtgcccactatggtaactgattcccaatggcagcccaaaaaagaccagtttgcttccttctaagtatgagatactacagtgcttctcaaacttcagagtacatcataaaggctgggggtctcactaattccctcactggggaatgggatccaaaattagcatttctaaaccaagttcccaggtgatgttgatgctgctgttctggggatctggatggagctggaggtcattaagttgaaataatctagtcacagaaagacaaatactgcatgttcttactcatatgtgggagctaaacaaattgatctcatagagaatagaatggtaaatagtagggactgggatgggttggtggttggaattggaggataaagagaggttgattaataggtataaacacatagttagaagaaataagttttaatgttggttagccgactaaagtgactatatctagcaacagtattttgtatacttcaaagtaatagaaaagaggacttgaaattataccaacacatagaaataatacacaagatcatggatatctcaaatatcctgacttgatcataacacattccaaacatgtaacaaacattcatctgtacccctaaatatataaactatcatgtattaataacagaaaaaaatagacccagtgaagctatgggacctgcaaggattttaaccataggcagcgataaggactaaccttagtccttatcgctcagcagaattggaagacagaagggagaaaaaataaagcgtcttcataaatgacctgctgatttcagttcattcagttcctttattcatggcaatgtttgcttctactgagttacattttctattttgacagtatgcacatttagattggtcattcaaactgctcagaggaaaaattgaagacatgtctctgggagaacagccaatcaacttaggcaagggggtaatgaaagtcatagccacttcatgtgccaatccaaattttatactttgggaggggattttctataatatggtagtttttgattactcagactttgatgatcaagtttatcttattagtgaaagatagaaaacccaggaatatatttcttaaagttgcacagaaataattaggaataactctgaaactaatattttttaatatccatgtttatgaaggttggcaattatattacttccactaccagtccttgaattgttaattagagaaaaaagtgaaaagacaaatgaaatgttacgggaactgcatcaatatgttttctaaatattttactcatcaatgtcatcattttagctgagtataatgaggaattattaagagccagagcttttctatgcattttgaaagcattttatgagttattcttatagttgggttcaaactctttgtatctccatttggagaaactgtgacttagaacattttaatattagaacttgtaatattatattcaaatacagcatttttagttttgtggcaaaatttttgttcaattttaatttttatgtatttatttacaagcaagttgaccacttccgtatgcttattaataatttgaagcaattcatgccatttcaactttcttagttctaggcaactaactggagaaatatttgtttctaaatgtatgaaattgtgaaaactgtgtattagtgaaaaccaatacaacagtagtttatttggtgtgtatttttaaatatttgatagtaaaacatagcacatagtagcatacagcagacaaaatcagtaaaatcctcttaaggattttatacatttcctacatagaaaatttagatgttcttggttgcagctattttttttttcatttatttaataaaatgtctttcccttttaaaaggttcttgttaactcttgtggcatgttctctctttctcttacatatttctttaaaatatagaacaagtaatactgatttgtagcaattaagacaggttgctggtgtttctgattcctcagtaagaccatggaaaataggatttttcttaggaagttaatcagcaatctatggcaacaatcagtacactgtgttccagtgatatttcaaaatgtttaacagcattagataacttttgcagtaattacaattaatattcacaaatatagcaataggatttatgtgttactggatttttaaaaatctaaaatgccatggattataagacaacccattatttcatagagctttacaaaagaaaaaaaagttaaattattccattgggtatgcatcctaatttcagagatgttgaaatttgaacaacaacatgtggtaaacacacatagtagtgattgttgtcattagtagatgtttggagtagtgtttatgagcaagggaaataagcacacgtacacggggcttgtgggagaagatgctgggtcattatttctacaggtcatctcggcaatatctatccaaagcgctcaaactattcatacattgtgattctcattatgattcctcttattcaaaagagtaagcaactcttactcttttgtataagaatgtaacttcttttacttaaaagaaagagtacaaacatttataataaaacatataatgtcaataaaaatacaagccagttggctaaacacattatgcccatcacttactgtatggtgactgtttctattttttaaacacatttacatattaggatcatacagcaaatactgttctatgatctatttttttttccacagggcaatatatcacaagaatttttttctgtattatgacagaatgtgagctcctcacaggcagcaatctttgctccctttactaatatatccaaagtgcttaaaagagagcttaacacatagtgggtacttaataaatgtttataaaactctgtacctatgacagtgttcaaccttgaaaatgaaggttagaaacactgcttacactatgatccccaattttaagtgtttttgtatgaacattataaaaagactacttcttcttattatctgtattcttatttctaatgtattttatgtcttattttctataatgaacatcaattccttaacaattcagaaatattaaacatgtaatttttaaaatagaaatggcttcatatatttattttttattttataagacattcaagataacacttgtctttttcataataaaatgataatcatttacataaaaagagcatgagcttgaaccattcttacccaaaatctgaatcttaggcatattacattctcaaataaatctagaaatgaaaagtttctcccttgcctccatttgaaatactgtttatctttgtttgcttaatgaaagtcccttagaggttaatgatattaactctttctcacgtatgtggcacatggattttcacagaaagtcatttgctttgggtattatcgtgttttggaggaacagaagatgcaaagctttatgtaatgaaacacaaaatgggctccattttggtatcttaattagaatgccttctgtggtaagcagcacgaccccctaaaggtgtccgtgccttaatccctggaacctgtgttaccttccattgcaaaagggactttgcagaagcaatgaagactatggaccttaaaataggaggattgtctgggtaggcccattctaatcacacgaatccttaaaacgaagagaattctctggctgtggttagatggatgtggcggaagtcagagagattgaaagcgtgagagggaggaacctgccattcctgcggtgggaggacatatggaaggcatgaaagggaatgcaggcagcctcggggaccaaagaccataccagatgacagccagcaaggaaatgaagaaaatggatctgtgtcctacctccaaaaggaagtgattaaggccagcaaactgtgtgagcttagaagcggattcattcttacagcctccagggaggaacacaacactgccaacatcttgatgttggccttgtgagaatttaagcagaggacccagttgagctgcactgcatctggaatcctaacctacagaactatgacatagtaaacgagtgttgtttcaaagcactaggtctgtcacaaagtataatggcggcaacttaagaaaacacaaataagccttcaataaattcagtgaatacatatttagctatgtatttttctggcacttcttaatatgtgttctttcagttttaattgacacataagtgtgtatatttgtgtggtacagtgggatgtttccatatgagttacattatgtaatgatcaaatcagggtcattagcatattcatcacctcaaatacttatcatttctttgtggtgagggcattccaaattttattttatagccattttgaaatatacaatacattgtcaactataggcactctactgtgtagtggaacaccagaacttattcctgctatctaattgtaattttgtacccaatcaccggtctctctccattctccccacacagcctctggcaacctccattctactctctacttctaggagatcaacttgttttgattttttatgtctgataactttaaatatttgaagtttagtttttttcttaaggcttttttcaatatggacttaaaaatatttgttctcaaaattatttagccattgtcataacacttgctatgaaataactggagaatcattttcttcactaatttaaaatacaccaataaagcatataaaatcttaggtaaatttatggccttttgcctaaattatatcttgttccatttccatgctgtagatgagtttgtgtgaatgaggcctagataaaatctattgcgaaacaaattcaaacaaaacaaaaataatgcaaaacaaaatcaaacaaaacaaaatatagaacacactgtcgttgtgtttcttcctccatgtatgcttatatgttcatatacaatatgaaaaataattgaagagcaaactcccagtctgtccagtgtgggtggaggttgacattgaggaaaacattatttaacagtaggagaaggtaataaaaacaggaaattatttaatttgggagaggatttgagcatcgagcaaatcaatctgaaatttctcctctagccaactctgttaagttgatactcctttcgtcattccctactcctacaaggaagtgccaatttcctggtatctacagtggattttttccccatagcctacaagcaaacagatgaacaattcatgtaggtgaagattgctaaaaccaatgtaatatcaatagcaacaggattatatggctgtagggcatggtggctcacacctgtaatcccagcactttgggaggttgaggtgggtggataacctgaggtcaggagttcgagatcagtctggccgacatggtgaaaccttgtctctactaaaaatacaaaaattagccagatgtggtggtacacacctgtagtcccagctacctgggaggctgagacatgagaatcacttgaacctgggaggtggaggctgcagtgagccaagattgtgccactgcattccagcctgggtgagagagcaagactctgtcaaaaagagaaagagaaagagagaaagaaaaaaagaaagagagagaggaagaaagacagagagagagaaaggaaggaaggaaaggaaaggaaaggaaagggaaagaaaagaaaagaaaaaagaaaaatgaatttattgagtttttaccagttttgttttttttttgtttttgtttttcccccccctcaaagaaaagggggatttcttgtactgtggataggtaggattgtccacactattttttatggaaacttaactttttttttttttgcttgcttttctttattgcagaaggagtaagaaatacaaatatttgtatgtacatgtgtatgtatatgctatatttatatctccaaggcttgagtattgagcaatttaaatgttttaaagaaaagtaaacatggttttgttgttgttgctcggattttatagcctatagaagacatatttgagagaatatggattttgaggcatgagaaaactcctgataaaaaatgttaatatggagggagtcaccccagattactaaaaagttggagaacaaatgtcaagtgaaggaatgtggaggcagccccacagagcaccatgagagcttagtgaatttgcccaagaaaaaagagaaccctctgtcctaaaagttagaactaggggagaaccaaagtaaaggtcactgaggaacacaatgaaggtcactgaggaaatgcagtcatttttcacctgattattagccacaattggagtaagaatttccattcacttgtaatctgaagaaatcatcccttcttcaacacagcaccccaccaactaattgtgcagaaggagtgacacccctcatgacttacttcagtaacttttgttagccaaagaagatactctaatttcagaagatctcagatatctgtaacctgagaaaaggggattggagccctggctatctattggtatgacaatataggatagtacagtggtacttgtatgtggacaatggacgatagttaatgaggcagtgattaaaattctatagtattcctgttgcattgaaaatatcagttcagtatgaatcattttagaatatgaaagaagatcacttactaatctagaagttatttaaaaaataagcattataagataactgagctacacatttcccaggacacacatgtgagagagtatatctttcctaagatacacatgccaattctatagatgggctatataatggagttaatttaaaatattcctattactatttatctttgttcttatggcatttgcttttgggttcttggtcatgaaatccttgcctaagccaacgcttagaagggtttttccaatgttagcttgtagaatttttatagttttaggtcttagatttaagtccttgatgaatcttgagttgatttttgcataaggtgagagatgaggatccagtttcattctcctacatgtggcttgccaattatcccagcaccatttgttgaatagggtgtcctttcccaatttatgtttttgtttgctttgtcaaagatcagttggctgtaagtatttgggtttatttctgggttctgtattctgtcccattggtctgtgtgcctattttaacagtaccatgctgttttggtgactatggccttatagtatagtttgaaatcaggtaatgtgatgcctctagatttattctttttgcttagtctagctttggctatgtcggctttttgcacagcaaaaggaatagtcagcagagtaaacagacaacccacagagtgggagaaaatcttcacaatctgtacatctgacaaaggactaaaatacagaatctacaaagaactcaaacaaatcagcaagaaaaaacaaacaaacaatcccttcaaaaagtgggctaaggacatgaatagacaattctcaaaagaagatctacaaatggtcaacaaacatatggaaaaatgctcaacatcactaatgattaggggaatgcaaatcaaaaccacaatgcaatactaccttactccagcaagaatggtcatcattaacaattcaaaaaataatagatgttggcgtagatgcggtgaacagggaacgcttctacgctgctgatgggaatgtaaaccagtgcaaccgctatggaaaacagtgtggagattccttaaataactaaaagtagaactaccatttgatccagcaatcccactactggggtatctacccagagggaaataagtctttatatgaaaaggattatatatatattatatatatatatatatatatattatatatattttatatatataatatatattgtatattcatcatatatatgatggataaactgtgatatatatattccaccatatacatatatacatatatatacaaatgtacacatatacacacgtgtacacatgcatacacatgtacgcatatgtacacatgcatacacatgtatgcatatgtacacatgtacacatatgcatacatatatacacacgtatgcatatgtatgtgtgtttgtgtgtgtgtgtgtgtgtgtgtgtgtatatacatatatatatgatggaatacaattcagccattaaaaggaatgaattaatggcctttgccgcaacctcaatgagattgcaggctactattctaagtgaagtaacacaggaatggaaaaccaaacatcgcatgttctcactcataagtggaagctaagctatgatgatgcaaagacataagaatgatacaatggactttgaggactcagggggaaagggtgggaagggggagaaggataaaagactacaagctgggtgtagtgtatactgctcaatgataggtacaccaaaatttcacaaatcaactgctaaagaacttgctcatgtaatcaaacaccacttcttcccgaataacctatggaaataaaaaaaaaataaaaaataaattaaatattcctattagtatccatcacaagggattttgctctttgaagtttgtgtgatctcatggttacatatgtccttatgcaagagtttgtgtttaatcaaaatatattcacttagatataaccatagtacccatatgtgtgcaaaggaatacccatggatacactatttatcattatgcttaagttaaacaaataatttatacattgtatttagtcccatgtgtcaaaatgccaaacttaaataggttatattaaagacatctttaatgaatattttgtgatatatatcagataaaatagcatatcaatagaatattcctgaagaatagtaattctttatgtgtattaaacatgttacacatatattatatagaaatacctttacatattcggtaaaatatccagaggtaccctttacatttccttaagagtcttatagggacgatattatactgaattattttctactgttcactttgtagaaaatcttgcctttttatttacaaaggttgttattgctaatacacagaaatatttttaatccatcactatcatctgatatatcatttgtgattttagcaatgtttttctaagactagcaaaatctacaagaaatgatttattgctagtctcctttcaaatgatacagtgacaaataaaaagctgaattcatatagtctagggtatggttcagtattaaagacttgattgtgtaaatcagtccatatccttctggttggtatctaaagtacctaataggcttgtgtatatgaaggaggcaatgaattgaaataatgttagcttaagttaattctaaacatttgcaaatatagaaatataaaacacaatctgccctcaacttaaaataacttttagaattacaaattaaaatatatgatatcattcacagatcacacaaatcagtatacaaaatttattgttggtgaaactgaaatctattgtttagaaaggattattctgccccaaagaaactgaagggatcagagaaagagaatgcctccagactgacaagtaagtaattggcatgagtggagatgaatagacttatgccaaaaaagctgcaggtaagaagttcccagtagtcattgaaaaacgaatgaaagtaatcagtgagacagaataggccttaaacatcttcctgctctccaacactgtggaagcaggctgagggtggggggaataaaaatcatccttaaaacagaaagtggataaagagaaaaggccaacagatataacctcccccaccgcaggatatcatcccatcaaagtgggaaagggaaaaagacatacatttaaacaaagttaacaatgttcatagctatattgatgttggcacaaaattacactgaatggaagacaacttatacttttaaatgactagcaagtcatgggaactggcttaaattccatcgaggaataaaggaccggttccacagataagtcattaagctaaaggaaaaataaaaacataatgaagttacttttagaaaatatcccttgaaaactgattgttcaacatgattattataaagaatgtctgttataggaatattcaagaggaaaagtaccgtagaactgcaaaaacgaaagcaggagagaattttacaaagctgggggaagtcaacagtatcacatatagtagagaaagaagtcaagaaatgggacattaaaaaggtcactgatttgtggaaaaaagatatgtaattgatggagaaaaagtggagaaaatagtttcagctcagtagtgcgaagagacaggtgaacaagaaataaaggtaacagatacatgtatatattggaatatacatattcatttgagaaatttggcagcaaagtagaaaaataataagatgttaaataaaatggagtatgcgaaatcctaaataagcagtgttgataaaagaataaaatctttccctaattttctgtgatatccaaactaatgtttttgtttattatattttttcatcatcactacattaagattaaatgcaaaaaccatgtatcctgattaaagacctttttcctgcaaactgtcctgccacttgtacaggacttaagttgctgtctggcttgggcaaactgcacacagttagtacatttgtactactactatccccaacactccttcaaaaccaagagactcacgactagaggcctcaattccaccatggcacagaggtacaagaataagagtaaaggggttgccaatgagaaaatagccctccttcctcaaggtggacacagtcccacatcagggctgagttatgcctttcttcacccccttggacaagatgccttaactactgtatatggtagaagaaacaaaatagaaaatggggatgtcgagtaggagagggcagagagaagaaaaaggagaggaaatcctgcctttactattctctctatcctgagctcattattcttggaaaccattgccctacttcagaatcccaactccactttgttaaaaaaacagttacttttaataaaataatttaaaaataataaaaaatgttcatggtagaaaattatgaagttatacagaatacagtttttgaagaagcaactactatagacctactatagaccttttgattaactattttatagaccttttaaaacttctatttaaagaagtcttacaatttttttgttataagttatttacaaaatttatatcctattttttcacagtattaaatgtttatttctgtcccattattggtaagcataacttttaatgcctttccctcacttgtcccatatttaattaatcaatctctatcacagtggcttataagaaagtgatttgtaagaggtggacttgagtttgaattctggctttactaattctcagctgtgccattttggccaaagatttccttctgaagcttcagaattttatgatccagagtgccccctgtctgacattttagctcatcatcacagttcttggttcctaagcccctcatattgtactctttcgaactaatacatgagaataatatttttacactgctagaaaaatggatgatacaatggatgataaatgtttttgcccagagattatctaaccacatcataataagatcttagaatattatttagtacccatgactctatacagtaaatgaatataattattactacatttctagaatccaataaaaggtgacattatatgagtgctttacatgctaggcacaatgctaaagtaatacccttctattatctgagtcccatgataatgtcataaattagtaactcttccgatgctcgttaggaatatagggagactcagccttagaaaggacacacaatttacagatgcccactggctcttttagtaaatgtctgagttgggattttatctgataccaaggcaaccactaaatccatgcccttaaccaggaagcctcaagcactcaagcccttacccgatgttcaccataacagtgttgggcttcctgggctgggtgtggatacagcccttcctccaatatctacagtctcagcttctggaactttttaccttggctggtgttactcattctattcttcaggtatcttaatttctttgttttcatatatttatctttatctttatgtgtttcattctgagtaatttccacaaatttatcttctactataccattttttctctttggttttatccatgtcttaattcatatttctaaaattctaattgctataatcagtatttctagaattcctgtaatttaaaaacactggcacatctctattagcaaacacaagcttaaaaataaaatagaacataggctgccattaacaatataaacaaatgctattaaatatctagttattagtcaaataaagaatatttaaagactttatgaagcaaattgtaaaactcaatttaaggatattaaagatcaataggtgaagaaatatgtcaactgacagaattatttaatattgttaccatctcaattgtccccagagtattccccttgctctatgggcttgtttctataataggtaaaatgcattctaaatccaagcagatgagttacaataaatttttgaaacattgcagttgttatctgaggactgatcttatgttgtttatgtgtgcggtatacaccgactaataatttgggggaaaatgacacgatagaggtacaagaaagcatagaaacaagaaagactttctagcaaggtctttgtgacacaaattatttgccaggataatagtgaactttgcagttggaacttaataatggcaggagaggaagtacaattaacaggtttaagtaaaaaatgtacacaccagtatgtttcttttttgcacaagctcacaatgaaaagatacaactgtaataaattattttcctctgaggatactactcatggatcattatgcattcattcatttcttcattcattcattgtattagcccccgttttaaggtttaggtacatcatcgagaatcaacattctagtctggcacactggcatgtgaagacagccatttattttggtttaaaaagtgtcttacgaggtgtgtggtgttcaagaggaaggaggcataaacatagtttgggtatctgtctgtcagccctatctgacaaccaagaggccctcccctacatggagctggcatcaactgttttgtgagttccctttaactgttctttcttctctgattattctatgaatctcacaagctatgggtagtattgaataacaattataacagaaccgtccatccttccgattttattcactggatgctaactttacacatatatttaaaatccttttgtactaaaatgttactggtctggcttctaaatagttgctgtgataaggatgtgtcaactaataacacaaactatattttttctacttgtatatttcatgatatgtttggtttttaaggtggctttcttgtttttggtttgtgatgtatctaaaaccacctggccattggtaatgagacctggatattttatttgagaaatggctcaaaaatatgacaggaagaacacaatgctgacaaactaattgacgaaacaaagaaaactcattggtatcacacaggataaatacactgggaaaagagattaatatatgtgtgtgtgtgtgtgtgtgtgtgtgtgtgtgtgtgtgtatgggggggggagagtggggagagagagagaaagaaagagatttggaattcagtaattaacttgctataatatttgagttataattacttttgataaaaattttctttttgcatggtcaaagatgaagctttgtgagattttaaacttgcagttcaagctgaaaattgacactgatagttgctaattttccaggaacagtgaccttcacatctgtactctgtagctaaatcagggaactgttacagggaaaattacaaatgtttagaaggaattgatggttattgtttcaccatatataaacatataaacaatacatgattagagccagatcatagatagagtcactgctgcatcctaaaatgataaaaccatgaacaatctattatttttggaagaatggagttagagatatttagatcagcaattcaatgctcaaatttacattctcagttttttgctcaaaattaacactcttattcttaatacaagatatatgcagtcatcataaatatgatccttgattcagtaaataataagggactactgtgtataagaactgttctagatgtgcttttgaatagaaaaggttaagatcattgttctggtggaaactacattacagcaggtggagcagaccataaacactaaatataatacaaaagtaaattatgtagtacactagatggtgagaagtctatgaaaaacaaatagggctaaagaggatttaaagtctttggggtgagcatgtagagaataaatcattatagactcttgggtcaccatatatctgtgaattctatattttctaccactacatacataaaagtagttttaattgaagattggcagatttgtgtgtatgcatatgtgaatatttttgtaggcagatgatctactggtttcatcagactcttgatggaatcatgttctaaaattaaaatgattgaaaattccaatattttttcataaaagcagacaacattgttcacttcattcctattacctttgcttttcaataattgtgaaaaccagactttttgaagaaaactatgttatcattaaacatgttaatatttactttcagtctgaaaaaatatacatgataaaatgcattatacaaatgatttaggcattttaggccttttcaatttgaaatgaaaatgaacttggaaatatttaatataataacaactacagatccctctaatatatttaatttatatttttaaagcaatggtcatttaaaacaacattttctacaatgtgttaagtacgtggtgaaacaataaccatcaattccttctaaacatttgtaattttattccatataagattatataacttcagttatttatatctaaaagaataagagtaattcctgtctcaaaagattgttacaggagttaaatgaggtagtacctgagtaccctcatcgctcattatattcctttttatttttaaataatacgtacctatctttttttcattattacaaaaaatagatatacaagcattcttttgttgtgatggagtcatatttcacatgttgtttctctagtgttactctatcttattcccgtctggataaaagatcttgaaatgttctttcatggagatgaaactgctttcctcctggtcttcttctttataatgaggcctacgatgccagtcataactggtttattatctattccctcaagctatgtctatgtgaatgattcagcaaccacatattataaaattctaaataatttgaataagaaacaacttatgatcctggataaaattatttttttaagataagcaaattggctgctatattttgaaagattaggttgtgttacaaaatacactagtaaaagagtaagaaaaaaaaagactagttcccttaaaaagaattcttgattgaaattaatctgtgaacgtaatgattaggataaaatgctgctaatatatggctagaaggaaataagaatgggcaatgcataagtgagataaattgcatagatagggttcttctgaaagggtaaacattaagactgaacatatgtggtcagttgctgtcggaatagctttatgttgtccatactagacaggaatggggcaatagtatgagctcctacaccccttgcataggcatgagtcagacacatggtcaaaaaaagtataacagactaaacaaattcaatagctgtgagatgtttaagtaccagctttgagaatcagctatggtaccctaatttcaatgtaattagaaatagcaaataaaggttatataagccatattaggctataaaccagaggtccccaaccctaaggacacagacttgaaccagtccttggcctgtcaggaaccaggcggcatacccggaagtgagcagcaggcaagcaagcattaccacctgagctccacctcctgtgccatcagcagtgacattaaagtctgtataggagctcaaaccctattgtgaacagtgcatgtgtgagggatctgagtttggagctccttatgagaatctaatgcctgatgatttgaggtggaatagtttcatccagaaactatccccaccatgtgtggaaaagttgccttccatgaatcaagtccctggtggccaaaagtttggggatcactgctataaagtatatagaaatcctagaacttttagtaagagtaaaaatctgtgaaatacatttttttttttaacttttattttagtttcaggggtacaggtgcaggttttttacagaggtcaactgtgtgtcacttttggtgtacagataatttctttaacataaatttcaactgacacaaagcaagaaatacaactcattaaaattttttttaaattttatttttgctgtgaaatatactacttttaactaaaaattttgtggcattagtttgattaatataattttgcttttattactaaaatttcttttttttctgggaaaaataacagctaagttttggagagttgatccctagtttttcagatattagaacataagccactgattaaactgtctaaatgcatctgggcaattcaatactatttcattgaaaacacatcctgtagaaatgcagaattaatctgttcacacatttaaatgtatttcttttaattcattaaaatatgacaggcacaaccttgaaaataaaattttatttatcaaagtcaattaatattcaacttaagcaagggtataagcatattttgtgagggaaatatttggcctttgtaatctaaataatttatacataaaataagagagatcagtggaattttagttctgattataacaaattatttgtatgttttagaatgtatgctttctgttaaataaaggtgttctaacttttagtgtaagaaatcatataaactctttttggaaaactttaaatattcattttgttctacaaagtgttctttgaacttgaaattttgctgtggtccagtccaaaactaccattactactacattttattttgtcaaaaatattgagttttacatagctcgttatgattacatttttaaaccatatctatatgtatgggtggcaaatttaaaagggtatttgtttgacaaagtcaaacatcatccatttctatggctaaaagtttacatttttgtttttaaatcacatgttttgccattcttcagtgtactaccataggaacatagcctagaatatcaaaaaaagaaaactattattaaagaacaaaaaaaaaagagaggtatattatgaccactttcttaaaaactttacaatattattttaacaggaggtggtccctgatattatttgtgtaaaatctaatgggccagagcttattctcaactgtgaaatatatgctcataaactcagattgttgcctttttatttctttttaatctatttgaatggaacttacaaagcatctattttcatctagcaaaacatttcccttcccatttacccagtagattcacataacgtatacactggaacattaccattattccctgggtctacatggcaattctgcattagacaatattcaataatacaatacttttcacagtgaaataaagtaaaatttagaaaacgattcagtgtacctaatatgtataaagcactctgctatgattgaaacatgtttagtatatgtggtccacttttaaaatttcctcagatatgtgcagtccctgacctatagtgtctatgtcattggaagctatgaactccttaaatgaagaaataagtagggaaaagtcatgcaaagaagtggaacacctgcttctacgtatattgtcactatatctttaataaatttttggtttctttatatgtttgcatgtgttataaaaaacatggttccccacaacaaaagttttctagactatatggtttgctaatgatttagactttaacttgtaggcaatgaggagccactgtagatgtatcattatgcaaattatataacaaaatttgtgttttaggtcatcaatatagaggatgaactagaagttgagactggagtcagggagaacaattaggaagtgaggccaataatacaagggcaacaactagatttgaaactcctttaaaattttcagttgttacaaatgcttgttattattattgagattaatgcttctggtaattaaactttcttggattagttgtaagaatgatttgcattacacgaatttccaacgataacggaacttgtcataatgaggctcttttatgttataagtaaaggccaaagtgcaaaactaagctgctgcttgactattttgcactacaatggttcggctgtcatttaaataactcatgctaaaaaggaatctgttattatattaacatctcttgatactacacaaaatgcttcaaaactgttccacagtttcttttaagagtggccttgaagactagaatgaattttcctagatgtaacctaatttaaatggcatataaatctccaatttgctatttgcttgtagataaccataagcactttaataagaaaatgtaggtgtcattacactcggtcaaacttactattaaatgcctaatagacttagacaattttacatcctttatcgatggagatgtcattaacaacagaccctggagctatttcctgaatttcactctaaaatcaaagcatattatcattttctggttctatctcattataattagcttggtcttaaaacaacagcaatttctttaaaacatagtgtgtgttagaataaaatctggtgtttttttgttaactataattagctttcaggtatttactctctttatccccgtccatctctatactctttccattattaaattgtgtcacatggcttgtatggcgatctcccaatatttgggaagttatattacaatatctggcaatcttggcagaaagctgtgctctatatgttaaattaaggagtctttaatcatataaattctgtggaaaagcagccttaatattcctgaattttagcctgtagaaaggacagaccctttattatgtatttatactaccaaccaccagggggtaatagaatactctaaaaacaaggtcgactaacttcaagaaaacaacagaagttcttactaaatgggtagatagaggtggacaaatacatttcttagcacctaagacaataaatgatcatcaagcacacacagattgtgtctgactatcctccaagcacagcctgcaagctatactttcgagaataggttcgcctaacaattaaggcagacagggctatctggaaagctaattttggtgcagtatctgattactcagcactgctaaaaaaaaaaaaaaaaaaaaaaaaaaaaaaaaaaaaaaaagtgtttctgccatgtcaccgaccagcataattcagaggaattcacccttaaatggaaactccccaacacaaagcacgtggcctgtaacactctttatatttaggtttacacagactgaatgcaatgagttatttatttatgcacatcaaagccctctgagggtgaggattagaagagtagcaacataattttgatgacttagagcataagttgaaagaatcacaagtagtaacccaatcacactggagtctatggggattactggccatttctgtttttactaatgggtcttttatccaaataataaacgctttttagagaaaaatcataacagtttaaatgttttagttcatactatgcactggacactatatgctccacgaatctaacaaattaattctcacaacaagctgaagaaagagaaattattaatacctgtgttctacaaataaggaaactagctgaaaaccaaatagctatggtgaggtgggatttgattatttgagtctaaccactttctttaagaaaccaaaagatgcaaagtttatatgtcttctttatccatcctcagtctatccagaaatatcaggaacaatgtgaatttgaaacgcctgagaggagaaggtttaacctcagagcatcctgcaaacccttatcattcctgacattgtgctttcaagagtcagttaccactattgttattgctgatgttattataatacaaagaatagactgttagtaaaaaaaaaaaaaaaaattcattggcagacgttttgagggatgtatctcctgatagattccgaaggcttgccccaaaagagcttcaagggtaaccaagaaaaagctgtcaggtgggtagtgactgacaaaaaaaaaatttagaaaacgcacttgagctgtcctcagtcaaatacacccagcagatcctgcattcggataaagggcagcttggcagtgaggaaacagtctggatttgggagagcaatcgatgggttaaattctgattagaatcagactccactgcttactaggcaaaacatctaatcatgaaactcaaagaggttaagatcactggctccaaaatcagttcagctgctttgttttctatatttgaaaaatagaggtaatagtagtagctacctcattgattgacataagaattaagtgaatcacctcatatgaggtacacaatataattcctgacatggtgctttcaagagtcagttactactactgttattgctgttattattataattgcattacattagtatcatttttgatgtactaaagtaatatatacaattttaaagcctctggtgcatggttatttaaccttattgatacatcgtctttgttaaaccttttaatactgtactaaaagtttttaaatctaggctgtccagtaagggaaaatttctattcttaaaaagctgagtgactcctcaggtaaaacattatttctctaaatacttttctcccgcataaagtaaccaatggtcctttatgccaggggcatattttccagaagactaattggccccacctctaaccaactatttagtgaatagaaggtagacatgtagaagaacaaaatgtcatccttgaggttgtggagatgatcaaacactgcttcattctggcatagaatccttacaatttatgttttttgtctctgcacctactcagaatttctacccagtcctcaagtgacagctgtggcacacaagctaaaggcacttaacttgcttcatgatttcttgaccagctctttattaagagttagatttagcagggtttgcttgattccttggtcgattattctgtacattacttctaagaattaccttctttcctgactcattgcctttcatatgcagtctccaacacttcatttattgtttattctttattcggagggaaaaatactacttccctttgttctgattctttatttttcctgtctacttgcaaactgctagagtattgtgattatacccaatttctcaaattcaaaatgtattatgtattgaattttctttaaaaaatgaaatatagatctgtgagtctatattgcttaagaagtgaagaaattggacttacaatttgtgcacatatacttaatttttctatattctcgtagtgattatccctgacatttatgaatctacattgatttattaagtgaaaattttaaaagcccaatatttaaaaactcagcatgtacttaaaatgatgaacctaaaatagaatcatctgattgatcatcaataaacccgacaacaattcagtctgaggttgtttctatatacatacctagaaatttggaatctttctttaaacatttcccatgctaccttaaaaaaacaaaaacaaaacaaaaaaacagaagcacagacaaaagaaactttgggaagaagagatgtatatcaagtaacaatgtgaaggtgttttttgttgtcgttgtttgtttttgggacagagtctcgctctgtagcccagggtagagtgcagtggtgcaatcttggttcactgcaacctctgcctcccaggttcaagcaattctcgtgcctcagcctcccgagtagctgggattacagatgtacgccaccacacctggctaatttttgtatttttagtagagatggggtttccccatgttggccaggctggtctggatctcccaaccttaagtgatccacccgccttgtcctcccaaagcgctgggatcacaggtgtgagacaccgcacctggcacaatgtgaactttcataagcttgaactctccctgtgggaaaaccaaatcctgttaggctggtgggttgtgttttgtcaattcagcgtgtaaaaaacactgtgaaaatgtacatttaaaaagtagataactaatttataaaaaaataagaacatttaggctaatactcctgattggcaaaattatgtgaagatgaatatcggcggccccttctactcatggcatatatttaccaaatgcctggtgggtcccttctttccagccttctcctctcatttatgttagtagtctggattccgtagacattttggcttgggggactactgacatagaaataaagatgtgccaagctctgacaatcagctataaaccagtagaaatacgttaggaatctttcgaaaggcttttataatgtagcgtatttcaacgtaataagagccacgatgaaaatgaggataattacccactcagtccttgaacaactacaacattatgcagccattaaacatattttcaaaaaaatgccgtatgaaaatataaacaagatttagttaaataacaaaattagatcacacagttgtaggtaaattagtattgagttatattataaagagaattaagactacatttgcactagcaaagcaataatatcaacggattgataatcacttagaaatgtgctaaatcatgctagggtaaccaattctaggagcaaggattcatatttacacattaattgcaattaattatattttcattgaatttttttaggacaaattagtgagaccagtatgctaccttggaatagatgggggaaagtgaaatattattttacaaatattgtctaaactttaaggtctacaggggatgtttgaaaacttgagaaggatgaaagatgacaattatctgagatttatgaagacagtattggttaagcagcattttaactagtataattattgttctgattacctttttttaatcataaaagtaattcattctcattgtaggtgattggaggatagacaaaggtaaaaataagaaaacaaaaatcatctgtaattttatcaacaatatttattagtaaaagttttgaactttcgtttccagttttatttctgctaaaacaacccacatgaagaccaggggctaccatttcactgaccagtatgtccaagcacctagaacagtgattggcaaaaacaagcaattaggcactcaacacattgattgaatatgtaatttcaaaattagtcttctattgtacccttaattttgtgtgtaattctctcttttaacatcatattgtaaacatcgtcctctatcatttaatgtacaaatacaataccttttaatatggctacatgatgtaccataattccttctgttgaatatttaggttgtcttcaaattatcactgtcatcaaaatgcttcagtgaacatctctgcacataaagccagtagcatctgattatttaatgatgacatataaataacagaattggaaaatctagatcaaaatacgcaaatgatttaatatgtttttgctatatgccatacacatatctccaccagcagtgaatgaagagcattgatgctgaccattataaattttttttcaaattttgcaagaaaaataaatagtatataattgttttgattcgtaattatttaattactgatagtgctgaatatttttgtatatgtcaataacatcatctttaattggaaatactgttattctaaaaatttaacatagaatctgatgtataaaacatttggatgtatctaatctgtatatgactataaacatagtcatatatattttcatgctaaataatgttattcatattatattggtcatccatagtttcagaacacacacacacacccacgtgtgtatccattgtacaatcattgacatatgtatgtatatatatttatatatagtctgatgacacatgtatatttattgactgatgtagaagtatttaacagtaaaaatattagtgttgatatggttaaagtatggaatattaattcctggtttatgttacacataaaaatgtaattatgtttcaaataataaagctatgctcattctctctctcatacgcactttgaactggcatgaacaaaatctcctgtagtaatttcatatacataagacttgacagacactttatatactttcacaagaatttaaatatatcagatattttttagtgtaaaattagaaaaaataatttaacatgactatcaatatattttaaattttcagctttgagagacataatttatctgctattttgataaattttatctatatataatgaaaatatatgtaaatgaatatagaaaattgtgtaataaaattgagtacatatttacattaagttccttttttctttttttatttgtggaaagatgtttcattatacctatctgtagggggaataaaaaaaacagtactgaagcttctgaaatgaagttagaaaggtggtcttgactgagttctcagatgcgaatagtacagcttgtgagtatgcttactgttcacagaagccctctgccctgccaccccacgacacaaatctggttgctgctgggcatatttcaaattcagaatcatgtaactagcagcagatgtgtctgtctgcaactgtgataggctccatctgcagtttgcacctgttgttttgctgaggccagagtgcaggtgtgcatataaaaactcaaagggcaagtagacagcaaaattaaggaagtggtttttcctctctcatgatctgcgttcctgttttctttctttccttccacttcaaaaattgagatgctgatggaatcataacctgtggtcagcatcagccaattatcctaagatagtaattattgtaatttttcactacaatctttgaaaaaaaaggaatataagaaaaacaaatttgagagccaaaagaaaaaaaaaggagatacataattcttcaagagcagcctctgcttggactattttgattcatgttgatataagaaacactttgctgtcaagggaaatattgctagtgtgtgattacatattcagaacttcatctatttttaagaacatattttgtttaaatatagttttgaaaaacaatactgagatattttctagggtatttacatggccagttctagttttaaaatcacacttctgtagaccggtggttctcaaactttattgtacatatgaagccactgctgatattgttaaaatatagatttagggtagggctggggcctaagcttcgccttctgaacaaagtctcatgatgctgatgctgctggttcagggaccatacatataatagctaggctgcagtatacatacatacatatatatatatatatatatatatatatatatatatatgattgcatcatatgaagcatgtggaataattttgaaaactgtgaaatcatttaacaaatataaacaatttaaatattaaaacttttcgattacattgataatgaacataattaatgataaatctaaaaaacgtcattcaatcagttattaaattatcacattagtgttttaagcattcagctatcttgagaaagacattggcttgagttctaatgataattgccttcacgatcattgtccctgggtgtgatagatagataagcattctgttctttttgccatctacttttgatacattcttgcccttgttgtgagtttcttcatgatgtttacagaaggatctcccaaattctcccttcttcttttagagccaagaagttacaaagcatatccttcattgatctctttagtttttctattaagttgaacagctgaaatcttaagtttatttggatctcactaatatatcggtcttttccaatcacatttttctcttactcatttctacagtaagtatggttcatggactagtagcatgggcaccaagtgacagcttgttagaatctcaggcccaccccctagtctactaggagcctgtattttatagagatcctcgggtgacttgtgggcacgtgaaaatttgagaagcagtgctctggataacacttctaataataaaatataaatctctactttaacctagatttagaaacatgcctaaaatcaatgggagttttggagacagacagataactcttcaaatcccagctgttcagcttttgaaatgatgctctgttacagtctcctcacggtcctcatcaataataccttcttcacatgttgtcataatagaagtgtgatgaaaatacaatgtactcagtacagtgtctggcatataataaataatcaattgttgctaaaaacatgtatatacgtatgtgtgtataaatatataatatacatatatttataattatagataaagaaattagaggaaggaaagtttatgattgccagagattacaaagtggttaattttagatctttgtggatcaatgctgacctgattaccagtgtgatacattcaaataccatgtcactttgctataataaagcaattctcagcagttcaactaacttcatatttgcaaagattcttactttttccctggcatcatgatcagcatagtaatttttcttttattattttctctgagaaacatttttttaaatgaggaaaaaataagccctctcacaatatatcaatgcaatgtaaaagactgtttaaaatatatttctttgcaaaacatattaaatggatcattatttacatgagatcttcagaagttatcatggtctattgtgcaaattttaaactgacaccagaaaggtaaattatgtttaggcagctttcaaaaactggagttttgattcaatagaccgtagcatctctttgatgtgctattttgtaattcttcaaattattttgcagtatatgcatagctatcatgatgctgatagatattcatatttaaattatgaactaaagtaaccttatacctatatatgccaatttttcatatcaaaaaacacagaactgaaaaagctgtagagcagaacacagtatttgaacacatttttgtggtggggtgatttctagattatctctgcattcgttaggcatatctgctgtgtcacttaccaatttattgcctcagctcccaatgcacccttcaatataataatcaacagaatttgtttaagcatttctccttaaagtgaaggtgatgttaagctttctcagtagaaggcactggggagaaattgcaggaggaaggggcttcctgcaatttccagcccaggccagaagggtcagcaacgtgggtgtaagaatatctaatagataatgtcccagcagccactggctcaatacttgtccttttgtgaccttgttgccttgacctggcaatatttccacagacaccttggactccctgggcaagccctgcctagctggcctgcactcaaccacctgcgtcccagaggctcacaacaccaagtagttgctcctcctgccaggtgcaggctctgaaaaccttccacctccaccagcacctggactaccttgcacttcacaccggccaccaggcgctgatctgttgctcctcacctgctggcactgcactataaagggtggcgtgtttgtgaagcagcaccagacagctccagcccggccaaaccagtaaacatctctgctctccattaccaaaccatgtcttctccaagggaagtcttccctatttgtccttccttggatcaagggttgtctgcttaggttgccatataaaatttccttctatcttatagctacatttaccatagtttgtttgtttgtttgttcattaaagtactccctctttaacctactgtatggtttctatctcctagttggatccagactgctagattggctttctataattagaagtgaaaattgttctggagatcattttgctatcataagggctactacttagtgtgaattacctttgtgccaggctctttacaaacattatctaatttaatcctgacaaaaaatcttataaagtgagtattataatccacattttacagatgaagtaactaagccttaaacttagaaaatgtactcagagccaagtgatagagttgggcttcaaaacaagtcctctctcaataggatggctgtgtgtataactactctctattttgtaaccatcccaaaacttaactgtccaagaaaactccattttatttctataatgactaatgaacgtaatatttttaaaggtttattatccaaatagaaatcaaaacgtttctagaatgcattagcctgtagtgcttatataggacatggtctttaccttctgagctttcctggttctgccaaattgatacggtaatatacaggctcataagaaagaaagacacgcttcagaagagtatattgtccgataacatacagaggtctcgttacatttaaatttcaaatgaaatgatgattttcttttttataagtatatcccaagtaatacagtgacaccccccaaaattattttttgtttacctaaaattcgaatttaactccatgccctgtgtttttatttgctaaatctggcaagcctacaagagaagtttctcctttgcctgttactgttcctgtaagtttctgtgaatcttatcgcaacaaaagtaagctcaaaataagacaatgcatctaggatacgaccccactttccaaatacataaagttgttcaagttcaaatacataaggtttattctaagttttctcatagacacgaaataaattttaagattgaaataaattcctagtagacctagttttattattatatcatgacttctgatcttattcgtgagggctgctaagagttttaagagaccccaaaactcgttggggctaaaacacggctatatgaaaaagttcatgatcacataagaaaacagatagaaactggaccttttctagaaaactcacgaattatccaccccttgtttagcatatgatcaggaaataaccataaaagtagccaaccaacagctctcagggctgctctgcctatggagtagccactataatttttttaaaatttcataataaacctgagttctaatttgattgcactatggtctgagagactgtttgttatgatttccattcttttgcatttgctgaggagtgttttacttccaattatggtcaattttaaaataaacttgttttccctttactctgtgggctaactcttaaaattccttcctgtataaagccaagaactcaagtgacctcccagaatgaaccccaatttggagtttcaccctgtgaaaagagccactgttaatattgttattcttgttatgtgatgctgagcttaattgtaaagaatagaatgcttattctgggagttttatatttttatttttccaacttattaatagaagggaaatcttagaaatatatatctacagagaaagaggaaccagaatggataaactgctgagtggaaaggagaattagactcctcgtagccagtctaattaaaaactaattcaggtcctctgcattaattaaaagcatgttattggaggtagagttatgaaaagataatgtaccaacagaagagctgattgtactactgggtaggatataatataatatagacaattagagtaaagtatataaagtgtcatgaatgaactatgcacaatcttttacggaaataagtaggataatcctggacacagattgaataatggaagtgtatggaaaggttgacaaatgtgtgtgagtcctgatggctgagcaggtatttcgttgaatgaaaaaagagagttctaggtaaactgagaagcttctgcaaaggtaaatgtgcatgaaaaaagaagtctctttgggaatacactaaggatttctataaaaccagagcatagtatttgaagggtggggtgaagtagggccagtgtaagagattaggatggtgagggtgtcctctaagccttggaaggatgtttagatgtttttatcttgactttttttaagaaatatgattttgggcccggcgcggtggctcatgtctgtaatcccagcactttgggaggcagaggcgggcagatcacgaggtcaggagatcgagaccattctggctaacatggtgaaaccctgtctctactaaaaatacaaaaaattagccgggcatggtggcgggcgcctgcggtccctgctactcgggagcctgaggcaggagaatggcgtgaacccgggaggcggagcttgcagtgagcccagatcgcgccactgcactccagcctgggcgacagagcgagactccatctcaaaaaaaaaaaaaaaaaaaaaaaaaaaaaaaaagattttgtcttctggttggagaatagattggaaaaaggcaagattggaggtggggtattccttaatacataaaaggaaaagctaatgtcacatatctaatctgtgttagacaccatccttagattttaatatgtattctcactcttcatcattatactaacccttccgggaagacagtagtattatcacaattttaagttgagatttagcaaaattagaggattactcaagtcattagagactacactttaacctcttttttcctccatacctatggattaagaaaaaaaaaacaataatatagtgctttatttttagctacatcagcaattggctttgccaaataccctagatgagaagagttgagaacatgagctatggcagtgacactgcagaggagaggacagatggaagtgatattaggaaggtgagtaactgatcttgatgtggaaagggtgggaagaaagaaggatcttaatctttggaaactgtactgttaaagagaggaaacagaaggaaaaaaagtgaaagtagtaagataatacattatctttgggatgtgtttaatgtaagataggtatcagatattcaaatacaaatatcaagtaggtattaaatatatacttctgaatttcaggaaagaattttaagtgggagatacagatttggaagtcataatattcaaggtgatacttgaagtcttgaatttaaataggatcacccaaggataatgtatagaaagaaaggcaggaggttagggaaggccctggaaaatactgccacttaagtcgcaaacaaaggaaaaaaaacctctgaaggtagttgagaataaatgtcccaagacataggaaaaagcagaagagagtagagtcctggaagcaaagcaagaagaatgtttctgaaacgagatgccacagagaaaacaagaaaaagaataaaaaaatatgtgcttttgctttagcaatgtagagatcattgactagaatagtggactggtggtacaaatttcatattatactaaggcaaacgcatgagttgtgaggaggtatgcacttagagaaaacaactctttcaagacacttgactatgaaaagaaaggtgacagctatagtcaaggagggttttatggttgtttaagattatagacttgcagatgttgaaatgaagttgcagtatcattttgagactagacgattaagatacaggagaaaggaaataaatgacaaaactctcaagaagggagaaagtatgaagaggaggcttcaaatatcacagaaggtggctaaactttgacactgatccaacctaaattatgaaaaacaatttaatatatatctatataagcatgtctatgtgtgggtatatattcacatattctatataatctatatatattatattatataaatataatatataaatgactatatttatatagaaattccatatattatctaatatgtctagattaatatatcatatatgttagagagataatatacaaatatctatatataataatctatatgttaatatttatattgtatagaaatattttaatatttctataatatatattcaaatatttctatatagaaatatatgtatttatatataatcgtgtatttaattttctatagatgtaatatttatatataatctatataagtatatacaaatatctatctatatagaaatacatttatataaatatatttaatctttatatatgttagctttttatttctatatagaaacatctatatataatatagatgtttttatatacagatatttcagtatagaagtatatatgtaatatagatagatatttctacatatagatagaaatatctccacatatatatggagaaagagagagagaaagagagaaagagagagaggtggagagagtttgttttcagtatgtagaatgggcattgttaaccttgtatggttttccttggcattgaagtccttctgatgaattttccaattgcctgggattcataaacccatgttttggaatttctaatttcctacttaatgttctccaggtcctccacataacagaagatgatgaatattcagaagagcacagccctaatgttgaaattgcagagaaagaaaagtgcacacatttcagagcataaaaggataccgatacctacatttatctagactgtaagtcccatgaaggtaagaactatgccaaattgttctttaatctattaattaacctacttttcaatgctaggccggtaaataagatagtctgataaccatatttatcctcagctggtatcttgggaggattgtattccataacattctttatgtaagagctgtatcatctgaactgattccttccaatattaaaccataccaaataaaatattaagccctttcttacaacagagtatttcaagtttcactgtatttctcatcaatttttacattatttcttttatttcaattagctcctttctacctcctgtagttttcaagtttgacctttcaacatcaatttgaaggttatgacctaggcccacattgagataactctttttcactattttgacacaattaaaacaggttctggcttcagaaaaaaaaatcaacataatatatgttagctcttcatttccttagagtttttgagattcaagtgatgacatagaactttatcgtcagctacatcagcagttagctttgccaagtgaggttgctagctcttctaaatgcaaattgaaagagaggagaaaaaaaaaaaaaagagcaaagcattagtaggcaaggaaatgatatggtacttggccaacgaggtaatagcctttattgcaagccagtcagtgctccacagatggagaattatcataccaatagtgtttgatgtaagacccaattccccttgtgttggtgtctctgggcaggggttagtctgcagtgggaggtaaataaacccctcactaaaccagtattcttaattaattcctgtggaagtactcactgaccaggctgtaagaataccaaggaggatgtgcataatatttctcctaactgtgaatacttggcaacaagaaagaatctgcagtgccctcttcattcacaaaggacaatatgcctatatattatctaacagtggatattagaacatctcatctatttttagagttttatttcatgttcataaaaacattcccatttttctcttcctgaagggtgctgcttgaactgaaactgccaatgactttccacatccctcatcctattttattatagaaacgctcataaagacacaattttctcctatcaataaatatgtttgatgttccatagaagttctgtgtaatacatgcagaacaatggagtcagactctggaataaattattaccaaaacaactttaagcgatgaggctgcctttggatgctctcctgtggatgtgatgtggatgctcagtgtgaaagcaggatgaacaataaagcccatgagtcataatcataaatcccaaataggcattacccttccttaagacatttttaaaccctttgaaaaagaagactataaggtgcaatctggttttaggggcattctattctttaatacatttagttaaagtgtgaagtggagcacgcctgggctggggtgatttttagatgcagcagcatgctcagccggcagctctgtgtggatagtgatggtgtgatggaaacacggagtgtgctgcctgtggtgttctggacagggccttatttactttatttaggtttgttttatttttacaacatattcctcttgaaggcttctaaaatcccctgcctataaagtaaggcaaataagcttaggcatccagtcacccatactgaacggaggcgaggagacctggtcatctctacaaagtaagaagaggtttacaagtattattatttggatatatgttgcctttcacaatttactaactttctcaaaacacagactctacatagaaagtattagggaacaagaataatttgatgtgattgtttatcagataggcaataaaaaggcactaatgttcttcaaattagaccattagacctgctatgttcaactctgattctacctgtttaacactcattaaacacaaaattcagggtgctgactgtcaagataaatagggttattttctgcttttcctattttctcacaggaagacacatataccacgcaatcaagtagtaatttcagaactagacacattatgtggaaaatgtcatgctgaatatatctccactagtacagcctagctaagcccttgattaatatacaggagatgaaagtttctttttcttattatttttatcatttacgtattgtacaaataaaatgttattgcatctcagaagaaaaaagatttactaaaatgtttgtccacaaaatctcatactaacttatcactgaatttctgatacgctgcatttcccatgaagcttagtacaagttcagtgagaattactgaagcccaccatcatgtaagttctgatcattgctgggatcaccgaaaaaaagttcataaagtcaactcaaagtattggtaaaatatatttataatgttaaaataacatagatatattaaggcaaggagcatttttaaagatcacccaacaatggcatacattttgcatacttggtaaagggataaacactgctcaggaatctcacaacaggggtctttattacatctagcagctctaccagttatttgccattgcagctttaagggaaaagattctaaaatctcaggtagaatgccatgagtatacagcctcaagttctagagatttcacatcattgagataggttacctatgcctccttcaatgagcaatcagatagagatatacagtttgctaccttgtgtggtaatagaaaatgttagcttaggcattcaatcaaccataccaaattgggctggggagacatagctaaatctataaagaagagatttataaatcctttattacttgcatatatgttgcctttcacaatttaccaacttactttcacgtaactcatttcatataataattatattgagacaagatattgtttttgtatttttcttactagcatctcctttgtatgaatcaagaaacagagacttaaaagaaactgggtggttctttcagttttgcacaatgaggatgttttagcagtaggagttcatcacttctttaactcctatcaattatcactttactaacatctacatattatctcaaaatgatgttttcacttttaaaaacccctcattagatgccgtgctattcagaagcatgcagtataacaatgtgtctttttccagtataggcaatattctccagtacttgacaggcactcactgacggctgaaccattgaatcactggatgaatgaatgagtacctcatattaccccctttctagtaacacctttgattattgattcatttcttactaaagacccagcacagtgtcacaccgtgggaaataaatgatacaacaatcaattacatggttactcctgtgtggtacaatggccagcctgctgccatctggatgcttgctacaaatccaaattcctgggttccatcccagatttgctgaattagaatctcatatatactaaagcttgaaaagcattccacaatacattgacagtcaacttgtgaaaacaagtcagtggatttaaaaatatcactttcaagaaacagtgcttcttacaactattctacaatatttttcccgtgcaatctctcttagattgcccaaaactaaaattttgaggaagtggcaaaataaagacatgtcagtgaaagttcaaaactgaggaaaagagcgagctagttttgtgggtctggaaactcaaaaacaaaagcatttctgggaatatgagctcataaaaagcactaatgattagagcaaatcagacacagatcaaccaatgacatgatcgtcataatcaaatgtccttatgtaactatggttatgtggaaaatgaaaatacttattccgagtagtggataaagcaagtcttaattgccatcatcttacattgtattattttttttaattgcactattaactctgctactttcctgtcttctgctggttgactatttctattactttgtatttcagtagctagttttttttttgtttgtttgtttgtttgtttttgacagagtctcactctgtcacccaggctggagtacagtggcatgatctcagctcactgcaacctcagcctcttgggttcaagtgattctcctgcctcagcctcctgagttgctgggattacaggcatatgccaccatgtctggctaattttttttttgtatttttagtagagacaggtttttgccatgttggccaggctggtctcaaacccccaacctcaggtgatctgcctgccttggcctcccaaggtgctaggattacaggtatgagccactgtacctggccgtattttggtagctgttgttttaaccaccataactattttgtaactgtcaaagcccagcttactgaaacccaccacaaagttaaaaagcccagtttgcttactttctcaaacatctcagtgggatcgatttaatattatcaaacagatgcagatctggggagtttccagcagtctcagttctcagagttctggccatgtttctttaggttaagttgttacaaataaactgaatagatgcattgaaaaaaaaaaaaagtgggggttttagagtcaaatgtagctgcgattaatctgttggttaccagcagtgtggccttgggttacttattaagtgtgcttttctttaacatttggtcaacacaatattaaagaattattgcaaggaagaaaaataaatacttgccttgtgcctactgatttacagggccaaaaataaccactgttgttaaatgactcttaaatccatagtgatgacttgaaagcctagacagggaaatcaaattattcgaagtcaccaagccattaaagtccacagtagttcttggacctgcctttattcagtccttatccaggattgtttccattctatgacatctccttctaaagttggaggtatgtcacagtggggatatggacagtacacacaaggccagaagagtgtggacatgggcaagggagcagaagcacatgctggagtgcacagatcccaggtaaaacaagaaagcctattggctggtgtctgatgtgctgctcaagtgtgaatacctgtaagctgcttataacctggcgcatgctgttagagtggctaggagtacgtcttcgcactgtattaatagcaccagcgtctgggagcttctgtcagttcttaaccataggcagctccagcatcctgattggaccgtaccaccccaacagcttctctgaattactgtgaggtgatttcctgaccaaatattgttcctctattttttttttttttgttttgagtgaggggaggatgggactcaaaataaaaaccaaaccaaatggaaaaacataagggctcaaagtctgagatagtcaccattttgtataactacgggaaatctcttaggttattgcagatggtatgggtcgcagcaagggaattatgaggccattatgggaagtttcttcacatgcaacaagtagggacattttatccgaacggccagcaaagcaaagaacagttaattgtagaaagaatggaggcaattataacatgtctctgtcttgtttagggaaccagctctctggtagacattggtagaggtttttctctagagcaggagtcagcagactttatctgtaaaaggctagatgataaatgtttttgtccttgtgggccataaacttttgctgcaactactgagttctgcctttgtagcacaaaaaaacagcaatcaacaataggtaagcgaaagagcatggttgagttacaactggactttacttgcaaaaacaggcaaagaactgaattaggtctacgagccacagtttatcaacgtgtggtctagaattaaaaagttcaaaatgagaaaatatccaggaagttttcttgcttccagccccactctccactagacagagcagatgcctgatttttatttcctttcacgtaactcagaatatatctgccggtggtagtgcagtgctttagtgtgagtagggtgctagtaatgactacttttataatgacgcttgcaaagtggactaaaagctaaggctctgtctgattttataccctgctgttcttcagcagccagcatagtgcctaacaagtcacaggatttaataaatttgtagtaaagaaaggccattcatgtacatgcaaattcttacctcagaactactgggggaaaatcgatctcaaatggcttcaaatattgaaacctgtgttggcacttttagttgaatgatttgattaaaaatggaaaaagaagaggaaggaaggaagggacggagaaaaggagggagaaagaaaggtgatttttcttaaaagtttcacagagtcaggtatgttttaattcattgatgagaactgagtatttatgacacaagtactgtacatataatatttaatctgaaactgaagcaaatctctctgaggtagggttagggttacccattgtagagataagaatacattttcagaggtaaaatgaaatggctcgccccaaattaacaatccatacaaacacaaatttagacattcttcctccaaatctgtttttctcaccaacataacagacctatatgaatgttaagtgaaaggagatgaaggaaaaatgggagaagcaagttgaaggatacaaactgtcaacatgaagtattaatttaatatgaatttcaagataatttaggaatagtataagacagacagggagctttccagatttcaaggaaaattaaattctcgtttgcaggctgggtgtggtggctcgtgcctgtaattcccacactttgggaggccaaggctgtcagatcacttgaggtcaggagttcgagaccagcctggccaacatggtgaaaccccatctctaccaaaaaatacaaaaattagccaggtgtacatctgtagtcccagctacttgggaggctgaagcaggagaatcgcttgaatctgagaagcagaggttgcactgagccgagattgggccacttcactacaacatgggcgacagagtgagactctgtctcaaaaaaattctattttgcagaagcaataacaaagtccactgtagatgcttagtcaattctcctgcttaatttgtgtgtattcgtttgtcatctatgttaataatttgttactttgctctgatgagagagctagagatcaatgaatcaatttgaactacttgatgggatttttctctaaaaagtaactacatttctatagcagtagaacttcacagtgttttctcttcttctctgtaaggtggggctggagggtgaggtaacgataaagtgtaacacaaactgtattttaacaaataacacttaaattgctttgcacaattgttgaatagctgaattcttcctattttttctaataaagactaataggagacagtggtagagagagagagctttccaagaaaggttagaatggtttcaatatgtgaagccatttgagatcagttcttccccaatagttctgaagtatgaatttgcatgtatgtgactgactttcctttattacaaattcattaaattctatgacttgttaggtactatgctaggtgctgagaaacagcagggtataacagaggttagagaagttagagaaaaagtgtatgttagagagaggggagtaaccaaaacctatattttacaacatatgttttttttaagtggcacatcaatgtattcaagaaagttggatactcttcaacaactgcttcaaaaatataagaaactaatatttgtatatttgcatttaacatgggatttcctttggttagttttcccacttatattgtttctcacagatttgccttctaaaattttaatcattagtcaactctcattatgatactgtataaatgtaggctttagctgacactatttcttaatttttctccttcctgtggccccagtttggtctctccagtcacttcacccataacacatgtgtgataactcctgcgtccatggcccactctgaggaatctttcatgctctagttttgctcttacaggggcttattccatatcctaccagcagctcaaaatcagcatatccaaaaacacaatcaattgccaggttcccttttttgttccccctttctgctggcatctttgatatctccccatacatctttcagaatccattctgatgatttctcaattgctacatctctttcacttcttagcttgccattggtatccaggatctgcacacagctgctacacagagttcctagaacagctcaaatcctttcactccccttggcaaaagctttattattccaaagatatttcagattaaaaaactcttaatgacagaaagtaactaaaaaatactattttctttagaaatattgaaagaaacagacattcccaattccaacctccttcttagtaatcttaagaggcaagtgctaatgactatttattaactatcttctcaggtttttccatgattatgtaatctcaatactctatgaaatttctatacatttttataggaataaaatcattatatatactgatttgatgtacatcaaatatatcataatacatatttatatataatgattttatttctataaaatatacatagtggccaggtgcagtggcccacacctgtaatcccagcactttgggaggccgaggcgggcagatcatgaggtcatgagtttgagaccagcctgaccaacatggtgaaaccccatctctaccaaaaatacaaaaaaattagccaggcatggtggtgtgcacctgtaatcccagctactcaggaggctgaggcaggagaatcacttgaacccgggaggcggaggttgcagtgagccaagatcacgccattgcactccagcctgggtgacagagcgagactctgtgaaaaaataaataaataaataaaaattaaaaaatgaaaattctggggagatatatatgtgtgtgtgtgtatatatatatatatatatgaacactttatgtatgtatgtatatatgtgtatatatatattatattttaggtatttatttagttacttaactttaattatatatcactatgataaaccacctaaaatgccacttcctttatttcaggactgttttcttcattcttttaatagcaagtgtgtcttcttccataggccagaaaactgtctttgaatctttattactgcatatgtaacaggatgctgattgtaatttggggatatttttagacttgtggctaagacctatagctgagaaattaaatgcacaaaatacttcactttaaaattccaagacccaccagccctgagggacagcctattctgcaccagaattactgaggagtgacagatcagataacttgatctaacagataccaacaacaaactacctgttgctgtctctatccctatgcccgtggatggaagagggtaaggagagaggaaaatgtcttttggggaaaggaataggctctttcccttctgaattcaaaccgctagagacaggtgattaaaaagaattacccaaaactacactgacagcttacaagaaggaaaaaccagcactgtatctcaccagtggatgtctgcttaagcagtgatcttggcttgttatgtagcaagagagtaggggaaatgagagtaggtgagattagacaaagtgaaaaacttccaggaaggaaaaggttaagacagcagcctcccttttttttccagcttttggaaagtaaggaagattggtgccctgtgtatccctggatctgagagttactctaggaggaggacacaggttttctgggaccaccacaagaaaaaggattatatggaaacacatgcattaggggagatgtgccagcacaagttcagccagaagtactggccaggtcttttacaggacttacaaatgctgaagcttgctgagtgaagataagctcttcttaatggggataggttggaggttgccaccattttcatttaggtcatagacaacataccaggtgttggttttatatagcaaagaaaaagaattgatcttttccagttacctaagaagagacctgctcttttcctgatttcccctctcattaacctaaaggagaaggcagggagaggatggtttctaagatccaaccaatgtcccacttttcctacaccttctacttcgagtccctgaaggtacagcactagcctgaagtgacggaaggggaggaaaggagataacaattgaccttgaaattgtaaactgaactagaattaggcttaaatacttgaataagaaatgtttattaaccaaaattggtgacaatttatgaaatttgagtaaaatgccatttaaaagagctgatgaaaaagaggagagtcagtatgcaaaatccgggaggaaaatagtgactggaagataaatgtattcccctcttatattccaaatagtggacacttttcaataaattgattttataatattcacatattaaattttattacatttatttacataaatgtctggtgccacaaataagattgtaaacttctttgggtcaggaattagatagtaagcaatatttcccaggacgtagaatgtacttatatgtaaaagatgttcaataaatatttgtcaattaaaacataaggaattaaattgtagtacattagaaaacaaaaaggataaaatacaggaataatggatgcgaagtatataaatccctttcattttcaatgcctttaatgaaaggggcagtcaactataaagaggtaggcatgactctgtcatttaaaaacaataaagactgtataaaatatgaagagcagagcatttgtaatcacatagacaaggatttaatcctcagttctgctactccttagctgtgtggtccttagacaagcagctgtggtactccttagacaagtatctcattcataaataaataaataaataaataaataaataaaaagaaaaagaaaaaaaaaaaagaaagagtgagctctgggtggagtatagactctaatgttactcctaggtataaaattctacaaattgtgaaaatatgcagcaagatacagctgaaggaacgattacatcatagtccttataatctacatcaatagtttcttttggcatgcacattcagccacaagttattctttcaaatgttaaatttgactcatttgggtaaaagcaagctgcaagttttcttggttcactgagtttttgaagcagcactctttattcaaagtatagggcctttttttcttgttttctaaacatagtctgtaagattcagcaggtttcagagttgtattacaagagaaaatacaagtcaagtaggttcagcctaatccctcacccagcgcagacacaagcaatgtcaggtaacatagggaaaggagcaagttgccctctctatattctaagtgcatcttctcctgtcagtgttgatgatattggacacagcaaagcataaaaacaaccacctaaaattagtagggagcgttatcctacgatggaaaaataatcagagcctcatttacaccacaagaacaaataacccaattcagccacttgccgggcagttattttaattattagaaaatataagtaattggaaaagataaatcattacatgtcaataaagaattagtgctgatactaattctctctaagaagctcaccaggtgatataaaaagtaaggtttataatggaaaaagggtttaacaataaagtgaatttctcaaatcatggcaaatcattccaatgcaaaagatactaggaacaaaatagcatgacagaaaagagttaatatgtccacatgaaaacttgtatgtgtacattcatagcagcgttattcacaatagccacaaagtggaaacaatccaagtgtccatgaactgctgaatggataaactgttgactatctgtatgatggactattacacaaccatcaaaagtgataaagtatgaatacagtccatgttacaacatggataaaccttgaaaacattacactaaggaaacaaaatcagacaataggctgtatataaatgattcatgtaaatgtttccatttacatgaaatgtccagaataggcaaatctttaaagtagaaagaagactattgatagccagagttggggaggagagaatggaaagtgacttttgatggttgtttttgtagggaaggagtattaaaaatgtttccaagttaggtagtggtgatgattgtacaatcttgtaaatatattaaaaacaactatattgttcacttgcaaatggtgcacttggtatgtgaattttttctaaacaaatcatactttttaaagtaaaacaaaagagagaaagttaaaaaaaaaaaggagagatagttcaaatgttggtttgcttcatttttctgcttctacacaccttttatgtagaacataaaccctgacctcaagaattttaccaggtggttcaacaggatgcctgacaaactataaaataaatgggacagttacataggtataaatatagataaagataaaaatgtggcactatgggaactaagaatggtttggaagacttcccagaggatgtgattttgagcaagtgttaatgaacaaggaagaattgttaggtttgaatgaagagagagatttcatggagaaggaatagtaagatctaagaaacagagtgcccttgggaaacattatagccaaatgggaaggtatgagacaaaaagatgaaattagaaagagtagctggctaggcatggtggttcacgcctataatcccagcactttgggaggtggaggcaggtggatcacttgaggtcaggagttcgagaccatcctggccaacatggtgaaatcctgtctctactaaaaatacaaaaattaaacatgtgtgagggtgggcgcctgtaattccagctactcaggaggctgaagcaagagaatcacttgaacctgggaggcggaggttgaagtaagcctagatcacaccactgcattccacactccagcctgggagagagagtgagactccatctcagggaaaaaaaaaaagaaagaaaagttatggtcagtgggtagggaaattcaagataacacttgctgaggaatttgaagtgtattttatagattgtagggagtcaccaaatatcaaagaattcaaacgacttccaaaatctaggcatgttttcaaaataacacatatattaattccttgcattgccactgcatatagaatttagatgtaaggttaaaagtgattataagcagatattatttctttatagctatcataagcaaggagtctgattctctctcagtgagagatatttctagctcactccctcagctcagtctggttaatcttattattcatgttcgaaggaaagtaataattaaaaatattttctaaaggttgtaggttatcccatatatttatagttatagggtaaggctcaatgaaggtagaacaggaggaaagctacactaatcgcaaacatattttttaaggtaaaatcatctgcttaaaatttagaaagtttttgaagactatttcaaaataatgtgttgtcttttccagtgcaaatcattaacataaatagattgtatattcatgcagtatatcttgcccaaaaaaccacctgtatgtaaatcaccaagttcaaattagaagtctatgtgattaacttttcccctttatgatactgctgtcaagggtgggagaaaaacatgttatctgaatataaatctttatgatatagacagcacatatcagatcttaattctttttattttttacttaaaaatggtatataataccagagagtaatatgttcatcttgacaaaagcagcttcaattgtgtggtcaaaaattctacatcatcataaagggatgatgctccttaccaaattaacatatgccaaaactctgttcaaatatgggtgtatcaaaaacgttggtggatatactgaaattactataaacattaaagtacctaaaaacacctaatgtggagtctggtaaataatagctcatcaataaatgttaattttatttgttttcctgatttctcacaagaaatgatatggggaagaagtggtcattgttaatattaattgcaatgctagaaatatcagtgcaactagaagactgaagcaataaatgagagcaatggcaaatataatttatacaatccatgagactgtgtgtttgtttctgctattggtaattcaacaataaatttgctgattatttaaaattcacataattgtttctaccataagaggaaggaaataaatgcttgatcatatctttaccaggtaaaattcttgttctctaatacaaccaccaaaatatgaacacaaaataaaatatctttctcagcaggttctatcttgtcaaaagataaatccaagaagcagtcaattcttaaagctcaaaaatcatgatatcttatttgagtagatttctgtgcatactacgtatatattttaatttgaatgtgtatagagttaagtgtataatataacatcccactgtgttaatgggaactctaagtaccaattcccacagagcagggattacaagttacttttatgttgagtacttgtgctattttgaatgttagctacattgtagaataaccagccagagaggtaagtcatatgtgtaaagctgtaggaggcaaagaaaagatttaagataaaataaggatatgtgaaacacaaatgaaaggatggattagatgttcaacaatatattgagtgaatggtatttaaagtttgagcaataggacatatccttactattttttaatggattagaccattagagatacagtgtccatctatggctaagaaggacatctgtagccacacaaactggaataagcctataaagcttctttttctttcctttttaagatataagatcatcaacagaaaataaagaaacccccttatgtctgagggatgtatgctttcaaagtacattgagagcatactgtgtgttactttttggccttccagcaatttgctagtggaagagtctgctaaatgattaaatcccgtatgtccaacttagaagctttttggttcagggtaggtagcatattcctctcgcaccaagtggctcccgaactttattgtaaggtctagtgcttcctatagaaacagcttctggctggacactcaatgatttcacatggaccaagagtgattggtcactcagtttcattcaattctggggactgtgatgagctgtgtgggttatgcttttacagctgaagaaagccattgctcagattttggaaccattgacagatttaaggaactcaaatgcagtactcctgtaacctgtcagccttgttgtcattcttttcagatactctgttacttcttattgtagagtctcaacatggttcatttccctggactaccagttacttcagcgagcctgaaacccagaagtcattgtcaacaccacctacttccttgcttcctaaaacactcatgcaaaccatctcaaatcttgtcaagttttccttctaaataaatgtcatatcaatctacttctctacattttcactaccaacacctaagtcaaagtatcaccatccttcacctggaaaaattattctctcccagtgttcattttaagtcccattcacagcagaaaaaaatgatattgcaatgactctccattgttcttaggaaaaagatacaaaactcttcactgatatatgtaaggctttctccagcttcatctaaatgcaaagacccatctttgcactctcagtcaaagccccaccacactttttcaggttcttcatttgctcaattttctccagcttacaggatatttttcacgtgttcttctcctgacctgaaacacttttttgcccactcctcactcattcaaaccctacttattaactttcatttctccttaagcctcctcaggaaagtctttcccgacactgtatttccatggtacagacttttaaacaatgtctaggactttttgcatagtttgcatttgtaattttacatttgtttctttgatttattgagtaatgactgtagtagacattttggttgattttcaacatccacataatattagataattactttagatcaaacataggaattccttcacctttctccaatgacagattcaaacatatagatatagatgtagatacagttatatagatattgatatagatatacacatacacagagcctcaacttggtcaatgagatataagaagaaatctgatgagggaattctgagaatcttatcaccacatctatgatagacactaaaggagaaacagtcttctttttcctctggatattttgtgtttgggtatagtctctgaaagtatagaagacagattgtcaccagcttgtggatgacccaacaacaaaagtggcagaatagagagaaagatttcaatatatttagttatgtcactgagccatttaattatttaacattgtgtcagtctctttatcctgctataacagaatatcaaatatgaggtaaattataaacataaatttgtttctcatagtcttggaggctgggaagcctaagatcaatgtgccaacaatttcagcatctggtaaggggggcgagtctctgcttccaaggtgcaccttgaagcttgtatcctccagagttggggaatggtgtgtcctcacatggtagaagcagaagtgaaaaaataatcgaactccctacattaaaccctttttaatggaattcattcattcacaaagataacactctcatgatgtaaatatctcccaaagggccccacctcccaaaactattacagtatggattaagtttccaacacatgaattgtgggggacattgagatcatagcactccaccccagaacccccaaatttatgtcattttcacacacaaaataccttcatttcaccctgatagcccccaaagtcttaattcactctagcataaactcaatagtctgaagtccagagtttcatttaaatatcaaatatgggtgagattcgtatcggggcaacttgctctccagctgtgaggctgtgaaatcaaacaagttatgtacttccaaaatatgatggtaaaacaagcatagaatatacattccaattccaaaagggagcaatagaaaagaaggaaggagtaatgggtcacatgtaattccaaaactcagcagcataaatagcattcttcaaacttgaacttaatcttcctttactcatttacacaccttcctggtacactggggtggatgtggttcccctaatgccttgggcagctccccgcatatggcttttctgggtgcagaccatgctttagctctcatacattgaaatgcatgcctgaggcctttccaggctgctactgcatgctggtggctctatagttctggggtctttggaatggccctgctcccatggctccttaggcattgccctattgagaactctctgtggtagcccagatcccacagttctgctcggcattgccctagtggggcactgtgtggcagttccacccctgcagtaggtctcgacctggcactgagactctctgaggcatcttctaaaatctagtggaaggaagccatgccttcacagatctatactctgtgagcctacagacttagcatcatgtgaacatcaccaaggttacagctcatgccttaggtccctggccctcaccccaaaggccctggcattctgggcctgtataggagggaatacctcaaagttcttcaaaatgtctttggggtcattatcccattgtcttgataaataatatcaggctgccttctatccatactaatatccatatcaaacctgtgattttttcctctcaaaatactgctttattctttacttggccaggctgaaaatttcccaaatcttcatattttgcttctcttttaattatgaattgcatcttgaaatcatttctctcttttcacattttactacaagcagtccaaagaagccacacagcattctgaacgctgctgctagagacttcttctgccaaatatcctggttcatcactcttaagttctgccttccacaaagtcctagggcatggatataattcatcaaagttctttgccactttataactagaatgaccatttatccagttttaaatatccttgttcctcgtttctgtgtaaaacctcatcagaaaagtcttcactgacatgatcaattaagtaatgtctaagaagactgagggttttcctataccccttcttttcttctgagccctcacctgaatcaccctaatgctccattcatagcaaagtagacttcttccagtattcatatcaaaactcttccagcctctatccattacctagtgccgaaaccacttctatatatttaggtatttgttaaggcaacaggccacttctctggtatcaacttctgtcttagtgtgtttgtgctactataacagattaccgcaaactaacttataaccaatagacagtcctcacagttctagaggctggcagatttggtgtctggtgagggtctggtcctggcttccgagatgttgctatgaatgctgcatcctccaaaggggagtaatgctatgtcttcacagagcagaaggtgaaggagtagaaagaacaaaactctctccttcaaactctttcataatggcacaaacccatgccactctgccctcatcaccaaaacacctcccaaaaggccccacctcccaatactgttgcattcggaattaaatttccaacacatacattttggaggactaattcaaaccatagcaaatctcgaatcctttccaacatctgtatttacagttttatgagttaataattattaaatcactttgatttggggtctgcaagcaacagcagcctaacttattgtgttaatattatttatctcagtcttagatcctaagctccatgaaagtagactctaggattgtttctactcatcattttagtgctagcatctagtttagtgcctacattttatagtttgtgtttattaaatatttactgagtgaacggacagatgaataccaaacattttctgaaaaactccttgggatattcattgtttcccttttagctttggattattcttattatccatgtggccagttgcttctgtttctcaaaaggcatagtttcactctggccattttcctattagcaggctatgtttatctcaatacctccaaaatacgacatttagtactaggcaaaattgttcagctattctcttgccaggtagataacagttatattgtttctctcattctataaagatcaatgattttataaataaaattgtatatgagacttattctgaagctttttaaaaacataaatacctttgaggtcctccaaaattatgggtgatagatctggtatcgttgatacacaggcatatttacattttggtgccctatcaggtaattctcatgtgttttcaagtattatatccattgttccatatactaaatctctgttgactttgcttaggtttgtattaactctttggtgatcttattatctctaagctaaatttattatagcttagagaaagaacattatttcttcaaaatgaagagattataggaaaagaaaatacaggctttgttctgtagagtatgaggaattaattattacttgatgatagaaacacctaagaaggtaaactttgttagactgtaaggacaaagatattccaataatttgtttcctctttccttggtaactgaaccttgatttcatcttagagacccataccgaaactttcagcccatgtgggatgagtagaccttgatcaaaccttgattcaagagcagatatgtggtgttgggcaaaataaatcagagtaccccattcttctcaccagaagtgatgatctcagtggcatgcatgtgatctaaatatggccaatgaggtgcaatgtgatttttgcttggaatgcttaaacagtgactggcactctttccgaggaacagtttttgaagctgagccaatgtaagatcctaagtctggtgtagtcattttatgcatttagggagagaccctgtgtgaaagcaatgaagcagaactgagagaggaacaagggcctgttgacattgttttcttatctctatattctgccctgccagaagcctctgcacttttcatttagttgaggcaataaatcactatttcattcaagacaggttagatcaggttttctgtcacgtggaacagaatcataactgataaaatgtggaagaacttttaaatatatgttcacatagaaggtaagcctgtaagtatgaagattctaatcattagaagaatttttatggaggagttagacaattacttgaaataaatatttaaaatggaccaatcatcagaatagtgattggtcttgatcacatttatgaggctgggaagtagaggggtgaccccaggaagcaataaatcaaaaagaagggagaagagaatcttaagagggtatcctttggccctaggccatctatccaatcctgttattgctaagaggtcattgtaaataacggatacttaaagcaagtacattatatgccaagcactgcagacactaagtgatttaaattgaatgatctggtcagagtcaacgtaagatcaaatccaactggcttactgccaaaatagttctatgtgcctaacaggtagtgatacctcatattggcaatgctggatcagcagaaattactaatgattttggcagccaacaagctccatgaggtaataatgaaagctatagctttaaatagctcaatggaaaaattcaatggggcagaagggaattgcaatgggctttctgaactgttctgttgatgctgcttagcaaatgtagctccttgagttgttttcatttcatcaaaatcatgatactcttgagtgttggcaaggaaatatcaggtaatgataaagtggtgaacatgcctttcatcagctgaaaatctttaattgtaaatgcagcatgtaatggtgtaattagttgtctaagtgacaggataggctcaaatctttgctagtattttgcaaaaagaccattaggtttccacatccctttcttcaaataagatgatgagcaggcaaagataagtaagggattcatttttaaccccatgaactgagcacactccccgctagaaatgataagaggctataggaaagtaccatagtgtgtcaggccagatctcactgacacagacctccataacaactgtttctgtactgactgagtggttaagttaaatattaaaagccagtgcccttatacaaaagctgggatgtaagaaaagcccaccaacagttttgcctaggccttttctggaccttaaagcatgacaaaaataacaaaggaatttttaacaggatccatttaggattaaacaagtctaactgtgggtctgaagaaactccccaggcctccacaaacgtgtttgccagcggggctgaaggaactccccaaaccaccgtgatttagcaggagacaagatgagggtaatcaccctagcacctggacccatttagattaagtaagtttactgagactccagaggaaggcctcaggactcagaccttagctatagattaaaataagttaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcgcaagaacaaaaaaccaaacaccgtatattctcactcataggtgggaattgaacaatgagatcacatggacacatgaaggggaataccacactctggggactgtggtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaataagttaatcacttatgtctttagatgaatgcatactttcacctagacatatagcttagaaggtatataagctctggaaaactttgtaattttgagttggtctggtgataatttccaggccttctctctgtaactgtttgcagatatgaaagctctctccctccccaattcatcttgattttgttattgggccacgagaaatagcagccggacccacactttggtccagaaacaataggttagtactgctactcagatatgtgttggttctaaagaaaacacacacagaggtaaatagtaaggatcatattttaagcaactcaaggaactataaatatatttgctccctaaatcttagacacaatcttgcaaaacaggtattattatttccatttttcatacaagacaattggggctcatagaaattgagaacatatttagggtcccacagctagtatgttgcaaaaacagagctgtgatttgtacctagtgcaaaatctaagtgtcaaacttcaaagttctttaaacagaataccttcaactgtctttaaacttttagaaagctggttctaaaatttctctacatacaagaattatagaaaagcttgctaaaatatgagtttccatgagcacatacatgtgtatgacagagagggagagagagatttgagttggtagattatgaatgcagctaagaaatttgcaatttaactacttcctcagggaatcttgaggcaggtattcctcagaccacacagtttagaatgtcctttgcaaaatcctgtatgacagaagtctggagatttttatacagggacatcatacaatgaggcttctaatagaatcttgatgacaaactgcaacatgtaaaaagacagacttatacttaatcagaaccagttgcatagaaagccctaggctttttaaagttacattaaaaaaagaacatagggcctcaatcactaaactcaaattggatttgtaactccaggactgttagaaaaacagctttttcatctgcacctgttatggtggagatgattctagaatgagcagagtgaatccaagaaagtatttttcttcatgaaggaaacaaatagtgctctaggcaactgtggttgatggatgtgatagcagatcctttcttagcatcctcaccttataaaattaatagatcctcacttttaaacatattatagaaaatggaaaagagaatcaaacgaacaaaatctatttttctaaattaaaaagcttgaaaaagccctgcttcctttgtctgtcataatgatatcgctggatcactgccaaatcagaagctatatgaatgattgttcttagataatagttccttctgcaaaatataaagctacttttcccaaaactcataccatgagtttccaaacataataaatcctagttttctaaaaatatcttttattttggaactgattttgccttaattttaaccactgcccgctaaagaattatgtcagttatactcataggcatttcaatgttgtacaactattaccattgtacaaattctactgtctgcttagtaatgctgccaacatcattaattttaacagaaagatttatacattgcaaagatatgctttttaaaatgctggtccctcaaagttttttttctgtacaactataagtattgtattttattcaagacaatcaaaagtgtttttggtaattacatttattcataaaaatgtttatatagatttctttgtgacagtagcagcaagtatgcattgtcgtagccttatccaaccctcttgacattttgcttttcccttgtgcaggaaatggggaggtttcaagtggtgagggcaggctggaactgggaggggaagaggaaggaatcagaacagcaaggcttttgtggttttctgggcttctcagttgatttaatgcagcagaaatcagataaccagtatcatcaatcatgacaatcatatgaactgtctccatgcttagattgctttattctcagaatcattattttcaaattatttggtctgaataaagatttccatgccagttaaaaaatgatcctctatatctcccatttcagctatgaagcaatgaaaataacaaatacagctttctttgagaaaacctgaatttgaatcttgacattgatacaaataggaagcagacaaatgctgggtagaagagggaggttccccagcaaaggccctggccttaaggctggaaactatggcccctaaatgagaacagttatccccattttccagccaaaatgttgctttttccaaaaccacactggcccaccaatccccacatcctgtacccataaaaaccacaaaccccactggcagaggagcagagtggcttggcagagaaggagagaagagaagaagcatctcaacgtcaagaggagaagattcttttcccacttcaccccctttccagcttcccatcccactgagtgccacctccatcattcaataaaatctctgcatctttcaagtctgtgtaacctgattcttcctggatgccacacaagaacctggttaccaagagggcagggtgtaaaaggctgtcaccttgactctccattgagatggttaacacttagccatctgcagacagcaactgctaaaagagcattaattgtaaaacacccctaaacactgccatggggccagagcccaaaagcgctctccctggctcctgcacctgctcacctgcgtgcttgccctccaggaaagggcttgagccacatccccattgcaagttcccagagcgggtcaagggagccttgtgggcccttgggtgagttacttaagtcactgagtttcagttttgtcacctgtaaaatggagacaataatgcctatttctcagagttgctctagagacaaaatgatacagtattttgaggagagctcattcatattaaactcccaatttttttgtttgtttgggaagactaatataagtgttgatttgctttgtttttttcattataattatcaggtttccctacatatatgtatatatatatatatatatatattttctatttgcttctatttgaaatatcaagtgaacaaaacattttttaataacttctcagcattctagcttgagattttaagctgtaatctatcccagaatttctgatgtcttcaatggctgctacaaaacaaaaacataaactttaaatgcaactcatttggattttttcccctttcttgctttcctctgattgatattttctttcatttttcttatttcacttcttcccactgtttccttgaaaattatactcctgtataaccttttagctttaatatccaccattttaacattcatatctttatctttctcctgaataatttaaagatattacagtgagtatattttaatgctaaatacttttcatcaaatgtacaagcaaatttcctaaagcatttcaaaattgttttaaatttattattaattgttgtggatacatactagttgtacatattttgggggtacatatgatattttaatgcacaacattttcttctatactgtttcctgctccataaatgagacagtgttgttgatgctgttttgtgttgctttagaatacaattcatgtttatttgtatttaatacacatttacaattatttttacttagcaagatgctttccatctaagacagtccatttgtgatagtattccctctgcctaaattacatatttagaagtttgttttttgagggtctgttggtggtaaacttaatatttgtttgtctgtagatttgttatcttgcctctgctcttgatggaaagttttcttggatgttgttagtctatagaattgtagggtgaccattttgggaggggtgtgtgtgtgtgtgggtgtgtgtgtgtgtgtgtgtgtgtgggtgtgtgtgtgtgtgtgtatttgcccagcacaggtatgttattctgctgttttctaattccattgttgaaaaaccatttagcagagtaagtaccagtcctttgaaggaaatctgcctgtttcctctgtctactattaagttttctgtttatttttctgctggctcgctatgatgtatcagaatgtaggtattattatctgtttatactgagaatcaatgtgtttttcaacaattttcaaaggtatcagccagctatcatctagttgaatatgccttcttcctcctctttatactatcctataaaaaatagtagtccctctcttatccacagggcgtacattctaagaccctcagtggatgcctgaaactgcagatagtactgaaccctacgtacactgtgttttttcctatacatgcatatctataataaagtttaaaattagtttataaattaggcacaggaaaagatgaacaacaataactaagaatagaacaattataaaagtatattgtagtacaataatgtggtctttctctctctcagaacaccttgttgtactataccacaggttggctgaaactatggaaagcaaaactgtggataagctggggaggtgcagggggctcatatagagtatatactgttgtggacatttatacactggcctacattttttaccctctcataatttccatctctttgcccatctgtgcttaattctaaataacttcttcaggtctgaataaatttttcgggtctgttgttgatgtctaggctaatctactatctgattcaccattgaggttttaaatctaattattgcatctttcccccccctctttctagtcattccattcatttccttctcaaatgtgccagttgtttttgtagcctcttatttattgcttatattctcaaactttaaaaaattaaagacaatttatttgatgactgctaattgcaaaatctaaataattttgtatctgattctgtttccttgtttctactggctttctcccaggataatttgtttttttatgccttgtattcttctggaacttttggttacgggtgaataatactcttcagaatgttatctttaggtgttattttaagcctgggttaaatatgcatttctcccaagaatatgtgtgcttacttttgccagtcttatatatgtattacctataagagaccaccttacatttatcttttccctacagtatactatgaatgtgggccaaaaatcaaattttgtttatggtcataaattctcaggggaagcctgttttccctttgactcagtgccaaggtcaagacatgcaagacattgcaaactctctgagcaatgttctaatttcttgttcagccttattgtgacagcagacctttttgtcttggctttatgtagggcacttcctattagtcttcacaccttgggtatgcccaaaattttaaatcctgtctctcccactccctgagagaaatttaaaatagaagttcaaattaaaagttctcaaaaccctaagatcaaaatgttgctctgagaaacacttaagtccccagatctcatactttaattgtgtgtggcttctgcatactctttcttttgttgaagcacaaaatctactttacaataattttttaaaaactattccttaaacatagtgatcttttatgtctttgccatttttctgctaactcccctgcacctaccaagttacgacaattggacttctcccctcatcactatattctgaaagaataatttttgtcatatatttattttaatgcatattacaaatatgtacttatactcagaaatcattttattttcacttatttgaatctatgtataaatcttatatagcctattaaaaaaaaaacactaaagtgtatatttagagccaaaaaaacatttagagagcacctagacctaacctttggaaggtgcagggactttcctaatattacaaggtgtcaggtgggaccagaatccaactctagggtaatctgatacagtgttcttcctaccaaaacaaggtttatttttaaagtatggtcataacgttctgtcttctaaacaaaattcattttatctaatgaggaagtgagcttaaaataaagatttgatgtttctgacctgatggtaattttcacaaatctcagacattgatgctggagaggagaaatttcaattagatatttgatgatcactacagacaaagctgaataatcataatctcatgtgggtggtgatatatttagcaaacagtaaacatgagagactacactaaggagttgtagcacaaaaccatattttgtctatatttattgaaaactaattagccatgaattgcagggaaattgcttgaatttattagtgaggtgcaagtctaagatataaacgtaatgttcttatattgtattgtgtacttttctaaatttgtaaacttttcattccaaaagtttaatggcccacactctcaaataagctgtagatgggaaacagaaaaatgaaatccctcagggaagtattagctaagataatgatcaagtaagcaaagtatagataacaacagtgaaggccagcagcagaaaaaccggctcaccaaggaagaaaatatcataggagtgtctgcatttctgggaaaccaagcagaggggcctttgtgttgaggcctcagtttcccaagtctcaaggatgagccaggggaattgggcgagagtttgggaggtagtaaacaaaccaagacgcagtgttattcagggtctgtgactaatgagatagcgaccatatatcatgtagccatatatcagtaattttctaggaggctcctcatttcatacattctgaccctgtgtacatattagcagaataaactgaaaattccaagatggtgtattcccactgtattgccaaaactgcctctagaactcaacaaaggcacagaaatcccttctcatactacatattacattttagagtcaaataatgtgtacactctatctgtaaaatggcaaaatcagagaaaaatttgaatggcagcagtgattataaactgcttaagtttaatggcattcatttaatcataaatatatggaaagaaacactgggaaattaactgcatgatcttaaaatgagaaagagtcttctaaacagaaaaacaaaaatgatagattagtctatattataaaaagaaataaaaggcaaaatgtatatctaccctactttgagtgagactaaatatcactgccttagagcactaaaatatttctcacatcaacgatcatatctgaaattctcataactagagtcactcattttgcactcattaatgtggttccaccttggagtgggataatgtatttcatttaacatgttaacatacaattacagatatatttacctgattattctctcagtgctactgtcattttaaatttaagacaaaacttaagctttaacatttaataaaatattttgaattttattttataatttatgcatcttttcatttttcctcatttctcagaaagtgaaataaatatatttggagcaatcaagttttagaaatgtgatagtatactgtgctagcgatagaaaaaatgaaacggagggagaattgaaaatgaaagcatgccaggggtagaatgatatggtttggttctgtgtccccaccaaaatctcatctcaaattgtaattcccatgtgtcaagggaggaacctggtgggaggtgactggatcatggggcagtttcccccatgctgttctcacaacaatgagatctgaaggtttaaaagggtttaaaagtgtgcagtggttttcccccaaccactctcctgtcaccatgtaagatgtgccttgcttccccattgccttctgccataattataagcttcctgaggcctccccagccatgcagaaccgtgagacaattaaacttattttctttataaattacccagtctcaggtagttctttatagcattgtgaaaatggactaatgcagtgatgaatcacatttactgatttgcttatgttgaaccaaccttgtttccctacttgattatggtggataagcttttagatgtggtactaaatttggtttgctgatactttgtagaggatttttgcatcaatgttcaacaaggataatgccctgaaattttctttttttgttgtatctttggcaggttttggtatcaggatgatgctggcctcattatatgaacatatggacacctagaggggaacaacatatactagggcctctcagagaatgaagggtgagaggagagatagtatcaggaaaaataactaacgagtactaggcttaatacctgggtgattaaataatctgtacaacaaatccccatgacacaagtttatctatgtaacaaagctgcacatgtacctctgaacttgaaagtgaaaaaaaaatcttcagtatgtcatatttcaaaatacagtaatataaatttgtacacctatttatcagactaaatttatggaatatatataaataattagctaaaatataaataaatgttacatttataaattaagtatattatctacaaatagcaattctagagtgtataaaacatatatttatgaggacatttatattaaattatacaaataatttatcttcgcaaaaagactattaattaggattacccttattgtataataaggaaacttgtactaagaaaggataaataatatacccatggttactcttctaataactgggatatctcagtcttatgcttttccatcaccaaatcattggttcttgtgtaaaatacattttatcatttctatgaataaacctagaaaattattttggctgtgtgcatttaaccttatttataacaccaataacatcttttttttaaacttttaagttcaaggatacaagtgcagatttgttacataggcaaacttgtatcattgagggtttgttttatagattatttcactacccagttattaagtctagtgaccattagttatttttcctgaacctcttcctcctcccaccttccaacttccaaaaaaccttagggagtgttgttcccctctatgtgtccatttgttctcatcatttggctcccacttgcaagcgagaacatgtggtatttggttttctgttcctgtgttagtttgctaaggataatgacctccagctccatccatgtcctgcaaaggacatgattgtgttctttattatggctgcatagtattccatggtatatatgtaccacattttctttatacagtctatcattcatgggcatttagcttgattccatgtctttgctattgtgaatggtgctgcaatgaacatatgtgtacttgtgtctttataatagaatgatttatattcattgggtatatatccattaatgggattgctgggtcaaatgatattagggaataccacactgcctttgtatttattcaaggtttgttttttttttttttttttttttttttttaatggagtctcgctctgtcacccaggctggagtgcagtggagcgatcttggctcactgcaagttccgtctcctgggttcacaccattctcccacctcagcctcccaagtagctgggaccacaggcgcctgccaccaggcctggctaatttttgtttttttgtatttttagtagagacagggtttcaccatgttagccaggatgggctcaatctactgacctcgtgatccgcctgccttggcctcccaaagcgctgggatttacaggcatgagccaccatgcctggcctattcaagctttaattgtactttctcaaagtcatgcctcaaagcctttctgctctattaccagtgtatccttgtcttactatctgctggcttggctgatgccttttgttctctctctctacacttcaggttcctgggttcttctaccttgcccattctcacatgaatttcccaggcaataatctgagacaaagtttctgaaacttatcattggcattaatatatgtaattatgtgtccttttagtttttataaccttatctcctacataatgaaacgtaggaacttgtagttggggaaggtatttagagttcttgatatcaccaacatggttgcagttgactactataatttcaataggctccctataatacctttattgcctatctgaaagggtcagattgtgaaatccttcaggacaaattcaaggtcttttacttgtctttttatctctctaaattataaaataatataccacttttttttttttttgagatgtagtttcactctttttgcccaggctggagtgcaatggcacgatctcggctcactgcaatctccacctcccaggttcaagcaattctcctacctcagcctcccaagtagctgggattacaggtatgtaccaccattccctgctaattttttgtatctagtagtgatggggcttcaccatattagacaggctgctctcaaactcctgacctcaggtgatccacctgcctcagcctttgaaagtgctgggattataggcatgtgccactatgcccagccaataatataccacttttaaagtgctaaatattttcttgcttagtttcattcctagtcacaatttattctttatgggaaatgttcaatatggacttaatcaaagcccctatttttccttcaaataatgccctttaaaaagtgcctcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaagtgcctcattctcattttacgcctaaagaaaatataatggttagcaaatataggtcctttggtaaacttaaaaatgaatatatttttttcaaaatgcaaaagaaaaaactgcacctaaacttgtccagaagcatcagttaaacaaaagcagtcaacagcctccagcttccattgtaaatgaactttgtaataggctgcttacctgtttttgtggttagaaacattactgaacagcatgaggtcctgtattataatgtggttgaagaaaaaagcattccaatataagctttgaaattgtttgcttatagaaatccagaccaatggtaaaaattagtgttttggatattgccaacattttactccttgatacacttataaagctccttcctctaaagggatttggctttgatggactattaactaaggacacatggtatctgaagtgataaagacaaattagatttattttcttgctcccttatgaaagtcttgaaatctattattattttcaatggaaggcttatttaaatgatgtttctggtggtttttattatatataaacttttttatttttgctttgatgtagctaagatattacagacttcacttagaatatgatgaaaggaaggttagggttacaaaattgaaacctcacaagaccactgtcttagatcaaagacttcagctgaaaataatgggctgggttctgataattcattcttacaaaggagtacacttttatccaacccaggctacattataatgtttctttgccgtataatgtaactaggcaggtaatagcactgaaagactttttaataaccttattgtctcctaatcttaatatctttagtaagagtgagaagctataaaaatagtaaaatatgtgatgtataattttaagagggatagtaacatactcttcttataaaaagtttaatgcttaagataagtaatgatttcaatatgagcattatgtaaattatatttatacacatgtctaagtatgtttgcaaatatatcatacatatatacatatatatgtgtgtgtgtgcacatgtatacacacacattacccagagcacacaaccattcataataatgccacatttaactggcaatcacttaggtgttataaagactactgagaatgtggaaataaacaaaacagcacctgaacattacaaatcaattacgtaaaacactttcatttaagattgtgaatattatttgtaggaacattctacattcccatgtttggttatctaatttttctgtcctcaggttaaaatattctgattctgagtttagctagaaggagtaacagtgtcaaaagcaagacattgtcaattgatatctgcatacatgcaaatatgtagcacatttatacacacatcaggtttgtttattaagtgtataacaaatgactttctctctttaactgatactgaaggcatccctatattaaaagcccaagataaaattggtcatagcaatgatatatgaaatccttcaatgattttatacaattagcttttgaaagtaaaatatgtgtatgctatactgaagaataacacatttacacaaatattttttaaactgaagcatatatatatatagatatagatatatagatatagatatagtctacctatctgaaatgtttactttaggccttgagaaagagaatatatttattctaaacctatttttttaataattaaattggtatcataacacacaccttgttataaaaactatatgattaagagaataagacaagccacagggtggaagaaacatttgcacaagatatagctgataaaaaactgttatccaaaatatgcaaagaactcttcaaactcaacaataagaaaacaatctgattaaaaaatgctcaaggctgggtgccatggctcatgcctgtaatcccaacacttcgggaggtcaaggtgggcagatcacctgaggtcaggagttcaagactattctgaccaatatggtgaaaccccgtctgtactaaaatacaaaaattagctgggcgtggtggcatgtgtttgtggtcccagctacacaggaggctaagacaggagaattgcttgaacccaggaggcagaggttgcagtgagccgaaattgcatcactgcactccagcctgggtgataaaatgagactccatctcaaagggaaaaccaaaccaaaccaaaccaaaccaaaccaaaccaaaccaagccaaaccaaaccaaaccaaaccggaaaaacaccttaaaagatctgaacacacatctcaccataaaataaatgaaaagagctgggtgcggtggctcacaactgtaatccccgcactttgggaggcagaggcgggcagatcacctgaggtcaggagtttgagaccaacctggccagtatggtgaaaccccatgtctactaaaaatgcaaaaattagctgggcgtggtgggaggtgcctgtaatccgagatactcaggagactgaggtaggagaattgcttaaacccaggagacggaggttgcagtgaaccgagattgcaccatcgctctccagcgggggcaacacagtgagactccatctcaaaaaaataaaatgaataaataatggaagataagcatatgaaaagttgctcaacatcatatgacattaagaaagtgaaaattaaaacaatgcggtaccactacgatctattcccatggggaaaatccaaaacactgacaacattaaattatggtaaggatgtggaacaacagaaattatcatttatttccagtgggaatccaaaatgatacagccattttggaagatagtttgacagtttcttataaaattaaacatacacctaccatacgttcacattctttagtatttaccaaaatgcgttgaaaacttatgtccacataaaatcctacacagatgcttaggggagctttattgacaattgtcaaaacttggaaactccaagatgtccttcagtaggtaaatgtacaaatacactgatacatccagacaatagaatattattcagtgctaaaaagaaatgatctcctaagccatgaaagaaatgtaggaaaattaaatacatatcactaagagaaagaagctgatcttaaagggctacatactgcatgattccaattacatgaaattctaaaaaataataaataaataaaggcaatactattgatatatttaaaagatccatgattgccaggttagggagcagtgcagaggaataggtagaacatggaggatttttagggtgatgaaacagtctgtatgatactataatggtggatacatcattaaaatttgctcaaacctatagaagatgcagcaagagtgaatcctaatgtgaactatgaactctgagtgataataatgtgttgacataggttcatcaattgtaacaaatgtacttctctggtgggggatgttgatagtgggaaaggttgtaggtgaataggaaaagatatatatatatatatacataggaacactgtaatttcctcttgatttctctgtgaacctacaactgctctaaaaatgtaaagtctacatatttacaaaaaaactaaatgagaagacaaaagtatgcaagagtttagcatcatgtttgatgtgtagtatgcactcaataaataacaaccacttgaatagttaataatgttaaatcccaaacacctagcagagagtctcacacacaatatgtacttggaaaatatttttactaagtgaatgaataaaacattggatcctccacctgtgtcatgtcaaaagaaacataataaaatgaaataaagtttataaattttatagtaaaaaattgagacaaattatctatggtttcaagatacaccgtgaaatactatgcagccataaaaaaaaaggtcatgtcctttgcagggacatggatgaaactggaaaccaccattctcagcaaagttacacaagaagaaaaaaacaaacaccacatattctcactcataagtgggagttgaacagtgagaacgcatggacacagggaggagaacatcacacaccgggggcctgtcgagggttgggaggtggggtgggatagcattaggagaaatacctaatgtaaatgacgagttgatgagtgcagcaaaccaacatggcacaggtatacctatgtaacaaacatgcacgttgtgcatatgtaccccagaacttgaaatataataatagtgaaaaataaataagtaaaaaagaaaaagaaaataatcatggctaaatgttgtttatgaccgaatctttgtttttattattggcagaatttttttaaaagaatacaagattgaagaaatataaagcattctttgacataggacccacaaggcttgccacatgggggcaaaccaattgtacatcgtccttcctttgatggtggtctatgccatatgctttagagtaacacaaatggacaaaacctccataagtacctagttgaggagtgcaatataaaacagtgagattttccccccgacctaaagagaggatgggtcccaatggcccttacatatttaattcagccaagtggaactcatttgacttttatgcttaattttgagttttatgtttagtttctttttgtgaatttcgctaaaatatttgcctccatatgtcttccagcggtatcttttgcaaagtcacaatgattcttctatgtattacaggtgctgttttattttttttatttaatgagagtaatgtcagcattatctaaatggagaattgagtatgatggttttcatcattgatataatcaaaagtcagatgtaccaggaaactaaaactctgatggtaaaatcattcattatccaattgctctggaagaacaaagaggatatactaggttgtttttggtgaaaatttaaacatcatttcgccttatatcctacccatttatctcccgaactgggttggctgtttctttaccctaaaaggacttcacatttagtacttataatgtattaaaattgactcttcattttctctcaaacttgactagaaatttcctaaaaggaaagatttccttctttactgtttttccgaacatctagtacaatgaatgacatgtagtaggagtttgataactgtttgtaaagctagagttcatacttgggaagcagcctcgatctctccaagaagatcacttgtgagatcccttcattgttcagacagatctggttcttttattggcagagaaggttatatgctatgaaaattctggtcacttctttctgaaaaatgccaccattcaagagtcattaagtagcttaagatattttatcctggtcattatcactagtactcttaatacggccggcactgctgggaaatctttattgagatcttattccgtgttaggtactgtgctttataagcattatcttatttaattgtcacaacaattcttggtgcttgttattattgcttatattgaacattgaagcccaggcttactgaggtaataagagttagagcctagatttaaatctggcagtttgattcaagagttagaaagcaatcacatttcaaagaagtagaacacaaactatcaaaacattctactatgtgaatgtgattataattattttttatctaaaagccaggcaggactttggaaagatgagaatgaaagaaaagaggtgaagatataattacaggatacataaaaacagttgcttttttattaaattgatcactaaactatatattagtattcaacttgcaattcattagttacaagtgaggtggaatatcacttcatgcttcctatgtttttatttaatatgtttcaaattttccctaaaaattttacatatgtgtagcttaaagattcaaatcattgtacaagaattatttccacaggcagttgttttatatggcctccaattctttatctgaatatttgagagagaaaaaatttcaacaaataaatgtttcaatgttttcaaagtaaaattatgttgccaggtgaaattataatatagtggctattaacctttgttgcttattatactgggggcttttggaaaccttaacgccagggctatacatcaaatcaattaagtcagaatctctggacataggactcaggtgttagtattttttttaaacccctgggcattccaaagttgagaattactgttacagaaccatttggaatagttaatgatatacaaaataccctgaaaaaaagcttttccctagcagtaacagctagagcttcagctgtcaatgaaaaaataaatagtacaataaaaagtcactaaaagggaaaattattactaccagtcattgctatttgcattcctaaaaggtgattcaatctcatcacaagcaaacaaatattttgtagttgtactcacaaccattgaaaattgggacgttcccaataaactaaaagcagaagataaacagaacaggaataacctattctactttggagatgaggatacctaaaataagttttcaaggtgaggaagcaactttatagtccttttcataaatatacagtgctcatgattacatatattactctcttctgggctgtaaatgaatttcccttgtataatacatagtcacaaataccacttaaaacacaatatatttatttttaacatactttatttaaattaacatagactggtatatgccttttttgtttgtaaagctattggcctaatttttatatgctaacagtatttttgcacttcaaaaatttcatgtaattcccccgtggtcaaaagataaatgagagcagataaagaaacacctgggcatataagattttggatattattttaggtgacatcggaagcctttggaggttgagagtggaggactgacatggcttgatttacacattaacagaacatctcctctgtgaagaatagactatagggaggtaagggggcaagcaagaggacaggttaaagagttatttcagctaccttattttagctacagccaagtatgagatgttggtggccctgggtcagtgagtagtagagatgctttgagtgatgggatcttgaatatagtttaatagataatatttttcaagacatagatgtgggttatacttgggatataggatgtagaaaagaggagtcaaagtaaatatgtaactctatcacaagttatttgtgttcagaaactgagagttgccctaatatgattattaagtaggcatttttgaaattttaatttcttgatttgtctcaccaatgatgatcactttctcaggattttgaagaaactcacagttcttgtagttcagatatgcatatataacataaacaaagtgatttctagtgatttcctttgcctttattccaacatatacacagattatgcatagaaaattaatcttgcaacaactcaaataacctcataagttatttagctccttctcattattataaactcagagcctgaatcactggaaagctacgctgccaccaatgccaggattcatgactttgtcattgtgtcacgtttcagcagtgactttcaataaccagaagttgtgaagatgttaggcagcttcatatggaaataacgctttattcaggtaatgatctaaatgtccattttttgttactaataaaccaccacgtaactttccataaagaaatgaaacttcctacttcagaaaaacactattctattaatttttctctatgtgggggtctaaattaaatatgaaacctgtgccatatatttccaatgagaggctatgcaaattttctataaatattcaaggtggacctgtcccttcctcatttctctacattccattttctaattaagactcgattttcaataaataaaaactaattatatgaaaatactggccactaccccaaaagtaatatcttaacaatcagtgcttcagatgaattaaactaactgtatatttttttaaattgctaaactagattcagttcatctctttcttaaatgttttcaaatcatatcttttgaatgtttcaacctagaagcatcttcatgttgctgccatttaacattatattaaactatggtatcgttggacaataattgctaccatttaacaattatgctaaactatggtatcattagacaatatagaatacttatgacttactctacctatacagaattttcatatatgctgtttatatttgtctttccatcactgcaagcttcataaaaacaaacaaacaaaaaagtatgtctaatttgtttgccactattcaactagggtcttgcaaatagcactaggtttgacatacaacatgattcgaagaagatggtgatgtaagatgtttacattttagtcatctaagaaaataaaggaagaaagagaaggaaaaagggagataacttgaagaggaggagggctggaagagaaaaagaccttgtgtaaataaggagatttgagtgcttgtttcagcccagatattaaacagttaagttattttgaagcaagtgctactctggtggaacagtgaatttaatcatctgaactctgaagttctttccagattttatacttcttaaccttaatttgcaatataggtacatatgcaccaaacacatgtatgatatatatgattcctgatacaatttaaagtatatcaatgccaagttttataaaagtattcaaatactatatgagaaattacaagatagcattcttctcattgagagtaaagaactgtgtaattcttaacactccatacagttacaaaatatcttgagagcttggaaggcagtctcagttccagtatttacctacagtattacagaacctgctactataaagtatcataacaaaaccattacctaattgttctgggagtgacattcaactctatatgtagtagaaaaagaaaattgttcaaatgtataccttaggtagttaacttggaaaactgcacttgcatttcctgaaggaatgtaatcatgatcatttcatttgtgccacataactgctataacagcaagacgctttttcttaagagaacacatttgtgccataaataagcaataatgtatagagaaaaccatcagcaaggatatgaaagctgagttttgctatggcattccttattattttatgacatttgaagcaatagagttttttccttctgttaagaaatctgaatagtatcaacatgaaaaggctaagaaaacattttctattaatacttcgatagattctatatgtaggggaaatgtgctcagtacaaagtaagattcctaaaagacaaagtaatatttctaaaaataactagacaacacatatctactgaaggcttgtccgtttttagaattacataaattaatccagaaatgggattgctataaggcattaaaaccacatgtatcttagtgtctttcacatgatgctcatgttattctgccttgttttattgctgtgtactagtttgattccctgatagattgtacagtatttgagaataaagtttgttttcactgcagttcttaacaatttatgaatctgatacagtttaatggaggcatcagttgggctcactatttttctttatgcataagtttatttaaataatattttgaacataaactgacattatgattcctatctaattttgagatacataaatagcaaaatttcatttgatgtgaaaaaatcacaagctgttatgtgtgtgtttatatgcatgtagatattatagttagcaattttttgataatcaaaaactcagaattaaaattaaatgtcagaataggtttatctcataggtcttttaatctccacattactcagtagtcatggaaagaaaatacaacttatttttaaataggattatataattgtactgattaatatatagaagtaaaaaataaccattgtaaatatctatatttatatgaaatcactagttatatcaataaacttaatttcaaagaaatactaaagaaatatataattcaatataatttttaaaaagtgactacagtatcttcataagatggttttaacacagaattcaacccagattggtagaaaaaaattatccacttcacttttttgtctgtcttctcattggtagctcaatcataagctaagcagaattccatccctaacaaattccatccctatcaaactcccataatagtgaacaatgtcaccatctaacttgttgctcaatttaaaaacttgagcgtcatcactgacaactctctctccttccgcttcatatccaaatgatcactaacacctgaatttgatctttatttaaactttcacttatttattggcaaaattacatagaacttcacacagctgtattaagtgatatatacctaaatatatgtatataatatatggcatgttattctgatagttttaacagctgtaacagttgattaattttacactttggaatgtcaaaagcaaagttgtatgtgaaaaattaatcttattactagtgtactagtgtggtagctggatttgaatagtttttaagataaagttttagaaactctttcacatagaaattcatcctatataacatattacaatgaaggagaacttatgttttaagttactttggattatgttcactgatacattaggttttaaatagactgtatcaatatctacatatacaaacatttacactcctgtgtaaaaaaaaaaaaaaaaaaagaagttatgactctagggagaagaagagctatgagttacacgtaaagagtcccttacacagcctggctttaaaattaaaattaaaaaaataaataaaaaccaggtatgggttctgactatttatatagtgattattgatagtgataaccatctatgaacttaataactgctattagtgaataacttgataaaatatatttaaaaagaagaaagcttttctaacgcatagggcaaaaaagatcaacttctaatactgcttcagcctttgttaagaatcacttctcttctcatacattaactacatttatgaactatgctagaattcaatggtcgtaagaaaccagatctgacatatctgcccggacatgcaattagatcagctctttttccattttaatcctaatacaagagtttctaatttaagcattcaaactaaatggaaacctctaaggtctgtcagtttcatccacaaagctcttttgttagacagttccatcaaaagttagacaattcattttactaggaaaagaactgatcagtagaagaataaattgtatccttaatgcatggacagatcactggattactgttaaagtattattacttaagcagaatctccttttgaaggagtcttgcagtccatgtcataaactgattaaaaatcagtgaatgagtactttctacctttgttgtatgttaatgagaaagcctctatcccagaaagcttttctggaagctggtaacctttagcttcctgaaactagagcatattagagctatgcaagcacaaaagttctaatcaccagttcctagaacagaaacttgtattttaaaatataatttatttcattgaatgaaaactttttatatttgattaccagccttcatactcatattattatatgtcaacaaataatgaaatcatgtcactcttcatatgtgtatatttgtttgtattaaggagaatgatacataagaaagagtattttatgtgtgcatctatgtgtgtatgtggggagagagagaggggtgaggaataattactcagaaagtactagctatagaaaatagtcttctgactcagaacggcaaagagccaactttcttgtaacgaataaaaccttagaatggtccatttaaaaaccacaaataattgatgtaaatagaaacacggcataaatacaaagcatttattagtattttcatttaatctcgtttgagctgtatacacttagaaaagtggcttaaaaagattgcatcagagtatttttaaaggacaaaatagatgttttttatttaatatcaaaacttataaatgctcactgtgatagaatatagaagaaagaaaactaaaatttattagatacttaactatgttctggctttctgaccttctgacatatgtgagatcctaattattcagttaagaaaactgaggttctatctagtaaatatcttactcagagtcccccagttacagaatgggacgaggattcaaatttaggtctgtggaatttcgaggttcattctctctcagctgtgtctccaccttccacatgtaagatactcagaatagttctatttgaatttatttatatccttttttcctagcccacattaatgatattaatgtaaaagtgaagtcttcaaaatgagattgatgttttaacgtaacactcccttcacagtactgaggtaaactaagaaatttgtttggcaaaattccagggagcacatttctgagaatttaattggtaatttgattgaagtgacataccatatttcaaatgtttattttttactggtttgaataaccaaagaatgtatataaagtccagaaagaggaaaggaataaattataaagatatgaaagtcctttatctttccagtttgaaataagtgttctgcatacaaaaataaaatgttgtcatcaataagttgatgtaagttttctggagttattcggtaactatccacatatcaagttgtatacccataaacccccaaaattctacctaggccttaatacagatgaagtatatatgtattaaagcaactgaaactttatttatagcactaaaacaggaaatgattaatgcctattggtgagggattggttaattaaaacattaaacatttatacactggtatcctgtacagtaattcaaaaggatgagtaggactatattttattgacatgtaaagatgtctatgatatattgtttattttaaaaagtagtatcaaaaataaacagtaaaaaaattatgatcttatttgtataacttgcaaaatttgtctatctttcgtagaggagaatgttcaacttctaagatctcacctctctctggtgggagtttgtgtggcttttactttctcctttgtgtttaaaagttacacacagctcaattttaccaaaacaatgacaaaacttacaaacaataataaaacaataatcatcatcatggcatgtgtctttgaagtcattgacctcatatttaataagttggcaaattgtatcgattcaatctctatgtcttatttttggcttctactgttctacctaaggtctttactttcaactgtcttgtggcagtagttcctttattgttgcatctagtttctcattccccttcaatgagttccacacattctaaaactgaaatctaaaaccaaaaatgtgtttaatgtcataataatctatcaactctaaggataattttagggtaaatatcacatttttcttctactccttttttcccttaatgctttacctcgctttttatggatacattgttgtatttaatgcaaaagccttgagtttgggttataggaactactgatgagtgttttttgtaacattattaaaaatagactaaagtcatcgtttctctttaaatatattacttggttaccctcaaagtgcaaacataaaaggatacaaatttgttagccagtctttaaggtggcttcacaatctgattcctgtatagctttatatcttctttactctcttttctaccacgtgctttgtttattactgattactcatggctgtgacccccaacccaaccaactttcatcctgttttcttaggctgatacttcttacagcagtgcaatcatttccacctctatcaaagctccaaatattaccataccttgctcaaattctattatttccccaagccttatgagatcttcccattcatcatttacccctctcatcctcactttccaactagatgttttaattttcttatagtgctcaactactgaataggcctatgcgtattgtgatcacagccagcaaaactgtctctccatcagtcactggtttgcccgaaagtcataaaatagtttatgttcattcattttacaaattatacagcagtaaaaacggtaaggaagtattatttaaattatgtgtagtagcattttctaccccttagaagctggctctaaccctaaaagtgaattcatttaagcacacagggatttctagaggtgatctgagtgctgacagtgatggccaactcatctagaaactagacaatcatccagtttggattagctgcaacatactgctgaatgtttagagaactggtcaccaagcattagcgtacctctgaatcatttgtggtgcttggcagaaggcaggttttcagattgatgtccagaaacatttattcagaggtctgtagggtaggacagggaagcagtaatctgcattttgtcaagcatccttggtgaccttgccacaaatggtctggggtggagagctcccactttgtaaaacattctcttagcaatggaacaattacagatatttctaaataaagacttatgagctgcaaagattattggaacaacctgcagtaaaataaaattcttgtgaaaatggacagattatcatccattttcaaattcaaaatcagagctaaaatcatagattgccctcatcccacccaaactcaactgatggtttgttaaagttaaaacaaaatgatctccacgtatcatctgaataagaagccaccaggtctcactcatgaaaagtggaagaaactcttataacaataactgattataagcacaaccgataaaacgaaatcattctactgtcaattttcccccttatgcaacactattgaataaccatctggacccgacaatttatttcctgaatggtcttcagcaagtcttcgcatttcctctccagaaataaaaaatttcaaaggattttgcttatttggggaaatttttgctaactgcagtcttcaaagtctaaattaggcctgatttggttaccctgagacatacaacattagaatatattgtattaatccttaaatgccttaattactactgcctttttagtacattgttgattttttcttctaaacagatccaattaagttttgattggccattttttttcccactgaaattataaactaactcttaacttctttgctcataatagatttgttcattcagcataaagagaaattcagttgtattaatcacttaagccataaacttgcccctggcatttgttaacattctaaagctacttttacctatttatttttattattactttgcgtactcttaattagttcagctaactgattttcgtttcatctttaattgatatcattttaaaaattcaggacactggtgttcataatcattcttataaaactgtcttaattttctcctgcatctcacaccacagtattttgggaaaaactgcactccgtgaggcagagtggtctcctattgaccaatcctgaactttagtgttgaatgaaattttgattcatatgtttctttaactcagctcttgattagctactgtagtgggaaaaaaaagtgaaacagtaaattaatagcagattgtttctacaatggcaacaaagggtaattttttttggcttaaataatctctttattctaaaaaagattttctagttctactttttttattattatcattatactttaagttttagggtacatgtgcatcccattactgggtatatacccaaaggattataaatcatgctgctataaagacacatgcacaactatgtttattgcagcactattcacaagagcaaagacttggaacaaagggtaattttaacctctacagttggcgagatacacaaggaacacaacagatagagattctattagtatgactgatagtagcatcttgttcctgattggtatggaattagttctggaccaaacgtaggtaatctaatttctatcactaggaaattgatattattgaaagaaggagaccaaaagatcaaagtggtgcatcaagtagagttctaaaaacaatttgtgagtgctttagaaggaataaagaccatttttaaagtaccacattaaacacattttgaaaattgatacttcttatgtgtgagtgtttgaagtattgaaaaatgatgtttttaaacttgttaaaaatatcagatttattgtactattccaaataaattataacagttaaaaatctatatatttgtctttaatgaatacatttatgagtcagaaactaaattttcatataatctggccagtttgaataacttcattgttcttcaacatcatttttataattcaaaagtccccatataaaaatgtttaaatataaacctttatgagaatattgaggatcatgtatatacatattaaaattatcagcaaatttagatagtgactatacaaatgtcaatgattatagccatgtgtccataaagatatgcttagcacccaatgacatcaacgactgtaaagttattaattcatttaccatatccctttacaaatgttctaattgcccctcaatatcttttagcttccttttttagcattttatcagatacaatgagaaagagggagagatcttaaaactttaatcagctaacagtaaattggagtaatatttggcagataattagtaatttgtaaaatttgtaaaattagcaattagtaattagtaatttgtaatttctgttgaacaaagagtaaatataagacaccataaaaattgtgtttaatgtagaagcaacaagaccagggaagctgaggggaatgatatggtttggctgtgtccccacccaaatctcatctttgaacttgagagagatgatttatggtatctggcagaagtaatttccaagcagcaaagcattcaagaggtgacttgggtgccattaaaggcttttagttttgtaaggggagcagagcataaaagttaagaaaatttccagcctggcaaagtgatagaaaagaaacacccattttctgaggagaaattcaagctggcttcagaaattcacacaagtaacaaggaaccaaatgttaatccccaagacaataagggaaaacggaaaatgtctctagggaatattagaggtcttcatggcagcccctcccatcacaggcctagatgcttaggagaaaatggttctgtgggcctggcccagtgtcctggtgctgtgtgcagcttagagacttggtgccctgcgtcccagctgtgcctgccatggctgaaagtggccaacatagagctcaggctgtggcttcagaggttgcaggcctcaagccttgacagcttccacatggtgttgagcctgcgggtgcacagaagtcaagaactggggtttgggaacatccacctagatttcagaagatatatggaaatgcctggatgcccaggcagaagtttgttgcaggggcagtgcactcatggagaactctgttagggctgtgaggaaaggaaatgtggggttggagatccccacagagtctctactcgtagtggagtagtaagaagagtaagaagagtctctattccctagtggagctgtaagaagagggccaccatactccagatccaccaacagcttgcaccattcacctggaaaaaccacagacactcaatgccagctcatgaaagcagctgggagggaaactgtaccctacaaagccacaggagtggagctgcccaagaccatgggaagccacctcttgcatacagtgacctggatgtaagaccaggagtcaaaggagatcattttggagctttaaaatttgactgctctgctggatttcagacttgcatgggccctgtaacccctttgttttggccaatgtctcccacttggaatggctatagttacccaatacctgtattcccattgtatctgggaagtaactagcttgctttggattttacaggctcataggcagaagggatttgtcttgtctcaaatgagactacggactgtggacttttaggttaatgctgaaatgagttaagtctttgggggactgttggggaggcataattggttttgaaatgtgaggactgagatttggaggggccaggggcagaatgacatggtttggctgtgtcccccacaaaatctcttcttgaattgtactcctataatttccacatcttgtgggagggacccagtgggagataatttgaatcgtgagggcagtttcccccatactgttctcatggtagtgaataaatctcacaagatctgatggtttcataaggggtttgcacttttgcatcttcctcattttctgttgccaccaccgccatgtcagaagtgcctttcacctcccgccatgattctaaggcctcccagccatgtagaactgtaagtctaattaaaactctttttcttcccagtctcaggtatgtctttatcagcagcatgaaaatggactaatacaggggaagacttacatttgccacaaacattcctgtataaacatccaaaccaaagaagactatcattagggggttgttatgagatgtgatgagaagaataaaaattgctactgtacattaaaacatcacaacttgtcagggatgcatttgagagaatgaggcaacctttatagtcactgtatctgctgtgagaaatgaatcacattgaactaatcactatagtaggggcaatgcatttattaaggagtctgcagcataaagcaagaagaatattattttttcactatgtaaagaaaacaggtataattctatatgattccatattaaaaccacaatataattttctgaaaacagtaaatttttagcaaattctatcatctaaagactatttttaataaattggaaaatattgatgtatggtttatgatgggcaaaaaataaaaataaattacctatatagcagaatggctataatgatattattatctacatttaggtattggttattatgtgcctgctgctgttttgagtatcttatttgatatcaactaatgtaataatcaaaacaatcctataaaaatacatgattacttattttacctatgaagcacagaagcccagcaaagttagtagcttgccaaatatcacagagctaatacatggtagagatggaattcccaaccaatttaaccttaaagctcatgatctgaacatttgtacttagctacttcacatagagaatgagatttgaagtaaatttttgagctctatctactgatccatctatttatcatcaatttattctctacagaaatcctgacagggagttattatccacccagtttcactactgagaaaacaaaagctacaaaaaaaaattagtgatgtatgactgtatagctagtaaaagtaatctagacatacgacctaaatctgcatatttctaatgcctgaaaatggaaataaaaacagtataaaagtgctaaagaagtatatgtagatggtaaaatgcatgcattaatgcatttgtattcatttcctgacattggtatttgactctagcgtaaatctgttataaaatccctgttaactaagagacagacacatagaccttgattataacgtatacaaattaaaatataaaaatacagacaaattaccaatgctgcagaagtctgttaatagtgattcaagggacacttcactaggctgacaaacaggtacaaattttgaagttaattctagggaattgtgcaatattaccctttttatcacacattttcaaaatcctgttaataatctttaagaatttttaaaactcctaatagcccaattgtttatgtgttgatttctttccctattaattttcattattccaccattgaactatcagctacaggaagaaaaagaccatgtctgtttcattcaccatgatatacttgtagcctatactgttaactcagagaaactactcaaatatatttgttaatgaataattatgctcaaattattagatagaactctggaaaaaaaggataaacttcccatagtaagaaatgtaactcttgaaataaaaatttcaatgaatggttagattaatcccactgtagacacagtaaaagaaagaaaaatagcaaactgggaaatatttctgaagaaattacccaaaaagaaaagatgaacactacaaattgagtttaagcattaaggactcttgatatattgagaatagatgaatgaaaaataatatttgataagataactaaaaatatttctgtatcaatgaaaattaaaaatctatagatacaggaatcaaaacctatattgagaagacaatttagaaaaaaaaaagcatacctggatacactgtaataaaacttcaatggtagaaatacagaaaccccaaaaagatcaggaaagacagattacatataaggaaaaatgagtgggctgacagcataccaaaagatgtaacaattaaaccccaaagacaataatatatcatacttaaagtactcgatagaagtaactcccaatatagaacactatactttccaaaactatctttcaagaaaaatgatgaaataatgacatttacagataagcaaacagtgggaaagtttagtctcccagatcttgttggagtaacagctacaggaggaagagagaaaataatacaagaaagatagtctgaactacaaataagcaaaattcataaatatgtagataaatactgtctgtgtaaaatagtatatttgatttggggagttaaaaatgaacaaaagtaaaaactaaaatataaacaaaagtagtaaataaatggtaatggagctgataggcattgttcaggtattttaggtattgatactgtttacaaggatggcttataatattaactttaaactttgcaatgtatatttccacaagtacatacaaccaccatcaaagaatcaaagtaggttacaggactattaccttctccgtgataaagtgcaacaatgaaagatgggaacaacaacattaaattgaaagaaaaaaagaaaaaatggaagagaaaaaacatatagaatatttgaaaaattaaaatgtagtcatatattaataatcccaacatatgttaataaaccagctgaaagacaagaagtgtttagttgatttttaaaaattaaatatgctatgtaagacacgttcatatactataagaaaagagaaagattaaaactacaggacagcaaaaaataaacaagccaaatacataccttgaaatgctaactaagcgaattatattaatcttaggcaaaatcagcattttgataaaaagatcgttagggtaataaaatgtcactacattatgataaaatatttgatttactgggaagatgtacaattctcaacatatatttcaaataaaaagattttgatacatataaagtaaaagcattctttatgtcactggtagctggtgttgagcaaggaagaggattgtgaagttaatcacaatagtgagaaatatgaacatgactccctcaaatggtgaacaaaaagacaaaaaaaagtagtttaagtatagaaggttagaaataacaagcctgattattggacagataggatacatagaattctagataacaactaaagaatgaattcttctcatgtcaagatcatattcaaaatttataaaacctctagcacatggaacaagtctaacatatttaagagatttttgacaaacacaatctgatggcaattacattcaaagtcaattatgaaagagaaacaaacaatctgtatacgtttaaatactccaaagtatctcatgtgtccttagagaaaccattttaaaaacattttgaacttaatgatttaaagtttttgtttgtatcaaaatctgtagatgcagtaaaaggactttcagagtaatatatattcttaaatgctcataataaaaatatgaagaatgcctaaaaattaatcaactaatatctcatccaggaatttggagaataaacattagaacaattctaaagaaataaatagaaaacaataatacagagaagatcaacaaaattaaaagcaaattgtttaaaaatatgataaatacaagaaattataaaaaataaaaaggtcagattttaaaagagactacaaatacttagtactgcatttttataggacagtcatatacattcaaagtagattaaaataacattttaaagcaatataaaaatttaatccaataatttgaaaacagatgaaaaaataaagtaataaaattctatgaaattagcaccagaggaaacagaaaaatctgaaatgcactgtaaagaaaataggtccaccaaaatgcttgtattggtgagttctatcacaatacaaagattcttctgggtattttaaaagcgtcccaattcattcagtaaaatcaatctaactttaatataaaaacatcgacctaatcttaatataaaaacaggcaaaaatagtatgagaggaaaaagttatacccaatctctgtcagcatcattgatgtaaaaattccaatcaaaatattaaccaactatacccaacaatgtttcaaaaatgctaagactgagtttgatttaccacatattgcaagggttctgtagcactaaaaaaatacaaatatcatttatcacatgaacagattaagtaataaaatgtacataattatctcaaaatatattctaaaagaattttgtgtaatccagtttttgtaagtttttttaatgttggttttttattatactttaagttttagggtacatgtgcacaacgtgcaggttagttacgtatgtatacatgtgccatgttggtgtgccgcacccagtaactcgtcatttaacgttaggtgtatctcctaatgctatccctccaccctccccccaccccacaacaggccccagtgtgtgatgttccccttcctgtgtccatgtgttctcattgttcaattcccacctatgagggagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctaccattgatggacatttggcttggttccaagtctttgttattgtgaatagtgctgcaataaacatacatgtgcatgtgtctttatagcatcatgatttataatcctttgggtatatacccagtaatgggatggctggatcaaatggtatttctagttctagatccctgaggaatcgccacactgacttccacaatggttgaactagtttacagtcccaccaacgtgtaaaagtgttcctatttctccacatcctctccagcacctgttgtttcctgactttttaatgatcgccattttaactggtgtgagatggtatctcattgtggttttgatttgcatttctctgatggccagtgatgatgagcattttttcatgtgttttttggctgcatgaatgtcttcttttgagaagtgtctgttcatatccttcgcccacttgttgatggggttgtttgttttttttcttgtaaatttgtttgagttccttgtagattctggatattagccctttgtcagaagagtaggttgcaaaaattttctcccattttgtaggttgcctgttcactctgatggtagtttcttttgatgtgcagaagctctttagtttaattagatcccatttgtcaattttggcttttgttgccattgctttttggtgttttagacatgaagtccttgcccatgcctatgtcctgaatggtattgcctaggttgtcttccagggtttttatggttttaggtctaacatttaagtctttaatccatcttgagttaatttttgtataaggtgtaaggaagggatccagtttcagctttctacatatggctagccagttttcccagcaccatgatcaagtgggcttcatccctgggatgcaaggctggttcaacatatacaaatcaataaacgttttccagcatataaacagaaccaatgacaaaagccttatgattatctcaatagatgcagaaaaggcctttgacaaaattcaacaacacttcatgctaaaaactctcaataaattaggtattgatgggacgtatctcaaaataataagagctatctatgacaaacccacagccagtatcatactgaatggacaaaaactggaagcattccctttgaaaactggcacaagacagggatgccctctctcaccactcctattcaacatagtgttggaagttctggccagggctatcaggcaggagaaggaaataaagggcattcaattaggaaaagaggaagtcaaatcgtccctgtttgcagatgacatgattgtatatctagaaaaccctatcatctcagcccaaaatctccttaagttgataggcaagttcagcaaagtctcaggatacaaaatcaatgtgcaaaaatcacaagcgttcttacacaccaataacagacaaacagagagccaaatcatgagggaactcccattcacaattgcttcaaagagaataaaatacctaggaattcaacttacaagggatgtgaaggacctcttcaaggagaactacaaatcactgctcaaaaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaacaactactttaaagttcatatggaaccaaaaaagagtccacattgccaagacaatcttaagccaaaagaagaaagctggaggcatcatgctacctgacttcaaactatactacaaggctacagtaaccaaaacaacatggtactggtaccaaaacagagatatagaccaatggaacagaacaaagccctcagaaataatgccgcatatctacaaccatctgatctttgacaaacctgacaaaaacaagaaatggggaaacgattcccagtttatgtaatttttaagagctcctagaaaacttacacaataaaaaatccttcgtatttttattagatacctcaaagatatttaataaaaattatagtgaacatcattattaatagtgaactattacaagcatcatttggcaactttggtgactattcagggttctgtctcgccatgctccaaaagtaaaaagaccttatagaacaattagaagaaaaaaacaaaactctaaaaaaaaatagctctcagcataacaaggagtcagtctaaactttaagacaactgtatgtataaaaagaagaaaaactaccacattccagtgaatgatctctcacattcctgtcataaattttgtgatgatcaagggtagtcagagaaacactacaggcaaagggaagacaggatcaaagtggcagttcaaaaatcactctaaaactcatgccagaaaatgaagtccaccttgtgggaaaatattttaaaaaattaaatttagaaaatgaattttggtacatcagagtaataatgctagaaaagagggttaaatgcatacaatatatagaaattgtctttaaagcttattagggagtcaaaatttcaaaagaggagagagataccctttggtaattaggttgaaaaagggggaaaaaaaaaaaaacctagaagaaaatgaattcctaaaagacaaacaaccagaacaatctaaagatagcacaaacgtgccttatcttcttttactcttcctctctctctctctttctctctccctccttcccccactcccttcacacacaagcgctttgctacacacaaaagatggcaccattgatctagaaatgtcttaaactacaaataaattaatacatatgagatcagtaacattgttgaatatatagtcaatcaatccataaatataaagtaattacctatagaagaaacaaactgtcaaaaacctgaactttaaaaataaattagagaccatgtggcacctgatagaatgacggatccccctgtgaattaatcttgctgaaaaatcataattaaatggatcagtcctctgtgtttaaataataatttaccgaggaatgctttaaacagcatcacagaatgacaactgcaaatatcaactgtgggaacttttatgaagtagtcattaaacaaatatagaccaggtcaaagtagctgggtgccctagattctccaacttgttagcgattaacagagtcaaattttaaaaactaaaagatgtaagaaaggaaaataaccaaaatcatgaaggcctgatttgccaatgcaattgcatttcagtgactcaaagatgttttgattaaaaacaaattgaaggtgtagaaaatctgccaatcttcctagaaatctggagtctgtcaataattttcagaataaataacagcacattggagtaaaatagtgtgcttatacaaatagcaaaattaaaataagatatgcaaaactgccataagtgtatttgaatacttctcttgcttttgaatataatttgtttattcctgtagagaacaatattttaaaaataatatttctctttgaaattttctcaagataaatatggtatcagggaaacaatgaatactgctaagtttcacttactcttgacagttatatgtctcctaatagcttctcaaccttacagagatactttatttccagcaatcctgtcaaggtaatttttcatcacaactatttctccacttaaaatgataaaaaagcctttatctttggtaatctacaagaagataagtacattttctgatttgcaagaagaggatgtttcaaagctgggactccagtgaatctaattcatatttaaatatattgctttggaaaattagaaaataaaaagaaaagcttatttcggcatcatttgtggatcaagcccagaaattataagaaaacattttcaaaaattgctagaattctttctggtacttctaggtttaaaagttcataacacaaattcttttatcataatttgatgagccactattaatgagaaatagttttatattgtcccaaaagtgatatacttaacagaggtttatcacaaaattgttgaaacttaaagaaaggctaaggtaatatgaattggaaagaactattgagaatagctaactggacaccacctactactaaaatatagcttggaggtgtgattgcctaagtaccttgactccctcccaccatctcctcctaggattgagaggaggaagggatgcaacttcataactatttggggagtaactaacagaggaagaggagaaaagaaaaaaaaaattgctgcttgagctgattaactgcctgccagctatgcagaccatcctccctcctcttgtgggtgagctgaaggagcacatatcttttcttactgttatgagcattaatattgtggtaccctctcttgtttcttgctgccttaaaggcccacaagaatcaatcttcacgaatatatcactatatttttctcatttagttctttaatatgggacttggtaaaatttttcacacagagcagcagttggaaattgttattttattgcacttttcaaatttgtaatagagatttcaaaataagcatatgttagagtcaaataaatatttctaaaaaatggaaatactcaaagccaatttccattcacttgaatctgggataccttcttataaataatgtaatgaaaacatttatattttcaaagtatcttacactgaaacataatgttcttcctgaagtgtaagtgtagggtgcggagccctgtttccttggtggacagattgtttgtctcatcaactctgtgataaaatatggactcaactattatcttgaagtttaagacattaaaaatatctgaatggatatcattctcccttatttttcctctttcattatctcctctactattgagtctcctaacactctgagtaaatattggccccaagcaatatttgagtagcatcaaaacaaatgttatataaagatatgatcttgacacataagccctactgaaagtaatcccgtctaaacccagtatgaccccacctatcaggccccatcccctccccatgtgaccttttctcactttgatatctcttttaatcaggccatcttaaaagaagcaaacaccagattgcgtcccttctccttacatcttttatctccttgagagaaattaatctgttccatgttatccctgtgcagcaaacaggtcattttaataacagaaaattgaatgttgagactagcagttactttaattaaaaggtggtcactagagaattgatttcctagctggttgttgacttacaaacagaaaataattggcacataaacccagcagagggactctactcagaacatagaatctgttgacaagaagaaagtaataatgcaggaaaatcatttacatttatatagaagatgttatatttatgtctatttccagttattagcattctagagattaggaaagacatcaccttgaactttctcatcattacccactctctttctctgacaattgatgagcctgacaatctcgttaaactgccaactacataatttgcagaggctctaacttgccagcccctggaaaacagcaaagtgattgtttaacacaaacctggcactaatcttaatgaaaattttattttataagccagattgctagcatatccccctcctcgaagtctgcactagcttgaagcaacactgcaaagaagacagggacaggaataggtgatcttttaaggtttttcttacctggttttctctagtcctatagttatattggatcctctttcccattctaccaaagatacactatattttttattttctaatgactattcccatttttgccatctcctactgagaatgctcacattttctgtcaaagtcaggaggtgattctggctctgggtttcagagactttcaaggtttatttccaaagaacaagaagaaaatttgttgttgccattgttttatttatggtagggtagatcaatgcaagtgatagggtagatcaatgcaagtgtgggtccttatggaggaatgttggggaaagaaaagaaggtagggaagggagttaccagcttgggagctaagccttggaagtgcttagggagacagactgtccagtctctgtccaggtgttggtagagtacaccaggacatgctcagcagataaggaaattgtctggaggccaactattcttctttccagcaagaactttcctctccagcatgcaaaatcctttaagaaagtctgctaccagcacatagccacgtgactgttcagtccaaatactgcctatcagtactacagcatttttctcagttccacaaatactccaggacctcatatttacagggaaaaagagagttttctgggtctctaataaggtggtgatggggaatgccactggaaagagctttaactgatgaacaagatatgtacagtcattagtgatagcctctttaccttttgtaatataagctagatagacatattgggggttatagtataaaatcacagatattttgaaagataggggacttaaatataatgcttatggcaaggtcattaggctaaggttctagattctcttttgatgactattctttttcaacaaattggtggaaccatttggacgaataagttaggcagtccctgaaattatgacagttatattcaatgagttaagtgacctgttgttaattaagaagctgaacatgaagtattagtggttcccaattaaaggagggtgtgggaatattaccaggcactcaggggtaaattgattttctttggaagcctacatagggagtctactggcatcacagaactttgtcagctgaacagtatggtttgtggcacaagggtgagatttggagacagataccagcacctggtaaaacagactagtgaggagatataataatccaggaaaaataaacatcaaaaatcaaaagcaaagcaataaaatatgtacttttttccttcctataaaaacaattcaagaagcgacaatgcatataaagcataacatccctagtttgcttttggaaaggaaaaaggggactaataagaatttcaaagaaaaacacagaatgtcaactctgaagtaataagatttattggcatgctgcattttagtattagattttaataatcacattataataggaatccacaatgaaaactgaaaaagcacataaaaaggtaagaattcacctagtgttattaaaatagcattgtgagatataattatgtaatgtataattttatacataaaaaatcattttaacgaattgatatttataatcagagtggcatcttttttaagactttaagttagttcgggttctaacataccaactattctaattttatagtaattatatgactccagcaacccaagctggtagaagtaaatatgatcaacattcatgtccttgactgccaaaacacgctctgaaaatgacagtgagggcttctttgtagcctaaagaggattatgtagacctctagggaactgttttcacaattttaaaagcagtgaaggccagatactcgaatcattttgaagtggccacttacaccttgttcaacaaaaaggcagcctgaacacataagatcatattagacatgcttggttaaaaaaaaagaccttttaacattttatgtcactcaaggaatcatgttttatttcaaatagccaagaataatttaaaactaagcctttaagtaatctaaccttattcaacatacctttctggactagtcaccatgacactctaatatgtgagatgttattcttttctagcatccagatcctatcaatgttgggtgcattttcattaatattttactgaggcattttgaacaacagatgttaattttccagattagttcgactctaaaaacatctaacaccttacattctctatggcctcatttagatggtctttgtcaactcaatgcaattcaaagaaagactctacctaagatagttgcttattattttagctggtaattgagtaataatattaatacttgggaggagactgagtgggtaggcaggaacttccttcttaaatattcactaaatacataaaaggccttttttgttagcaatagacaaatttgttacaaattatttttataagcattgaaatacagcatttgtgtgtgtgtgtgtgtatgtgtgtgtgtgtggttttcttactctttttcttagatgggattattcgctctaattcaggcattccagaagtttgcggtctttagagcagtgcaaatgaatgattacagtcaaggaatttaaagtcacactacttagattccaatattttatctgtcatttattattgatccacagcatgttacttaagctctgtgttgtattaattttttcctatctaaaataagaatagattatacatcacagttgtgttaagaatcttatttcggttgatagcctgaagcccatgtccttagaacacagtcagcacttaagaattattatctatttttcagcataaaactttaaacttttacaggtgaatttttgaagaaaatatgaaagtataaatttaggtgtgtaatttcatccacatttttatttttaagaaagttgattaccatcccttcaacttagaagataaaatgtgaaaaataaaagtttctggctcatgagtacatacaatcattaaatgtgtggttatttttgtatagcatatatattatatatgcttattatatatatatatgtatccatagtttatagattttacgtaagaatgcaaatggaatccacatatatgcacatatacacttaaacatgtacttattaaaaacaagagtaggctcccaaatgcaagttcagtaaaagtttattacattttcaattgagagtaaaaatattttatttggaataaactattacttttacatttcatgatttaaatgctttcaagtgtctaacttttgtgttcctttagatatatatttgaacttaattttttctggcaatattttaaaacataaagaaaaataaatcttaacaaccaaatcaaaatattcagacaccctcattgaattaaagaaacaaggaaaagtatgttgcttgtctactagtagttagctaagctacagattagaattggctgctcttaagtaataagtcaccattacccagaaaaaaaaaaactttgaaaagtaaaccagaatattttagcagtaaaattttataggcagtttcaggatgacatttaatactatttgccaaatattctatttcttttttagtacttaaagctctacaactcttcattattatataccagtaactttgattcattcttctttctcaaaaaggaattactatagtttatattgtcttagctgaaatgataaaaatattatctcttaattttaaataaatatccaattttttggaagtattggtaactgaaaaaatcttcctgacaatctggaattcttagaagacattttggtgttttcaggagagcataagaaaatttaaggcagaaatatatattaagttatattttgggaagtttatttggagaactagatgctctatatctgttggatttttgttgttgctgttgttgaaataattttttttaattttcaaatgttacgtatataattttgtccttcttaaattttcattcattcagatgttgtaatactgtattctaccaattttactcctaccttgaaaattaatcctctcatatttgagatgtatgtatgaattattttttctaaaaattctatatttaaactcatttttttactgtgtattctgtatatcatttcaattacgcacttcaacaaatatttgctgatctgatatatattttccaagtcattcttattctatagacagacctacagtgattatctagaatagataatacattatataatattaataatttatagatcattattctatgtagatattatctattcacagataataatctatgctgacagaagtccaaacagtggtcacctttgtggtggctaataggaaggcagcaggagagagactttttacatttctacataaattttatctagaaattggtgttgatttggtaacaatttatcaaattctacccttaacatttgtgtactttatgtaatacatcaatgaatatttacaagttatatgcatataacatatacttacatataacaggtaatacattgtgtacatatatacagtgactatgcataaatataactataagcaaagagagatactcttagaagttatcatacttaactacattgagaccaaaatttgaactttgagagcaatgattcttagtcaacagacatatgctaacttcttccaatatgtctggcctgttgcttggtgctacaggaaacaaaaatgtataagacattgtccctgccttgccaaagacttctaccttattattacgttgtgagctcatttaatacaagttgtgcattattaatttctctatcccagcacctaacagtgtagtgttcaaaaaaggtattcagtaagtatataataaattaactcagtagaaggtgaggagagtgagccaaatgcataaacaaaacatatagatctacacagcacatcattaaccataaaggcacactcgtgagttcctaggaaacagggagaagctatgtttaaaaccttgagacatttgtctacccaatgttagaaaaatacagaccttgctaaaatgaagaaacaggatctactaaaataaaccttacacaggtgggagaaatatcttgcttagatgacaagataagtggagctccctttgtggaagccttcataagggaggttttatcctcttgagctgtttctcagggtttcctgatgggtaaacagccttggactgcctatgggaaactgattcccaaatgtcagacaccagttatgttttctctagtcctcaggaaactgaaaaatatagggagagcatagggcaatttcatattgttaaatgtacttacctaaaataactttttacatatgttactaacctgcacattgtgcacatgtaccctaaaacttaaagtataataataaaaaaagaaaaaaaaaagattatgcaatctttaacatgatattaaaatgccttctctatgccttctctgaaatcatgaaatcaagattctattttcattttattggtctcaattggtcaaaaacaaaatgttgataacaataagtagacctccttcaggtctacttatgagataattatatacatgtatgcacacacagatacattattatgggtgtgtgtgatattgtttggctctatgtccccacccaactcttatctcgaattgtaatcccaataagttaagggaagaacctggtgggaggtgattggatcatgggggcagtttcactcacgctgttttcataatagtgagggaattctcatgggatctgatgatttcaaacgtggcagtttcccctgcactctctttcctttctttctcctgctgccttgtgaagaagttgcctgcttctccctcaacttctgccacgactgtaagtttcctgaggcttcctcaaccatgtggaattgtgagtcaattaaacctcttttctttataaattccactcttgggcagtatctttatagcagtgtataaacggactaataacaatatatataagctggccttttaaaaccaaaatcctagaaatatttacaaaaactaatccaactaaataaggcacttcaatttaagaaaccatacaaaacgtgaactgagctctagcttttcatttatttgtttgtttggtgtttatgccaatgtacctaggaagacaagaatagaatttcctttggaccttgcaggattaggccccaatatgtatttggttccttcccctcaatgttttgttgttgctgctgttttgtctgggtaaatgagcctatgattaagatcaaaggctaactatggggtaacaggtatacaacagtcataaatagtagaaccctgcatacagataaagaaaatatgagtacgacaaagtttgcgtgagtgatgaggaaatgaagacaatgaatgcatatgaactgctggtcaacaggccagtgaggccactagtccattatcttgtatactctaatctcttaatattctatttcttctggagtggtgatatttctctaatttccttagatagactactctaccagtaatacaccttcttctgcaggtttttcacacattttaaatcttccaagttccagagatattttacccaggcatttaaaaaaaacaaagctaagggggtacttgtttttttttaaatgactgatgatatatcctgaatactaatagatggatatgtgaatggctagctaggtaaacagtagatatagatacatagatgtatacatacatacatataaacagactccagcatacaaaaacaacaaaattgcaattaatgttaaattaaatgtacacaaacttatcaatgagtaaagtgaaactcaactaaattcttatataatttaaagaatgtgagtgtttttatccttttctgtttgagtttcttatcaattgtataacgataaaaattatggttttagattccaatttcacgaccagagactacttatttagcttttctgctttactttcctcatttgtaaaatcagtaaaataattccacataaggtctctgtagactgagtgaaatatggtaacatcttcaaaagttctgtgttatgttaatcattccagaaataacagtctagaataaaatatggaattaatgtcaattaaatatatatgcattttactttttattgatatataagagatgcacatgtttcagggtttatgtaacttttgatgcatttatataacatgtaatatatctatgatcttaaatatttatcttttatttatgttgtgaatatgtgacttattctctactattttgaaatgtactatagattattgttattttgactatagtcactccactgatttatcgatactaggacttattttttctaagtgtattttttgttttactattaaggaacctctgtttatccactcctcccctctactcttcatggcctctgctaaccagcaatatactctctagcttcttgagattcactttataagttcccatatatgaggaagagtacaatatttgtctttttgtgtttggcttatttcactgaacataatgacctccagttccgtagacgttgctgcaaatgacaggatttcattttttaatggctgaataccatttcattatgtatgtacacattttcgttatccattcatccattactaggcacttaattaggttgcttctatatttaactactgtgaatagtgctgcaataaacatgggagtgcagatctctctcttatgtattgatttcctttcttttggatgtatatccagttatcggctccatatactgggttatatagcagttctatttgtagatatttgaggaccctccatactattttccctagtagctgtactaatttatactccttcccacattgtatgggggttctcctttctctacattctctccagcattcgttattgcctgtctttggatataagccattttaagtggagtgaaatatctgactgtagttttgatttgtatttctctgatgatcaatgatgttgatcacctttttatatacctgttggccatttgtgtgtcttcttctgagaactgtctattcagatcttttgcccatttttaaaacagatgttttccttcctatcgagttgtctgaagtccttatattctgattattagttccttgtcagatggacagattgaagatattttcacccatcctgtgggtcatctcttcactttgttgattgttacctttactgtgcagaagatgtttagcttgatataatcccatttgtttttgttgtctgtgcttttgaggtcttatcccctcaaatcattgcccagagcaatatcctatagcatttccccaaagttagcttctagtaatttcatagttttaagtcttagatttaagccttattccattttgatttgttttatatgttgagagataggggtctaggatttttccatataggttattcagttttcccagcacatttgattgaagagcctgttattttgccaatgtacactttcaacacctttgttgaaaatgagttggctgtaaatgtgtggacttatttctggtctctattctgtttcattggtgtatgtgtcttcttttatgctagtgccatgctgttttggttactatggctttgtagtatattttgaagttaagtcatgtgatgactttagtttgttcttgttgctcaggattgctttagcaattcagggtgttttatggtttcatatacattttaggatatttttctatatatttaaagagtgtcattctttttaatttttgtgggtacataataggtgtatatacttatggtgtacacgagatattttggtacaggcatgcaatgcataataataacatcatggaaaaatgggtataaatccattcaagcattatcctttgtgttttaaacaatttttactctttcagtgattgttaaatatacaattagattattattaacaatagtccccgttttgtgaaaaaataccagatcttatttgttctattttgtatgcactagccatccctacctccctcccacactcccactacccttcctagccttttgaaaccatccttatattctgtttccatgagttcaattgttttattttttaaactcataaataaatgagaacatgcaatgtttgtttttctgtgcctggcttatttcacttaacatgatgacctccagttctatccatgttgttgcaaatgacagaatctcattctttttatggctgaatagtactccattgtgtggaagtgctatgtgttctttattcatctgttgatggaaacttaagttgcttttacattttggctactgtgaacagtgctgcaacaaacatgacagtgcagattcaatatactgatttcctttcttttgggtttatactcagctttggggttgttggattgtatgacagctatatttttagttttttgaggaacctacaaactgttctccatagtagttgtactaatttacattcccaccaatagtatacaaggcttcccttttctccacattctcgccagcgtttgttattgcctgtctttggacaaaacccattttagctgaggtgaatggatatctcattgtagttttgatttgcatttctctgatgatcaatgatgttaaacattttttatatacctgtttgccatttgtatgccttcttctgggaactgtctattgaaatattttgcccatttttcaatcagattatgagatcttttcctttgggattgtttgaactccatatatactctggttattaatctcctgtcaagtgagtagtttggaaatattttctcccattctgtgtgttgtctcttcgctttattgattgtttcctttgatgtgaagaagattttaaacttgatgtgattccatttgtccatttttgctttggttgcctatgcttgtgggatattcatgaagaaacatttgcccagaacaatgtgctggagagtttcctcaatctattcttgtagtagtatcatagtttgaggtcttagatttatgtctgtaatccactttttaatttgattggtgtataaagcaagaggtagggataaagtttcattcttctgcatatggatatccagtattcccagcaccatttattgaagagactgtcttttccctagcatacgttcttggcacctttgtcaaaaatgagcccactgtaggtgtgtggatttgtttctgggttgtctattctattccattagtttatgtgtctgtttttatgccagtactatgctgttttggttgctataactctgtagtacaatttgaaagcaagtaatgtgatttcttcagttttgttctttttgctcagcatagcttggctagtctggatattttgtgattctatataaattttaagttttttttttttctatttctgtgaagactgtcattggtattgtgataagaattgcattgaatctgcagattgctttctgtagtacagacaattcaacaatactgattcttccaatccatgaacatgaaaattgtttccattttttttagtggcctcttaaatttctttcatcagtgttttatagttttcactgtagagatgttttacctctttggttaattcctaggtatttaattttatttgtggctattgtaaatgagattaatttttatttctttttcatattgttcactgttggcatatagaaatgatactgattactgtatgttgattttgtaacctgagagtttgctgaatttatcagttctaatatgtttttggtagagtctttaggattctcaaaatataagatcatataatctacaaacaatgataatatgacttcttcctttccaatttggatgccctttatttctttctcttgtctgtttggtctagctaagacttcagtaatatgttgaataacagtagtaaaagtgggcatccttgtcttgttccagatctggtatggtttagctttgtgttcgcactaaatctcatcttgaattgtaatcccctgtgtttagggaggaatctggtgagaagtgactgggttaggggaatggtttcccgcataatgttctcatgtttgtgagtggattatcatgagatctgatggttttatagtttttcctgtactctcacagacactctctcacctgctgccatgtaagacatgccagcttcttcttccaccataattgtaagtttcctccccccgccatgtgcaactatgagtcatttaaatgtcttttctttatgacttactcagtcatggtctgttctttatagccgtgtgaaaatggactaatacaagatctaagaggtagtcttatttaggttaagtatgcttgctgttctataatcttcttgtacatgaatgttaatatatttctctaggtttgggaagttttctgctattatcccttcgaataaactttctacttctatgtctttctctacctcctctttaattaaggccactcttagacttacccttttgaggatattttctagatcttgtagatgtgcttcattttttaatattctctttgcttttgtctcctctgactgtattttcaaataaactgccttcaggctcactccttttttatcaattgcttgatcaattctgctattaagagactctgttgcattcttcatcatgtcaattgcatattttcactctataatttctgcttgattctttttaaatatctcaatctctgttaaatttatccgacagaattgtgaattccttctctgcataatcttgaatttctttgagtttcctcaaaacagcaattttgaatattttgcctcaaaggttatatagctctgtttctcctggattggaccttggtgccttattcagttcatctggtgaggtcatgttttcctggcgtgttgatttttacagatgtttgtttgtgcctgggcattgaagagttaggtatttattgtattcttcaccatctgggcttgtttctgcctgtccttcttgggaaggttttccaggtatgcaaagggtcttgaaccccaagcataatcctgtggttcttgcagacttgtagtggtactctcttggtggtcttggataagatctggatgaattctctacattgctaggcagagacttttgttcttttcccttacattttcccaaacatatggagtctctctctctgtagtgagccacctggaatgggcaggtgtgttgatgcaagctcctttgtggccaccaccaccaggactgtgctgggtcagatctgaagccagcagagtactgggccttgtcaaaggctctacccttcaggattgcgagttccaggaatgtccagagatgctgtccggaagccagggattaaagtaaaaaaaccttagcaactgatgttgctgacctgatgttccattctactgtggctaaactggcactcaaactaccacaccaagtccttcccactcttcccttcacttaccaaaggaagaggagcctctccctgtggctgccaccaccactggttcatctgccatgccaccaccaatgttcgcttaaagacaaagcactcttctattggcttgtggtgaacgctaccaggcctaggactcactcttcaggccctggggtgccctttgaccttggtcaggtccagaaatgccgtccaagagcctaagcctggactcggactcccaagagcctgcttgttgctctaccctactgtggccaagctggtacctagtgtgcaagacaaagtctcctttacttttccctctgctttactcaaacagaaggaatcattcactgtagccaccgtagctgagagtatgctgggtctcctccacattcaacacatttcagagcccaaagcccatggcatactctctgggtatcgctggtggttattcagggctcaagggctctttagtcagaagtcgatgaatcttgccaggactgggtccttccctccaaggcactgggttccattttggcccagagtgtgtcaagaaatgttgtctgggagctatgtcctcacaactctgcccagtgccctatcctactgtgactgagctggtatccatgacataagacaaagttctcttcactctcctctttttaagcagaaggagagaatcactctcattgctatgagctgggttgcctgaagttgggggaaggattgtgcaaaccctctcttagctgtgcccatggtgtctccctaggtcatatgtgaccttagttcactggctctaagctcagcctagcactaggaattgaataggaattgcagtccttgtgtcctaatcatatatggcatttattatttcgaggtatgttccttttatacccagtttattgagagtttttattacaagttggtgttaatttttatctaatgcttttcagcatctatgaaatgatcaaatgtgtttgttctcggttttgttaatgtgatgcatcatgttcactgttttgcatatgtttaaccattcttgtatccctggattgaatcctatatgatcatggtgatagatcattttaatgtgttgttgaattaggtttgctaatattttgttgaggatgtttacatctgtgtttatcaggaatattgacctgtagttttcttttatatagcatccttgtctgggtttggtatcagggtaatgcagttcttataaaataattttggaagtatttcctccttttcaatttttttttagtttgaatacaattggtgttagttcgtaaatattgggagaattcagcagtgaagtcattaggtcctgggctcttttttgatgggagactttttattacagcttcgaccttgttagtttttattggtttgctccagttttctatttcttcaagattcatcctttagtaagttatatgtgcccatgaatatattccattatggtcataaaaggtacttgatctaattttgactttttgaatttgttaagaataattttgtagcctaactatagtctattcttgagaatgtttcatacgtttataagaaaaatgtgtattctgcagcaattggatgaaatgttctacaaatattagttaggcccatttggtctagtgtttaatttatctctgatgtttcttcattgaccttctgcctggataacctgttcattactgcgagagaggtgttgaagtcccatgctattattgtattgcagtctagctctccttttagatctattaatgtttgctttttataattgggtgctcctgttttgtgtgcatagatatttgtaattgttatatcctttcatgggactcatccttttatcattatgtagtgtcctcctttgcctatttttgtagtatttgacttaaaagtctatgttatctgatttaaatatagctactcttgcttttttgtttccatttgcataaactatcttattccctttcttcaacttatagtctatgtgtgtctttataggtgaaatgggtttcttgtaggcagcatatagttgtgccttgtttctttattcgttcagacactctttgccatttaatggaataatttagtctatttaaacacaatgttattattgataggtaaagatttactattgcaattttgttacttgctttctggttgttttacaaattctctctcactttcttcctttgtggttaagtgattttctctgattgtatattttggtttgttgcttttcatatttagtgtattcattacatgtgtttcttctgtgaggcttacaaaaacatataaaaattttattttaaatagacaacttatctgatcacaaagaaaaaattagaaacaaaggaatagttaaaacaaattgtacactttaacttcatatccatttagatttttcttgcctcaatttacatatttttatagtgcctgtctcttaagttgttgtagctatttttttgatagattgctttttagtcttcacactagagttataagtggattgcaaatcacaattacagtgttagaatattgtgagtttgtctgtgtccttacttttacaagtgaacttaataacttcaaatgttttctctttgcatattagtgttattttttctttcagattgaaaaactccctacagaatttcttgtaagatgggtctgatggttataagttccccatcttttgtttctctgggaaagactatttctccttcatgtttgaagaatagctttgttgggtacataatttttgtttcagagttttcatttttttaaatttcaacatttttgcatgttttcccacttctactggcctatatattttctaataagaagtctgttgccaaaaaaattggaagtctctcatatgttttttgcttcttttctcttgttgcttttagaattctccttttgtgtttgacctttgagagtttaattattatatgccttggggtagttttatctgggtgaaatctgtttggtaatctctgacctgcatatttatatagtgtttttgaaagctgtcatttcttttaataaactttctaccccttggtcttgctcaacttcctcgaacacaaataattcttagatttcctcttttgagataattttacatatcttgtaggaattctttattcattatttttcctctttgtgtattttgcaaatagcctgtctttgagctcactgattctttcctctacttgatccattctgctattgagagactttaatgactttttcagttcagcaaacatatttctcagctccaggaattctgtttcaatttttaattatttctctgttaaatttccctgataaatttttgacttttattctgtgttattttggaaattaatgagtttccttcagattactattttggatttttatcagagagctcttctatcaccatcttattagggtctttcactggctccttactttgtacacttcggaaggtcatagttccctctttactgttttttcttgtggaggtacacctccgtcttcccatcaaaggactagtcttttatttcagtcttctctttctgggttggtgtttttactggatatgtttccttagaggtttctttgcaatatagttactgagtatcttttctgctaagttactttctcctttttagcactaaagagtgccttaagcccgggtttgtcttggctttagtgaaattcagtgtgttgcctgtcccagataggggagatcccaaagggcaaatgccaacagtatgagaagactgggtaggggtttattcccaggaaacccatgggacatgccaacaacagtatggtcctgctggatggctactctaatttggcatctcctttggctgggatagaacaaagttttctggtctggtaatggtagtcctgccaccctccccactccagtctctggctgtcttcagggatatttctgccttcacgccctcccaatgcttcctatgggttgaggcaggaacaggtctcctgccagtgcacccaagaggttgaaaagctggctgttcaatttgatctcactcttgtaatggagtatccataagtctcggagaaattttccacctacttggtgcctggaagatttgagaaagggcatcacagatataaaagtctgattagcctaacaacatagcctaactcctagcatggagtttttacttctctgtagcctcagatgctgtctcatcctcacatataaatggtgatatattgctagaagttcggtaattcactgttccttgtgtctaactttttaataaaacgattgtctttggcatgactttctctctgctactataaaatgttttaatatatccttcttctactcatgtttattgactgtgaaaatggctgtatttcttcaattaagaataatccaattttctaaaaaaagaactgataattggctattttcgttgtggttatcatggtaacaataacatagttctggtacttacatttcagtcaagctgtttctctgaaatacatttttcttctacatgcataccttatactgagttatgtgagacctaggtgttttttcaagcacaatggcaataatcaagatctaaataatttccttttcatattatgtcaaaattactaaccaccattatcttttaataaaatatttttaaaacttgtggatttatacttaagctaaaattcctttttgttcttttttgtcccccttaggaatgaaatgcctgaattgtaatattagggtctttggtgccacattctcagagcacaggggtgtatgtgtctgatagtttaaataacagttaaatcaaattagaactctaaaatgaatcttatctattagaacagtttttacccccccaatacagctacttaaaatatcccatttcggaaaatgctcacttagaagaatatgtgttttcttttgaccaactaagtgccttggtcacaacagcagggcttctatttgctaacagagctgtttcttgcacttattgaaagaagagggaccgttaaagttttagtagttgaaaattatccactaattagaactggaagcaagaagccatgaagtacaggtgataactataaatcagaacaattagtctgtctagaaaagcaacatgatcaaatcagagtcagcataccagctgctcatttaatctagggttgcaatgtttttccctttttgtgagataaccctgtacagcaggagcttggatttgacaagtatgcattcctcagaattatttatgaattcaagaaagtgttggtacgctgatgttacttttacagaaatgcttggatttgaataagaaaataaatgacattcagaatgtgaaattccttaaatatgatgttgcattttcacctagcataaatatttacatcggcaaaggtactgaactatatatttttctttctgattgctattgcttgagaaatatatattatgtgaatatcatcattttgttgtagtactgcccttcggaaatacattaaacttctacataaaagtggaattattttataataaatgaaattttaatattcctctaaatcattacttgaaatctgtttttattttcttagacattctggcagtattagagaaataagtattttgagtgcacacacaatgaacaacagcaatatacaagacaatatttatatactaatgctgtttccttctgtaatatggtaattttattacacagtatttctagagttgagatgtgtaaggcactctacatggttttggaaccatactattctaaaatctgacttgtttttaaaacattatatgtttgtagagaaatgagataattagacaaacaacaaaaacaaaagctgaaagtggtaacaattgttacagaaatgataaagcaaatgaaagatcagaaatttcaataattcaatgtatgatgatgaattacagtcatatacaataattcctcattgtgtatacaatataatatgtaattccttattgcttatataaccattatcattattataaaatggtcttgttttctgaccctaactaagtttaagacttatctcctattttcatctccataaaaatttctagtagatttcaggcagatcctaagattttggaatataaagacaaatgaaaaaatgtggcttctgccatcaaataactgacaatctaacagaaagttacagatgtaaacaaaccattacaatactaggtgttaacagcaaagtagaaatgtgtgcaaagagttgtaggaactcagagaaacgagtacttcattcccctagaagtcagaaaagctttctaaacacttcatcctgagattaaaaaaaaaaaaaaaattgaataggtattccccctgttggaatatgttgggaagatattaaagaatggagagcagctcatacacaggcattgagagatgtgtataacccattcttggatgagcttaggaatttggcatagtgttgcctaaatatacaaggaagccattttgggaggtaacactgaaaacttagagcaaataactaagaatgttttaaacatgatggtagttatatctcatatacaataaggagccatttaaaaacttcaaactaattaaggacaaaagcaggtttgcattataaaaaaaagttatgctaataattacatggtgtgaactggaagcagagaaactggagacaggggtccagatagaaacataggggaacaacctagagattgtaggtaactcccagttgtactaaagagttagtactcaaaggttttaaatttcacagtcaaattagcaacaaaccataatacttgttgtattttgtatttgggaaggcattgatgaccattttgcatttagcaagccacaaagtcttctgaatggtagaggtggggatggcaaatgggagatacatatgaaagaccttgcagaggaaaatagacagtacttagaaattcattagatgtgaaatagaatattaaagttgaattcaaccaaaaaattccttttcaaatgagaaggatgaatatgctattaatacaatttgggagtctacacgagagtttcagagggaagaaatgaagctttctatataaactgataagctatttgaaaactaaagtattggccaggtgtggtggctcactcctgtaatcccagcattttgggaggccgaggcgggtggaccacctgaggtcaggagttcaagacaagcctggccaacatggtgaaactccgtctctactaaaaatacaaaaattagccaggcatggtggtgcatgcctgtattccccactactaggggtagctgaggcagggggattgcttgaacatgggaggcagaggttgcagtgagccgagattgtgccactgcactccagcctgggcaacagagcaagactccgtctcaaaagaaagagagagagagagagaaagaaagagaggaaactaaagtatcatgatgacgagaaagaaaagggctaagaacatttatgggagtcatatgaacgaagacatagttgaagtcacttagggagagggtgcataaaacagtgtaatctaaagagaactttggttgtgtttacaattagagaattggtaacaagagaggaattaatgcagagaatggggcaatagtgtgagatcacaacagtataatatcatggaacccaaagaagcatagtttcacagtgggctttttctgggtcagatgttctaaagatgacaaatagactcagaaaatccttgcgtttgatggctggaggtaccagtgatcttccaagagagtaattgtgttattatatatgctgaagtggttattgggaaatagatttcaggtggatagttaatgaagcacagacaagagaaaaacagtactttcaagccactttttgagaaaactggtagtgaggagaaaacagaaaagatatttcagaaaaacgtgtttcttgaagtagactgcttatggaggaaaagtggagaaagtagctgacatagaaatggtagtaactaattatgtgtttatagaagtggaaatgcataaaaagagcagtaaagataatggttatcaattaatacacttaatggctagcttatggtaagatctaaaacaagaaagtgaatgtgatcaggagagtaaagaataacaagatcttaacatttctgactctatttgtatagggtgaaaaatccgtaaagccaatccatacatggatctatatatgagtctagatccagaaagccaatctaatactattctctttttaaacagaatgtactactgatatgcttggctctgtgtccccacccaaatctcatctcgaattgtaatcctcataatcctcaggtgttgagggaagaactgataagaggtgattggatggtgggggcagttcccctatgctgttctcgcgatggtgacttctcatgaaatctgatggttttatacatttaacagtccctccctcacacactcttgctctctcttgccgtcttgtgcctgcttccctttcaccttctgccatgattttaagtttccagaggccttcctagccatgctgaactgtgagtcaattaaactctttccattataaattacccaatctcaggtatttctttatagcagtgtgaaaatggactaatacaattatcaaaactcaaacttttatgatactctaaatttatctgatattcttttaacattaaacctccagtaatcaaagtggggtttacatggcagaaacattacattcaccaggaagcttgttaccaaacgcagaaacttaggtttcaccccagacttatggaatcgtcatctgaattttgaaaagattggcaggtgattaatgtacacattacattttgagaaacattgatgcatagcatattaatttaaataatattattatatacatttatgtggctagtaattttgctatctgttgatttgttctgtacagtttacctccctgagagaaaatctatttgttaataagtgattttatttttttgccaagaatacaaatttaatttgctcttagaaatcagggagattaataaaataaccctaaagagttgaagttagttagaataaaaatgtatacagtattttaaaaccatgttgagaacatatagaatgcaataaactttatccagtagaaaaaataattacttgattaattttactttctttgagatagggtctcactctgttactcaggctggagtgcagtggcataaccaccactcactgcagccctgatctcccaggctcaaacaatttccacctcagcctcccaagtagctgggactactggcatgagccactgcacctggcctaattttagtttttattttaaaaatgaaatttctgtaagaccctgaaaccagataatagcctttttaaaatttatatgttaattttctgaatctcataatgcaaagtggctttccgtgggtctccttcaaactcaagtacagcacatctacatacattttaacgaactattgtctgtgatattgccatcaaatcgcattcttcttttttctttttttttgtcaccagcattctactttattgcagctcactaaaaaaaaaattgtagccctttacgtctgtttaatcatagttagtaaaattatatccactcgacatattattttgaatcattaatatgctcagcatctctagctaaggcaaatcagaagagaaaaagagaacgttgggtgagaatctggtttgtcattccccatgtatggtggttgaaagatagccacaagttctttgataactccccaattcaaagattgggtccaattccccttaccttgtatttggactagccttaaagacttatgtgaacaacaacaacaaaaatgcagccaaagtaacgttctggaacttccaagaatatttcacaataattattacagcttttgcccaggactcttagaatattttctttgggatccctgatccatcaggaaaaaaatctgactacctgagaccactgtgataaagtgtgcacatgaagtgctcttgttgacagtccctgctgtgcctaggctactagccatacccaccaaagtgacagacataagtgaaaccatcttatagattccaaacgagtcattttccagttgaaaaccatcaagagatatctgttgatgccacatgaaacaaaataatcactcaactgaggcctgtccaaaattcttgaccccaaaatttataagaaaaagtaaaatgactgttttaagccactaaattttggggtagtttgttaattagcaacagattaatgaagttacatgttttttatatgccatcccctccttttcttttcttttgtttaatggaagcaatgtgagcattttctagcactacacagagcacttcacgtgaagctagaaattcatcctacatacttggctgaatctttgctcaaatacaattcagtatatattcatagaattgcatatgacagataatatttcataatggttcccttattctcatgccagtggttttgtggtgctgaattactataaatgaattaggattttagcagcattttgaaatgtagaattatacatttttccattatgattatcttaattagatggagaattaagccaaggaagaatgcaaaggctgaaacctaatattttgaaatatgattatgttgaaatcaaaaattcaattttccctttttatattaaaacactctgaagtggccttaatataacacacaaagggcttttctattttattttacatttaccaagaatgagatcacttctactatctaaaatagaaactgtactctcaagcacttgaggtctttgctctccatgatcttagaagcatataataaagatagtaatagtgtatgagtaattctcaacatttctcagctaatgaaaatattttatcttaaaatatattttaaaataaatatacctacttctaagtatcaaaagttaatttaactaccttaaccagttttgtcatactaatgtacaaaaaaatcaaaaaagttttttatctgtgcagaatgatttttaaattaaatatctttatcaacttataccattcttgaagtctaattgtaatctatgacattaatatttactcaatcactttgaaatttattgtgttttctggcagtgacctcaaagagaggtagtatggcttagtggaaagtatgtattaggcatcaaagtgcaatagacgatggtctacatagctcctgggccaattaatggctttgggcaatgtttccctcatctttaaaatggacatgataatatcttcttgcaaattaatcatgaggatgaagttaaataatctaagtaacacgcataacagttcctggcacaatactgaataaataacagctattattatgaataatagtacttctcttaaaactaattaccacagtttgttttgaattactccctaatctagggaaatatacagttgttacaaaagaaaaccccaatctgttttagatttcatattttatcaagtattatgtattttacattaaaaaattctcctaaacaattattctaaaatattttacatatatgatcaagtttcatacgtacattgatttatttctcatgaagtttccttccaatgtattatcagacaccaaaataagagtactattgtactattgttatttacaatatgtcattgcacatcaccgtacttttgctaactcttttttttttttgagatggagtttcactctggtctcacaggctggagtgcaatgacacaatcttggctcactgcaacctccacctcctgggttcaagcaattctcctgcttcagcctcccgagtagatgggactacagttgtgtgccaccacacccagctattttttgtatttttagtagagacagggtttcattatgttggccaacctggtctcgaattcttgacctcaggtgatccgtctgcctcagcctcccaaagtgctagcattgcaggcatgagccaccatgcctggcctactaactcttaaaaaactccattgagtatccaaataatttgtccaccggaaacatatatataagatgcaaaagaacaaaagcctgtttggggtgggaatggggcgaggtaggtagtgctgctggaggacatgtattaaataaaatgaaacaaaaaggcaaaaagcaattgaaaagtctgaaaaatcttgcatccaaaggaccatttggccccactaaaataatttgttatcagcaaagataaaatagaataagttaaaagtatagaagtgaaaaataccactcaagaaaatattatctgagattacagataagaaaatgaacagatgtcctttttattaaaattccaagttgctaacaatggcatatgtacgtctgactgacatgtttgaaatgccataaagggattcttttgtatatcggtaatatttttccaatgcctttaaaaatggtatttatgtacatgtaaggtatattctgaaaattataattatgggtattgttaattaaaaccagtgtgctgttaaaacaaaataagaatatttttgggcagcctatctattttggggccttagagatcacagttgtgaataaatcccttcaagtcactattcgatttacacaagatacaaattattatgtcagagatgagatatatttcatttgtaatccctctctaatagaacttataacaaagtagaggacgttgcttgttttgattgaaaatggcatttgatgtacaatagaaccggtacaaataattcattcctaaacaatgctggcatactcactggaataacagcgtgattattgtttaattttacattatctaggataccatctctaaaataatgcaatagcctacatttttctgaagttattagcaaaaaatagttttgcctatgaattatccaataaattaagctttttcctttaaaatacaacttttttctaaaatgtataaaatacttaaaccctttcttatagtcacatcatgtacgtttatcttatttttgatgatagagttagcagtgccactattctattggcctgcattctgctatataaaggactattgaaacctgtagttatttgtccacacaatcaatgactccacctgctatgttttgaaattccttagtcctgttagagtactcattattttctctctttcattgtaactttttacttctcatagacatatacctagcagtaagaaatctgatcaccctttaatgtacttctttcatttagaaatacgagataaaaacataggatcaagcttataaagacttgctgtaagccaagaacaaagagactttcaatgacaaagagatgtctccgtaagaactggcaccaataatggtacagattactacgttgatttagttctatagttctgcctacgttagtcaaattgacaaaacatatttctagaaataatatgtttacagaaagttctgcagttgctgggcccaatttcattaattttaggacattccatcagtgatgcattcagctatgtgtttactctttctctctacctggagtttctcttcagaatggcaattctcttccctcatacttttgctggagagatcatccagggtgaaagataagagaagaaacccaaatgagacagactatatttcatttattcttactaaaatatatttaaatttcagccatgtctccttgggaggacttctgactggattcacattacatagtcaattatttgcattattactgccattattgtttttgaattgtcattattcctatactagtgagctaatcactgtcattgagtgtgaattttactaacataactctcagaggacaacccgatttcaaagtcctcaagagtatttcacggttttcctagtgtagagacaacaaaactgttttacttttacagacattaaaaaaactatattaaattttaaaaagagagataagtctatacccgtcagataactcttgattgatgaaaattcacttaaaattggtagaaacttgcataatacctggagtttcaaaaatataattcagaatgccattgcaagaaaaacgtggtgtgttttctatatttttgtttagttacacctcattgtaaatttaaaaaacacaatttttaaaattataattctgcaaactagaatattttcccttccattttgttaatcacagaagatctttcttagagactctccagattacattatatagcatcaattataccatgagcttcttgaggacaataattatatcttttcaagtctgcagtcttaatttcatgagtgaatgaatgtcaatagtttaagatcttataaaacattttcttactctgaataaattggcatataagttataaggtaagaacttgtggttttgcaagattcaaataccaaaacaaactgaatatttttaaaatatgcttagtcatgaatgcttagtattttcttacaactttctatacccctatatttttatttctcttttggattgtgtattttgaagtattgttattataaaatgcccaaaattaattttaataaatgttaagatatcatcaactaatatgactttctataactttctcaataatctcttaaaactgaaatggcaagataccacatgtgcactcttttgctgtggtaaagacatacatgttatcaaattttacaggtaggccaacactcaggtagtaaactatagacctgaacaataaaaaactaaaaataaaactgataaattagtataaaacaagaaacaaataatgagctactttgatttatggtattcatttccatttcacataagcaatctatcttaatacatactacaaaccttgcatctgctttattaagtagtacatttcacattcagccattctaaaagagaaagatagtatttgggtgatggagcagatcatttctgtttatcagaaggaaaaatttaagcaaatcttaaaggggcaaatttttatagtactatttgctctgtattattgacctaagtactgtaatcaccattgatatagtagacgtcattaaatcatattttgtaaatttagagatattccattacagattgatttctctatgtatacgtatgtatgaatatgcttcctgaggaaacctgtttaattaaatcccattaatagaatatcctttttctgcattgtacacgcatttatgtaaatatatacaaaattatcttctagtctgaaggcgctatagttcagtgaatagcatcatgctgattacatccaatgagctttttaaaagcagattttgtttctttaaaaaaaaaaatagaataggtctctgccattcttaccatgaatgccattttgctaagcaaaaagattatcagagcaatctgaatttatctgtgtagcaaatacattttagtacttagtatcatttgttacaaaattataatgaaggtaagagagggaatttactccattttcctttttttctttatagaaactaaagctcaaataagactaggttatttggctaatttacatagctaatccatagcaaaaagaaggcaaagcccagaactctaaaatttagtcttaacttctttccacatatcaagaggtacttgtacttacaatgggaaaggtgattaagaaacttacttaatcacctttcccattataagatttaggcctgcagtaacaaaattcaattcatggtaaatatgtaaaaacagaaattttaatggttttatttcaaatacttgattctcacttatgaattggaaagcaactcatggtggatttgaaggattgcttcttaattcaggtcattctgactccatgcaaagatttaatatcatctattctgttttttttttaatttaggagattcataagataattagaaaattttacttcctaaaaaattaactaaattccattttcatcttcaaatttcctctttaaggtatgaagtactatactaataatttctgagttgatccagaaagttgtctatccacattaacattattgacaccaacctgttggacacacacacacacacagcagtttctagaataatgttatttcattcaataccgtttgctaaaaatattgatgagaagaagacatgatttccagccagggccgtgatttgtatggaatttgcatgttctctccaggtgaactggcacatctaaatggtcctagtctgagagcgagcgagcgagagagagcgtgtgtgtgtgtgtgtgtgtatgcacacgacaacgtgtgaatgtgccctacgatggaatggcatcctgtccagagttggttcccaccttgtgccgagctacctggataggatcaggccatgcgagaccctaaactgtaataagcaggtaaattattgtttttactaatcattctaaaacatatgtatagctcatatttattttaatgtttaatattagaagtgatttaagtgcttgaatctttaaaaaatgcagtgatgtgtttgtgagcagaaatatgccataggaactgtattcttgtttatatcaattaacctttggtaaaattggtttcctaatatgttgtttcacttaagacggcagtttccaagaatctaccaacgatgataaatgaggtattactgtacttcgttggtaatatatgcactttgttcctatttactttgtatctattattagaaaaacatataactctggcaacaataacaaaaacaggctaaaataaaattatatgcctaataataataattataattagactacttaatatcttgttttaatgataaattctcagagatgggacatatactgagagtatactatttctattggagctatgtccactttattccagtggttctcaacaaagggtaaacttactctccaaatggtgacattctcaaggtcaacagacacttttgatgatcagaactggctagttactactacatgtagcggggagaaactagagacactgctaagcgttctgtaatatatatagcatgaccttaaatgtcaatagtgcagagaccgaaaaactctgcctttcaaacagctctcttattttgagctggattcacacagcctcaataattagacatgcctgattcagagtcatggcatgatttcctagctaaaccactacatctaactatatgaagggttgttcactgggaaaataagccaacagcatctccctgggcacaaatactgtcattctgatgcatgaatgtacataatttttcctttagcattcaattcagcattagcattgtgagatctcgcaccgacttagcaaaactcaaaaatttaaacaagtttttcgttgattttaacctgcggaatttaattttgagtttctatggcatttgaaaccaaatataaaattataacaataagagtatccattaaattttttttgtctcttacttctgatttactttatcaatgaacattaaaaagtagccatctggactgagaaagaaaataataacatttctcatttttaaaagaattcggtaataaccataagcacaaagaaataaaattcatcagatttttttctcctattgcttcagcctagggacacagtgataggctgacaaatctgaataggaacataaactttgattgtaatttaattaaaaaaaattattttactttttactccagttcattaatatttttaattcatgcacttgccaaaagcatgatgctctctttcagtcaaaaacacattgaacccgcagggaagaaatactaccccacgagtaaaggttccttcctcagcttgtcaagaaagtcattccaaactcaaacaatggcagacggcagatcttgctatataacacatctattctatgatacactgccattcttgaacgtacatgtatccttcagaaactacaatggattataatacaaattaggctgacaaaagttctcttagtttatccattggtctcagaataatgcagattttcttgcttcatctgagcacttaaaactcaataatatgccagacctacctaagaaatgccttaaaagtagtttattatctagcatagctttcaaaaagagaaaaaactattttatggtatttgtttttaataggttatgttattgctatagtgacagaaagaactgaaaagacctactgtatgtatccttgtataagaaatacacaaaacattaatgaaaaaactcatttgctaaatcagtcgctaatcttgtccagtttaactttctgtaatccctgacaaacaatcctaatattcatcactcatcaagtcatgcacaaacttttaaataaaataattgtatatgggcaagattattctacttggcaaatggcctattgcactgatatccacctttggttttttagaaatgaaataatcacagtcttgcagcttatttctgccagaaaacttcagacagaaaatgtgtattaatacaatactctatgtctgcctaagaataagcttaaagacacaaattctccttctatattgttgaaataaaacagaatcatagaccaagaaaattagaatggggaaagggaatatttctaatgagttaggaatgattaagtaagatgcatcaaaaatgtcactcgtcctcttagatatctagactctatgctatgcattatggaggacagcaagaaatgtgagccataattttgtccttgattacaattaatggagaagaaaggaattataaatatttagaaaaatattataacaacagattatgccaagtgcaaactatagggttcaaagcataaatgaatattatccaagactatgagagatttttgacattttgagacattatgcaagaagcaaaattgagctggtccttgaaaggatgggtcgatttagaaaaataaatgcagagcttcataaatcaccgtttcaagagatgaggacattatataaactattccattcatgcttttattacagggacagtgggaggaaagagaacagaatattggtagaactaatcttcagcatgatgttggcagatctcaataaaattatggccacttgtctccaatgttacaattcagggctttggagagtcttattttataggcttcctcattaatcatgggatgtctttctccaaacttatgtttctacagtgtaagtgtgagatgctctcaaaagaacttccaggaaggtaggttaccctccttacttgtagacaccagcaagctggtttttatctccaaagtagaatgtcttggacccagtgtagcttatgcagatatataaatggcacaatgaccccagtacatcttttacaagatgttgttcacttgcgcaaaaaaaaaaaaaaaaaaaaatttgaatacaagggacactgatttccttcactaaagcttcctgtatttaaagctgaaatgaagttgcactttttactcttaattgatttatatgctacttttaccatggggctatagcacatgttgtcttgtaactgtttttcagagaagggtcattaggttgatatatttttgtacagcaacaggaatgactgctctgctaaatcactaaaaattaagacaaagacaaactgaaatctgcaaggattgacttggcttctgtccatagccatatcattcttggcaaatgtgaaaccattttaaaagtttttattattggcatggaacatattttggcatacacatatacaaaatgaacattataatgacaataagaataccaccttgttagtttaaatcagtaagaatattgattactcagtaatgtaattcagactattagctaggttttgccaaaagtaaagtaaccctgtatttctttagcatatcttgcagaaaattcagattcatctaaaggaaacaaataaataaaaaacattctaacaatgaaaagagaaaatacagtgagtactgaagagtggtggagctgatcatactgatagctgtgagttctctgctgatggtgggaggtgggtggcagagcccatggaggtgaaagatctaaaagttcaaggcagcaatgttccttctgagtttgagaaatatcatttagcagggtagatgctcaatattcctttccttcctttatcctgatatgaaaaatggagatgttgtggtaaataggggggtaaattgggcatggaggaagaattaaaatatttagtatattatgttttttattgttggcttatgttcatgactattgtgtttcttttttcagcttttaggggaagaagaaagtaccagcaataattcatttcttacagaatttagctgtggtttcgtagagaagaaattagaagacctgggtttatgctggatcctcgtccaaataactttgtgactttgggcaaattactttatgtcactggacttcacattttctgtatgtaaagcaagatgttttgattacattcttccactggtatgcgtacaattatggtactgcaatttatgactttctgttcctactatattgcgggcaatttgaaggaagacaatacatttttcaactctaaattctcaaggcttgacactggttggcatacagttaatgctctgtaaatgtttgttgaattgacttatgttgattatcttacttccaagtccttgcagaaatgacgtgttataaataacctctctatcatttcataacattagtgatagaaagccgtattagtgccttggtgggagccaagaaataaaaaaataaaaaatatattttctacaacaaaaaaaattaagatggacagttttacttgatttctgaaatcagagaacaaacacctgttccagtaaaactgaaaagacaaaatatacattaactaaatctgtggaaaccctcaacttcaaatagaatctagatagagatacttcatctggatggagaaaataatacatcgcagtattaagagaatgtatttgttcctaacaatgagctctttcacttcaatattaaaatcctatttcaaagagaggttaatcaaagctgaagactattgtgtattgcgattttcacagaatatataattctaacacggacccctttaataatcaaactgttgctaagaagcttcttttgttattattattattattatactttaagttttagggtacatgtgcacaatgtgcaggttagttacgtatgtatacatgtgccatgctggtgcgctgcacccattaactcatcatctagcattaggtatatgtcctaaagctatccctcccctctccccccaccccacaacagtccccagagtgtgatgtcccccttcctgtgtccatgtgatctcattgttcagttcccacctatgagtgagaatatgcggtgtttggttttttgttcttgcgatagtttactgagaatgattatttccaatttcctccaagtccctacaaaggacatgaactcatcattttttatggctgcatagtattccatggtgtatatgtgccacatttttttaattcagtctatcattgttggacatttgggttggtttcaagtctttgctattgtgaatagtgctgtaataaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccgttctaactggtgtgagattgtatctcattgtggttttgatttgcatttctctgatggccagtgatggtgagcattttttcatgtgttttttggctgcataaatgtcttctttagagaagtgtctgttcatgtcctttgcccactttttgatggggttgtttttttcttgtaaatttgtttgagttccttgtagattctggatattagccctttgtcagatgagtaggttgcaaaaattttctcccattttgtaggttgcctgttcactttgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggatgtcttctaggatttttatggttttagatctaatgttgaagtctttaatccatcttgaattgatttttgtataaggtgtaaggaagggaaccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttgcttactatagccttgtagtatagtttgaagtcaggtagcgtgatgcctccagctttgttcttttcacttaggattgacttggtaatgcgggctcttttttggttccatatgaactttaaagtagttttttccaattctgtgaagaaagtcattggtagcttgatggggatggtattgaatctataaattaccttgggcagtatggccattttcatgatattgagctaagaagctttttaatgaagtcatctttcaatgtaagcatatataaaactcactcattttgtttacattacttttgtggtcatttcaaccagtgtttaacaagttagttttgaaaacagcagacatggaaggaatgattcaaaacaaagatgtcttatgatttcaggggaatattttattacaaatatggaacacttaacccatgaacttagctccacaagtctttgacaatttagggaataatgggaataccaagccagatttctgtgcagtggatggaaggaattaatcttagcaaggtaaacccttgtttttgatttctcagaccctccatttataaaaataatatgggaacatacaaaccacttgatacttttatctgtaaaacacttagggcaaaaaatatatattattataggaatcaaaaaattaaaaataaaattagcattggaaagacttgaaataaaaaaatccattttgtctttgtaaatctaagtataaattcaaatcatcctcagctttccaaaaaataccctcacaaaatttccttacctactggggtgaaataggcattgctgttaaacgatgctaactaaacgaattctgctcttttcagaaaatagtatatattttacaaatatccttctttagtttatcaagaaatagacacaaatacaacaaatacttgagttatacattggctttctttaaagaaagtacatgaaaatattttcttttataagaggagatggcattgaaaacatgagtatgaaaatagcaacattaaagaaaaattctatcatgctagcaggagtttcatgttcatctctatatgaaattgtatgcattgaagtaaaaaataaacactgacggctgcagaagcccatctagagtggccgctgtgaggatgccagctgcagcaggggaggtgcagctggggctgtgtgctccatggaactgatgggggaggggaacaggtgatcccagtgggagccctgcgcccaactaaatagtgaggtgggagctcctgctcccaggcacagctgcagctgcccagccacggctccagacccaggcatccctgtgctctcagagacccaggaagcccccttcccctgcaggctcagaagtgcctctgcacccactccctggcctctccctgctccaagcacctgctctgtggtggagcaaagttgtggacatgtcccaatagctaagcccaggtgctgttgtgacctggtcaggtgtgcctgtacttgggggcagcactgacatgctggtcccctgctgtcttggccccctctggaaactgcttctgaggctaaaactttgggtgccaacaagcacaggagggaggctgggtgtctgagattggcttggcacgtgcctggtgttgaccctcggcaaagacagcctggacaccatggagggcacattaatggcagccggaggcagacaggttcctaagtgggaagctgtgggtccctggtgaaacccaccttcaagccagggatgacctgaagcctgggggccaggatgccagttttgggtggagtcagtgacctggagtcagaacttccttgatgtcttatggccagttgaatggtgctttttccaggcctgtccatggccactcactgacaaaacagcatgcacttctgccattctgagcccataacatctccagactcagccagatccagagacttgtgaggatgacctgcctgcagataggagctacccacttcaggtaacctctctgctgagagctgtgctgtcacttaataaagctcctctccaccatgttcaacctccagttgtccacataacctcattcttcttggacatgggacaagaactcaagatccaccaaacagtgggagtgaaaaaagccataatatatttctggccagcttgctaagtcatgggcagtgacatgctcctggaccacaggattgaagagtggtgaaccttctgggggctcagacctctggattccccaagccagagctgctttaacgtcatagccctcctgccctctgctggtaccaggcagcttccccaaacaggaagcagcagcgaggcaagccagcccaggatttgcaggccagaacaaggtggcaggactgaaagagttgtaacacaaacggtctgaaacacacctgctctgcaacatccccctcacagctcgctatgctgcggcggtgaggggagaagggctgtaaaccttctgggatccccgacctcagggctccccatgtcagggctgtgtcattcggtaacaccctctttggggttctgcggtttctggcatctctacgctttcaggcgcactgcattcccctcatccggacattggtcctacagtagaagcctcttgcagtacacctggtccagtctcagtctctcatggtgctgccacctgtgctagtgcgtggagctgccagcgctgctcaagtagccaacatgactaactgtgtgcactggcaggaccccacgcttgattgtttacacacccttgccactccacacctggctcacccttggcaggcatgggatctgtgttggtagcacgagccaatcaaagactgcaaggctgagtgggtgaaactagcccagcaggcatgagcaaaactcaagcagaggtgctgttgaccccagatgtttccagctggcaaagtgacatcctgcatcaacatcttataatcgtttactaggtataaaaaaggggtagcagtgagcattttcatccaaagtagatcttcataattggaaataatttacacttatactctcactttatagatgagaaatctcagatacagagattgcaaattgtcaacagtcacagaagaagtcagtattaaaagagccctacaactgaatctcaaggaacataaagagtttactggagaaaaatatcatttccatagctatatatgttccaaccaagaatatgtcactaggcgttttacattcttatttacttaaggacatgaagccgaaagtcagaagttaggacagacttagaaaatactggcagggtagtaaacatatatagaatgactgtgtgttgctttgagttagaagtgatgggaataacctgccacctccatacgtgaatctaaatcccatgcaggtgactactactgagaaaatctggcttcatttgctgcattgagacagtgcaaaaaataagagtgttcataaacatacatacacaggagtttaaattgcagtactattcacaatagcaaagatatggaatcaacctaaatgcccatcaatgacaggttggataaataaaatgcgatatatatacaccatggaatactatgcaaccaaaaaaaagaatgatatcatgtcttttgttggaacatggatggagtggaggatgttatccttagcaaactaatgcacggacatataccccatgttctcacttcaaagtgggaggtaaatgttaagaactcatggaagcaaagaggggaacaacacactggagactatttgagggtgtagggtgggaggagcaagaagggtacaaaaaaaaataactgttgggtacgaggcttagtacctaggtgataaaataatctgtacaacaaacctctgtgacatgagtttatctatataacaaacctgcatatgtacccctgaaactaaagtaaaaattaaataaaatactaaagtgtggataaacatcttttaaaaagagtatagaaagttgcaatagaggatcatggaatatcttcaagacatctcagattttatcattaaatttaaaaattataaaatgtatgttcattcccaccaaatatattgcaaaataataaaatagatcccctaaacttttctcttctaaatttgacaaggggacaaaagagtataaggactatactatttttaatgagagagagaaaatagtcttgctcctttgtagaaataatttataagaatatgccacaataaagcctgaagtatgtgcctctattctatagggggcacaggttcaaaacaagatatttgacctattttccactatgagaacaggattttttactttaattccttagacatgacaagttgataggaaaagcccgcattttgctaagatacagtcatgatgctacgggagttaaatgaacaactttactaaagtcttggtcaatctgactttagtattctggatttatgatgtcatgtgtttaaactctccctgataaaattattaaagagatagaccctgaggtcacataaattcttacccatatctcacttgtttgtcattcaggtcatttctatgtttgttggaaggtgaattaatcacattagtaataaaaattaacagcactgaatcattttagtgcattgaaatgtggaatgaacagtaataatcaaagagtaggaaaacaataaaatctgagttcttacataagaatttgagttgtgaataccaggcaaggcttttgtacatatgattttttaaatattttggtttatgcctagattaaggtatgtgtgagtgttagagagtcttatctccttaagttttaatatatcatatttatcccagtttcttttttttctccctttttaaggaatcactttattaagatatattttacacaccataaaactctcccttttaaagtatacaattcagcagtttttttgttaactcacaaagttgtgtaaccatcacaactacttaattttagaacattttttaaatccccaaaagaaatcctatacttatcagcagacagcctcttcttcttcctcagctcttggcaaccaaatctatggatttccctattctggataattcaggtaaacataataataaaatatgtggtctattgtaactggcttctttcaaatagaataatgttttccagattcattcatattacagcacgtaacagtacttcatttcttttacttttggaaaaatagcattgtaaaatctataccatatttaaaaaatttattcatcaattgatggacattgtgattgtttctattttttagctgttatgaataatgttcctcggaatttgggggcaagtttttatatagacatatattttcatttttcttgtgtacatacctaagagtagaatttccaagtcacgtagtaatgctgtgtttaatcatttgaagaactgctaaactacatctgaagtgtctgcatcattttgcattcccaccagcaattgataacaattccaattcctccacatccttgacaacacttaatatctgactttttgattctaggcatcctagtgggtgagaagcagtaccttgtggttttgatttgcctttctttgttaactagtgattttcatatgcttttgaccatttctatacctttggagagatttctatgcaagtcatttgcattttttaaattgggttgtctttttatgtttgagttgagctctttatatattttagatgctaatgtcttattggatatatgatttcacaacactttctcccattctttgaattatgttttcacatttttgatggcattatttaaagcacagaagactttaagttcaatgaaattcaatttatctatttttctttgatgttgtagttaagaaccactgtgtaacacaaggtcacaaagatttactcctatgttttcttctaagaattttatagttttgccttttatatttaggcctgtgatctattttgagttatatgtggtttgagatagggatctgacttcattcttttacataagactatccagttgtctcagcaccatttgctgggaataaaatattactttctccattgggttatcttggcacctttgtcaaagatcagttagccataaacttatggctttatttctggacattcaattctattccattgatttattcgttaggccaattttgtctatgcttgtaacaatgccatacttcattgattctcatggttttatagtaaattttgaaatcagaaactatgagtcctcctactttgttcttttttaaagatttggctattctgggtccttgacaatgccatgtgaattttagaatcagcttgttagtttctacaaagaagtgagctgggattccgattgagattacattgaggttgcagatcaatttggggaatactgccatcttaacaatgttaagtcttccaatccatgaatatattttttccattcatgtagatctttggttttccccattaattgaagttttctgaatatcagttttacacctcttttgttaagtttattcttaagtattttacttgatactgttttgaatagaagtgttttcctattttcatatttgggctgttcattacgaatgtatagaaatatcattggtttgtaaagtattaatcttgtatcctgaaaccttgctgaactcattagttctgatatatatttaagtagattccttaggattttctacatatacaattatgtaatctagagatagagattctttccaatgtggatcctttttatttctttttctttctcaattgccctggctagaacctccagtacaacgttgaatagaagtggccaccacttatcactcctggccaaaattatttatgtcttcttttaataaaaacattaagatgttttttgttattgttgtagctaaattcatgtgattgacttctagtttcagtacagtctttagaaaatgtgaattgtacatttttggggatcacctttaaagttgtctctgtttcaatgtacctgttcttttttaaaggttgcatccaaagtttgagatatatcttttatcttaggtcaatatttgaaatagtcattcaaggaaacatcacagttacagattaaatgcttttgagggtgtttatcatctctcaaagctcaactcaataaacatagtgttcaagttgtgtgcttaataggcctttgccagagttacgtcacttgtactttctttcccagaatggaaataacctgatgtacatatgaatatatattgaggtagtaaggcttggatagccttactcccataattaaatcctgtatagagcagccaactatattcaactgtgaggtctttactcaatattaacagatccttaagtggatgaaagaaggtcacagaatgcttggaaagtatttctgatccagttgaagaaagcattagatcaaaatgtgaaggatgaaggtgataaaaatgatagacaacacttcttgcctgatattgttgtaagcactacaaaagttgcatgtaatatctttacaactgctctttaaggtatccccatttacagtggaggaaatggaggtacacagacattaaataactcacccaagttcatgcaggtaacaagtgatatagctgggatttgagcctaggcaaactaacttccaaactgtcctctgattactaagctacagtacaatgaagatcaatggcagaggagtggtcagaacactacctggctttgggagactcgcagagtttatttggtgtcccttcctgcattccctactttgtcacccacattatcaagagggaaacaggaagatttcagactgcataagtggggagagctggtaaaatatctggggtaggttagtcagagtgtccttaacacatcctcttttgcttcaaaggtgatatggtttggttctgtgtccccaatcaaatctcatcttgtagctcctaaaattccctcgtgttctgggaaggatctggtaagagataactgaatcatgggggcaagtctttcccatgctgttcccatgatagtgaataagtctcatgagatctgacggtattaaaaatgggagtttccctgcacaagctttttttttttttgcctgctgccatccatgtaaaagacataactcactcctccttgccttccaccattattgtaaggcctccccagctacgtggaaccataagtccattaaacgtctttttcttcctattctcagcttatgtcgttatcaagagtgtgaaaatggactaagaaaggctaagagaaaaggcactgaagctctaaccacataagcactttatctgagcacttcctctgtctacattcagggcttgcttaataagttggttctccttatctccattccatttttgtctcatattctggtttcttgaatttcatttccagattgacattatttgtaattattcaactacatgtttgtagaaagaaacaaatgtgtatgtttatttttcttcaagaagaataaacatttgagaagttttctgtggtgacaaatatttttgtgaaaattagtgacaaattattatactttggggaactgtaggacattttttctttacaagagaattcttctttcaagatagccctcacaacaaaacttggctatgtctctaatcgttggatgtttcattctctctctgtctttcccagcagtacgcattgtttagggaagcagatgacttcaggacagtcatgtaaaagacaagacaaatcccaaccaagccagcgttaggggtaatacagtaactacatggctatgaatgtttgaaacagtattaatttgatttgttagaatttaagtagaaaaataagaaatttctcattgttttttaaggacaacttgtacatctattaaacagaacattgacattgctataataccaagaaaatgttatcccataattaatcttctattaggatctgtctcagaacctcctcggttaactccattccatcctacaccaaaaaaacttcactatcggatatccgcataacactgacattggcatgcacacattccaagcatttaactgtcttccacatgtccaaatcatacaccttcccaggctgtaaggggtatctcagaagtaagaaatgaagataaagtgggattcccattcagaggtaggtggccataagcaggacagtgtaaaattatttgtctatactccatattagcataacctcattcccttaaagcctgcctaacagccctaccacttaccattgttcagtgctttaggaagatgctatgttattctttaagcatgattttttaaaccattttagtttaaatgttaaacagttaaacttattgtgtaatatttcatttcaggaatctcaatcatcttccactatttctcatttgcaaaaatggtaagccaattcagcatcaactagaaaatagaaataatatgtgaaaagacattttcatatgtctcaacatgtttgtggataacttttcaaggcttacatctttctttgacattagagtttgtatagcaagaatgatacacaggctcaggcaaagtggaaatattctcttattacaaataagggaggagaatgaaaaatggataggagtgtcagctgaaaattgtagaatgttctgtatcaagaacacataatacttgttaaataataagtacagtgttctgagtacccaaggttttgttaaaaagtatgtacaataacaaacagagaataataagcagagagcttttgaaattagggaagaactataggatagtatttatattttggtgaacacctggagaagagctgcttgatttaggacaggaggcaagaaatcatacagcaaatgtgtgcttaattaaccacaaaacgttctttcaatgtattagcaatatgatagataatgtcagacttattagaatcactatataaattattcttggccgggcgtggtggctcacacctataattctggcattctgggtggctgaggcaggtgaattgtccaggaattcaagaccagcttgggcaacatactgaaaccccatttctactaaaaatacaaaaagttagccaggcgtgatggcacaagcctataatcccagctactcagaagttgaggcaggaggatcacctgagcctaggatgtcaagggtgcaatgagccaagatcgcaccactgcactctagcctggataaccagagtgagaccctgtctgaaaattaaattaaatgaaaatatcttcataaaagcattcataaatattttatgtcagatgagaggctaaaataaaaaagtagatagtttaacttcccactaagtgatcactcttccatgtagtccaattattaacactcttagtgtcaattccttggagtgttaacaaatgcataagtcctatgctaccctgaggggcaattatgaatataatgtaatttttgcttaatgccaaagaaacatgtttaaacactggtagtccttctgaaatgaaacttgccgtcttgtgaatgtttaatgaatgctatcctgatggtgaaattaggtgaaaagcaagctgatactcagtgaatgaaagctatcgtaggtatgtaacctctcaagttgggttgaactccacatgtaggaattctgattcttacacattgaataaactttatagaggtagattttaatgtcctgatatgatttggctgtgttctcagtcaaatcccatcttgaattgtagctcccataattcccatgtgttgtgagagggacccatggggaggcaattgaatcatgggggcagtttcccccatacagttcttgtggtagtgaataagtctcatgcgatctgacggctttataaggggtttcctctttttgcttggctcccattatctcttgcctaccaccatgtaagatgtgcctttcaccttctgccatgattgtgagactcccccagccacctggaactgtgagcccattaaacctctttttcgttataaattacccagtctctggtatgtctttatctgcagagtgaaaacaaactaatacatgtcccatgaatattttagaggctattagtgattgacacaaaatactttatgagtcataatttgttgtgcctccttccttagtgataaattgaaatccttttaattccaggtaattgtatacaattatttttgatctctagtcctatgtgtgaagaaaagaagtttaactaattagctgttgtagaaatgaatgatgctagttggcatgttggtggcatttaaattactatggatcctaaaaagtaaaaatgaaatagcagagggagacttccactctaaaaggtaaaaagagccaaagacataggaagcaggtggtgattcaggtcattccagaaactaaggcaagagttgaacatagtaaactttgggcaccacatcaaaataaaattatctaagatacagtggctcctttaatttagaaattgttgttagatggtctttaatatggattgttgcttaatgacagttaagattaaagaacttcaactattattaaaagaatgctgtccattttcctattagaaagtagaccattttgagtgtagatatgtatcttgtagattttttcctatttcatgtttttttagtttatctagtgacatttgttaagtgattcatagttgatttttattaaaatttgtagtactatttatcccaagtcttctattttggaggcctaagttgcctgctttaccacacaagtaaatggtactgcaggttatttggtaaaagtcaggagagaattatttcaaagtctaaaataaaattgtcaaaatatgtctttggaaacgtggctctagatttcagaaatacccaaacataatagctcccatttccgtttgagtagtttgggcgggctttatgctgctgtaacaaacaaaacaaaaataaaatgcaactcagttgcttaagaaaacagaattcatctgttgttcagataagttagctgtgaaactgggagtatcttcactgcagctgtcctccatcaggtgactcagggattaggaagattcagtcttgtggctctactgtctcaaatgcatgcctcctctacaatctcctttgcagaggaagagaaagactgaaaatgcacatagaggatttttatctcctctgcacagaagtgatatactttacttccattttcccttggccaaaagtaatcctatgaccacacctaactgcaaggtggaaggaaaatatgattttctatatggtcaataaagaaagaaacccagatattaatgcacaccaatagtatcactctcaccatccttatgatttctaataacctgctatcccagcaagctaaagggaataaaaggcttaaagcaaatgctcataattttaaataacttttttaaaaatgataaataaaagcacctaattatacaggaaacataaaattaaggtccttgaagttggggtcatgtcatatcctttttatattacccaatccctatcaaatggtttgcaacaaaaaaaaaaattgtgagagaacgaacatattagtaaattcatgagagtatgattccttcctttggtcagggaacacatgatttatgttcatatcatgacataaatttacatcaggatagcatactagcagtaataacaactttaataactgtgtataatgttaaaatgtgcaaagcattatcatatactatatgcttaaaaagtcaaaactgtgagattggtatatatgtttggtttgttctctacaatttaaatacataacataacaaccttgaaaacagtaacatcattttaacacaaaacatttaatttttgaggggagagtatcttgtagataaaacatcagaatatttttggtacatataaaagaaatacactttttaaactctctagatggaaatagcattcaattcttggaaaatacaatactacatttgaattaatttgtattatttgaaagatattgtatgactaatgctaagcacatgaatttaatttgcaagttacctataatactgttaaaaaaaattcaggacggccaaacttgcataaaatttgcattagaaaactgagaacactaatgaggaaatgaaacagccattaatcatcattgcgtgactgcagaagggttaagtgggtttctatagattttgcttcacttattaatgacatggttttacaggtataaaagatatgtatacacagatccaaaattggggcgtaggctgtggcaatttatttccccttggatttaaagtaactatctctgaatttttctcaataactatataagtacaaaagataaaatcttgttttaactatctatgtataaactttcctaagagctccagatcagggttactactcaaatatatgtagaattgggttttattaaaaacttactaggataatagtatctcagtatatatagtctttagagtccaaaggatagactgaaatctcagcatcttgattcattaagtatgagactgtagatgaactaattaagctctctgaccattagtctcatctctaaagtgatattaaaatgccctttacaaagtgagactggaagcatgaaatgagaatacacagataaagcacctagcattgcacctgacaaacggtgaaagcttgaaaattcaaattctctttgagtgtacatcattgtgcatatgttattattttgacctcttaaaaggtccaaaatccaggtgcagaaaataaaatacatgaattggaacaaattgccagaactacacacacagatacaaaattcagtgattcgtaaacattaaacacattaccttatttaagtgaaaaaatgctgcaataagattttctgtaaatattttacctgctatgtaggaagtgtcagttctttactttgaagtaaatttttactgctggtatttagttccagagtaaatattttttttacttgagaattatatcataatttaatggagtatttttaatgtatttaatttggaatctaagtttgcatattatcatttgtatttcaatagtactctggttttaattttacatttattttcatttctctcaaatggcactcagttttgtagagtgtatcatgataattcagaatgtttttcaaatactattaaccatccttcacattcacagcattgttttctttcaaaatgataactagaagcaagcaattctagaaatggaaatttaaggtttttttttaattatactttaagttctagggtacatgtgcacaatgtgcaggtttgttatggatgtatacatgtgccatgttggtatgctgcacccattaactcgtcatttacattaggtatatctcctaatgctatccttcccccctccctacaccccacaatgcagccataaaaaaggatgagttcatgtcctttgtagggacatggatgaagctggaaaacatctcagcaaactatcacaaggacaaaaaaccgaacaccgcatgttctcactcatgggtgggaattgaacaatgagaacacttggacacagtaaggttattttttaagtaaaggtgaaatcctaaataagttagttaattgaaaatattgaggaactactaaacatagagcaatgtgttaggtatgctgcagtaaagagaacaagatgacattgtttcctcatttagcaaacttgcagaattgctgagtagaaaacatgcacacaacacaagaaccttagaacatatgacagtgtaaggtaaagtgctatgctttgtcatcttaaaaacaaagagttcaaggacagggggaatcaaactacaatattgaaaacaatgaagacttccaggagaaagtgggacttgaatttggccttgaggaatgaataggaaatggggatacgagcagacacactgatcatgctggtcacagaagcagaaatagtgatggtggggcttgtaaagggagaaaactgaacaaccttattagctttgagatttctggtatgtactgaagaaagattgcttttggataactgtggcaatacttaattgtataacttgtatatcaaactagggaaaaaaaactcatacattttcccacactggtcacattaaaaaacaaacaaacaaacaagcaggagaataagtgttttagaatccatcacctggtagtatattaagaatggatttgaaataagatatattagaagatagaagaccacccaaaagatcattttggccatccagaattggaaattcatactgacaatttaaatgaaaaatgatggaatttaggcaaaaggacaattacaggaggagggtccagatccaacttttgcaactaaggacagctttaggatggaaaaagtatagaggacctctaggatttgttatgatggaaatggggaggcaaaatttgtgctacctaaaataccccagttcctcaagaaatgcttaagcaaagctttccatttgcagaaagtgctgagggagatggaaggctaaccctcattctcattttgcggctaaatattgactaatactttgatgaatacttttaaaaatcattaaggcagccagggaccgtggtgtggctctgtcgtctcagcgattctggaggctgaggtaggaggatttcttgaacccaggaggccagcatgggcaacacagtgaaaccttgtttccaaaaaaaaaaattactaagaaaaaatataatttcaagttccttttgttcatatttatggttaaatatgtaggactgaattcatcattgtgaataggtatttgtttggtagaaatttctatttaccactctccaaaggtaatgcaaaattctactcaggcctagtaaaagcctgcacaatgaaaggctaaactagtctcgcaataaacagaagcttgccttcactgtgggctggttaaagttatgacagaacattttaatgtcaacttattcttcacgtatcttgcaggactcaaatataaggaataagacagagagaaatatgtcaaagtgtattcttctgggagggatgcagaccccagtggttcatggtgcactgatgatggagagagacaaagcatacatctctatgggaaaggcatcattcagtggctttcttagtgatgagatctgatatacaactttaagttttctgtttgtgtgcaataattctgtttaacctcaagtcttcagtaacgtttgttcaacatgacagtttactatcaaatgtggtactgtttggtgggaagtgtgaacttgaaggatgaaacccacatggaaatgaaatgattataacatattgagaaatcctgaaagcatttggttttaggaagataatgaacaacagcaaggagatactggaccttcactgctctcccactcccatccagcaatacccagttattactaaataatggagtacaagattgtatttctgcagtccatcaagttagaatctcattcttggttcagtattatggaaagggtcactgcgtcagatgagttgggacatccagtctacacacgtatctaagctagagatttcttcatagtattaaatgagataaaatgtttgataatcttgtatacactcagaacatagtaggatcccaatgtatgaatgtgatagtgagcaatatttcaataatatttgaagaaaaaagactgggtggattcaaacatgaatacaaagctgctgtttggaaaaatacacaacttcacagaaaacctcctatctcaaccagtacagctttatcatccctgtaatgcatgtcccaggaaaatgttgcaaggattttaagagtttccatgtggaaaagatcagtgtgttcagtgtgtttctagctttacaacatgtaaattatactctcagcattgtactactgaaaaacttttaaacacccaatttttgtgtcagctcatctttggtttttatcttgcttctgcatttgatctatttttaaagaaaaattttccacattttaccgcataatcctctgtcctatcacgaactctttcagtggggatttaatttccttaagaaacaaatgctccctctgtttggaatgttcttctaacccatgaagttgaatctccaagaagtatctggacttatcatattgtctaatattggttaagatgtaactggacttatgagattcaaactcagaagatggaaatgaggggagatttttttttaaggattaagcctgacacagaaataaaaacatactccaaggaatagtgacaaacaaaataaaaatatcagaagactgagagtcccaaagaaaaaaatatctcaccagatttttgaagttaccagaagatcaaggagtccaagcctgataaaaagcaaaacagaggaaagacagaaaataagagtttttgtttcagaaaaaatagacaataaaatgctataattctacaatattattctatttacaagtactgctggctgaataaacactttaagacataatttctgtagatgaaaatgtgtctttaacttaaactgaagtgtttaacttacattgtgccattaaaacaaaggaaaaaaggaaatgttctagctctagaaaatattttttccaattatttaggtgacgataattatttggttaattctttaagttctcaaagaagggagattattattaaatgcacttgaaattctctaataattagtacataaatttaatgtttttatgggagaagcagaccaaagtttcattttaaaagacttttcccatttttcaggtttttgctggctatgacaataattagttctggctttgatttatttttgaaaagtaaaaccatgaaagatattataatgacaaagataaaaggcttttaatttttaaatgatactaaaatgcagcctctattttttaaaggtgtttgaagttcaaatgaaaggcaatatctgaacagcacaaattcccaagaggagacccagcacctgccatgggatgcaaaggttttataaatgttgtcttgtgtaaagaaaatggcaaacattgtgaggccttttgcaaatatgcctgcctgcttctgtgtttgagcagaaatattgaacttctaaccattattattataaaataaaggagattattctttaaacatttgatggtagccttttccttttgtcttgggaatcgagtttgaaactacacatttgaaaaacacatgtctttctttgaaagagaatggagaacacggtaagtgtgaaaggagttgacactattgtgtaaggttttatatgtgcatatgaatatgtgtctgcatcttactgtcagaaaatttaaattaggttatttctgttgggccagaataatctccataatgctggaccactaattggtaacaaatcatcccgaaggaagctattaatattccttctctagtgtctaaaatcatttgagaagatcaatgcttcacttttgaagagtaagtaatggatcttgtcatattattagagaccttactgaattctctagcctggcttcaaagatgtaaaacggatgatctatctcttagaaacctttgtccatggatcttagttctattaacgacctaagaaaataatctgatacattcttttattgtcatattttaagttatttctttgcggtgcgttataaaccacaaaagatttgcaaaaatagaaatgtatacagctcaataaattatcacaaagtcaatgctcatgtaattattacacagataaacaccttgaagttaaccagtacatagaagcctgtggcttgttctgtcacactgggtaagtgtatatgtatatacaaagatacatgtgcagagatttgtaatcatgctgcattaatgtctcatgttcatcacaatatttcaagtcatttgactgtgtgttaccagggagggacaacaccttgaacatatcataggatgtcattgaatatattgtacactgtaatctcagtaaactattaattatctgtatttgtcaaagtatctggattttttgtccagcctatggttctaacttaagttttaaactttatctacttggaatcatgtactacatctctctctctgtgtacttcctttcctttaaaatcttatttatgagattcattcatcttgttgctcataactgcagttagttttcattactcctatagtattccattggataaatattccacaatttacatattcaatccactattggcagatatgtggattgtttccactttggggttattaagaattaccctaccataagcatcctttgttaagagtgacattactgggtcagaaaatatgcctatgttctactttagcaaataatttaaatagtgttacgagaattgccattgttgcacttttccagaaaatatttcttttctgcttaattttagctatcagtttactatttagtggaatatttctgtacttttcatttacattatcttcataacaaattttagtgcattttcatatgtttattagtcatacacatgtgtattcatctgagaaggtttttttaagttatttttatgcattttatatgggtagtctttccttatcgattcacagaagtgctttatgtattctagatgcgagtcctttgttggttatatattgtgaaaatctgttccctactccatggcttccttttttactcacttactgtttcttacgttgaacacctattgttaattttaatgcagtcctattgaatcatctttacttatgtgtcctgtttattacataaaataatcatatatacacatctgtatttgcttctaaaaatctttttatgttatgattactttgcctttcacgtctaatccaaaaatctacctgaaatttacattttgagttggggtaaaatttcattatttttccaaattggtccagcaaaatttattgaaaatatgacattttcaaactgctctacaatattagtcatgaattcagtacccatgggtgcttggctctgtttctagacatttgtgtgttccactgaacaatttgtctatattgtactgtcttacacaatatgcctaataatatgctttgatagctggtagagatttttctaccctttctttcaatatgagtgtgttgactttttactatattgatataatttacataatgtttactatttaaaattctacaattgttttttcagtatgttcagtttgtgcaaagataactactaattccagaatgtttctaacaccttaaaagaaaaccctatatagtacctattagcagccaatatctgattctcttgtatcttcttcccctgataactcctaatctattgtctctctggatttgcctattctgtacacttcatataaatggaatcacacaacatgtgaccttttgtgtctgccttaatttaaaatatttttaaagtccatttatactgttgcaatataatagtactttattccttatgttgctaaaaaatatttcatcgaatggatataccacatattgtttattcactagccgaaggacatttaggttttcatttttttgctattatgaataacaatgctatgaacattcctatatgtgttttcttgtgtgaacatttgtttacagtcctcctgggtatatacttaggaatttcagggtcatctggtaattctatgtgtttgatgaactgccaaactgtcttccacagcaactgcatcatttcacatttccactagcaaggcataaggtttacaatttctccatatccttgccaacacttattttctattttattaaaaaaatcaaacaccgcatgttctcactcatagttgggaattgaacaacgagaacacgtggacacaggaaggggaacatcacacaccggggcctgttgtgaggtggggggatgggggagggatagcattaggagatatacctaatgttaaatgacgagttaacgggtgaggcacaccaacgtggcacatgtatacatatgtaacaaacctgcacgttgtgcacatgtaccctaaaacttaaagtatgataaaaacaaaaattcaaacaacaacaacaaaaaatcatagctatatggtggaatgtgatggatctcactgtagttttaatgtttgtctccctaatgactaataatgttgaacatttttttcatatggttattgcccattttttaatcttctttggagaaatatgtattaaaattcttcactcactcacttttttttttttttttttttttgagatggagtcttgctctgtcacccaggttagagaccatcagtgcgatcttggctcactacaacctctgcctcctgggttcaagtgattctcctgacccagcctccttctgtgattacaggcacgtgccaccatcacgcctgactaatttttgtatttttagtagagatggggtttcaccatgttggccaggctggtctcgaactcctgacctcaagtgatctgcctgcctcggcctcccaaagtgctgggattacaggcgtgaaccaccacacctgacctctttgctcactttttaattgggttgtctttttattgttgagttctaagtgatctcaatattttattagatatgtgatttgcaaatatttcctcccattttgtgttgtctttcactctatggtattattttatcccaataatgtagaattttctacatatagctttacatctttcagtagatgcattctgatttgatatttttatgttaccagacatggtatttttatattacttgtatatagaaatgcatttgatttcttagtgaggaacctcaataaaaaatcatatattaaaattaataatctggtacattcctttcaatttactatccacacttacacaataatagttttatctagtctattcaaatcctttaactttactaaaaaggcatgcatgtgtgtatgcatgaattcacgtgtatatgcacgtatacattttgcattcacgcatttaccaagaccacaaatacaacactgaatacaagtggtgatactgggcatccttgtctttatctcaaaaggaaccactgctactaagtgtgatattagttgtaagcgtttgctagatatttttatatcataataagaaagcacacttctataagaatgtttataataaagggtttttttgttgtccattacttaaatagttacataattacttagagtgtctttttcttgcgcttctcatctttgctaagttgtatttttctagaaattttattcaaaattctatgtttttagaaaagtaatttctaacatcctctcaacatccttttagtatcatcagggtttatagtgatttaactgacattagctttccttgaatcctctattttttttacttggcaagttgcatcactgtcactttcatcagtttatttaaaaaaaaaagccagttgtggttttgttgatcccctctgttgtatgcagtacaatatatgatataatattttccattatattaccttctgatatttattatttctcttcttttgtatttgagatatatgtgctgggtccttcctaacttgttgagatagatacttatattatttttctgcctttttctctacatatatatatatatgtgtgtaaattacaggtttcacttgtaatactggctttcattttcaaacagcattttaatttgtattcatttctaaatattttcaagttgtgttttaagaaattccaaaaatataaatatctatgttttaaatgtcctaatatctgaagattttctacctcatattaatttgtacacaaagcacttactctatgtaatctcaatcctctgaatgtattgaaacttgccttatgattcagcatctggtcattttttatgaatgctctatatgtacttaaaattatattgtaaaattatatacataaattaccttaaatgtgttgatcttgtggtttattcaaatattagaagatgcatgttgtcatatcccaccatgatttgggattcatctttctttccctataagctacatcatttttccttgttatgcatattagccattaatatataaacatttgaaatattcatagtcttttgttcaacagatactattatgaagttgttccattttatctctaaaactactatttttttttttttggagatggagtctcgctctgtcgcccaggctggagtgcagtggcgtaatctgggctcactgcaagctccgcctcccgggttcacgccattctcctgctttagcctcccgagtagctgggactataggcgcccgccaccacgcccggctaattttttttgtgtatttttagtagagacggggtttcaccgtgttagccaggatggtctggatctcctgccctcgtgatctgtctgccttggctccctttcaaagtgctgggattacaggcctgagccaccgcacctggcctctaagaccacttttctttctaagtaggttttgtttgaaattaatagaaccataccagtattttcattgttttttctcaatacaataacaaataattttagtggaaagtattacatgttaaagtaaattctcgggctgtaaactcactagtggaagctaccagctcttccaaggaaagtcaacgaatgctttgactggagtgaatacatattctaaacagagaaaataccatattcaacaacatagatggtagtatattctatgtggctgaagtctgaggttcattgtggaaatagatataacccaacattggaaactagaatttcagacgcgatttgagagacttgataatggaaagacttcggtaactggcaatttgaagataaggcaaagaagattttgggcaaccgggtgatgatatccttcactaaaacaaaccaatatgaggaagtagtagaggaatataaagtaaaatgtaaatgtattgagtttgaaaacgctatagctttttctgggtacatagttctgaaatctgtacatgtaaatctgtggctcaggagaattttacaaattagaggtacacatttggaatttattagtactttagtgatagaagaaacatgggagaaaagaaggacacagaattaataaccaataatagatacacaggcaatcaatgaaatttcaaaaatagaattttttttacaaggagtagtatgtttaacttttatttttatgaactttacaagttaacaacaacaaaaatccagaaacgtttgagttggcttttttttttaaattatgattatacttataagttctgggatacatgtgcagaactggcaggtttgttacataggtatacatgtgccatggtggtttgctgcacccatcaacccatcatctacattaggtatttctcctaatgctatccctcccatagtcccccaaaccctgacaggccccagtgtgtgatgttcgcctccctgcgttggtgtattctcattgttcagttcccacctatgagtgagaatatgcagtgtttggttttcttttcctgtgttagtttgctgagaatgatgatttccagcttcatccatgtccctgcaaatgacatgaactcattcttttttatggctgcatagtattccatggtgtatatgtaccacattttctttatccagtctatcattgatgggcatttgggttggttccaagtctttgctatcgtgaacagtgctgcaataaacatacatgagcatgtgtctttatagtagaatgatttataatcctttgggtatatacctagtaatgcaattgttgggtcaaatggtatttccggttctagatctttgaggaatagccacactgtcttcaacaatggttgaactaatttagactcccaccaacagtgtttttaatattcgccattctaactagtgtgaaatggtatctcattgtggttttgatttgcatttctctaatgaccagtgatgatgagctttttccatacatttgttggctgcataaatgtcttcttttgagaagtgtctgttcaaattaaattagtaaaattggctgagaaacttaaggaagagacgtgcaaggaaggagcatgtatgatggggaccaagaacaagattgtcagcaagatggaatgttcttcagcgcattccaagagcatgtaaaaagaaatgtgaccttcactttcacctttcgtagagaaatgtatgcagaatactcaaattagaagcatcatgtattcagtaataaatggtaatttatagaaatataattgtaattgaatgtatgattttcttttttgtaattttgataaagaaaggaagaaaagggtactattcataccttttgagaatgaggatatgggttaaggaaaggtagctcttgtttaggaacatgttatgctaaaactttgaggtcatcagagagcctgagccatattctttatcaaccttaaaaaaaaacctggcagatttacaaaaaacatggtatgttccttccttcatctcaaatatgtaacacaagacttttatacctagaccttagtgtttccacttagacacacctgttataaatatcaactctttccttcctctactagcttcttttgaccaagatatgtaattcaaatgacatatctgtgggattaaattcaactactattgctaaaatctcaaggttttgcttttttattgttgttatgcatactcattatactggcatagagagacctaaaatcaattatactgttactatccttctttagtgtcttcctttctaataattaataggcataactgtacttctatgtcataccaattactccaaatgatgtgtatttttacattcttatttatataatttatcttgtcctttcagttatgctttttgggatactctgttcccacatagccttaccttctctctacatccccctgcaatggctcatgagccataggctctcagacagtgtttataaaatatgtatgaatgataaaaatgcattcataaataaaacaattttatataaatgtaaagtcacatgccaaatgcatatttcagatcctttggagggaggtagccatgttatgagtccaagagggctggaaccaaaatgtcaagagtctgtgttctgactttactgctttttagatgtattcatttggataatttgcctaaccttcagttttcttatatataaacagaagatcttaatgcctagatctaattacctagctcaggaatgttataaggattaaataagttgttcctatgaaggcacctaggtcagcgcttgtactcaagtgagggcttaatattagataatcctggacttcatgggccatctgacctccctaagggcccatttctctggtaccataaatcatgacctagttcttgacactacctgttcacaatccacaccctcttccttttccaaaggcatgacctttaactgtcatgttaagacagaagaagaaatgaaaacactcctttggcaccccatagtccaaatcttacttcttcatagcaaaaactcagtctatacacacacacacacacacacacacacacacacacacacaatttatactgactgtataaatttccctccaaaaaattaaaggtgggttcgatgatttctatttgactctctataaggtcttgaatttttatccaagaagaaaatatgcaggctaattgatccgataaatctatacattgtagcctctctactccttatagaaacagtgacattaaataacctacacctcctatatcctaacttgtatatgttctacataatgcatctgagtgggcagcatcttgatgacgtcattctatttgtaagacttttacatatacttcttcaacttaacagcgtttctttaagcctaggaattttcttgcatgaatacttattaccaccattttcgataggaattttaactcacttgaggagatttaattcaaccttccaaatgatcacacttcccaaacaagtcataatcaacgatatatcgtcaaggagattcgtgcaattatctacaagtcttctaattggaaatacacattttacctttcctttggagggaaatgagtcgttttagagtagagtggctgcaattgaggcaaacaatttaagtaaaaacaaatgggttttataaaccttgcatgtagatgttgaggactgcatatattgttaccaattttgttagttattttactctgcaagactgagtttgagaatttaatgaccagtgatacattttccacagtgagcttacagaacttacctcaatttagttcaaatatctctaatttatatttgcataaggtttctatttcaatacccataacctttgctattgtagcaatgtcttctctaatgacataagtgaacactacctaaattctgcttggaagaaaaatgctactgtcacaaatactttgtgaaatatacatatacataaatatatcttcaagtatatgtatgttgaataaaagagtaaaagagtaaacaaattaatgaagaacagaaaaagaatataaatctcctagcctggtatgcttgataattagtaagtgctagataaatactattaatataatccacatcataatctaattcatcacacagcttttatgtgagccctccagcaattttaataataccaacaattttacaactaaaaatatgtgcttgagtatatcatttgcatgtagttctaatgctgccctggaatattatctacacatcagaaatcaatagaaagcattttcttgaatctcatttccataatcaacaagctaattcaaatccatgtagagcaaataagtgatttcgattgaaacatttttaatgtcttcaaaaaagtggactgataaaatactttaaacatgaaaagtaacttaattattaaaaattataattataaaaatagttaaccagaagaaaaaactcaaaattcagatatttttaaagcactatagtttatcatgtctctactttttcttgtgcaatttttataacatgaaatagattgtgtggctgttgtttcaatgcaatggggaaacaaaatagccttaaatgctgtggactatgctaaatatgaacttattttcaaggaaaaattcagtaattctgactactttttttgttaagctgcttcctagaagtgaaatgaaggcttcggtcccaccagagaggcaagtagcacaaagaagttttcctttctctttcttccagcaaaatgactcagactatgaaattaaaatttggaaaacatcaccctattaaatttccctctctttatcaccatcgtggcagggcaaatgaatgttcccttcagctgtgttcccatgatttttatccatttacatattgcaattcctcaaaaaaaaatttaactatttcattcccttgtacaaactttctgaagattctgaactcaagagcagaaagtgccttattgctcatgatccttgtcacagtctagataatcttgtagactctagccctttgcctacctttctggcctcaattttgttttcctcactgtactctagctacacaggacatatttcagtttctaaagtgtgttccctgaccccatcacagtgcttttcatatagtatatagtaaggtagctaaatgctagaatagctctcccagttgttgtctctagaacaagagaacaactgaaatcacagtataataggctttaataataaacacattaaataaaatggtagcccttcttatttaaaacaatgtcatcttcattgcttgggatggggaaaaaaagaactcaattaactttgcaaatgaaataagattttatatgagtactctagtatgagaaaccaagtttcctcaggaaacccaagagaaaatctgcaatgcttaaaaaagtttacttcagtttgcccaagagaatgaaattatgaaagaacaaataaagacagcttgatctagaagaagaaaaagattattcttaagaggtatgttgtgatcttaaagggtaagctaagcacatataaaataaaagagacgacatgctcaggtcaaactttttagaagggtttcagaaaaaaagagaagaggttttaatcattactagattggaaagttacttgtgcccaataaatataaccaaagaaaggagacagtctcagagactcaactcttttggagaaaacatatctaaaaatctatcaggggaacaaatctgcagatagagtaattagcacaatgaggaaccacctcttcagtacttagataatcagaccacatggcatctgaacttctgtaattgagaggaaaattgccaaaaagatcaatatagaattcttaaaattgtttcacgtaaatattgtgagtcgatattcactaaattggcataatttataacaaattgggatatgagtgttgcttagccattagggattctgagaagttggatgagaagtgaaataaggcatagaaaagatgaaacacagtaaacaagaacccagcaggcaataatatactgaatccagagctagctcacacgctctgtaggaatgtccatcttgggtcacagttttttacttcagggtgtgaagatagacaagatgtgcttgaaaagttttttttttttttttttggcagatgcagtactcatttattttttaactgtcataagacaaaatatagacaagtatatgaattcctggactgcaaagcaaagttgaataaaaaggaaacagtacattctgaatctgcaaacagtagtagccctgtaggtgttaggaaacgtttaacatgttaaacagttaaaaattcacctgagcctcctagaaatgtggaaggaaacaatagcaggaaatagaatactggggtcatgctccactgctggagagaaatgtattgtagaaataaagaagtttctgatgtccctaaaagaatacaagtttttcaaagcctggaaaagagggaagaagcactctgagcaggagccactgacagaggtattgggcttagcagaccacctggggatgcacatttcaggactatcaacagcttctgttcaggctcatgatttccgatatgaaataaatatggggctaaaagaggaaccctcccaagaaaacatgttgcacaggtttcagcatctccatttctagagttcatggcagcaactcgtgcagcacagaactttatatatctgctcacaatagagtgtgtgagccatgctacaagacagaatccacattcgttacaaaactggggctgaaaattaaattgctttgaatatactatttggggaaaaatggtgcctcagattatacctggtgactgaatcttttttgttttttttttttttttttctccctgagatggagtttcactcttttcgcccaggctggagttcaatggcaccatctcagctcactgcaaccttcgtctcgcaggttcacacaattctcctgcctcagcctcctgagtagctgggattacaggtacccaccaccacacctggctaatttttttgtgtgtatttttagtagagacagggtttcaccattttggccgggctggtctcaaactactgacctcaggtgatctacctgcctcggcctcccaaagtgctgggattagagacgtgagccactgcacctggcctgagtctaccatttttacaaatttctaaacttagcagtatggccggaatgtttcaaaaacactctttgagaaaggaatgtataaacaggtggatttcctctgagtcactgtccatgcaatgttgtgattaagcttatgacagaagaattagatcacgtggagatcacagctcttggaatccagaaaaatggcatgaactgaatggcatctcagcaagggtggtccaagcaagattttcctgggatatattctttccatcattcatcagtgaatcactggttcactgctgtaaaatagtgggttgctgtgttttctgaacttggtgcatataaagatagtatggtaataatcttctatgtcttattacttttatttactttttattacttctatgtcctctgtactttttaaacagtgggatcctacactaaaatctttgcatatttgcatgaatgttcacaccagaattgttcttaataacaaaaataagaagggacaatgatccatagaagtgtttaataaattgtgccatattctatcaatgagctattgctacgtgcattaacatggacagttcagaaaccaagatcaaaataaagacgaaaaaagatctgtcaattgtgattcaacttattttgaaaacagaaaaataaacaacacatcgtaagggatacatacttaaataattataacgacagaaaagcaggatggtgtttacctcaatgaggaggagtactgctgaggtactgaaggaactacaaccaatttcaatgactgatagctgctgaagtcacccacactacttgggaatcagagcagttagctgtctggctgagcaaataaaaaaattatttcaggctttcgtttctttggcctttaacttacgaattttggcctttgatttgactggatttttacacagcaaagtgatttcatttggagatttatgtcaacctctggaaatgtaataatggaagagttatagtgtccacatttggttctttcagtatcagtgacattatattattgtctgcatactgatattcatttattgtgtactactgtaatctacatttgacaacatggctggtgataatttgaggtgggaaaaatcaatagtgtggcaaaacccaataggctaacagaaccaatacctgcaggatgtggagtataatctcccttcttcttctttcctctggtttttgtgagtgtctccattagaacaatccacctgatcttctctttactcctctgattctaaagtttggcagaagaccctgagcacatccacttcagccccctcttgactcctgcctctctccatgcctctcagtttcaaatctcagtcaatttctatgctgtcatgtgatgatcagggagggccaactctgccctgtttgggaggcatttggttgttcagctgcaccaattatcaggttggtaagttggcttaactcagtggtagggtattaagcctttttgcccatgcctttataaccacgttttccaatcatctctataataaaactatttgacctccatttgtctgtctcctgagtcttaattctgaattgattccaggctcaggaggggaagaacagggaattatttattgatcccctaaaccctaagagcagtgattataataaaacactggatgacattatcagatatttattattatcagatcaatcattgtttaacagtcttaattcctttcatgactccataacaagacaatattctatagacaatccacagaatgtacacaccacagggtcagtaaaagaggaatgcctttttaataataaatcattttttgtgtgttccaatattttcaaggaaggaaggcctcaggaagagatttatattaagagtctgacagttcatttggaaacctcataaggcaaaagttaggagtatagttattagaacaactctcaggttagtcacgcttcctgtctctttcctcccctcatccattaaaaagaggaggaagaaagaaaataagtttcataagttgaagttggatttagctaaggtcacttgaaataaccagcagtattttttcactgcctatataaaataatagaagatgctcatatgttgactgatgtgtgtggaactacttgcacagccttcataacaaagagctctggggttttgaagatgggtattttaattgaaaacaactacgaaaaataaacttttatatgattaatgtaaagcagttttacttaacattacacaattactaatacaaattgtaaaagttttgccaatatgctaaatcctttattcctctctctagcgcatatcctaaatgcaatcaaaggtgatgattagatgttttaaatttattctagcaattatatactttatgtaactattattgaaatgctcaaaaataaaataatgtgaatggcaatcacagattttaaaaactgtctttgctttagttatcaagccatccaaaaaaaaagagctggaaatagagattaaacatctaatctatagcaccattacagagaaattatagactccctcagcttatatacaaaccatgatgcctctaccccacattctctttgatgagaaaacatgatccaaaacttctcctccctttgtttaacccagttctgcaccaagacttctacttacctcaccataaccaatctcagtaagagttctttaaagcaaagggtgagcccaacagattcacattaaattgtaatgtgaaactctaacttcctacagaggtttgcactaggggtgtgggtatgtgtgtgtgtgcatagtttcttctgcagcttaccctttaacaaaacataagaaatcttaaataagtgaaacattttcaatcactaacaagatatcttgaggaaggacaactatgaactccagggactcagggcttaatgggaacttttctatttaatctctaaattttatttcccctcccctaattcctgaagtctatatgcttcctccaaaggcccaaggttctgccctattccatttctgtgtaggacatgaaatggaggtgctcagggcagaacaagattaatgagcagccagttggcttcacatgtcgcaatcattaaagtgcattaaatcatcactggagaaagaaatcaaatacagtgcctaattttgattttccaatgcaacttacacgacttcagaatgttcgtggcctctcctgccacagcagacaggttcttgaatgaagattctaaacatgcacactcttatccacacaataaaacaaacagaaaattgctcctaggtgctatttttaaatctccactaagtattgaacttaaaaaaaatatttttacaagagtatcccattattagacttcctaggattactataagtcccctgcaagatgactttagttccaggcttatttattcatttatttttaaatcactgctcaaagcttggagacactaagaattaactccaacaagtggatatgaagtccaacttcaccactgactgggttttgaactccagaaaaattaatgcaacattagaacctgagttaactcatctctacaatgggaataataatgagaataatgactaccttttataaattgaattatgtcaccctcaaaaaaggtgtgtctgaagtcctaaccaccagtacctcagaatgtgactttctttggaaagagaaactttaacagaggaaatcaaattaaaatgaggtcatgttgaagtgggatggaccacttatccaacataactagcgtccttttaaaaagaataacgtgaagaagagacacacggtacaaacatcatgtgaagatgaagacagagattggaatgatatatctactagtcaaggagtgccaaagattgccagcacaccatcagagctaggagggggcgtgtctcatctccagagctatgaaataatcaatgtctgttgtttaagctgctcagtttgtactactttgcaatagcaggctcagaaaactgacacactactcaaaaaggtgattgtgaggtttaaataaagtgatatataaagcatgtcacacaggataagctcttaataaattaatattaaaaatagtaacagtggtgggatattttgaaacataaccatttggtagattatacaacaactatattcgatttattcttcatttctatttttaggaatttaaataagaaaatattccagtggtaagtcaggagacaatgaaggaattataaaggagataaatttcttaccagtcagtgtgtgctaattgtttcaatcccctgtaaatggtttggcacgagaggaggttggaacacttagctaaattgaagtttggggattatctgtgaatttaaagtatctatgccattttggcccctattagcacaagtaattgagaggaaaatcttgccagttatgcttttccataaggcttaatgtggacttcgatatttaagtaattcattagcaggcttaaatggtatcatggaacaacattaaagtacgtaagagatagtctgtgaccttcattttagagatgaacaaattgagacccatagaggttataatgaactcaaggtttattataacagtttacagtggaaaagctgacactggaatccttgtgtactagtttcttgtaaaaatggagtgtgcctttcaaaattctgtgagtttgatttttagaatcccgtggagctttttaaattatcagaactccaaattctgcacatggaactttaagatcgaggttgagggaactcagatccagggagaagaaaatgacattaacattttcagtaaagaaacctcaaaagtttcatttggggaaggagatgcagtggggacggagggcaagtatttttacactaaaattatcagctgtatacaattttagaaaaatcgttttacattgtttagaagatccattaaatatggcctggcacgacctttctaggacaagtcattaaagccctaaatggtatttggaaatgctgctacctcagattgaggtcatttgcattatataataaaacacacagcatactttgcttggcaagttcactggaatggctgaactttggccccttgcatgattttgcaaatacagagtgtacttgttctctacttaacaactaaccccacttaaattaaaacaagctgcccccttttcacctctggtgtgctctgcttttaagtatgcattgtgagaagaaatgttagacttttaatacaacaaactttgtttcattgcattagttttttcactttggtttattattttatattttcagtttttataggacatttccatgtggtctttccccaaggacatcactactgtaattgaggggcccagtacagaatctattccagaaagaatcattcagtttcattttgtagcttcatagcccagaaccaaaacgtttcaaaaaacactcaataacaccaatacagggacccctctggacaacatatcaatttgtgttatgaagtgaattatagctggacccgccagagctggtatagttaagtgtctgtcagtgtttccattatactttgagggctttgttcttggttgcaaaaatacccttcaggctaaagcacgcaaggctaatgtggggagtgactgttccctttgtttattttttaccatttaaaaacactagctctcttgtgtgtttgcttgttatacattttaaaataaagaaattttggttttataaatcaacagtctgccagagtgatggtggttttaatggggtgagcttagggtatgaaagttcacaagagttggtgtgatccacattgtgcatcctggaggttatcaaagcctcaaaaaggaaggtccaatgtgtcgcagatgctctctgaaaattacaggtgtaattattgggcctctaaattttaaattcagaggtcaccatttatatcttggatggaatatgactgcattatgtttagggtttagctttgtcttccctttttcatgcccctatccttacattgaatccatgcaaattcttcccttaagaacctagctcaaatttcctattttctaagaaaactcggatttcctcaaatagactcagatgttcttcccataagcttacttagatcccctagatccaatatagcaattattatattataccatttgtctgtgtgtctttttcttcaccaggctggatgatctgaggaaaagaactacttattagcagaatgctagacatattaaatattaaatatgctcagtaaaaactgattgcttgaatgaaaggatggagggatgaatggaaatgtgttctgtgaaacagaattaatgacaagggaactggaggaatgaaagagtctttgaaaaacagggactatctttaatatgacttcctggttctagttttcaatcttccagagggtacaaattcttacacgccccgtaatgaagaacctcccaggaaactggatgacttgtaaacttttactggaagaaataaatgcaatgggatttgttgagaaaactactgttcaaggagcaaggagatgaaatgtttattctgacttagtcactgactcggtgaccctcttcaagttacttaacagctcagtgattccatctctctgcaaatggtgataaataatagcagttcttgacggcttcacaagaatatttggcaaaaaatgcattagcatctttgagacattttattaacaaacaaactatatatattacacaatattatactgatattacatgctatgtactaaataatttatttttaagggcactatattgttgaaattacattaacctaatcacaaagtataattggaaggtttgtttcttctacttgttacaggcagttggactatattctaaaaagaaagtttatgtaaagtagattgttcaattgtttctgcatttagcatgtgaggacagcctatgtgattggtatgctgaataagctgtcacgttctacctgaatcaccaaacacatcttcaataaaaggtgctaaggagaattaccaatgcttttagaagaaaatgatggaggaaattattttttttaatcacaggtttgcaaagcaggttagactttaaggacttgaaagcttccagtgtttatcaaaggataatttgcgaatcagctgctttgatgtaacctggaatattgtactgcagagccacagaccccattctggatttaaggaataagaaattttggggagatatacaagaatctgcatattaaacaagatctccagatgattcctataatcactcaggtttgagaaccccagtgagatcttgcatcttttggttcaggaggcaaatgaaaagagtacagactgcagaagatcaggagaaggaaattgaacttcccagtgtaccaaggggtgataaatgatcatctccctttaaaatcactgagtatgctaccttttgtagaatttgagaaggaattagaaattgttttaagggtaaaaattgggaaaaaattgtactaaaaagacaggaaaaaggaattgacagcttcagtttgttgtctgttaccacggtttaagggtagattgtatttttggaagaataaggcagagctcctcaaactcttcctcattctttcttcctcaggcctttggaggcaagctgatctgcttaaggttcacaatcagttttatatttttctaaaggtttgtgcttccagcaactatgaagaaaaattgggtaaaataacaaatatagtacagttattataatccttcgctactgttacttgatacagcttggttgctttgtttctattagtaaggtagcatttacacacgtggaaatttaagcaattgtataaaagaatacaaaggcaaacgaaaaacacctgaggttctgatacagcataggaattactgctctcattttggtaaaaattcatttagacttacttactcattgtcaaatattattcaatttatataaaattatacctgtaattacatttacatattttacatatataaacataaaacatataattttatattttaaaacattttatggtttgcttttccatgtcaatgatgcttttaataattatataatcatgaataccgttcttatcaagtagaaaataattagaccgaggttagagctgctgtcagctgttttatctccttcaattcttatattgaagaaatgcattccctctcataaacctttatattcctcttatttttagattgaggatatctggaaaactccctccttctttcaacacctctctgttctaatatcgacctcaagccactttagaaaaaaatattctgacgaacgacagagatgaacataaattctaactctgagtcttctggagcaccagagggttatgtgagattcattagcttctaaataagacaaagtctatggtttctctctcagtatttgcctcttgtgatgactttgatccacacttcctggagagtgcttgctagaacactagttcctttggattcaaaagagagctacacaagtttaacattgtaacatttattcagttttaacaatggtttacgttcattgtattggttactttattgaattcttacaaccaccatataaggtaaaagccatttctatctatataggaataagtgggaaactgagcctcaaagagggtaagcagaaggtccacacaacttattcaagtggagcagatagggggtgggggttggaggaatggggaacaactgtttagtggatacagagttttcctttggggtaatgaaaatgttttggaactggatagagtttgtgaatacattgtgaatgtactaactgccactgcattgttcactttaacatggttatttttatggtatatgaattttacctcaataaaaaaattagtagagcaagcaattaaaccctgtcagattccagagaccacagtcttaaagattacaaaatactgcctcccatgtggttaagctagctccacatttttctagactgaacattagtgactttctactgcagaagttttcaatgtctttgttgtgctgaaaaacatgctagtcgttttcaaattactttttctgtgaagctcattttacctggaaagtttccacaagaatgtgtttcataaaatacttttatagaatcactgttttcttcaaaccaatgaaaagaatgtttattacagaattattttatcttagatggtctacttagtatgacagcaaaagttcacaggaattcaggccctataacaaagattgggcagtttaccgagattccctttatgaccattccttagcagttgttcataatataaagagtaaaagtgcaaaggatactaatcaattttatcttttattctctgcttgaaaacatttaatatttactcttcggttaagtttcatgcaaatagtagctctgctacatgcacataaatctatttaaatatcatgataaaagacaaaagatgtaaggaagtatacattggcatctgcaatttttaacacagcagcttctgggcttaaataagtctttcataagcaactgaaaacactaattttatgaatttgaaaaaacaaatggatgtttaatgtaaattttcagtatcatttttgttcagttattttctcaatagggaagacaacgatttcagaaaaagttaaaacacttggaaattcagagcaataatttattataacataattatctcttatttgatcaaaataacttataacccaatcttcctattctctttttaatatattagccactagaatttcatagaaaggatgtggggtttgggattagctaaaactcagtttgcctgtcacatattatgcattctattattcagtttctcatataaatataagaaaggatatgcctatcttataaaatcttcatcatgaattcataagccatccttccaaaaatatgtatatacttttaaccatcttactcatcataactaagaattttgactctgctaatttttaccagcctgccattattgacttcacttccttctttgcacattgtggagcccaagtgaagccatttcctggggggttcctagaacccccgaatctctgatctaagtcataattattaccaacttatcagtgcttacatttggatagttccactgccatatctgccggtgagcctctcgtgttgctggggaaaagtccccaaataatactgattgggtgtattgcaaacacatcctaacacctgcgggctgtatttgaactgctcagttcacatctcaagagtaaaaatggcaaaaaaaaaaaaaaattgtattctcccttagcagacttttttttttattcctgaataaaaacatcacttatttccttataaaaaaacagacattattcaatgtagctctcttacttccattcgcttggcttttgtatatttttattgatgtttacttttaaggcagtttttattttatgaaagcaacacaaacccatgtaccttctcatatgtgaagactgctatatgcccacctgtgatggtggctgatgaggggtagggatgggtaggagaaggtcaaacctcagccagctctgccacattaggcaacactatagaagtgccctcaagaagtaatctgaagaatcaccaaatgattgtgagagaggcagcgtgtgagttccaggttctcagaaagtacataaagccaaagatagaacagtggctacaaccaacaaaggagagacagcacttgccaaggagagttacatatggaaggactgtgtccctccttcctcccttgccccaaccaagacagacagcagggaagcagaaaaagacatgagaaagcaaggacgctccagaacctcttaccattccctcatcgccacccacccccaacccccatcccactactcccaccccccatatattcagagcaactggaacatcaagtctctcttgtgtacaggcaaggggaagatctctgaatcaaatatgaggttgaagatttaaaataatcaaaactaattcttaataataaaaataagacactttaataacaaaaagtgactgaaaagctatagaattgtcaaatgtgattaaggtagcaagtatgttacccagcaagaaaggaatgctgtcagagaatggaaggtggtgtttaaagaaaaaaagttgtatcattttataccctcaagatttcagactttttatcaaaccaattttgatgatttccgtagtaaaataattttcaaaaataacttattccttaatttctatctttgagcaagcaggtccctagctcctttttcacagtaaatctattcctagcctgatgcccctgagatcctatagtaatacacatatggtctagcctgtgttcagtcagtctgtactggtaatgattacattggttattaaaatattaaactactatgtaccattggtaaactggcactgactgccgcaaaccccagcccctagtgctctggtagtcttggtcgctcctcaagaagtccccacaacccagtaattaaagtgttaatgctagtacagctgaggagcctcccagtccctgctctactgagtggagttctgtttggttagcaccagtaccttattagttttaaattttgagtataaactcagtctgtaatgtagaattcagaaaatgatgcaaacatcttcaaatagtcaaggtctgtcttttttttttttttttttttgagatggagtctcactctgtcacccaggctgaagtgtagtgacgcgatctcagctcactgcaacctctacctcccaggttcaagcaattctcttgcctcagcctcccaagtagctgagattacaggtgcccaccaatacgcccaactaactttttttatttttagtagagacggggtttcaccatgttggccaggctggtctcaaactcctcaccttgtgattcccctgcctcgggctcccaaagtgctgagattacaggcatgggccactgtgcccggccaaggtctgtctgaaatgataaattgtttcctttgccactggatctcctctgtaaacaaatatgctctattctttctataatttcaaatatatctttctttccttctcctctaacctggtgttgtacattttgctcatgttaaacttccagtattgcctgcttaactagattgccaagattgtctatcactagacattcaagataatggattttccctctgaagtttctcatagtgtcttgagaaggatctcgttacaaagtggatatcgctaccctatttctgtgtgtaatctgagttctagattgtagcctcagcaagcttttcctgtctccccgggtctatgccacatatcaaaaatacatctactttttttttgttactgaaaacattcatacatcttactgaaaccactcaaatgctggtagtatttaaggtgtatgataagtgagaaaaccttagtgttttatgtaagacaaagtccaggaaatagaagagtatttatttacatacagtaaaatttttgagggtaaaacattattctgaatttcaaggagacacaagggcttgatatttttgccctccaagacctgctccaataccttcttaactgtcacatgttcataacctttatttctatcctttattgcttctcaggacttcggacttatatgtacagcctcctgattgtctgtctggactttgagagatctcttcttccccatcatctttactcagctatcatacacacacacacacacacacacacacacacacacacacacacacacacacacacatatatatatatattccagcactgttcatacgtgtactcaaaactcagcagtttacaaataatctgatgaggaaataggcaaactacatgaagatttcactgaagaagatagacagatggtgagtaaccacatgaaaagacgttcaacatcaatagccattagagaaatgcaaattaaaaatattaattcaatgagatatcagtatatacctatcagaatggctaaaataagaacgatcaacaccaccaaatgctggcagggatacagagaaatgagctaactcatacatcactgctaggaatataaaatggtacagctacactgaaaaacagttgggcagtttcttataagactaaacatgtaactgccatacaatctagcaactgtagtcttgggcatttattccagataaaggaagacatattcatataaaaacacgtatacaaatgcttatacattagtgtaacagacaaaaactggaatcagcccaggtgtctttcaacagataaaaagttaaactgtagcacatacatacaatggaatgctgatcaaaaataaaaatgaacaaactattgatacatgcaacaacttgggtgaatctccaaaaattaggctaagcaaaaacccaatcccaaaaggtatgattccatttatatatcatgtttaaaatgacaacattttagaaatggaagacagagtagtgttgccaggaagtattgtttaggaagagggttggggtggaaaaatggagggaggtgagtgtagttataaaaaggcaacctgtcaaatgctcgtagtgttggaactattcaatgtcttgactgtggggtaggatacttaaacttacaaggtgatagcattttatagaacataatgaagacaaacatgattacaatgggcatggggtaaatctgaacaatattgggggtttatctcaatttcaatatgctggttgtgatattatactatagttttccaaaatgttgccattagggaaaacttggcaatgtgtacagactctcttatgttttatagctgcatatgaatgtaaaattatctcaataaaaatttcgatgaaattaaaaaaaaactattcattatcattccatcaaattgtctccccttccccccactctgtatttctacataaactgaacagaattagtcccaattgcctacatcaaaatctgcgaattattccatgctccacctctttcctctttattttgatcatgtttgcaaaatataatattttaatattcattgctttgggatattggtctgcttgggctggcttaacaaaataccaaagactgaatgacttaaacataaatttattttctaattctggaggagagaaagtccaagatcaagtgtggcagcaccacctccataactgtaggccagtgtccgaatcccaaggctataggaaaccccacccttacatcactccaggacagtcctgccctcaaggctctgaacagaggttgtctgacctgttgaaactgtggcagtagccctgataacttccctcttggaagaatagtgaatgtttgcagccaaaaagccctattgtcctgtcaagtccaagaagtccaacagtctttcttcactttgtcccatctttgtcccttcagtaaaaactggcaggatttcagctggtataatcccaaaagctcttcttgaagtgacagtctagctacactcttggtgttctcttcagagtacgcttgctttttttgcaatataaacagactgaaaattttccaaatctttaggtttggttccttttatttttgtttaacagtttgttcttcaattcctctctctcctctgacattttaccatagcaatcaagagggactaagccaccctttcaacactttgctcagaaacctcctcagctaaacatctaattttattgctcataagttccacaaaacactagaacactattcagccaagttctttgctgccttataaaaaggattgattctcttccagtttacactgacatgatcctcatttctacataagacttcatcagaaccgcatatatttctttcatgcaactcagaactcttctagcctttattatcaagatgtgaagacacttccagattttttaggtattattcatagcagcaccctatttcttgatgtcaaagtttgtcttaatcagctgggttgccatagcaagataccatagaccaagtggcttaaacaaatgaaatttctttctcacatttctggaggctgggaagttcaataccaaggtgacaacaaggtagattttattctgaagctcttctcttggcttgttggtggttgccatcttgctgtgtgttcacatgatctctcctttgtgtgtaagcagagagggaaagagagagcgatctcttcctcttcttatacagcctccaattctatcaaattaggatcccacctttatgacctcacttaaccttaattacctcttcaaaaccctgtctttatagcagctgtgttagaagttattcaatggattcatcctacaaaatgtaaaacacatcaaagtttcaagaaaaaatagaaatcacacatatgcatacccatgacatagagataatcactgttaataatgatgggtgtgtttcttttcagtctttttctaagcattttcctgaaccctgtcccctaacaaaagcacatcaaatacatgactgagtacccatccatatgtatctgttttacatacataatatatatgtattaaaggggtatggtattataatattatttcacaatttgtcctgtttttaagaacagtcttctttaaaaaatcttcaaaattataattttagtaacagtaaaatatcccacattttatcaaaatttataaaaggttccttattattttgtttcccattatcatgttacaaataacaatatgataaacacatcattcataaatcttagctctgtaaaaataacctaactataatctacatctaccttcaagaacaaagtaaaagggttcagctccccactttccaatctgtacacttactgctactatcattgtttgacttcagacaacacattctttatttcactgtccttcttcttttttgataatttgcattaaaaagtttattaacccctaagtactttaattccttttgtcatgtcacagaaagaattgaaaattatatatttttaaatagacacaatcacattgaaatattatgcattcttgacgacctctcaccctcatgcctctatatatgactgatatttggccaattcctcattttttaaaatatatgaggtgtcaacccctccaagaagccagattgattaaaatttattttatatttgcacgacccccattccttgagcacctctccattgtagcatattgtgttaaaattaatgtatttacatgtctcttcccatctaagattataactcttatgaaggcaaataatgtatctgtttcttctttgtacccttagcacctaatgccatatgacacataattatttattaatgagagttgaaacaaacatttgaactaaaatattatgggcatgctatggaggtataattttttctaatctatctacattttataatgcggtgttccatctttgatcatactaacaaaacctaaaattaaatcaaatgcattcaaaatatgcttgtgcaacatgaagaccccttatgtatgacacacaaatctttaaaaaataaatgaaattttgaaaagaagttcgcaaaaaccgttgcccccacttcaaagaaaagagtgcccacctaaaaagataaagacaaatattatcacatgtgcttacataactcaaaacttacaagtgtatattagaatcattcctcttctattaataggatgattgagattattattaagaagtttaaaacaaaatccagctgattacagaaatggaaaaaagtaaaatcatatttattatatgtttattacataacagatataagaaacactttaggctaattgtatcattttaatgcctccacaacccctgtgattattgttaataaattcattttatatcttaggtagcttctccaggattccacggatagcaagtgacagactcatacttcaaacccaggaaggtccaatttcaaagtcacgatccccccaactgcctcacagtgtaataacacctaggaaatgttctagttttcagttcattaccagaaatatcattttctggaatatcaggagaaaagagtggtaatgactaacagcaggctcgaggttgaagctgcacatccatgggaaactgagattatttgcattgtgctatgtttgattaagtccctgccaaatgtcatgccaaagccttgacacaacagagatttgtgcctggagccattcattccctgtctggcagtgcacgtcagctggcttattttctttggatattctaaagtcacattagtctctttacagatatggaaaatgaccaaaaaattatatgaaaaagagtggcaaaaaaaatatctgggagagttttcaattttattatctcagaaaattattaacatacgcatttataggaggctttcttcttccatatgagtaacactgcagaaaacatagagtatgttttgggccaaataaaaaatatgagtatgtacatataaccgtatttccccaagcattacgtttgcatgagatagaacaggcatcaattactaatgatagtatatatgcctacatttttctgataacctcaaaccaaggatgcccaacttttatttcaatgtaaaattactctaatacagggaaaaataaagaacagtgactcatcaagtcatgtgtggggctggaagaaccttgaataggatagctgatgtagagaagttttagagaaacccttgtcagacattgtgaatctattcaatatttaaatatatctacaaaaatgataactaaccttctcccactacctaatcctgaagcttacgtaaattcttttattcgtttatttatttttgagacggagtctcgctctgtcgcccaggctggagtgcagtggcatgatctcggctcactgcaagcttcacctcctgggttcacgccattctcctgccactgcctcctgagtagctgggactacaggcacccaccaccacccctggctaattttttttttatttttagtagagacggggtttcaccgtgttagccaggatggtctcgatctcctgacctcgtgatccgcccgcctcagcctcccaaagtgctgggattacaggcgtgagccaccgcgcccagcccgtaaattctttatatgttagttcaagcaatttttctcttgttaatttctctttagagaagccgtgataattaatagctcctgtatgtgatatttattttgtcagttgtcatcctccttcacgactgtcctcaggaatcttagttcccttactcagtactcacaggttttcctctatgtaacgtttattcatcttatacattttcttttcaactctcttttataactcagttatagctcatgatcttttcaataatctttaataacatcttttttcatgatagcattccagtttgaaataacaggcattgtgtattaaccttgaactatcccccctatctttcatgtagtacgtttatatactgtttactgagctgttaatgtgtttattttcctaattccttcctctttttaaattggttttaattctaaatgtatttctctatttgttcccccaaaacctagatacttttaggtagttcttgcctgataatttaatttacatatgtcctatttcaataatttcatcttcagagtcattaaagacatgttaaacatctttcatcaacctttgaatagttccattatttaacttgcaagagcattagtgttaacagttcttttaatatagattttatggattaaggctttctgtacccaggcaatggtatatatttgatagccagaattctaattctgatgttttctcactattacatattaccagacaaaaagtgcatgtcccatgataccgtatttccaagcatgcaacagtaatataattattgtcataatatttttatacttcatttatggagaaattttaaaatatattttaaatatactcacctttgtccaaggcacattctgctgtggtctcaggacagaaacctaatataaaagaaagaatatttctattaatatacttagtaaatgcatagattgagaaataccaatatataaaactaaaataagaacaaattttaaaactccatcattgctcatattgtgtatcttcccattaatttcaaaaagatgtcttatcttttttttttaattaaagcacattaagacaaaaaagacagaatgcaaatactctgtaatacttcataatttgaacccaaaggacttctgttcctttatgtcttaaaataaactttccaggaaaaaattatagaaagaaagaacatatacagatatcaattttatgcaaaaaatcaaacatcgcttttcaaaaatgctacatgaattattagatttaaatcagaaagatgaagcaggttaaatagattttataataaaagcattataatgtttgttcatcaaaaagtggcagtgaagcactcattaaagttaacagagatagacttttatagtaataatgtttcaaaaactttcaggcagtgcatctagaatgaaggcacagataatagatttaaatatgttctaatgaacttgagtactttaaacatcaaaagagaaaatagaattgctgagttgaagcaccaaatttctattatttctagcttattattctatcagatgcagtgtcacatttctaaatatgttcagaaactcatctacctaaaggcacagattatctaaatctgagaactcacattgcaaatgtgataaatctaattataagaatttcaattaaatgtagaaggaaaaaatcactttgttcatatgttctggcattctatctgcctaaaatttccagaaaaaatctatttatcttgtgatctctaccactattttggagtaaaattttttgctatgaatgaaaaataacaccctaaaaaaatagaagtataagcaattttcttccatatttaatattctcaaactcaaagaatttcagttctagaagaaacctaactggaccatccagtaaactggattcagacttatgatttaagggattggttgttattgttatatgaagatgtctatggagctactgggtgatggaaggaaatcaggttactgtgtgttctagaatgctccgtaagctatcatcgaaacagcacaaaatacaagtgcatccatacatacaccatcacttagatcatataataattagcaacaggatgttgttgcttaaaatacatttatgcttgtggttttatacatatataaaatcccctaggccaacttctttatttgatggccaaaactagtctttttcacaccttctagattttatttgaatcttggttccttggatagctaatcagccaacgctgtagactacttacataccctctctgagacttgaattttcatgtacaatgaagcagttgtaaagattaaatgagtcattacaaataaattgcttagaacagtttttgggacatagtgactaataaatgttagctattaaaactattaacatttgaaaagtaaaatattaaataattttgatattttaaatatacttatgtcttattcataaatgatatttctactctaccacccgtcagtgtaaaaaccttagcttatgtttcatttcttctcttattatgttcaaattaattgagaaacacaagtatggatgataaactttattcatgaattttacatcagagaaatcaaagtaaaaatggcagtactttttttttggcagggacgaaatgaggcattttaaattcttcctaatagctataattttatgttctatgcttacatgcagtctggcatgactagagaaacagaaaacctccttaaatgacaaggaaacaaagttttccacaggtcacataagaatccaattgtctaatagccatgaaaacaaaagtatggggtaaagggattgcttaaacctctgaatagtcagcattactgccaggctatgatgaatttatcacagagaaacgtggtacgaacgtaatcagggttgagcttaaagagtaaacagacaaacttcagtttgtaacatgcacatctctctagccattaggaatagcttcggcattataatcggattaaggttacttgttctgatttttctgataggcacatacaccctaggatgggaataagttatagaacgaaggaaaggaggaggcatatttactatttaagattggtttaatttaactttaatataggctaatattaggaggaaataagacttcagaagacaaaaagaaaaaatgaacaaaataacaacaaggaaagaagaaaaataaaacgactatgagcttaataagaaaagttctgaaagtcaagcttacagggtggacgatatattttgtaaactacattttaaccagaagcccttttatacactggtggtgtcaagcttacagggtggacaagatattttgtaaactatgttttaaccagaagcccttttttttttttttttttttttttttgagatggagtctcactgtgtcacctaggctggagtgcagtggtgcaatctccgctcactgcaagctccgcctcccgggttcacaccattctcctgcctcagcctcccgagcagctgggactacaggtgcccgccaccacacccggctaattttttgtattttttagtagagacgaggtttcaccgtgttagccaggatgggctcgatctcctgacctcgtgatccgcttgccttggcctcccaaagtgctgggattacaggcttgagccaccgtgcccggccaccagaagcccttttatacacatgtgcagaacttgcaggtttgttacacaggtatatatgtgccatggtggtttgctgcacccatcaacccatcatctacattaggtatttctcctaatgctatccctcccctagccccccacccaccaacaggccccggtgtgtgatgttcccctccctgtgtccatgtgttctcattgttcaactcccacttacaagtgagaacatgtggtgtctggttttctgttcctgtattagttttctgagaatgacggtttccagcttcatccatgtccctgcaaaggacatgaactcattctttttatggctgcatagtattccatggtgtatatgtgccacattttctttatccagtctatcactgatgggcatttgggttggtcccaagtctttgctattgtgaacagtgctgcaataaacattcatgtgcatgtgactttatagtagaataatttataatccttggagtatatatccagtaatgagattgctgggtcaaatggtacttctagttctagatccttgaggaatcgccacactgtcttccacaatggttgaactaatttacactcacaccaaaagtgtaaaagcgttcctatttctccacatactttccagaatctgtagtttcctgactttttaatgattgccattcttacagcgtgagagaaattttatattacatcacaatttaacaagtaacaaccaaagtcacttttaagaaaaatacggtggtttaatcttactttttttaaaatttacaccaaaataacaactgaacttccataagcaaaactaagatacatttgtattggtattagttatataaagatgcaatatgttcagtgccttgaaataaaactaatccttgaacacagtattattttttgtcaccatttaatgtaatctaaagtgaaattttccactattctcattctgcttgttttcaaatgtctcattcctatcataatactcagagtacttaacctgtaaaatatgaatgttttcttaatattgatttagtgatgctgacaacataaaaaacaggccatgtttgtttgttgattgcttccaagtatattcactgcacaggttgaaaatctggagaaaaaaataattccataaaacagttcattaattacagatggatttctagagccaaagaagtatattgatgaaatgagaagaggaagggtaggaggtgaggggaattttgtttttgttgctgttattttacagttactgtgctttaaaagagaggtctatatttagagcctacttggaaatggtcaaatatgcacagtaatgcagtatcattagaactacaaatctttcctgtgttttgactacaataagaggtattcttacaaaagcagatggaagtcaacaattattacttcaccagagcagaatcactattttactccaaaacaaattaaatgatcatcacaatgatttatgcaccttatgcccaatctgaatgttgtaaagttgctcaagattatgttctttttcccacctttattaactattagtatctaataaatttgactacataatatatctatataatttccagagatacacatagagtcaatgttttatatcatttctcatcactgtctatttcttttaaggtatctgatagttaacacattcataagtgtgtgtatatataagctgcatttaaaaaacatatttccaaacctaattcatattctgaagtacataattattttatgtcatttgtggtcaaaattcgatgtatccatcttgttactgtaatggaaccaaccatgtcacacatgacaagtttataaccataagaagttgagcttatcgtggaagcctttctctcagttgtatcattgtttccctgtcaaagctgtcagaagatcataaggataggcagcagagttactccacatcaccttatttaaatgttaagcctttaaaataacttacttttttcaacctatcttggaggaacttttaacttcattttaaattccctactgacatacaacccaatttcaagagcatacatccctactgatgtgtgacgtttcaatgacattctgtattccaaagaaagatgctctatacagtgtgtaaaccgaatttaagaaatcaaataaaattattattaaatccaatgtctttgtatctgcttaaaccagatgtgttgtaaacagaatgacttcaaaataaatccagaacaataagtgtgcaacatattttactctcataaaagacagtaatgatgccataataattagtgaataaacagataagcatcattgtttatttgtattacattttaagaagaaactagaaatttcaacatattggtgttatgcgctgaattgtgtcccataaaattcctgtgttgaagtcctaacccccagtacctcagagtataagtgtatttagagataggatattttaaagggtcattaagttaaaataatgccattagtttgagccctaatccaatgtgactggtgtccttaaagaggaggatgctagaacacagcgagagatacacagaagacagaccacatgaagacacagagaagacggccatctacgagacaaggagaaagactctcagaagaaattaaccttgctgatagcttggtcttgaacttttagcctacaaaatcatgaaaacatacatttctgtggtttaagctacccagggtgtggtacttttctatggcagttctagtaaactaatacaactgataatttccagttagagtgtagctttacacaaatatgcgacgggtaaattttatccttagtgttcttgcattttacatttaacatttatctctcacgggctcatataatagaagctctcttgatattcctaggtttcaaagggttgtccatcagtggacacaagcttctctttcctgctctgcaaatgccttctaaagcaatctattgacctgaagattgtctatcacaaacactttagttactgagaatagcttagtatatatctgtctctgatgatatctgtctatataaagtaaatattatcttttttcatatagcaagtctttcacattgttttgatagtaatgagcaggtgtgataaaattgccatcttcactcattgctggtggcactataaattgaaaagcaatttacaagcttgcatcaaagtcttaaaaaatatttgctcccttttactcagttatttcacttctaggaatctctcaaaacgacacattcacgtatgctgacaaacattgatgtattctgatcatccatttcagtactatttatgctagtccccttctttctaaaaaaggaaataagctaaatgccttatcatagaataaacaaactgtagtattcccatagcacataggaaatattgtgcttttatttgtaaaccatgttttcaaagataacttactgtcatatgaatatcaagtgaattttatggttttagatgaagagataagtgtataaaaagatctcattgggttaaactatattaatacaagaaaatcaagaattccctttaatgtaaacctcctttccctcctcatccccccaaatgaatagtttctttttataaatcagagtaaaacactcagaataaagaaggatatatgccttacaagggtttttcagcacagttctccatcctcttaggaagcccagggagaagaatgtttcttcccacagttataatatatgaatacaatgtggtaactgcttcactcttgaagtctcctgcttctctctaatatatacatgatgattgacagtgatgacatccaattaaaacttcccctttctcatttggaggatcaaaaggtaatcttccttaattctctaagagaggtattatagaatatctcatgacataagacataaagaataaagagtattccatcctctgctccattccctcattataaggtacatacactgctatattagaatgaaacagtctaagccttgttgtaccatgatctccaagtgagagtttagcaaattcatatttttacaaataaagaaagcattgtaaaaggcacctggtcatgaatgccaatttatgctgctgaagcaagactgataccaggttgcctggaacattccaacatccaattcttttataaactgtgaagacaggtgcaaggcccttttggtatactctacccacagaaatcttggggaaaaaaaaagataagcactgttcttagtggttatctctgagttgtgattttctttattctgcatctttaaattatttttccaccataatattatattgcctgtacaggcaatgtcaatgttttattccagaggagtgaagtgttaatctcctattctacaaacatgaaaaataggctggactcatgcaggtaagtggacatctactctgcctttgcactaaggtctgccttgttcaagtcatagtgctcaaaatgagttatactgacaatgctaaggatatcggaatcaagagttccaggtcacagtgtgccccgcagctagaaatgatgaatcttcaggtgctacttggctcttcaagatcattaaaacacatggagtttgattttaatttgtatcatcctagaggactttttatctaaaattcaaatttcctaaatttagaattttgggggctaagagaatattgatacatatttacatacattcacattttaagatgtattttactatctaaacaacagtgcactggtgaaagtgcaaaatccttttaacacagtggatagggtgatgatttgggctcagggtccaagggttcaagcacgaggttccatcatttattaacctatgttctttaagaaatcacttgtccttactaggaattgtagttgtctgattaatctcatagtgaataccatcaacttcaacagccagctaaggccaccagcctaaataaatatctgtacctataaaacattctttctatatatgagctactagttctattcatcaggcattgagctctttagtttgaaggatccattatacttttaaatgtgatgtaggcattcatatagaagccttgagggagttatttttttaaaaaagattctaagtaaatgctaatcattacagtgtgtcatagccttaacatatttcttttgtctccgttttgttaacatattgtaaacctggcagtctccaggagggttaatcgttatattcttttgctgttttatgcatgatagtacctcataaatgcctgatcttcaaaacaatcataagctacagcaacagaaaacaaagtaataatggaattaatgtggagtaatggcagctctgacattatgctgggttgtacatcattatcgaaatgtagcattagtacctgaaaaggagacaagatgaaggaagtaagtccctcattatttctgagagctaaacttgagcaccagtttggagagtcgaatgctccattatcatcagtctgtaacaggcatttacgtatctgtcaccccacaagttcatcaactaattgcattaataatcgaatcccattttcctgtgtctttttaattttaaccacagagaattttatccatgaaggtcacttgttttattgtactgctaacacagacatatcaccattaatacttgagttaaaatatttctctgaagctgaagggctggttccttgtgaattttaatctacgggttttaagaaggaggagatcagggtcctaaattcttgtttagtcagaatctctccatctttgggcaagttatttaacctgtttgacctcatttccctcatcatagaataaaataattagaattacaatcaaataattaattcacctctgtatttctaggattttacacctaaactttcttctggagagaagagtagtagataaaagattcatgcagcattcagaggctagaattcctaattgatctccccaccttcaattttatcttcatccaatctccctttcattctattatagggagattactaaaaagcgaattcttggctggttgcggtggctcacgcctgtaatcccagcactttgggaggccaaggcgggtggatcacgaggtcaggagactgagaccatcctggctaacacggtgaaacccagtctctactgaaaatagaaaacaaacaaacaaaaaaatagccgggcatggtggcggacgcctgcagtcccagctacttgggaggctgaggcaggagaatggtgtgaaccagggaggcggagcttgcagtgagccaagatcgggccactgcctccagcctgggcaacagagcaagactctgtctcaaaaaaaaaaaaaaaaaaaaaaaaagcaaatcctttttatgtcactcccactaaagttcttaaagagcttctcatcacctaggttaatataagcactttctagtaaaagatttcatcaagtgagtgactcctgccttgctcagcagtcttacatgcccacatttagccatgcccacgttctgctggaggaaaactaaaccacttgctgtccactgaatatgtatgttctctttcatttttgaatgtttagattctattccttgttcttggaatacccttttcctgtttatcctcctatctaaaactctactgaggctaattctttcagtactaagttcataccatccccctttccatctttatcctagtcttagttgtatgttcctaattcctcttatatctcttgaactcgtgtgccataaccctttcctgcaattgttgctttactgatctgtatcttccattatacttatgagcttccagccctaataaactttgctttttgatttttctcatctagcatctagcataatgcctggcacacaacagacactgagaaaacatctgttgaatggatatgtgaaaaaataaacaatatgattcatagtgtaatttattatttgttgctctttttgcatgtgttgaatccaaaatacgatctactcccttctagctaacaagaaaaaaaagaacatgctagtttaacaacctaatcagccattacatgttaaaatgaagatagtgacttttactaaacttttcctttactttaaaattactttttttcaaaaccttaaattgaaaacaaaaggaagatcaatatagtctcataaagcactatttatattctctttccaacaactgctcacttccacttcatagcacaccagacagcaaagcccattcgttaactagataataaccagctaattttacacacacattttccagtcagtacatactttctcctgtcctctgggttgaaaggcataaattcaggggatcaattttctagtcatttactaaaaataccttttaaattgaacatccatgtgaggacagtctgggtaccactgaagagttgttttataaacacatagcttgtcatgtacaactttacattttgaaacagatatgctagttgttatggctaacatgtaatatagtaagaacactggaaagtaaaaaattagaaacactcttacctctggtcctcagatgttcctcaataaaatgaagtgatcaaaatacatttttaaaaacattctaagtccaggatacttattttggaggagaaaaatctttcataaatatctggtaccactttcctctgaagcatccccaacacaaataaaaatatgcacatacatgcacacacacacacacacacacacacacacccctaaatgtttacgtgtcaaaaataaattcaactatttaagataaatatataattccagctaggtgtggtggctaatgcttgtaatcccagccatttgggaggccgaggtaggtggatcacttgagcccaagagtttgagaccagcctagagaacatgaaaaaaccctgcctttaaagaagaaaacacaaaatttagccagttatggtggcacatgcctgttgtcccagctactcaagagccggaggtgggagaattgcttgagccaggaggtcaagtttccagtgagccatcatcacatcactgcactgtagtgtgcgcaacagagtgagcctctatctcaacaacaaaaacaaaaaagttaaataaataactctggaaacatgttgatattgtatactaatattaaagaaggttttaatggttttttttgtaaaatgcattataatcagtaaaatgcataaattgtaaatttctataaagagaattagagtaccatcaggtgaaaacatcatacccttcaacacaattaccccaaatgggtttatacatgagtcattgtctataatgccatctgaatagcagaaagaaaatgctagaaaagcatggacaaagaggatattccaagaataggactagcactagctgtgattcctcaagaaaggcagtgatagagaggggagacaagatggctgaagagacgcagctaggaagtgacactcccattgagagagatccagttattgactaaactaccataatatgggcagatgtttggaaacaaaaagctgtggtggatggagaggtgacattgaaggcaaggctgaagaggaaggaagttaggaaccctgcacagcataagggaatgctagggctagttcccagccccgaatggctcctgggagaggggtgagtgcaggaactaagggataactcactctctctgtggacctctaggatcctagctacagggtaagctgtgtcctccatgaatatgtgatctggcagggggatttccctggggaaaaggcagagacaggccttcaggtggtgtgtagcacagaaatgtttgtgtgctgggcagctccagcaaaaagtagccatagacgcccatccccgggaactccccgattcccggaggcattgttctcagctgacctccgagtcaggagagggcaagactggcttccccatgactaaggcatgtctgttttgtaagtcctgctgtctgtctgcccctcccatgctccctgtctgccccctcctaggggccacgcatagccactctgcaggaacaggtacacagtgtagccttagcagcccagcctgaatgctctacgttcatacactcctggtgaccgagaattacatcagatccccaaatacagctggaacctgacctaggccatgttctggtgcctccaggctatggcacaaagtatgggagtacagagttattcctacaaaacaaccaaagtcattgttcacaaaattagaaaaaaatttctaaaatttatatggaaccataaagaaccccaatagtaaaagcaatcctaagtaaaaagaacaaagccagggcatcacactacccaacttcaaactataaagctatagcaaccaaaatagcatgatactggtacaaaaacagagacacagaccagtgaaacagaatagaaaactcaaagcctcacacctacagccatgtgatctttcataagactgacaaaaaaaaaaaaaaaaaaaaaaaaaagcaatggggaaaggactccctattcaataaatgatactgctagccacatggaaaagaatgaaattagggtctcacctttcaccatatacaaaaattaacttgagatgtattaatgatttaaatgtaagacttcaaattataaaaatcctagaagaaaacctagaaaatacacttccagacattggctttgacaaaaaaaatttggctaagttctgaaagcaattacaacaaaaacaaaaactgataagtggcatgggataaactaaacagcttctgcacagcgaaagaaactatcaacagaataaacagacaacatgcagaatgggaggaaatattcacaacctatgcatccaacaaaggtctaatatccggaatgtataagaaacttaaacaaatgcaacaagcaaaaaccaaataactttatttaaaaaaatggacaaaatatgtgaacagacacttcacaaaagacaaacaggcagccaagaaacatatataaaaaatgctcaacatcattaatcatcagaaaaatgccaatcaaaaccacagtgagataccattttacactagtcagaatggctattattaaaaagtcaataaacaacagctggtaaggctatggagaaaagggagcaccaacttatattcctaccaacaaggtttaagtgttcccttttctccacagtcttaccagctatgtaaattagtatgtaaattagttcagccacttggggaaagcagtttggaggtttctcaaaaaacttaaaatagagctaccattcaacccagcaatcccattactgggtatataccccaaagaaaataggtcattatgccaaaaagacacatacgctcatatgttcatcattgtgtcattcatcatagcgaagacgacatggaatcagcctaggtgtccatcagtggattggatttctttttttaaagagatacatatacaccatggaataatatgcagccattaaaaggtaggaaatcacattctttggagcagtatggatggagctggagaccataatcctgagttaacacagaacaagaaagccaaatattgcgtattctcacttataagtgggagctaaacattgaacacacatcaacataaacatgagaacaatagacactgcagattccaagaggggtcagtgagggaggggagcatgatttgaaaaactaccactgggtgctgtgcttactacctgagtgcaatatacccatgtaacaaatctgcatatgtacccctgtatttaaaataaaagttgaaattttaaaattaaaaaaataaaagcaattaaaacaatacccaattttcaaatgggcaaagcatctgaacagacatctcaccaaagaagatatatagataacaaatatgcatatgaaaagatgctgatcatatatcattggtaacaaagagttaccaccaaatgttagcaaacacagaataacaaggactcttattaattgctggtataataatgcaaaaatggcacaggcactttggaagacagtttggtgatttcttacaaagctaaatgatatgatttaaccatcacacacctaggtatttatcagaatgattagaaaatttaagtcctgacaagaacctgtgcattaatatttagagcagccttattcataattctcacaaactggaagcaactaaaatatccatgaaaacagtagtttataaacaaactctgatacatccacatagtggaatactattcattgataaaatgatatcaactatcaagccaagacaaagcatggaggaacctgaataacaaatgactgagtgaaagaggccagtctagaaaatctgtgcactgtatattccaagtgtatgactttctgtaataagcaaagctatacaacataaagatcagtgatggccaggggttggcagggagggtggagaccgaggaacaaataggaggagcacagggggttttcagggcagtgaaactattctgcttgatgctttcatggtggacattaggtattagtcaaaacccatagaatgtacaagaacaacagtgagcccagatgtaagctatggaattcagttaataataatgcagcaacagtggttcatcaggggtaacaaatatatcaaagtaaagatgtcaataatgggtttaactgacagtgggaagagggaattccttgttataaactcaatattttgtacatctaacactgttctaaaaatacacaagtaatttaaaataatttaatagtatatatgattttataaacattcgataaaaatacgcaaaaatgctcaagttaaatgctatgtaatgggaaaaaaagaaagacaacggtgacattggaagaaggaaatctagtcaaatttaatcaaatcagtaagatctaattgaccaataatatacagttgcctaattgaagtatcaggtgtggctatttgaagacatgtgaaggcatgtaacacaggaagtctgaagcaccaagcacactgaaatacagtaggtgctcaacaagtgtttcctttccctgaattatgctgaaacttttggagtttagccttaatgaactttacaactttctcgaaaagactattctctctctatccagtaggtttttacacaatccgatttgctaagtcccatctccctctattatcttttgactaacattttttgtctggactcatattttttttttttttagacggagtctcgctctgtcgcccaggctggagtgcagtggcgcaatctcggctcgctgcaagctccgcctcccgagttcacgccattctcctgcctcagcctcccaagtagctgggactacaggcgcccactaccacgcccggctaattttatgtatttttagtagaggtggggtttcaccgtgttaaccaggatggtctcgatctcctgaccttatgatctgccgtctcagcctcccaaagtgctgggattacaggcgtgagccaccgcacccggcctttggactcaattttgatacctttctccagaagtattctttgactcccggtggttgcttggtttctttttccagaaattttcataatatcctacagtcatctcaacacagtgtgtatatgtatgcatgaacatggtcagtatctcagtaaacactccctggatgtcataagatatactgtcttacaggtacctctaagtcctaatttaaattataatttaaaatgccgatgagattaagattttctaagaattcctaaccccttaaagttactaatcacaatgtctattgctatgattgttcattgattgacagtctgtcaattggaggaacacatttgcatctttaaatgattattgagaatcatagactaattgaggtatgttaccaactgattaactgaggaaagaatattttctaaacatttaacagatgaggaaaccctaggttgtgataaattaagaaacataaaactggactccctcaactttgaactccctgcccagtaatcctttgacttaaccatgctgttcctggggaaaaattattgcaatgagtatagatagctctgagttatttatgtggaagacaaaagaaggaaacaaaaggttatgtgggaccttcttaattataacattctctcaagtcctcacagttattataataaaactccagtgtataacaagttatcgaaatttgaaatcagcatggtattctgaatactcaggaaacccacaaaacgaaagttcatcttactgttttgtgattggatacatctgcttccttggaatttgtctaatgctattcttccagtactttataaatacatgttgactgacttattttgtattttaagatatctggatagataagcccaaattatgaagtcatataatctaaatacatgaaagtaaccaaatcatcatggaatttattattctgcctttatatgtatgtttaattatcttgtttaaattcttccaagattatcagtgattttcattccttgacaattaaaaaaagactaatgttgaaacttttctcccacgcaacagtaattcttaaagtttatttagaaaagtaaagctgtttgtttttgattctgtgcatatttgctatcctcaaatgattttccccattataggagatgtgcatttgtatatttttttaccaaggttttaaagtgagcgtattatacagtgcagtgaggaaaatttccaatttctttcttgcatgaaatatctgagctaataattggactaggagaagtagaatctttcttttcattagacttctcttttcaacaaaagctttgttagcctactgaatcatgacaagtaatcctttatatgctggggtacactgttcttcctgatgaacttacaaattaaaatgtaatgtgaaacgatggcactgggaatactgaggaatagccactgatgtgggaagagatctataattaaaccaagatgtacattttaattataattttatcaaactgataatacagaataaaatacagttggagaaatccaaggaagtcataataaagagcacaagaacgctactttgtaccccttgttgtctcctctaccttcttttgccagttcctcccctcccaagccttattttaatatatcttgccaaagattagaaagcaatcaagtgatttttcaccacctttatcccaggctaaggtaattattcatctgtttttctctcctgcttcgttttttttttttttttttaattaaacttggtttgctcaagagtaaaatgaaccacagtacttatcagctcagtgcatacgcaagtgatactgaaggcaactgccagagactaaagccataggttagctgcaaatccattagtgattttaaatagtggggaaaaaattcttggtgagtcatgataaagctgaacaataactgcagaagtcacaaaacatgaaaatgtaatttgcatcaatatgtcgtcagacagatttacagaaagctaacacaagtgcgaaagatttcctataagataagcaaagccatatttgctgttaatgtttataaaagtattttttaaattattctttgacatataatgcatagttttaagggtcatagtttaggaagagctgtacaaaggataaagctaacatatctaaaagatattcttcccaactgcaaagcattcataaatcagagaaatacttggaatttactatggaaaattttaaagtgaatattaagaaaaaaatctagtgacgtaatttttatttaaccttgcaagctttttatggcttatttacaataaataagctttcaaccacagcatccacaattatactgaaggaaaaagatattattttaagtcattctaatctcacattctagaactacaacttattttactactttctttttcctgtttcacaaatttccttccaaagccatggtaaacttccataagggagctctaaagtcaaatccattaagccatcaaggtacatcttatttcaagattttttaaattagcagatcaataacctagcagaccatactgactcactcaaagcaattacaaagtatttgttcattagtggaactgtgctagcttaaaatctgaagtgaagtccagtgtcaaaatatattgtccatgtttattaccagcatttaaaattttatgtgtgtgtgtatatatagatatatatatgtttatatctatatcataaaacatatattagatatatgtatgatgtcttaataatgtattatatattatatatatacacacacacacgcacacacctatacacacatataatctctcctacattttatcaacaaattgtatatggtttgagcagggtttgctatgtacagggtttgggtgaatataactgctttcaccaacacggtttagctaaaaacatgttttggaaaaaaaaaactctagtccaacctagctagagtctttagaaagaatgaaagaaaagttttataaaataagtaggaacaaaaatatgaaattgtatatttttgtttctgctcaatattgatggcaaatactattttaagtaacaaaaatcttattgtataataaatatagaaaggatcagaaaaatacaaaattgccattcaggaaacactacagtagtaattattgcaggcaagattcgcaagggataccaaaattactgggtgaagcaggatatttgcataatctcacagtatctcctacagtatatttattagctatgaagggaaaaacactaaatttatggtggaaaaacctagtacatgctactttctcatagacaaagtatatatcattatcatgtaccttgatatgatgtactgaaaaggacacaacatagtttctgtagtctttatgcccaaaattcagaaccttagtctaatcattcataaatattacataaaccaaagtgagaggcattccgcaaaacaactaaatggtactcataaaatgtttcaagataatgaaagataaagagagatttagcaatggtcacagatcagcagaaactaaggaaatggagcatttaaatgcaattcgacatagtaatttgggtgctggaacagaaaaagaatatttgttgaaaaactagtaaaattccaataatgtctcatattaattaatattatagtaccagtgttaattatacaattgtacaaataaattttacaatggctatgtcagttgttaacattaggggaagctggatatggggtacatacaaaaggtaccatttttgcacaattcctgctagtcaataattattcaaaaaaaattcaaagccaatgcttcaagtaggtcatgatgaaatgaaggcaacatgctccaacattttctttgtaaccactaagttatttattaccactttgctaatgttataattattcactatcctggttttttctccaaatacaatgatgagaatatattacttctccatatttcattatcaataatacaaaccaatggcctaagcctgttttctattattatatttacctaacctaaaaatttttcatgtctattagagtatttcatcaaattcaagacaagcatttattgattgccattatttgccatgcactgaagcagctgtaagatgattacatttacctgcataaactaatgaaaactagaaaaatttacatcttctatgcctactctaacccattataagttaaaactattttgagaattattgatacatttgcatgcatttcatggttatattcatggtggaaaactttattagcatcgagagagtatcaagaacctgaagaattttactgtaatagatttgtatataatggtatgaggtcatataagcataagagtaaaataaattaccacataatcagcattttgtaccataaatgctaatactgaaaacagcatgtgagaaacacaacagaatgttataggcacagaagtaaatcacagtggacattcccttgctggtagaagcaagacgaggagtactttaaaatcacttgcaggtggctgggtcaaatggtatttctagatctcgatccttgaggaatcgccacactaatgtaaatgatcagttaatgggtgcagcacaccaacatggcacatgtacacatacgtaacaaacctgcatgttgtgcacatgtaccctagaacttaaagtataataaaaaaaaatcacttgcaggtaagttgcactctagagattcccatcttaatactaatttttattaacttcatatttttacttataaaattggctgggcacagtggcttacatctgtcttcccagcactttgggaggccgaggcaggtggatcaggagttttgagaccagcctggccaaaagggcgaaaccccatctctactaaagattcaaaaaaattagcttgtgtggtggtgtgcgcctgaagtcccaactacttggaagtctgaagcatgataattgcttgaacccgggcagcggaggttgcagtgatctgagatcgcaccactacactccagcctgggcgacagagtgaaattccatctcaatttaataaaaaaaaaatacataaaaatgtttaaaaatcaattttatttctcatttaactagattttataaaatatttcattaaaaaaaaaagaacaaacagtactacacaacagtgacactctcagtagtaaaatagttgggtggtagagagtgctacctcaccaagctcaaaatctttgtcagcttccaggtaaaggtccaattggtttatgatatatgatgacatataacgcattgacaaatatgtatcaagattcaggaagtgtttatgtcaactatgtaaaaaaaaaaaaaaaaggccaaatcctttacagtccaaaatttaattaatgttactttttttctgtcaattttcttttgtcacagtttaactaatatactctcctaaatacatcatttcataaagcaaaggaagggtaaaataagatttcagaaaaagaaaaagaagattgaggaatggagaaaaacataccaggtaaaagggatttgggacacccaataaggtggataaaggaaaagaggataaaataatgctactacaaaaggtcagagacctgagaaagattaaagacacaaaagaaatgacaaacagtagaaaaatttgaatctgaacaacgtatatcaattttttatttattattattattattattattatttgagacagtgtcttgctctgtctcccaggctggagtgcaatggcgtgatctcggctcactgcaacctccacctcccaggttcaagagattctcctgccttagcctcctaagtagctgggactacaggcgcctgccaccatgcctggctaattttttgtgtttttagtaaagacaggattttgccattttgaccaggctggcctcaaactcccgacttaaggtgatccaccccacctcggcctcccaaagtgctgggattacaggcgtgagccatcgcgcccagcctgtataccacttttacaatcagtagacacttgggaaatacaaataaatcatgaagttataatttttctaaaaatgtttctttccttttattgttttatacacatatgaatgtacagaggacaagctcctagtcaaattttctttcacaaaaggatgccatgaaaaaagatataaaaatagctctctggccgggcgcggtgactcacacctgtaatcccagcactttgggaggccgaggtgggtggatcacgaagtcaggagatcgagaccatcctgactaacacggtgaaaccccgtccctactaaaaatacaaaaaaattacccgggcatggtggcaggcgcctgtagtcccagctgctggggaggctgaggcaggagaatggcatgaacccgggaggcagagcttgcagtgagccgagatcgggccacggcactccagcctgggcaacagtgagaagctccgtctcaaaaaaaaaaaaaagaaagaaaaaaaaaagaaaactaaaacagctttctaaggggtggtaatggattttatttaaatcccgtagacacagtatataatattaatctgatacaaaagaaaaaaatgtttaaagggggagaagtaaaaagaaaagcccaaatagccaccaggtgagctccaggtggttataacattttaggaaatgtgataaccaaatctggccatattttaaagaatattttttttttctgcatgaagttgacatgcaataatcagtgaagtgtttaaacaactatctaactcttctttcatggtcttcatctagggtcaaaattagatctaaagtggaaacaactaaaagaaccctctgctttagttatcgctttactcacaagtttccggtgcctctctaacactttcaaaaattgattcaaagtccttcattaagtttatgtctatatttcatcacctatcagcctacctgacacattatacatgtttaaatattttctggctggctacatggacatctggagggatcttataacattttttgcctttccatacatagtatttattgtagtctactttgagttgatatttatatttgtatgcctatatatttttctaaataggaattacatgttaaaacgtttcagaaaccaggctctaactttggtggagaaagcattaatatacatccaaggtaagcatcatcaagcggaatgccttggcctataggcaagttcccgtagcgtatgagattttcagtgcgtaactattcaagcttgggaagtgcactggatgtcacataagaagttcacagaatataaataaactcaaacaataaattacttgctccaaaatattttattctgcactatttttccctgttcacaggccaagacactctactgagggggagataatcgacatattccctaggtgattaaaacttttaaatcggccaggtgcggtggctcacgcctgtaatcccagcactttgggaggccgaggcgggcggatcaggagatcaggagatcaagactatcctggctaacacgatgaaaccccgtccctactaaaaatacaaaaacttagctgggcgtggtggtgggcgcctgtagtcccagctacacaggaggctgaggaaggagaatggcgtgaacctgggaggcagagcttgcagtgagccgagattgcgccactgcactccagcctgggcaacagagccaaactctgtctcaaaaaaaaaaaaaaaaaaaaaaaaaaaaattaaatcgagtcgtaatttatcaggacaagtgcaaatcaaacttaaggtaaacattgtagctactgaaatctctcataaattctctggatgaacttcaattatattcaggtcttcaaaaacagaggttaatcatttgagcaaatattttatttatctttgtgaaacaactaaaagaacacacataatttcttaacttcatgggatcaaagatgatcttagcaggccagaacctctttctaatctggtcccaatttcctctaattttaatgtagaggtgggaatatctggctgggaatctagactgtactattcgttagctctccatcctcagatttaatgtacccaagtctcgagtttcatagccttaaaaagtgaatgtttgttttgttttcttgatgtattgtcttggacattggacaatttttcttaaatgagaaaaaatatggcaaagaattttataaaatgtttatcctcctcatcatctaatttgtttcctgccgctgaaagccaccttccccaggggcttgagaatgacacctgtccactgtgtcaccagttggtttgcttccctgcttattgttttctctatgaaatcttaaaacctaactaaggctttgctgcccactgcaggtggagaggagaataaatcaattcccttctgcctgatttcagtggctttatctcaaatgttttgtaagttattctgttgctaattaaacaatctcatttatagatattttcttcctatgaactcaatactagtttaataggtataaatataagttttgatcaattattaaatccataacaaagaaaaataacaaggacttaatgtatatcaataattatgttagcttgaaattagacattcacacaaatgtttgtctgtcaaattcagttcttatatttttggctattttcatattaaaattgtctaatgaatctcttcaaaacttgtaatgtgtttcagtagttgcctagaatgggaccaagtatgacaataggcaataaatatattttgaataaatgaatggatctacactaatatacaagtacatgtaaaaacccaaactagccttataacaagtatggtaactagttcagtttgaacaggtcctatggcatcttggaagacagatggttcagtacatatcataaatatatataatgaaccagaaaacgtaatagataaatgcactgtgttttaacagcttatagtagaatgcattaaaggattttccttaaaatttctactctagtaaaattttgttacagattttttttaggaactataaaatattttttcccactgtctttttgttatgctgcatatagccatcattaaggggattctcagctggttttaaaagattttagtttagttatatcctcagttaattgtgttagctaaaatcggattatacctttaaaaatgaaaaaggtgttctggaattatttgttaactgcacacgtttgttctttaagaaattcataagatcatagaatcatgttttttttaagctgaaatagactttaaaagatggtaaatgtaagaagtttgttttgaacctgtgcaattataataacgacctttaattcttttctaatggcctagatggaattaattggttatttcaatatcagggctcatcttgtgtggaatcataaaagagtctctttcttataatgggttctatcacccctgatgataagtttctctatcaagcttatttaacatgttctgaaagcacatttttaagagccttggcattctctgtctttcttcctttcatctttcttttacattatttgcagggaggaagaatccatttttgtttctttgtaattttgttttggtcaagctatcatttagatcttaccaacagtctttccttttaattatgtttcctatattgagactttttttgattggaaatagtatactatttacaaaaatcgagaaatcattttttgcttatgggaagttataagctatccaatttctaaatagcagccatgctgccatcttctggttatcttgtaagaattttcttatgcttagaagctttattttaaaatgcatcttgatgtaccttgaatttttttttatgtctactaaggacacatatttgaataattagagcactgcatctagagttctgttgtcctgaagtcctaaagcaaataaaaacttaagtcttatcattttaaatattataatcgaatgggactccaaggattaaaaaaaatgttttatcccatgatttggaggccagtgagattttctgacactttttaaaaaaatcacattactctttatttttttcacagcttttcagtgtggcagcaagatgaccacccttccctcagtgagtgtgaaacttttccaaatccacagttcctgttaatattagtactgcatgttatttaatgctgtttcaggtagcactgaaccacttgccaatttaactgtcttatttcatttgaaaactctgccagcacctatagtgcaggccaagggccacaaaggaagggtagaaggaagcgagagtttcatctatctttaagagctttttcattttaagtgatcattaagacttatagcactctttttttgtacattagtgtaacctaatgatgttcaatttttgtatgtgtgaaaattcccatttaccccactggcattcttctcctagtagccctggaggaaaaaatagaacaattttaggagataaatttatgtctcacactgaaaactgattttaaaatgtaagatattacatacattgcttcaaattcaaatgaggaagtacactcagtggcttcaagctctgtgctattttcagatgactatatgagagtataaatcataatagctcattgaaaatcagaatgcaaatggccccagtaaatgtttagcaacagaggattttctcaactgtttattaagagcaatccaaaatctaaagcagctgggacaggtgttaatttcaatcctgttatttgtaattagtgatgaaatttaatggtgtttataagtaactctgaaacatttgtcatataaacatggtctaaatttaaggggtattaaaatggagtttttaagcttaatagacttgggcaaacaggtattttgaataatcaacacctctgagagcatataccaaatttaaatggcaaaattggcccatttattgtaggcacaaaaatgaccttgtaacttctggatactgtgtgtgaatggatatggatgtgaattgtaccatacctagatggttgattactatttgtttactaaaatacaggacctgaaattccattattttgccatgacaaaattatttttagtctcctatattcacaaaaattgctattatcataagttgatagatgccaattgaatggaaattttatcatcccatagctttactatgaataaaatggatgtatctataaaacgtgccatttgatccatttctctgagttgttttgttttcttccaattacgaagacataatcttttttcatatccagaaacaaaagtaaaactcctacttggtcaaactcatgatcttctattatcagcagcaaagtagaagtaaatgtattaaaatgcccacacatatgtatatgttatcaatataagtagatagacaaatggatggatggacggacagatagatatgtacgtctgtcaacatgtgtttcctaaatttattttatgctgttaagaaagattatctctgttagtaaaaagcataaattatttattcagaaatttactcctattatatatatcctaaacgtgaatcaagcgggaaaaattttttattcagtattttcaaaggtttcaaattcagctcagaatatattattttagaaaaaaaaatgtaatggtaaaaagtatcttatttgttcttccttctgtgtagttcctacttggtttccattagattaaatcccaaattccagttaactttaataaatggacaaaaagtataaaatagtaacaatattaaaattaaaaagttttgaggataaaatgggacttttagttgtatggtactggaaatagtttatgaaattcaacccactacttcctaaaatataagagtatcaaagagctgaagaataatcaaaaggagtaagaaataaaaagacttaatctgattccaccaacatgtattgatcttttgtcctacgcgaggcattaagctaggttaaaaaatacgtgtttggcacttgtccttccctcaggtgttcagagctcatcaagagagttagacagataaacatctattaaaacaatacaatgaatgtatatatgtacatgtatatatatatatacatgtatatatacatatgtgtgtgtgtgtatatatatatatatacacgtacatatacatatatatatatggtgttccaaaaagtacaaattacagtcccattaattatgcccatgttgaccatggaaggtgttaccaagaaatgacataaggactaggccttaaaggatgcttagatttttgcaaggcaaatgagtgggtatttgaaaaaacatgagtaatatagtgaaaggtatggagacttaacgatttatggtatttggggtactggtggcagaggcaaaagtgagtgtatcaatgtggctagagcagagaaggcatggggggtatatgtagatgacaaaaatagagaggtaagtgagggatactgaacgataagctaatcaaacaaggagaatttagactctttaaagagatgagtcttgatgataatcatgactaacattgtttgtcgactatttcacatgtgagatttaatctgatcttcaaaagagccctgaaatataagaattactatgttctcaattttacagataataaaaccatggcttagagaagataaatattctgtctggaatcaaacctgtagtaagtaactcaaactgagtatctctctaaaggtcttatctcttctgctaaactgccaacctgactagaatggtgttttaaaagataactttactggcagtgctaaattagaataaattgaagggaagagaacctaaaaggggaagataacagtttagaagatgctgcaatcatctaaaccagaaatatcacaggtctaaatgaatgagggagtggaaagagcagaggtagcttcaccttaaaaccaacagcttgagcttcaatgtgctcactggcacaggccactcccaagcccctgggaggagcccttgcgtgggcttcacatgatcatatatggtttaaaacgtgagaatactttaactatgtatagttaaggctcctgtctctttctactttgtcttccaatctgtcacacttttgctcctgtcctatggtgttggaaaggccacatgtatttggagatctggatagagaaatatttgagaatatatttaatttggaaatagtggggtatattgagttttagaatagtgggacctaactatcccattgtagggaaagtttttaggaatactatcaccagatattaactcacccagctttgaaatactgttatagggctagagatctgatcacaatattgagggccattgccacccagccaaggaagcatttggatagtggaaaaaaacaaggtttgtatttaaggaaccaaaaacaagtctgaggaaaattcgtattcatgaaacaaataaagtataagcatagtattgtgttatcattgatacttagtcaaaaagggacgtcaaaagggagtatacatgctagataatgaagcatatacaattataaacatgtcattaacctttttcttatttttgatggaaataaaataaaatagatttgattagtatttctttgtggtaggacaaaaacctccagcagtacttcaaactgcaaatacacctgtgtatgaagttgcatggtttatgtttcctattgtatcctattgtatcagatcatgtcttaccacatctgacacatcttcttctgacaatgtctgggagttccagactaaacagtaggtaaaattgccactgacataacaaaatgatccaaatatactagaaaaaataaaaagtacatttctagtctctctacagaaactatcacaggattgtttctatgtgaagaatatatcaatgactatgcaccaccgtcacaagaaaaaagaaaatatatagaattacagaattatattaagaaaaagattcttctaaattttaaggtatttttcagtttttttaatatgcaatttattgtgatttctttgttcattctaatcaaatattcacttccaaacagaggctgtatttttaaagaggatccccaaatggatactaagttttgtttctgaaacacaaatcctttcctcagttgaaagaagaagaagaaaaggaggctgggatatctgagaaacgttttgaagataaacttgctaatacttcttaatccagttgcagggagagtaagataaaattccatggtgcctatcatggatagagtactgaaaaggattcaaggtttgcatagaagacagctcaattttagatatgtgctgtctgaggaatcaatgaaattacgggaagaaatatccgggaggaggttgaaatgatggctctgatgttcaggagaaaattgaaaaatagtcatgtaaatttgaagaaactaagcatttgctgacagctaaagctaagaaagtagatgagaattctcagggagggacttttcagttggaagaaatgaagagaggtacaaaacctgtagcctgataaatgtgtggagtaaaatgaggaaccaaagcacataaaagaagaaaaaacaagcaaaaattgcattcaaaaaggtaggcaagaactagtagaaagctgaatttggaaggtaaagtcggaaaggacttcatgaaaaacctaaaaatagcaaagtcttcaggaatgaaagggccatgaggactgagaaaaggatgctagtgttttggggttcctttaaaccactttattgaggtatgatttggcatatacaaagctacataaattcaacatatacaacttgatgagtttggagagaagtatacaccattacgtcattgccacaatcaaggccataaacttattcatcatctgaatagtaatatttaaaaggatggtggtaaactcagtgtaagaagtttttatcaactaatagagatggaagattgaacatagttttctgaatagtagatgggatatctgagagcaaagacagtggtcacacactgtactttaaagaaatacatggggaaggaataaaaaacacattttagaagagagtgttacaaagtatttggtacagaattagcttaatttaaaaaaatacaacatatgcataaaatatctagatttataccaaaatagtaataccctaggtagcagaatttcaggcagttttttttttttttttttttttaaacaggcagtttagttgtttgggtttttttgcatgtatttcaaatttttaaaaaaattaaattattttataagaaaatactataaattacatatttaaaatgtgcaaagcaaatttataaaatttaagaaggtaattattgtttaagaaagtagtagttaagattagaaggttctggaaaataaggaaaacatcaaagataatagatggaccaaaaatctagaaaaatgagaaagaatagagtgaataatccaaaactgatgaggctatacttgacgaaaaggatcgtcttctgtcaggtcgtgcatggtggctcatgcctgtaatcccagcactttgggaggctgaggcgtgtggatcgcctgaggtcaggagttcaagtccagcctgaccaatatggtgaaaccctgtctctactaaaaatacaaaaactagccaggacttgtggcaggcacctgtaatcccagctactcggggggggctgaggcaggagattcacttgaccccaggctgtggaggttgtagtaagctgagatcgcgccatcgcacaccagcctggcggacaacagcgagacttaatctcaaaaaaataaaaaataaaaaaaatcatcctctgtcataaaattgggaaggaagtagtaataaagttagaaaatgatggatttgaggtgaaataaaagtaagttaaagagttaatgtctgaatacacgaatgttcttgatcatattagagatacatatttcagcaaaatttgaaaaagtcaaaagacgattggaacctcacagaatagccaccagggagagaggacaaggaagggaaataaaacaaaagaatttaccaagtgatattgggggcccaagcagtgtctgataatcataaattttaataaattaataaatactatgttattttcttcgataacattgtaggggaggaaacctttattcattcctcactagatttatggctgagacatatgtaataaaagaggtcaacaagggaaaatcatatttatttaatatgagttttacctgacacagacaccttcagaaatgaagactcaaagaaatagagaaacctgtgtatttttacgctacatttgatgaagtaaatagttgtgaagtatgattggacaaaaaggataagatctaatgggaataaattggggggaatttatcaagggttgtttgttcagtttcctctgtgtccttgtgtcttcagacataaggacgttcctttcttccaaggatagggaagggacttctcagacaagaatcttatgacccatttcatgggagaaggtcagagaatgacctttctgcttctgctatttttctcaaatgttaagatgccatattttggggtatcatgttctgaattccatcagcatgcagcagcctagaagtagaaatgcagtaagaaatggtttggaataagccatatgtagagaagagaacaagaaggaaataaagtagttgctgagagcgcaggtaaaatgactgatttatgaagcagacacagcaaattggaagcaaaatcaggtagaggtcttagatatggagatataatcagagattagaaaatatcacccaaattaccaaagcatagtgggtgtgaatctctaatcctgagacataatggaggtaaaatgttttggtttttcttttaatgtttttaaaaatgctttgttctcaaaaatattttgaaagttgggacatttttcacattagatccccatcttacttattaacgtaacatcagaacattattcctgttattattacgggaatgactgcagaatcaaaacttatatatcttatctacacattttaaaattcatttgaccagaaggttccctccaatttatatattttaaaaataaatgcaattaacttccatatagcaaataaatgagataggtttgtagtcaggttgaagagcacattaaatgctaatagattaggttgagataatatgttttggaaggagagttaaacttaaaaattaaagatcttacagagagagcaattatagaatgtagctctttaaatgagttaatcaatagaatagaatcaaagaccactggaatttgaaagtcttcagagttcagaatggaacattcagaggatactaaagttatccacaatgttttgaagccctaagggtagaaagggactctaaaggccaggccaaatacttctaaaaatgaaagtaaccacttgcaaatcagtaagccttgcttttgaaagaatgatacactgtgtttccttgggggcagataaggaagagtcataacctaagtgttgtcagttcaatattccataaacactaatgagaaccaaggtaaagcatacatttgctaatgctaaaattcacaagagaccgaactgtctctttacaaacaataaaaaggggggtaagcattagaggaaggttaggcttcaataaaagttggaaataaaatgatgtcccaatgaatataaataaagggttaaaagtaacaaaagagtttgaggccttaacaaaaggacaaagcaaggaagataaaatagtcatctaaagggaatctagactgagagagactaggtggagagctttctttttgaactctgattaatcacgaagacaaaagaaaaagacttagaaacacagagaaaaaggacaaggattaaacctgcttcaaagtacaaaaagaaattcctttcagtctccaaattttcattctcaactattcctacaggtggatgagccacttgacattcttgtcaaaagaaaaaataataataaaatattgaattcccgaagagatttctgtcaaaataagtaaaataaagtttccaaagtgaaatacattttggaagtcctgcataccacactcttttgggattatcttaatgcccatttgttttataaaatgtttgattagccaggcggggtggtgcacttgcagtaccagctactccagagactgaggcggaaggatggcttgagtcaaggaattccagcctacagtgagctatgattgagtcactgtgctccatcctggggacagagcaagatcttgtctctaaaaaaataaaatatttaagatattccccagttttgcaaaaatctgtatttaatatttcataaatgtatatgaactcagccatttggaaagaaaagggactagtgtgatcctgaatcacaggatccctggagaaaaagggtaaaagcaaacggccaattgattaaatgattttaaaagatcctttaatgatttataactaatgaattataggtctgtaaagagagaacggattatttgaaatttaatagatgaacaaaggaaggatcattgtctatagaccatgaggtcttggaagacagaaaccacttgtttgatactttgtagctctgtcagcacatggtaagtacctgataaatgtattttgactgattgaatgatatgtcattaatattaggtatttaattatatttgcccaatttatccaatgttgaaaggtgttcaagggtcaataaaggagctcatccacatctctagctgatagcagtacctataataagcaatttaaagcttgtaaaacaacagccactcaaaatttaataaacatttcttaagggatatgcaacagaagcatttacatctctgaaggagatacacgattagttgagctttttgacaactgtccaagcactaatctccttgttctatactaagagtttagaatgtatttaaataagaaagatattataaatagctactcaactgttatttattatttatttatttgcatttgagaaggaaaaaagaatcagacacttatttaaaagtcatcttatatcaaaagtaaatattaggcacttccatcatgtaacaactttgattttagaggtctttttagtgacaaatataaaagcaatttttaaatcattagtacccggtatacattcatagaaaggaaaatgctttcatgcatataagtcctctcttgacaaagtaaagctactagctttaagctgacccacttttctctatgctgtatcaggtataagcaagctaaagaggattaaaaaaaaaaaagtaactttcagtataaaacaggaatggaaatgctctgcacctaaactccaatgggattttccttttgtcaaaggctgcccttctataacctgttctgagtttataaagcaaacaaatctcactgaggctcttattacacctctttagttgttaattttaaataatctgtacaaaggcaagtttaccaaggtatataaagggagcatatttctgtggccactggagagtaagtgaacaaaacttttgttggactaagaaaagtagttttacctgcaattctgaaaattcattttattaactgattggtcaataattgttttgagtttatagggtaataatttcactgttggaaattattggaggacacatttcagctaactattaaaggttaaattcaccaaacaggaggatactaattaactgcctcttaagaaattgacaaggccactgcaagttcttttatccgttgtctataaatcagaaggatgccctttaaggcatttccatcaggatacatgttggcacaaaactcaggcaagcagtgcttacaatcagaatactataatgataacaaataaaggttattgttctgtttatacaagaatggagtcagcttggataattttcaaaattcaaggatatatggcaagttggtgagtattgagaaaaaaatagtctgtttcatcttatgcatttcaaattgaatgtgtttagcaccaattgcttaattgcgactcaagttgcttaaggtttattagaatattgtgtttcatctccttgaattggtgcagacacagtctggtccaggtgtgaggtccaatatgataatttaaactcagtttaaaattgcttttactttactcctgaaatgcaaatgtaatggaagtgtttgagatcaagattcctatgggttgataggaatcctgttgtttccctcgtttttcatccaaatatgtccatattttgtattcttagcaattgtataaactaagatgtccttaggtcaaaagggcacataattatagcttgctccctgcctccttagaatttgaagttaatgcactaccttatattaggccataatttgctcctaaattagccacagaactcaaacttaaactccaggttcaaaatatgaaatatcttgttgttctaacatttggataatctccactttatacatctctggctctatagactagggaactcttataaatgtatgtttggaaactttttgtgggaaagcttagccatatagtaactcatatcacacaaagcccaggatgctaggaacgtttttttttaaaaaaaattcaactctccatacccagtatccagaataggacctagcttatagttggagctcaataaatgcttgttgaatgaatacacctatcagttttttctccatatattatctgaggacttctaacacatgctggcaacctccccctccctcagaaaaaaattctaatgaaacaaacttacaattgtttattcattctctctttctcacacacattttcttttgcattacactaataatgcatataatttgagctattttaagagtaccaaatactatactaattatattaattttaagcatggtaaatttactattactgaactacaaggaatttacttggaaaacctagttccacaaaatattttaatctgatccagcaaaacctaagacatattttgcagcatatgcatatcggtttattgtaaatttaaaaatctataattaggtaaatatattgccagacatgtaagcattacgcaaatagaaaaagatacgctaaatcactgaaaattgtggtggtctaatattggagtaatctggggaaaatactaatgttactttcaccttcactgaactggacgttttgataaaaaagaaaaaaaaaaaaagcaagtcagtaaaccgctcagtgataatcctcattggtagtaaaaaatgtcaaactcttatgagaaacacaaaatttttaagtcactctcaatatagctgcagaattgaagaaactattttttcattagattgcttcagtatctacaattcagaaataattatttattttcttaaattaatgggatatcacctccaacaatagtttttctgcattttctcattttaaatacatcagtgatatttcaacttatcatgatgagcatcccaaatagataaaacttcatggccagcagagttagtactgttttaataaggcatctgacaaataaatataattgtaactggtgccttcttgatgtctaggatctctgcctggtataccaatgatgtctgtgaggagaaaacaaaatttttaatttataaatgcatttttttctcttttctttcaggaaagaaactggttttcctgtaaaactaatacatgtgattattaaaggtaaaaacataacaaatcaaataaaaaaggattaatcatttaaagagaagctcatatgttaatgagcttggagtagtgtaatgaaatatcagaaagatcctgacatagtagttttacaatacacaagagcatacaagagatctagattttgtttagtgtttcactatctcactagaagtttatgggtgcctatcttaactgagttctcttactggagcaatggaacaagaattatgcccacattgcttcattccaatgttaaaatctacattatcagaaatgtagtgtgtgagttattttttttcttttaatacacaaagattatctgatggctgtttttgatcagcttctaacctcaagaaaaactatttttcactggaatcaactactgctatgtatacccagtctcatccctctacatttccttcagtcacatagggctcttttagctgaaagaagctttgattctgaagtaagacaagataattatataatcatgcaatatttcataaaatagcagtacactgcactgaatttcccatccctaaagcccgcttggaaatggctggaaatatggatccagccactgaatcacacattaatgtatcagcacacaggaaactaataaaaaaagtttaaatgggtaaattgaatgtctactaaaattgtgaatttatgaatgtgttctaaaatttctatgaacaaaaaattttatatggcttttaacaacattataaattttcaaccagaaaggaactttttatctttccttaactcttttgaggaagactctcagattttatttcaaccagttcttggcacctagtaggtgttgaataaatttttactgaattcatacataaaattttaaattatttgtggggagaaagcatattatgaaactcatgaacataaaggcatttaatctaaacaagactttgagctaataaaaagcttacttctttagcataccatgcacttggtagagatatgaggtgtgctttttatatataaaatgtttgattataatcagatgattcaaaatataatttttataatattatgttaaatttcatccacattttacataagcaattgaaatatttacttgatagaagaaattccttgttaagtattataattttatatgattgttctaaaggtgaaaatgtgatcatgcataaaatatatttaaaatttactgatagtaacaccttacatttgtaaaatattgtacagattatatagtgcaattatgtaatatctaaattgatcctcatagggactttgaagttaagtgtaaacactctcttttaattagaaaaaataaataccatagtagcttggattctggggccaggctttgggttttggggccaggcttacccaaattctgccatttactgtgtggcctcaagcaaatgtctcaataacccccaaatgaatgatgttaacaacctcacaatgacctagtagtatgagaagaagtaatatataaagtgctttgcctagtgccctttgtttggtaaatgtacaataatgatttcattattagcatcagtctttatagtgatattgttattaatgagagattgggctgtcaattaagtgaccggttaggaagcaacagtattagaaaagaggaagagttcaaacgcaaggtgatttgacttcacaggtttattcctagatcaactctgtaccagctcagttaagtggaaaacagatccaatgtaaatatttgctatctgaaggaaccctttcagattagttttacaaaataaaaaagtaaatttgaatatttaaagcttttcttttattataactcagggtttatacatactgagatttcttaaagtacacttttatgcctttattattggtgctagaaaagctattcttcagtgaaagctagatcctaactttttcagcttaaaaagcaatttggttgaaatggtacctaattactctattctcaaaggaagaatgacctttcaaacgtttgtttatcagcgtcttgcttaagaacattaatgttcctcttgaactcagaaaaatactcctattgagtgagaaatagagcttagaaacaacattaacagacttctgtaagaagaacagaaagaagaaaaggcacaaagtagaaaagaagtacaaaaaaacataaagtgaaccaaattaatatattcactcaacaaatagcttacacagaggtagcttttagagggaatggtgatcctaaccctcaagtggtttaccatgcaaaagccattacatataaaggattactaaagaaaatagtaacaggagatgaagtaaatttacagaggcataagaattataagatgcacgggtcttatttaaaggttgctggtgttagagtaggtaggcagccatgagcaaggcaagagagctccaattcacccccaggaatgtcaggcaaccatcagaagatggtcaggccgttatcacactgtctctctaaaataatagttggttgtagacagtgccaaaaaaaaaggcagtctcccgatacatagaaaacacgtgaagctggtggtgattttaaggtcctctgagctggccgcaccatcgtcaagccattatgacattcccccgcctttctgataatgtactttgtgatattcccatccttgtgaatgtattttgtaacattcctccccgctcttgtgacaatacaccctccccgcccttgtgaatgtactttgtaacattctcccagcccttgagaatgtactttgtaacatccatcccctgcccgcaaaaaattgctcctgactccaccgcctatgccaaacctgtaagaaccaatgataatcccaccaccctttactgactcctttctcagactcagcccacttgcgcccaagtgaataaagagccttgctgctcacactaagcctgctcaggcggtctcttatacagacatgcctaacagtgatcagcagcttcccaaaaagatctcaggagttgagcgagtgggctcaagcatgcacactaagaggcaaaatggcggggtttgactggtatctgacctacctctaggaacactgaacaggtaagagaaaaacagctcttgtgagcatgcatgtaacttcagtaaacacactgcacttgtggcccctcccaagtgctggcaggccactgagtatgtgaacagcccactccaaaggaagaacctggggaaaagaaatgcaaacctcagaacaaagacaatatgtaaaaaccccaagacaagagtcagatggaatactcggatctctcaagtcacctacttggccctcttccaagtatatttctttttgtttctgctctaaaatcttttaataaactttcactcccgctgcaaaacttgcctcagtctctatcttatgcccctcagcagaattatttccattgaggaggcaagaattgagttgctacaggagttactaaagattttgagcaagcaggtaacaatctgagtggtgtggtggaagataccctacaaatgtgcttaattaccaaatacacattttctattccctgtcctcttcttgttaacacatgcaagcacacttcacatacttatgtgaagataagtattgaaaatcctgatttcacgaaacaggtgggcatgagttcagttatggttatcaaacaagatgcgatgttggctaggaagcttgtgggaagatttcagagaaaaggcaatagtagtgtgaagagatagattccctctgctctgacttctccccttgttaagcattttcccatatgccccaagaatactctccactgatgcttgcagctacagcatttaccctgagataactttgtgaaaatatcttgcttttattattatttacacattgctctagcatattcacttcggaaacaaaagacatcattctatttacagcattctatttctactagtggtattttcatttacaaaaatatagtgattcttgatcgctgaaaatttcaaatcctggaaaacataggatttctactcatgatgctaacatcattagggaactgctattggctgaagattcattggaagaatccgatttttccaaaacagatgattctgatgactcatataattctgatgtttgttctgattagaaataaccctaagagcagtttttatattgtattttcatattgaaagtcagatttgcttctacctcaaagaatgtttatgtaaaaattaaatgagtgctgatggtgagctgtccccttttgtttttctaaatgagaaaggagtgaaaccaaaataggcaactatccagcttgagaatatatgaatatatgagattatgaatccttgtttaagccacacttaatcaggttctctaatccttatgtttgaaattgtgtgtaactgttgcatacttcataactattatgttttataggttattggggcacagagaacgattctccaaagtatagagctttggtctgatgagcatttcgaattaaattaaattggaagtccctacatcttcctcagatacaagaactttttaatctcttgttcttcttgcccacctccacctgaagccctgaaaggaactttggaatttccttatctgaccaggaaactcctttccatagaaatgaaattgtcttaaaaccccctttctaggaacctaatcaattgaccagaaaagattaaccactagagaaaagaaaagacaaaatatcaccaccgtacccggataggctttgtatctatttttctgagggcagcacagagagagactgcctgggagactttatctatataataagaccatcgttgtttacagtgcagttttgcccctcattttcctttaacttgcttatcccattcagttttttaaataaaatcgtttaaaagataatgtctgcctcctggttccatttatttcctctaaaaattatttactatccactctaaaattgcctagagacccaactttcatctcccttatgactggggtattagtttaatttttacttaattaatttagatactgggtcttgctttgttttacaggctagaacgcagtggctcaatcatagctcactgaaacctcaaactcctgggctcaagctatcttcccaccttacctcctgagcatctaagcctaatggtacatgccacaatgcctggctaatttttattttgtattttttttttttttttgtagaaacaagatctcactatgttgcccaggctagtctcaaatttttagcctcaactggccctcccaccttagtctcacagagacctaggattacaggcagaagcctccgtgcctagcctgaagagggcatttaatccccaactatgtggcccttcttttgggtctcatatttgtgggtctcccatgtcaatgtgcatgttaataggtttgtaggcctttttttctgtctattctgtctattgtcagttcatttcagcagtgaaccttcagcagataaagggccttagccacaagagatttttttttttttttttttttcagacgcagtctcactctgtctcccaaactggagtgcagtggcctgatctcggctcactgcaagttccacctcttgggttcacaccattctcccacctcagcctcccaagtagctgggactacaggtgcccaccaccacgcctggctaattttttgtatttttagtagagacggggtttcaccattcacaggatggtctctatctcctgacctcgttatccgcctgcctcggcctcccaaagtgctgggattacaggcgtgagccactgctcccagcaggatcaagtgattttacaatgatttatgcagagtaaataaataaaagtttgaatgaatcttgtcagttgttcatgagaggggtaatggaattaggagtgagaatgtaacatcagttgaatttttcaaataattggctaaacactagaagagaaggaaaagggaaatatgaagctaacactgacattcagaatgtgtctgaccaagacaggtgacattccatgatcagggacaggaaatcagaagggaaaatggtgactttgatactggatataaatttgaggttggagcaaaacattcaggaggttggaaattatcaaatacatatcaagtggcagttaacaatagaagcatttatgtaaattcaataacagagttgaagtacacttggcccacatgggtttgaactgtgtgagttcacatatatgtggattttttccaataaaagttataccaagtgtgcctgcctctcctgcctacccttccacctccccttcctcctgcacctcctcttcaggctactcagtgtaaagatgaagatgaagaaccctatcatgatctacttccaggttaaaaaaaaaaaaaaaagcaaatatattttttcttccacacgatagttttaagaagcattttattttgtttaggttactttattgtaagaatatatactacatagactatacaaaatatgtgttaatcaactgcttgtgttattgataaggctttcagtcaatgtagacaaaatagccttctattgaaaaaggatgccatctagcactctgatggcaaaaaaggagacgtcaatacctggcttcaaagcttcaaaggactggtttactctcttgttaagggctaatgcagctggtgaccataggttgaatccaatgctgatttaccatactgaaaatcctagggcccttaataattatgttaaatctactctgtcggtgctctagaaataaaacaacaaagactggatgacagcaaaactttaccacatggttgatggaatattttaagttacttgttgaaacctattgctcagaagaaaaaaaaaaaaagatttcgtttaaaatactattgctcattgacaatgcacatagtaacctaaagagctctctgatgaaggtataaaggatatcaatgtttttatgcctgctaacacaatatccatactgcaacccatgaatcaagtagtaattttgactctcaggtcttattgttaaacaaatacatcttttaaagctgtagctgccatagatagtgactcttctgatggatctgggcaaagtaaatcaaacaccatctggaaaggattcagcattctagatgccagtaagaacatttgtgattcatgggaggaagtcaaaatagcaacattaaaagcagttcgcggccaggtgcactcgctcacgtctgtaatcccaacactttgggaggcctagacgggagaatcacttgaggtcaggagtttgagaccagcttgaacaacatggtgaaactccatctgtactaaaaatacaaaaattagctgggcatggtggtgcacacctataattccagctactcaggaggctgaggcaagagagccgagattgtgacatagtacctcagcctgcgcaacaagaatgaactctgtctcaaaataaatcaataaaagcagttagcaagagattgagtctaaccttcatggatggctttgaagggttcaggaacgcagtgaaagaagaaactacagatgtggtagaaatgcaagagaactagaactacaagtggagcctgaagatgggacagcattgccaaaatctcatgatgaaactttaacaaatgagaagttgcttcttaaggatgagcaaagaaagtgggccaggcgcggtggctcaggcctgtaatcccagcactttgggaggccgaggtgggcggatcatgaggtcaggagatcgagaccatcctggctgacacggtgaagccccatctctactaaaaatataaaaaattagccaggtgtggtggcaggcgcctgtagtcccagctactcagaaggctgaggcagaagaacggtgtgaacacaggaggtggagtttgcagtgagctgagaccaggccactgcactccagcctgggtgacagagcgagactccatctcaaaaacaaaacaaaaaatggtttattgcagtggaacctactcctgatgaagatgctgtggatattgttgaaatgacaacaaaatattagaacattacataaacctagttaataaagcagtgatagagtttgaggggattgactctaattgtgaaagaagtcctattgtggataaaattctatcaaacaacattgtatgctacatagaaatctttcaggacaggaagagtcaatcaacgtggcaaactttactgttatcttaaaaaaatgcaccagctacttccaccttcagcaattaccaccctgatcagttagcagccatcaacattgaggcaagacgcttcataagcaaaaagattacaactcactgaaggctcatataattgttagcagtttttagcaacaagttaatttttaatgaaggtatatgcatttttttttagacatatgctatttcacacttcatagaccacagtatagtataaacgtaacttttatatttatgggaaaccaaaaattttgtatcactcacttcatagtgatgtttgctttatggtgatatactggaactgaacctgtaatacctcaaaggtatgcctgtaataagtccttgccaatcaataattgctttaattgtaaacagatgaaattatccaatcaagaaatacaaagtgacttagtggatttgaaaaaaaaaaagttgcagcaatatgctccctgtgagagactaactttagctttaaggtcacacataggctaaaagcgaagggacagaaaaagatattccatggaaatggtaaccaaaaggaagcagtagtacttatatgagacaaaatagactttcagtcaaaatctgtcacaaaaaaagtcactatataatgataaaggaatcaattcatcaaaaggatgtaacaattgtaaatatacatgtactctatattggagcacctaaatatgtaaagaaaatataaacaggactgaaaggaaaaatagtaagggatttcaataatggatatatcatccagacagaaaatcaataaggaaacagcagacttgactaacactatatcaaatggaccttggagacatatgcagaaaatgccatttaagaaaagcagaagacacattcttctcaagtgtacgcagaatattctccagggtatattgtgttagactgtaaatctgagcaaatttaagaggactgaaattatatcaaatatcttaaaagatacttgttatcatatttggtaagattggtatcaatccagtggtaagaaactagaagtctataagaggagaaaataggaaaattcacaaatatgtggaaagtaaacaacacactcttaatgcaatcaatgggccaaagaagaaatcaaaaagtataaggagacaaatgaaaaagaaaaagacaacatgcaaaaatgtataagacgcagtacaagaagtcctaagagggaagttcatagtgacaaatgcttacatttattaataataaagatctcaaataagcaacctaattttacatctgaagaaactagaaaaagaacaaactaaataaacccagaattagcagaaagaaaataatgaagattagagcataaatgaaatggatactagaaagacaattaaaatgatcaacaaaactgagagtttctaaagaaaaacaaaattgataaacctttagcaaaaatagaacaaaagacagagctcaataaattagaaatgaaagagaagatctaagaacttatgccatagtaatacaaaagattatagcaggttattaacaatacaccaataaattggatagcctagaagaaattaataaattccaagtagcatatagcctactagaactgagtaatgaagaaatagaaaatataaatagactaataatgatcatgcaaaggtttgaagcacttatgaaaatctcccaaaaagaaaagtctggggcaaaacgtcctcacgaatgaattcaaccaaatatttaagtgattaaaagcagtccttttcaaacttttctaaaaatttgaaaagggaatacttctaaactcattttaaaaggtcagaattaccctcataccaaacccagataaagatgcgaaaagaaaattatagaccaacatttctgatgcacatagatgtaaaaatcctcaacaaaatattagcaaatttaattcatcatcactttaaaaggatcattcacaatgatcaattgggatttatcccttgcaaatgggtcattcaccataatcaagtgggatttatctctgggctgaaagatggttcaacatatgcaagtcaataagttttgtacactacactaacagaatgaaggataaatatcacatgatctcaatagatgcagaaaatgaatttgataaaatttattatctttccatgataaaactctgaagaatttaggtgtagaagacatgtaaatcaacataataaaagccacatgtgacaagccaaaagtaaacattagactcaatgatgaaaagttgaaaggttttcttttaagatcgggaccaagacaaatgtgtctctcttaccacttctattcgatgtaataacgtcctaacctgagcaattaggtaagaaagaaaaaaaaaaaagcatccaaatcagaaaggaggaagccaaagtatttgtttgaaaatgacttcattttatatagataaaaccctcaaccccccactataaaaccgttagaataaatgatttcagtaaagttttgtgatacaaaatcaacataaaaaatcgtgttgcatttttatacactaacaattaactatctgagaacaaaattaagaaaacaatcccatttgcaataacttcagaaaggataaaatacttatgaataaatttaaccaaggaggtagaagatctgtacaatgaaaactgtcaaacagtggtgaaataaattgaagaagacacaagtaaataaaatgttcaaatgtccatactacctcaaacaatctacaggttccacgcaatccctaccaaattccaatagcatttttcacagaaataaaaaatacaattctaaaatgtatatgaaaccatgaacgctccaaataccaaagtgactttttttttttttttttttttcgatacagaatttcactctgtcacatgggctggagtacagtggcacgatcacggttcactgcagcctcaacctcctgggctcaagcgatcctttcacctcagcctcttgagtagctgggactacaggtgcacgccaccacacctgactaatttttatatggtctcaaactcctgggctcaagtgcttcacccacctcagcctcccaaagtgttcgtaaagcctcccaaactacaagtaattttgagtaaaaacaacaaagcttgatgcactacatttcctgaattcaaactatattacaaagctatagtaataaaaaatatgatattggcataaaaacagacacatagactaatggatcagaatagagagcccatactcatgcgtacatacattgtccacatataaggtcggctaatctttgatgagagtgccaaggattcacaatggagaaaggacagtatcttcaataaatggtgcctggaaaactggatattcacagacaaaggaatgaaactggacacttaacttacatagtacacaaacattaaatcaaaatagattaaatacttaaatatgagaactaaagctataaaactaaaaggaaacgtagagaaaagtctccttgaaattgatctgggaaatgatttttttagatgacaccgaaagcaaagtcaacaaaagcaaaaataaaccagtggtctatatcaaagtaaaaatcttctacacagcaaaggaaacaataaacaaaatgtaaagaaatcctacagactgggaaaatgcaatccttatatgcttccattatgctaagtgaaataagccagatacagcaagatacatatagtgatgtatgatatcacttatatgtggaatctaaaaagtcgaactctgaaaagcagagagtagaatggttgattttagcggatggaaggaggtaggggatggggcatgagagtatgttggtcaaagagtccagacttataagacgaataagttctggggatttaatgtatgacatggtgactgtagttagtaacactgtattttttacttaagattttctaagaaagatgctaagtccaagatactaagtgttctcaccacacatacacaaatggtagctatgtgaggtgaacttttttaagtgaaagtgtggagatttattgcaaagcgaaagtacacactgaagaaagggacatgcaggtgtactcaagagtcactgcaaggaatgtttcaataagcatggttgtggtcatcattttacaatatattcacctatcatatcaccatatactacaccttaaattatatgtaatttttatttaatttattcttcaataaagctggaaaacaaaatatttgttttcttggctagtctgaaagaagcagacaattttcatgtttaaagttctaacatgttttatgctaaacaaattttttccgttaaagaaatataaatcaatatattcaaacctagaaaactacttataataaagacctataatgtatattgccacattaaaacaaacaaaaatcatcttttattggaaagatcaaccacattatcgatttaataaatagccttatgttccacacaaataagctatctaatgcatcataattgctaaagtgctttggtacatttacataaatctcactatttgaacaatataatttgaataatatatttgaatatttgaataatatagttgaatatatatttgaacaatatatttgaataatatattgaacaatataatactttcctgttaacatatttaaagtaatattttcccctcaaatgccttatgagcttaaaaaagatggaaaaagggaagaccttttgcgtattctgaagcctataaacacgtagcttaaacttttctgggatgccttaccccaaaatatcactgtggctaaaccactatcatcaataaaagtcatgcataaggtgcattcctttagtaatagatagtgaactggaaaaaaaatccttcaatagtaagagctggatctctcttatcctatgcatgaaatgttaatcaccattacactaaggtgagaacaaaaatcacaagatactaataataataaagaaaaaaaagtttgttttttcttagtggaacaattaatagaaaataaggattctttaactgaagattattattttatatacgtaactacagcattagaaaacataatcaggaagctgtaaataagtaaattaccagctgtcaaaaaaattatcactatcaaattaaatgagcttcccctaggcaagctaagattgcttttgcctgaaggctggctcaaaaatgaatcatgagggagacaagtcatataaataaaacaaattttaaattaatcatgactgtgtagactaacttgaaaaataaatcttaaaactcattgctaaatcttttaacaactaactacaacgattagggactactgtaaaccagactaaatatgcctcaatgaactctgatttgtttttagattaacatacttatataatattaacttagatagtatacatgtcattcctgtaggtcagagtaagggatgactttcaacacgaaaagtggaagtaagttggttatttatagatatttaataaactacaagttaactatttatttccactttgactaactactcaaaaattgcttcaaatatgtctttagaggccaaatctaaaagaaatatatttcttctcatcctgtcaagtttacttttgtcctgtatttacacagataggtccataaaaaactgaatgtaaaatactgatgacagttaattttgtttctttcatcttatttacattatttttgtccacccattgtccacagggaataaaacaaacgggctaaggggttaggggtcttctgtgatgattacagagagaaaaacaaagaggataactgtcctgatacaagggtgccttgaaagcacatcagatgctttagcagtgtcaaaaagtcacaggcttttaaaagtgttaaagaaatttaaaattagccccttgtgtctcacggaaaccagaagagctgtgcctgccattgtggagctagttagcaagatcaatgtacaggatactccaccattttaaggactcctatgaggcattttaggtatagagtcaaaatgttgatctcctgagggactttcttcaatccaattccaagggctgatcttggggaaagaagttaatatgttgtatgtaactttggttctctcacagtggcttatgtttggatatgatacttatttagctgataatccatctaaatgccctctgagtatcactgacatggagaatgacaaggatttagaaataatatgtatttttaatgggacccacaccaacaagaagtgtcagacctaaagaaatcggtctttaaatggtgaaatctccaaaattgcagtaatgtacgctgttctatatcccctagacaatattacatagctgccaatgtgtaaaatcaaactttttaaagcctggtgagggaggtaagcctttttatcagctgagcatttcagccttgtgtttcttctgctcattaaccaagctggtgtgacaagtaagggaatacaactcctagatgctatgtttcctcttaattacagaggttccagaaacattatttagtttatgagtaatgttgatgttactaggagaaataatatataagtagaaatgtaggtagggaaggacagagagagatagaaagaggcagacgatttaggaaaactacattgtgattgtgattgccattagaccaatactaacaaacattattattccagtaaagaaaatgggtcgggcgtggtggctcatgcctgtaatcccagcactttgggaggccgagatgggtggaccacgaggtcaggagttcgaagtcaccctggctgacatggtgaaatccagtctctactaaaaatacaaaaagtagctgggtgtagtggtgtgcgcctgtaatcccagctactcgggaggctgaggctggaaaattgcttgaaactgggaggtagaggtttcagtgagccaagattgtggcactgcactccagcctgggcaacagagcaagacactgtctcaaaaaaaaaaaaaaaaaaaaaaagttcgtatgtatgtctttcaattattttattgtaatagctgacaaagatttatcattttctcatttaaatgtaaagcacttcaccaacatgttttacttgatcctgagatactgtcgaaatgttccctgataggtagcatatatttgaataatgcagtcccacatcatgatctactgagcttgctggggctttggaaggctggaggcagagattggtaaggaacactgacttcagcctctccctgcccctcataacttctctccaatgtgaggaagtgtcttcattgatgttgagtttggctggagtatcggcagaaattacaggtctctataacgatttattacaggtctctataactatttatttttaaaggcttttacagtataaattcctccagaatgagatgaagccccaaatgaactttggcggaggtttaataagaattgcactttgcagatttgatatgattcacctttggtttaaggacataagcctaatgataattaatttctactgcatatattgctgtaatacataacttacttctgtgaagtttttattgaaataacttttttcagcttttattttagcttcatagggtacatgtgcaggtttgttacctgtgtacgttgtgtgatgctgaggattggggtacgaatgatcctatcacccaggtactgagcatagtccccaacggttagtttttcatcccttgtccccctccctctttccctcttctagtagtccccagattctattgttgccattttcatgtccatgagcatccgacacttagctcccacttatgagtgagaacatgttcctgcaccaatttgcttaggataatggcctccagcacagccatgttgctgcaaaggacacaatttttttttcttttatggctatgcagtattcatggtatatatgtaccacattttctttgttcagtccattgttgatggacacatagattgattccatatctttgctattgtgaatagcactgcaatgaaaatgcgagtacgtgtctttttggtagaacagtttgctttggatatataccaagtaacaggattgctgggttgtatgatagtcctgttctatgttctttgagaagtctccaaattgctttccgcagtggctgaagtaatttatattcttaccaacagtgtataagcattcccttgaaaccacaccttgctaccatttgttgttttttgacttcttagtaataaccattctgattggtgcatacggtatctcattatggttttcatttgcagttctctgatgatcagtaaggttgagcatttttttcagatgtttgtttaccgctcatatgtcttcttttaaaaagtgtctgttcttatattttgcccatttttaaaatggggctgtttttggttgttcaattgtttcagttccttgtagattgtgaatattaggcctttgttggatgcatgggttgtaaacattttctctcattttgtatgttgtctgtttactctgttgctagtacatttgttatgcagaagctctttagtttaattaggttccacttgtcaatttttgttgttgttgcaattgcttttgagggcttagtcataaattctttcccaaggcccctgtacagaatggcatttcctaggttttcttctaggattcttgtggtttgaggtcttacatttaaatctttaatccatcttgagttaattttacatatggcaaaaggtaggagtccagtttcattcttctacatgtggctaaccagtatcccagtactatttattaaataggcagtcccttccccattgcttatttttgtcagcttcattgtatatcagatggcctgtaggtgtgtggctttatttctgggttctctattctgttccattgatttatgtgtctgtttttgtaccagtaccatgctgttttggctactatggacttgcagcatagtttgaaactgggtaatgtaatgcctctgtccttgttctttttgttcaggattgctttggctattttttggttccatatgaattttagaatagttttcttttttctagttccatgaaacatgttggtagtttgataggaatagcactgaatctgtatattgcttcgggcagtatgtccattttaatgacattgattatttcaatccatgagcataaattttttcccatttgtgtcatctatgttttctgttaagtatttttgtgtgtatacgtggctactataaatggtgttgcattcttgatttggctctcaacttgaaggttattagtgtgtaaaaatgctaccaatttttgtaacattgattttgtaccctgaaactttactgaagtcagtattttgagacatttaaccactgaaatgtcaaatgtaattgaattttatggcttcttggggtatgtggtagggtggaagggattgtacacacatttgtgtgtggctttccctctagtcaacttttagcctacctggaccaatacatccattatgtttggaaagctttcaaaacttacctgaatattccctagatatgtagttatataaagactgtcatgttttgtatagagaatcagagaggctgaagagaaaatatataagatatagataaatatcataatgattattgcataggctattctctcttcttgtaatgtgttttcttcctatgcataaaaatactgatattgttgccacacgtatttttaagcatttgtatctattattaaatgtagcattatcaatagccctctgaaataggttactattattattcaaattttactgaagactttgagagataactacattggccaataccacatagataataagcagtaaagcaaggatttgaatttaaatatgcttacaacttttcacttaaaacttccaaaaataaaggacatgcatgtgcatgcctgtatatgtatgtgtgcatgactgaatactttccttgatttatgacatatatatttataatatttatatatatttatatatattaaattttgtaggataagataattcaaatctgtgactgaagtcttattcagctctgtggtagtaaatatcaccttatctgtacatttgccaaaggcatcatgtccaaaaatcattataactgtaaatttatcacataaactcacttgaaaattggccttataaatatagatagaataggctggatgtggtggctcactcctgtatttttcgcactttgggaggctgaggtgggtggatcatgaggtcaagagatcaagaccatcctggccaacatggtgaaaccccttctctactaaaagtacaaaagttagctgggcatggtggtgcatgcctgtagttccagctactatggaggctgaggcaggagaatcacttgaacctgggaggcgtaagttgcagtgagccaagatcacaccactgcattccagcctggtgacagagcaggactccatctcaaaaaatatataatatatacataatatataatatatacataatatacaatatatatgtaatatatacataatatatacagaacatataatatatatgtaatatatacataatatattatatatagttaaaataaccaactacaaatagtatcatatcatccatttatttttttcctttcttcttgttaaattatttgtaatgttattttttaaagatattctggcttattaaatatttttaaacttacagtcaaaacatatcttcataacagaaaataatcacaacctacacgtactacagattgagaatcactaatccaaaattctgaaagctaaaatgctccaaaatatgcaattttttgagtgctgacatgacctcatgtgacgattctcagcgaaataataatagatgctggtgaggatgtggagaaaagggaatgctcatacactgttggtgggaatgtaagtcaacgcagtcactatgaaaaacagaatggtacgtccacagaaaagttaaaaatagtactaccatttattccagcaatcccaccattgcattcttatccaaaagaaagaaaatcagtatactgaagaggtttctacactctccaatttattgcagcactattcacaatagccaatatatggaatcaaaatatgtgtccatcaatggatggacagataaagaaaatgtggtacatatacatacattcggccattcttgcattgctataaagaaatacctgagactgggtaatttataaagaaaagaggtaatcagttcatagttctgcaggctttataggaagcacagtgcctccatctgcctggcttctgggaaggcctcaggaagcttacaatcatgatggaaggcaaagggggagcaggcacatcacatggtgaaaataggagcaagagagaaagagtgagggcggagatgacacgtacttttaaatgaccagatctcgtgagaacttactattgcaaagacagcacaagcctggagggatctgtccccatgacccaaacacctcccactaggccccatctccagcattggggattacaattgaacatgagatttggctagggacaaatatccaaactataccaatatactatatgatattattcagccataaaaaagaataagatcctatcatttgaaacaacatgaatggaactagagaaaattatgttaaatgaaataatccagttacagaaagacaaatatcacatgttctcactcatatgtgtgagttaaaaaatttgatgtcatggaggtagagagtagaataatgactaccagaggctaggaattatagtgggtgataaagagggatgggtccaaaaatacagtcagatagaagaaataaaatctagtgttcagtagcacaataggacagctataatgaccataatgtattgtatatttcaaaataattagaggagcaaatctgaaatgttcccaacacaaagaaacaataaatgtttgagataatgaatatctcaattatgttgatttgatcattacacattttatgtttgtatcaaaatatcacatgtaccccataaatatgtacaactattatgcattcataaaaatgtaaaaatgaaaagaaatgcagtcaactcttagtttcatgcacaaaattattaaaaatattatataaaattatcttcagtctataaagcatataagaatgataaatgaattttttgtttagacctggacccttagcaaaggtatctcattatgtatttgcaagttatcaaaaaaaaaattcagaaatccaaaacatttctcaagccaggaattttggattagaaatactcaacctgcatctttatttatccttagtcttttcccaaatgtactatttctactttcttcattacttatgactgaaatttattttatattaaactacataatttctgaatagaatttgacatagcacagtatttttcacatgctgtttacttgagaactaaataatttttgtcatacctaccattcatactacaatttgcttaatgctttgtgtgctttattacatgaatacagctttatattacttctgtaataaaatatataaagttttactgttatgaattaactgtaaaaattaatacagcaaaaacccaagcatattaataataaattatggttagatcactttgtgagtatgagacctagtctttcttacaaagaaaacaactggaacatatttcagttgtaaaagatattctagtatcaaaacatgtttttattgttaggaatcagaaaaactgaaaaattaaacaggtaataactttctcaatatgtgatttaaatttactgagatgattttgtgagtcttcaatacaagttgtattaatgatcatttaaaatcttgcctggtaagacaaagctcatcacaaaatacaaactgctctataccagtattcatgtccaggcacaaaaatgaaaggcccagataaaactgtgaattaagacaaagcatataaagtgggctctggtaccagatgatctggttttgaatcctcactggtacttactagctgtgaaatcttgcacaattgaactaatccatctgagtgtcagtttcttatttgttagtagccatttatgctcagttcctaaatccattaattaatgtctagtttcaaatgtgatcatctgatactgcagtttttatgttatttatttgatgaaatacttttatataatgagacaattcccctatctgccattttgtttcttctcagtggtagagttcatataggaaagacagaataaatgcttgattttaattttatttactagttttcaaaataaagatttaagagcttctcaacctctgaaatatatttaaatatacattggcaggtaggaagaaagagaaagaaagagagagagaaagagacaaagaaagagacaaagagacacagagagagacacagagagacagagagagagagacagagagagaaagagagagagaaagaaaaagggagaaaggaggaagaaagaaagagaaagagagaaagaaagagaccgagagacagagagaaagacagacagaaacagacaggtaggcagtcagtgcatatagacactgcatactgtagtctctgacttttaaccattacttagctttatttctgtgagtaatcacattttaaatgttcaccattaactagttgtctgaagcttattctacggggtattctcagggaaaacttaaagaaacgatggagtacaatgataacaggttttctgtgcccttaacaactcaaagttcctttttctgaatataacctttttggttcacgtaactctcattttctttcttcatgtatctccattatgttaccacattttcttcaaaaattgggtttatatttttaaaattataatttttcttccttttattagtcaatttattcttttccataggtgtccaaatgacacatttattcttttttctttaagatctattattttattataatatttcttggtactaataattccaggttgatatccttaagtacatgaaattagattatctttcaatacatagcttccaatatcagcaggaaattattcatgatcataattttgagttatctgttctgctctcttttatttgtttttcttcttcagggactcctgcttgtatgttggtcttccttgtgtatctttaatatttattaatttgtctttaatagtttttacgtctttctacacttttctttttactttctaaaatatgacttcctttaactttttcttagtgcttcatccatcaggtatatttgtttgctcttatcttctttctagttcagtcttcatttctgaaatgattttcttttatctatatttctttcctgagctccatcagctcctttctgagattttctaatactgattaatgttgctcattattgtttacttttactggttgcctttcaattatttaaaaaaaatacaattttgaagtattttgaaggcagactttactggctagattttattttcagtcatatggttattttgagtatgaaattagctaatccagagacagtaccattataaagtaatttatcaaaaaatagagactttcagttcctcaaatagccattattgattataaaatgatggaaaagtagatgtatacatattctgctatttggtactcatagtatacttagtgtccttagtagtgatattctcttataaaactttaagcaagatgtgtaattttcaaacacttttttaaaaagatcttttgcaaagagggacaatttgacttcttcatgattatgtatctagaaaaccccattgtctcagcccaaaatctccttaagctaataagcaacttcagcaaagtctcaggatacaaaatcaatgtgcaaaaattgcaagcattcttatacaccaataacagacaaacagccaaatcatgagtgaactcacattcacaattacttcaaagaaaataaaatatctaggaatccaacttacaagggatgtgaaggacctcttcaaggagaactacaaatcactgctcaatgaaataaatgaggatacaaacaaatggaagaacattccatgctcatggataagaagaatcaatatcgtgaaaatggccatactgcccaaggtaattgacagactcaatgccatcctccccatcaagctaccaatgactttcttcacagaattggaaaaaactactttaaagttcatatggaaccaaaaaagagcccacattgccaagtcaatcctaagccaaaagaacaaagctggaggcatcacactacctgacctcaaactatcctacaaggctgcagtcaccaaaacagcatggtactggtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacactttatacaaaaattaattcaagatggattaaagacttaaatgttagacctaaaaccgtaaaaaccctagaagaaaacctaggcaataccattcaggacacaggcatgggcaaggacttcatgtctaaaacaccaaaaacaatggcaacaaaagccaaaactgataaacgggatctaattaaactaaagagcttctgcacagcaaaagaaactatcatcagaatgaacagaaaacctacagaatgggagaaaatgtttgcaatctactcatctgacaaagggctaatatctagaatctacaaagaactcaaacaaatttacaagaaaaaaacaaccccatcaacaagtgggtgaaggatatgaacagacacttgtcaacagaagacaattatgcagccaaaagacacatgaaaaaatgctcatcatcactggccatcagagaaatgcaaatcaaaaccacaatgagatacaatctcacaccagttagaatggcgatcgttaaaaagtcaggaaacaacaggtgctggagaggatgtggagaaataggaacacttttacactgttggtgggactgtaaactagctcaacccttgtggaagtcagtgtggcgattcctcagggatctagaactagaaataacatttgacccagccatcccattactgagtatatacccaaaggattataaatcatgctgctataaagacacatacacacgcatgtttattgtggcactattcacaatagcaaagacttggaaccaacccaaatgtccaacaatgatagactggattaagaaaatgtggcacatatacatcatggaatactatgcagccataaaaaaggatgagttcaagtcctttgtaaggacatggatgaaactggaaatcattctcagtaaactatcacaaggacaaaaaaccaaacactgcatgttctcactcataggtgggaattgaacaatgagaacacatggacacaggaaggggaacatcacacaccggggtctgttgtgaggtgtggggagaggggagggatagcattaggagatatacttaatgttaaatgacaacttaatgggtgaagcacaccaacagggcacatgtatacatatgtaacaaacctacacgttgtgcacgtgtaccataaaacttaaagtataataataaaagatcttttgctaatttacttcctaatgaaaatctaaaggtaagaacctaagcaggattttttttttttttactttgcttgtagttagttactttaccttccaacaatcaatataactacttgaagtagtgtttataccatcatctagttattggtaattaaaagcatttcatgctagaaagaagataaccacaaaatgtattagatggtgctcacttccatttaactctatctttatatatgctgtttcaattgaaatttttgctgtaaatgtagacttacataaatttaaaattgtaaggaaacattatcttgcagatttatcctgcctaatacatctgaaatgagttgatacaaattattattttactactgatgcatcctgatgtttaaatgaatgaggtatagcggggaataaaaaatttaaacatattttacatttatctatgactttgctatttatatttataaggcatactaaagaatattacgtagaacattgtattaaaagttaggaaagatgaattcaaattggtgttgacatatttctataaactggtagcatgtataacataagaatacctacagtgatgttcgtcttctgaatgtttacagataatctaaaaatacctatcttttgatttctactaatctataagaactgatctgtgataaatatatcaaataaaacaagtccatatttattcatgggtattaagcttttatagtgaaatctgtaataaatgtatacaagcacaggtgttgtggaattcattttgttctgattttaatatcccaattcctctggctttaatgtggtcaaatgatgatcctagagaaaaattcctaaaataatatttgtaatctttgttacagaaagattttaaatatatggatggctatttggcagtatgttacctattattttgatacgcagttagccacaaaatcaatgtgacatgtttttccatatacaggataacattaaccaaaaccactacattaaatgaggctcaattttagacactgaatgtttcagctgcagattacaattctttattttttctttatttttagctcagaaaggaaatctggcagacaatagacttggaaattactttcaactatagaaacctacattatcattattattacttttaagagatccattgttttgaaagaatattctgtcatcaagcatttgctactatttctattatgtttataaaatttttgagcccctacaaataatcatagaactcatattcatttaacaaatttttactgagtgcttacaatagagtagactttcttttgcatgcttatctgttaaagtatagcagaaggttaatagttccatgtggtatcaactaaaagcctcagcaagttttcctaaacattcatctctatttcttggcattattaagtaaaaataatattgttttataattttattttaaaaattcatatatatctttttacttaaaactttaataatatttgtgtggcttttgtgaatccaaagtaaaaaagtaaaattaatcaaatatttttaaaaagttttattactactgatagagtatctttcaaatgtctatttgaaatatatttttcacttataaatttatcttcatggccacatcccattttttatttgcctttttatttgttttcatttcattttaaaatgattgttcagatcactatttgtcaacatagaaaatatacctgatatttgttaaatggggtgaagggaagcagcttataaaagattacataaagtatgatcctatttttgatagataatcatatgtacatttaccttgttttcatgactcctagcattgtaacatctttatgatttaaaaacttgttaattttattaatcaaatgagaagtagagttcacttccaactatggaagtcaacaaagggaacagagcttcctcttctcatgtactgcagctagcacctgagtgtgttagccaagatcattcataatctttgcatattgacagactggcacaaataaatcaggacaatataatattgaaagactggcagtgaaatggtgtgaagtccactgatgtggtatcaacagagtagtcttaagcagactttcaaggcaggtccttagctgtgaccccattacaaactcttctatttctagccttgttttcaaaatctatccaatatattccttttctacttaattatttttttttactgtttcttagaatcaaaattgtccaacgtaaaatgtattgtaggtatcagaccctcaagaatatgcaagaactctggatttgttagctgactgcattaggattggagacagggaattttcattaacaatttaagaaaggaatcctaaattgcatgcattttagcatggaaggtgaaatgccttatttattatagcctatggtcacccagtagaagcaaagcttcagggtgtagcactgatgtcgtcattaagcactatgaaggttaagaggaatttaatgacagcatggttgagtaggtatgttaaaatgcactggatagcataaatacagtgaacgacacacacttctaaattctctgctaaaggaacagactgaaacctagagacattttttgacattgcttaaagcatctcctatctcttttagcctcaggctgaggtaaccaaaatacaaaagcaaaattaaatcctattacttatgatttttaatgtcagctgaattcacaaggttactacattttttagatgagagagtatgagtttggaaagagttataccctgaaattgaaatgggaataccccaatcatctaaagtttctgctctcccttaactgacaagtacccttttataacttgtctgatagggttgctcatcgtaagattgaagatgatgatattctttttcctgtaggagttgacttgcaacagaaagtcagtaatccacatgcttgctaaccaactacctctcaatgttctttacctgtattatcagattccagcataacctgaagagctgattacaggctgaagcattttatctatagacaaactgcgtaatttccctaatttatatcatcaataaggaattttgaaaatcagtaaatctttggcttctaatgttatttcaccaaggtggagggatgtatttttagatcaggttcaatttattaatatggatacatttgccagagtttctatattctttatgctaatttgaatctctggatgatgcaatagatttcttggctggttggcaaaaatgtggacccaaccgcgaatctcattaagtggcatttcaatgtcagacattactgggtatgccatagaataaggaatccaaaatgttgagtaaatggaaatgttggagatgacattttatgtctttaacctaccattctctccctaaaaacacctctccagtatataagggtaataacttgcctataatcttgaaaaatgcataagtgagccaagctggtgttgtgacatgtgctattttgaagactatcaagctagtgaaaaacaccgtagttgaaaacaaaccatttattttaatgggaagtagatcttggagtagcagacgaaagagtatctacaatgaagtaccagaagcaaagtagacaatgcatagcaggcaacacagcctgctaagaaaatacccctatctatagggatggatatctgaagatatgtaactgtgtatttttcaggaccaaaataatagataattcattaaagttctatatagcagatattactgatggactatgtaacagtcatagtcatttactgttccatgttaacagaactctaattattttcaggtacatagcatgcctaaaaattaatttatgtgtcctccctcatccgacaaaaatgtggatatctaagtgactttggttacctcattcatacttctagggtaatttaggtttgggggtctgtgataaaattatgaaacataagagagaacttccaggacttcctggaaaggaagcttttaaaaagagtttttaaaataaatgcaaggaagacatagacactttcctatcagtggaacataacctctctggatgatgcctagaactgcagcagccatccagtgatgatgaggcaactagccaatggaccaggattacatgctgactgtagcagagcaaaaatatacaaagactcctcaatgagtttttgtaggaattcaattaaagaatgggaagctttttttctatgtttttttttttcccatatgagagaggaaaaaaagtccttattgttttagaaattttaagtaatattattttatacttgtgggaaaataattccaggcctgttttgctggaagaaagatgctttactggagccaaaatggtagaaattcatggttcctctaataatacctgacaaacatagaacctctgtaatgaagagaaggggcaaggccaggtaatagcaatacagatatatttctaaggaacaaaataactagacaatctgttaagggttctatcaggggacctgccccgataatcacataggttttctattttccaaagcgtcgactggcttgagaaataaaaggacagagtacaaaagagataaattttaaagctgggcatccgggggaaacatcatacattggtaggatccgtgatgccccacaagccacaaaaaccagcaagtttttattagggagtttcaaaaggggagggagtatacgaataggtgtgggtgacagacatcaagtacttaacagggtaatagaatatcacaaggcaagtggaggcagggcgagatcacaggaccacaggaccgaggcgaaattaaaattgctaatgaagtttcgggcaccattgtcattgataacatcttatcaggagacagggttttgagatcaaccggtctgaccaaaatttattaggcgggaatttcctcttcctaataagcgtgggagtgctatgggagactggagtttatttcacctctgcagtctcaaccataagagacaggtacgctccggagaggggggcagttcagagacctacccctaggtgcacattctctttctcagggacgttccatgctgagaaaaagaattcagcaatatttctcccatttgcttttgaaagaagagaaatatggctctgttctgcccggctcaccggtggtcagagcttaaggttatgtctcttattccctgaacaactgctgttatcctgttcttttttcaggatgtccacatttcatattgctcaaacacacatgctgtataatttttgtagttaacgcaattattacagggtcctggaacgatatacatcctcctcaactgacaggattaagagattgaagtaaagacaggcataggaaatcacaaggttattgactggggaagtgataagtgtccatgaaatctttacaatttatgtttagagattgcagtaaagacaggcataagaaattacaaaagtattaatttggggaactaatatatgtccataaaatcttcacaatccacgttcttctgccatggcttcagccggtccctctgtttggggtccctgacttcccacaacagggttctaaatcacaggtactactattggactatgtaacagtcattcactgtatgtagtgtggaaatttatcataatctccatgctatgaaaaaagaaaaaagcccagatctaccatggattattgcatagtggctctgattgacattagcattaactgttgagaaccctgaactccacaaattcaccaatcagggtgaaagtttatagtggtcaggtgaagttttgcccccaaatttgcctcataatcagcccagtgagatctccaattcaccctgtgtttattctaccagttcctaagtatgcatttggaaaagataacagccaccagcaggattattttactggtccatcagtttctgaaataagtactagtttggcaggaaggagcaacccaaagcctctggggtcatttcttattcaaacagttaataaaaattaattgcatatctctaggaagggtaaaacattagtacagccacctaagattttaaaaacctaggatggtgattcctattgcatcctcatttaattgtccatttgggttagtgaagatagctgctaaagagggacactagattagcatatatttaattgattggtgataacagttagagttccagatgtggtttctttcctggagcaaaaactgtgtcctctggtcaaagtaaataaatattaacctaacaggtacttttgttttttttttgttccatcccagataagagcagattcactttgttttatctggtagcaagagagtacttctaccaccttcctttattgttatatagtagatagggtacttagttacataatcatccaaaagggcataaacttttctactatttgatggcatcatattgctagtaccaaagcagcaaggattatatcctagatatctaaatttaatacatagtgttagtacaaaatacaagtatctgcaatttcagttatatttctgcggatccactaatcttggctccagcaggataatacattccaaaatgaaggccacttgtgcctctgccatgagataaccatacaacccctgagacttttttttacattttggattcaataaacagtacatttagttatatagatatgatccattaatcagttacctgaaaggatgccacttttgaagaaggctcagagcaaaagaaggctttctaacttgtaaaggtggcagtgcaagaatctctgttattaagaagatacagtgatgtacattgtattgttggcacactggaatagagtatgcggaaagaaagaaactcccaaatgagaattaaactggagacaaatggggtttgaaacaaattcatgccttctttagcaagcagctcatcttcttttgacaaatagctcttggcctgcactggaatttgacagagtctgagtatgaaaatacctaatgacaggacagaagatgacattgtgaccataccaaagtaagtatttcctgatctacttcattctgaaggtcagagtgaccagcacaggactccatcataacacaggagtggaatcaactgaaggaatgagataagcagatggcacacattctcaatcttagtgccaccctcctgccatattgtaatcccttctataataatcttatggagagtagtcaatcatcattcagtgagaagaaaatgctggtgccagttttacaataagtgatgaatgatattctaccactagatggaaattactcttatagaattacactatcagttttctttgaaagactataaaaagaggctaattcttctagtacaaggaacttttaaaagtgtatgttactgctcacatctttctggaagagatgatggcctaaagcaaaaatctacactaaatcatgggcagagcccaatggtttggacaaatgtttaaggaaatgggaatatcaagagtccaggattagtaacaaggcagctcgtggaagaaacatatggaaggacatcctagagtagccccagaatgtgagcatatgagtgctccatgtacaagttaacttaaggcttatttgaatacttccagaatggaggaaacttttaatatcatgtagacaatatcaggtaaacaagacgatctgctcagtggatctcagaagctctcattctctaatctctgatgggactgctgaatgggctcattacccacgtggtcatagtagcagtaacagagattaatgcaaaccctcaaaaatttgaactttctcttaccaaatctcgcctgactactaccactgataaatgccaaatttgccaataatagatatcagcattctagtttatggggtgactgaacttaaaattgtagtttattgggtggttgaacctgaaagtaatatcaatcctcttcaaaggatgcagagagtaacatagagaaaaactgtgtgcttctatggagcattctttcacacagcatagactacgtgggtaaacatcctggttccactacttactacctgtgtgaatttgagcaagttatataaactctataaaataaggaagaaaacttacctatgtctcagggttgttaaatgacttactatatgtaaaacacttagagcagtgacagatatatagcaaataccatgtaatggttcaataaatagaaaactaccatatcaagaggtagataaattaatagattataacatgactgttatacctctttcaagattgaatgtgtggggcacaccagttggtaaaaagcctcacctatgtgtggtattaattgaagataaacataagtgaatgcatgaaaactaattatatccttataggtgcagaaatgaggtctatagtagctctacatacattcttttccctatgttatgtgtattagagtaaatattcacttcactttccccaatgtttagccaatttttgtgtattaagtatgtgtgtggtggtaaattttcaatgtagctcccagtttgcaagataatgagatggatcataataaatgagaaaagaaatgggcatcatccaggaataccgtagctgacactaggtgagtgatgaaaatatgggactattcttttgagaggatggtttaatgagagatagttacaatatctaacacaggagcagtgataagaaagatggatgtagctattgcatggctaatgttctagaaccaattgcattttagtcaataaccaaattttaggttctcttttccttttggaagccttccccattgtattaatcttgatgggaagtaggtccagtgtcgcatataaaagtcaaaagggccatatagctgaagatagaggggtatgttttaggtttaagcaaccagtctttgatttgcttttgacttttgatggggtaaagcaaagacctagtttcttggggaaattaatctaggcacatatgaaaatgtcaaaggccctgcagtgtcagtgacatgaggggagtggctgtaataacagtggtagcatcctaaccagactggtatgactttggctgtgttttctgttctctgtccttgctgcatttttttattcttttattttattattattatactttaagttttagggtacatgtgcacaatgtgcaggttagttacatatgtatacatgtgccatgttggtgcgctgcacccattaactcgtcatttagcattaggtatatctcctaatgttatccctccccactcccccaaccccacaacagtccccagagtatgatgttccccttcctgtgtccatgtgttctcattgctcaattcccaccaatgagtgagaacacacggtgtttggttttgtgtccttgcgatagtttactgagaatgatgatttccagtttcatccatgtccctacaaaggacatgaactcatcattttttatggccgcctagtattccatggtgtatttgtgccacattttcttaatccagtctatcattgttggacatttgggttggttccaagtctttgctattgtgaatagtgctgcaataaacataggtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagattgtatctcattgtggttttgatttgcatttctctgatggccagtgatggtgagcattttttcatgtgttttttggctgcataaatgtcttcttttgagaagtgtctgttcatgtccttcacccactttttaattgggttgcttttttcttgtaaatttgtttgagttcattgtagattctggatattagccctttgtcagatgagtaggttgtgaaaattttctcccatttttttaggttgcctgttcactctgatggtagtttcttttgctgtgcagaaactctttagtttaattagatcccatttatcaattttggcttttgttgccattgcttttggtgttttagacatgaagtccttgcccatgcctatgtcctgaatggtaatgcctaggttttcttctaggatttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttttgagggctctgtgctgttccattgatctatatctctgttttggtaccagtaccatgctgttttggttactgtagccttgtagtatagtgttggaagttctggccaggacaattaggcaggagaaggaaatacagggtattcaattaggaaaagaggaagtcaaattgtccctgtttgcagatgacatgattgtatatctagaaaaccccattgtctcagcccaaaatctccttaagctgataagcaaattcagcaaagtctcaggatacaaaatcaatgtacaaaaatcacaagcattcttacacaccaataacagacaaacagagagggaaatcatgagggaactcccattcacaattgcttcaaagagaataaaatacctaggaatccaacttacaagggacatgaaggacctcttcaaggagaactacaaaccactgctcaatgaaataaaagaggatacaaacaaatggaagaacattccatgttcatgggtaggaagaatcaatatcgtgaaaatggccatactgcccaaggtaatttacagattcaatgccatccccatcaagctaccaatgactttcttcacagaattggaaaaaacgactttaaagttcgtatggaaccaaaaaagagcccgcatcgccaagtcagtcctaagctaaaagaacaaagctggaggcatcacgctacctgatttcaaacttgctgcatttttttaagaagcctcgatctctaatctccccaatatccttctttctgttgctggtaatcaataaatctaatatttatttaaacatatattgatatgcatttttaaacacacacacacacaagttgaaaatttgtatatataaatagtactaaaaataacgaaaagtcatacatccaaatactaacagtagttagagtgattcaattttatggttggtttttattattattatttattatttttctgagacagagtctcgctctgtcacccaggctgaagtgcagtggtgtgatctcagctcactgcaacttccacctcccgggttcaagtgattctcctgtcgcagccttccaagtacctggcattacaggcactcaccaccacgcccagctaatttttgcattttttgtagagatggggttttaaactcctggcctcaagcgatcctcccacctcctaaagtgctgcatgagccactatggctggcctgtattttcttattttttctagtatattacttttaaatttagttaaggaaaacacaaatttaatcagatttgaaaaatagactttgtttttttccagttgttgaaacattatccttcagtcttcaagttaaactttttcagagggtataaaacaaagtaaatacgtaaatgtgatttgcctaataatggcatgcctgagtttattcttacattatgtttggtcatttcattggagtaaggagccaaaagtaaaataaaattataaaattgtattagaaaaacaaaatagtgaatcggaaagaaatgggaagggaattagctgggcgtggtggcgcgtgcctgtagtcccagctactcaggaggctgaggcaggagaatcgcttgaacacgggaggcagagcttgcattgagccaagatggcaccactgcactccagcctggcgacagagcaagactccgtttcaaaaaaaaaaaaaaaaaaaaaaaaaaaaaaaaaaaaaacagaaaggggaagggaaatacactggaatgcaatctatgtatgtatttatttatatttcttccaatttggtttggtgataaatataaggagttcaatttttatattcagcagatcctgggatctgtactgttcttaaatagagatggacaataaactgtgagtgatggtgaataaaggaccactgagctagatccaaacaccatgctttagcaggaagttgttgtgaggggagctgaagctgcactggatttagagaaaattatctttgtacaacaaagtgtttttgtctatttttcttgttaaatttgagctgaatatattttaaaggttgcctaaaatatttaccagtaaaaatatctaaattattttgcatcgtcggaatcatactgggggataggagtagtggtagtggggttaacagaaataataagggtacgtaatgtacatattggtatacataagtataatacacacacaaaaaagttgaagtgtaatgggctgatgaatcactgagtcttgcgtttattcataatttctcttactagctatataacttgtgcaagttacttttttttctaagtcttctgttcctgatgttaaaataagcaaaataactatgttactctttgatttgggataagtagtacatgagataatccatgaagaaaatgtatgccagttcatgacaaaaagtaggagtacaataaattttagttagtattatttttacatatttctgttattagaatatatacgctagaacatggacctagcgatagaacggcccttagaaagcatttgtttcatttcctttgcaccattaaagatgaagttgttagcactggagatagcaagtagttacttaaggttcacatatttttagtggtaaaactaaaaatagaatctgactttcctgaatcttaccttgtatttttctctatctggtatctcttggcttctcagatttctgtacaaatgcataacccatacacacatgccataaggacattcatgtaccttaggttaaatactagcataaatatttacactgcatttgtaaaatcttaagaaatatctgttggatttttcttcttagaattgttagttccttaaatatgttggaaagtacacataagtactcatgttaaaaacatttttttttatctttgctaggacaaggaagtaggataaatatttaatatgtctatgaacaactatacatgtttaatattgggaaaaattgcttattttttctgctgaaatagctaaaggaggatatttttggatgtatatatacatatttatacactcatctatattttaaatcatgagtgaaaactaagaagaatattgagaatttatgcttaaattttttcttttacaaggcttttcaagtctgcttctttggaaccaacacacttatggttgtctttttagattaattatgaagggcaatgattcaaaacacaaaaaactcaaagtctactgaaggagagcattttttttttttttttttttttttgtcatggacaccaagaaggaaaactctagtatggtgctgtgtagtaacactgtaggatttttccatttcatctttcctaagtgaaaagtgggattaaatccatgataatattgatagctattaaccaaagctattaattcaagtgggctttaagaaataaataagaaggaagaaagagagtgtgggagggaagaaaaaagaaatatttgggaacaaaaaagagagactagatgtcagtattaattataaaactagtatcgttgttaaaacctgatattctgattatgaagaaaactgtcctttaagtaacataccagttaaaaactaatcaactatctaaaaaagttgttttttttttttttcttttccccccagatcattgcttcattggctttaccttggacaggattcatcagtgttgtgcttcatacaccaggtggtggcccacacagtccacatgatgtggaagaaaagggaatgtctttttacgtattttatttgatcttcagtggatttttttttgcatgtttcatactgaacataattagaacagtagtacttgtgatattctataagtaaaataatgtatcagggtactcatgtaaaactttctatacggttgtatatataagttgtttagagatcactagtctacactgtaaggcaggagttagcaaactatggcccttggaccaattcaacatctaacacttgtgttcataaataaggttttattggaacacagctatgtttgaatattttccataaaggattttgggctataatgtcagagttaagttgttacaacagaaaccttatggcttctagaccttcaaatatttattccctaggcatttacagaaaaagtctgctactcactgttctaaagagacaagaattcaggtcaaagttgtttgtagacaaggcggaaatcataatatcgcttagggacttggttccgggctttataaatagttgttacaccttgaaattttctcagctaacaaaaaaaggtgcaaatgtatcacatttttttttagccataaatgctaagcacactttctgtctgtttctcaaattaggccttttctttattgctaaaggttaatgaccttggccaagttacttatatactctaaaccttagtttacctatataagaaaattaaaataaataatatcttataaggttttataagaattataatacctgcatgtgtcccaaatttgcaaaatgagccctcagtaaatgataaatgcctctccacccacacattttgacaggatatatctcatgtaggtttgactttaataaaagtaacagcaatagatgaatatttctcgatctttgaaaacacatatattaaactttgtttatataaattgtatatctagaaaatcaacataagcaaaaatatgtataaaaacaagatataaattgctgattaaataatattaaaatgaaaaccgaaatttaaatagaggtacaggaaaactgtggctgatcttcaatggttgttaactgattgatggaatttagctaggattttagccagttatcttatcgaatagaccatgacaacatggctcagtttgtgggcttaagattcattggggaagagcttcactacatttaatggttttaattagaaacatatacctatgtatatgtcttcaaatacaggtgttctagtgctgtagttccagtgccataggcttcatttcaaccatgttctttgggtactttaatgactttggattttgttaataaaatcctatattcttaatgaaagtagcaattgatttttttcattgtttactgccttaattttattgttttttgtctagctttcactttcttgaattaaaattttaattgacaaagactgaatatattcaagtttaatgtgatttttatacacacactttctgtaataattatcacaaacacatccatcatcacccatgctgtacattagatcataatgccactagacatcatgctaagtgaaataagccagaaacagaaagactaatactacatgatctaatttatataggaaactttaaaaagtcaaactcaaagaaacagagtaggatgatggctgcccgggctgaggtgtggggtaaatgagatcttgatcaaagggaacaattgatttttatctttataatcctaatatctgcctgggtgcctagaaaatattaaattccaagtaaatatttatagcataaacaaaaaataaaaggaattgatatgacatattaattagaaaaataggggagaaaggacaaaatagtccctcataactacgacaaattacaccaattaacagttattagctttatttattatttatcttttagtgatcagtattatattgtataaataaatctcattaactagaatttgtttaggacacaagttcctagcagaaaaatccaggagttttagaatacttaaaacttgttattgaggtgagcatctggaatgttcaaaatttaaaaagtgtcagaatttgtggcattttattttataaactgaaaaacaaataaataaaagaaattcccaggcttgttagcacagaaaacttgtaacacagacattgtgttataacttggacggtctattttaagtctatatgcaagttaccaactttaaatatgttttttaataaaccactgaaatactgtatgtatatatatactgctatatatatatagctatatatagagcaatatatatatatatattgctctatatatatagctatatatatactgctatatatattgctctatatatagagcaatatatatatatattgctctatatatagagcaatatatatatatatattgctctatatatatagctatatatatactgctatatatatatatatatagcaatagtgatcttaacaattctatttagaaacctatttcagtattttcaaagagaaaagagagaaagggatatattacaaagtcaaaaatgcttatctgacataacttgaatgatcttgtccacaaaagactttggcagtgtccataaggcacacatttgaaggcaaggaccaccagggcatagattagacctagtgatctacagaggacaccccttaagtgaattatagaagctcatgagcatatacgtgtgtgtgtttgagggtgaggtggggggcatcaattcatgttaaatttgagctgttttcaatacctaaggacttctgatatggctagagactccaaatcatagggtccttcagttagtggtgatattcaaaatcatgtcctattctctaagatatgttggattgaggcaggtctaaacaataaacttgaggtagaaagaatctacccatactcgaaaaaagtcctcagcaagaggacgtgaaatcaatcatatgagagaaaatctaaaatgctaagcacagacaagacaaagtaaatcataatgttaattttatggactcagtatgcaaacctggcaatagctagcagaaggctgcaattaaatagctaactggttgtcagttatggagctattcccagctccatgtccagaggaagttaatgacatacacctggagcagagaaggagcagagtaactcaaagaaaaagcaacagtttgatgctcttcattaccaacaactgggaggaactaaggcgggcaggatattaatctacttttgtcttgagaaagagtaattcctagtgttatacaaattatgtagctaggcatggaaagtaactttctatttttaatattagctatttatcagttatctaaacgttaaataggtaatatgcttcctccctccccaagcaagatattttatttctccatttaacattgtattgttcttacccaaatcacccctagattgtagatctttacacctgtgcataaagcactgcagcaagggatatttcacaaactcagtaccctacagcattcccaatcaaaattacttgtcatctccaatgctatgctcagttttcacaaaatttatccaaagtctaggtaagaaatcagacttgtgacaagtaagcaactttcatatgaagatacatagctacactctcgagactttatctttagagaaattaagcccttaaaactactataaataattgtttctaaatatgtaaatcaagttattataaaataaattcttttcaggtaacttagctcatgagagtgaaattctttcaacatatagcaatcatgggtatcaaaacatggtgtacataaagagttaccagacgagtttgcagctaggtggactatgtcaaggagttctggttttgtattgtgaagacagagcatggaaacttatttttaagaaagctacccagcttgttattctgccaaacaccaactaaaccaaatgaaagaaaaatgaaactgaaaggtattagtgctgacactgcttggacagcataaatgaaacattgagagctggaggaaggaggatttccttttgattgactaaaaactgccaaaatcaactttgaaggaagttatgtttaagcccacaggagaattaaagagagtaggggattatgataaaggttttatcttgaacagaactggagtgactgtactgtgatgtgtaaaactagcagggagaatatcatgccataaaatatatatttttttgagtatgccagaaaaaaataaagcatccagacattcaagtaattaggtttttcttctgaatagttttagttttaaaatattaaattgccaagtaaaatttttctttaacttaaatactcttaagtagaacgaataactaaatgtagttctaaatgtcctttcagagtggttaaaattaagccctgtttttctttgtccctgtacatgattaaaaataaacaaccaaatcacatttggctctataccccaaaagtgattactttgttattttcacttcaatgggacacatactatcatccataagaaattactgatgtgttctatggtattttgaaaataaatacaatgtatttttactcatgagtaccatctgcaggatttcaagcatgtcaaatattttgatacttcaggaaattttatacaattgatgctatatttttccgagaaatgacttaaatgactgattatgaaatatctacccagtttaatttgcactaacttttgaaaataacgtccctgttctctggacctaatatgcacagtcaccccactttttcaccaatgccccctaggtttgtcatattcttgccactttacaggaaaacaaaacaaaccttactagttagctaagtactctcaacccattattccattccttctgtttctgtggtagctttccaggcagggccaagtcttcttgtcatgctgttgctcttgaccaggaaacctaattatcccagacttaccagaactatctggtgcctgtgaagttatttcggagcattaaaagaggagctggtagggctgtcggtggagctgagccctcaggctgggaaatgaaagtgctttgcctttccactgatccagctgagatacctgcctgtaggtgatgtacatcacactttttaaaaaaggcagatccacgtgatgaagctacatcctgctagaacagcccccagcaagaagtgccagaaaacgaaaatcacacaaaggcagtggcagtccatgtgattcacaagcagcattgaagacttttctcataagaaaagacttgtgaataagtcagatgagctgagatgccaaattgagagcactggaaagggggaaatctttaaaagggcctctaaacagctgtaacacgcttcagagttttctattttctgtctgatctttatactgacctcatgaattaacccatagattttacattgtaattttcagaggcactagctgtaaagccacagattccccagtactgcttctgttatgttcatttatatcaacacatgtccccttaatgctatatcttagcttgggggttgtaaataaagaaacatggccactagaccatatgcttcctgagggccagaaatgcatttcaaaagtagaatcaaaatcacgtaaaatgatggtaaatgcttagatgtgtatagaaaagaacaaatagggataatgacatttatccattaataagcatttacatggcttatttcgtttaattctcataactcaaaaggaaagtgatgagaagactgagactttaagaattgaagaccttgtccaatatgacagcctttaagtggtagatccaagcttgaaactcaagctttctaccccagaaagctgtgccttcaatctatattttctatgtattcagtaacacatgttaaagagatttagaagaaaatatatcacacaaaatagataaatatcaaatatatccttacatcttcatcattttaatacaaaaacaattttcaaaagtgtgctcatgtagacagaacccattacagcctcatttccctttcttgtaagaaaaaaactaatagctatttgatcttcaagatgcctaagtattaaatgtaaatcaattgcctcaataacatactttaaatttctttaaaaatcaattaataaaaaatgagcactttggtaatttctaattaataacatatttattgaataatccaacatacttcctaaacagacacagagaaatgtctgagcacgtccagttacccgaaaaacagggtgtgtctatgtatttggatggtcacttaaatacatagacacaccctgttttaccctatgtttttaaatacatagacacagggtggtcacttaaaaaataaagttgttgatttactttccgttcaaagttgcagtaaaggaaacagttattggggaaattggttccctgggctactcacaatgaattccagcagatcccaaaggatcacgctgtagagagagaatgtacaagctgtataaggagagctttaggaaggaaacacatgtctgaatttattctagaagacaggtagtaaaagaaaaataaagcaattaacccaggcatcaaataaaaaaaaattgagaagattctgattatcaatgctctctttcagtttttacacaaaagctactgattaactttacctgtgctagtttggctaaatgagaacagaaagtcaagatattactatattcttaaatttatatatagaagtctgatggtgatgctattgtccattccaagttttgaaaagaatgatgatgagccaggaaaaggaaagaatttccaggattaacataatgaactgttgtgaatcattctagatttcaagtagaagcacatttatgtaaggtgtgattgctaagctcttgactggcattttaatatcttagttcatgatcttcagatgtcagtccccactgaatcagtgctaaggaaatactagctgtgtgctaatttgagtggacttttgcatccagctgatgccccactccaaaccagaaagcctctaagaatcaaatcaaaatcttcaaatgcttttcctgaacacaggaaaacattgaaactgtagtagttaggtacactttagggattaacatagtaaaagtcaaggaagagcatggtcctacagcggaataagatctgttaactcagctcctagttcagagcagtcatcaagataatgtgaaaataaatgcatagagagatggcattgataaacaccagagccggatcatgcttgcgtagtgaactcacgaacagagtagttacccagatattccaaatcaacaaacaccagcccgtcacaccccagatccaccacccaaatcacttagatttaactttagaccaaaaagttaccactgaaaggtatttatttcttcaaggatgtaaaaagctgaattttagcctttctttttgaatactgaaacgctaatctttcctgtgatgctttgtgggtttcagacgcattctaaacttgaggcttgggagatcagaagtcatgctggagacaggaaagaattctggctcatcatatagtaaagaagtggagttaacatgtaaatgtttgttcttgttattattagtagtattgctattgtcctggttttctacttagttaactgattggatagatgactgaaacaccacatatacatgagcttaagcaacattttctggagtcatgtgatgaatttcagataattcataactaaaacaaaaattaaatggaaggggaagagaatatttaatatttcatttttatatttttaaatagacaaattaaaattgtatatatagtgtaaatgatgatgtaaaatatatagaatactatggaatgatgaaatcaagctaagtaaattatgtattgtatcacatatttgttttttattgtgagaacacttaaaatctactctctaagcaattttcaagtataaaacacattgttattaactgtagtcactatgttgtcctacatatttttgaatttataccttctaaccaaaatattatatcctttgaccaactctgctaacctcctccacctaccaccaccactctccactgataatcaccattttactctctgcttctatgaatttgaccttttcttgactaaggagagatttaatcttaagcaaaaggctttggaaaatgttaaacaaagctacaatgattatctttggaaccagaaagaccttagttgccacctgctagctatgtgattttagacaaaattatttaacctaacttcagattctttatctgcaaattggggatcacaatacctaaaagttataagcttatttaaggatgaaatgaaattgtgaagttaaagtacagtgcttagcatacaataaactttctatgttgttctatattcttctctactattttaatagaaataatataagcaaaagtagaattagtattacaggcattatcaaaagtgtctctgagtgaaacttgtctcctgagggttaatgcagtatcgtattgctgactgcgagattcaaagtttaaggtgaactgctctcgtcaggccagccttggcatggcagcttctacacagaaataactgttatatctgttccattgagtcaatggaggatcaattatatcttctagaatgtacattataaagatttaaatattgcctctttttgttttggttcaagtgaagttacaacaagtactgcagggcctaaagattcacattcttcaagcaactatctgcatgataatattgaattacattatttacaaaaggtgtaaatataaagttagtgcaggtacttttgtaggatgtatctataatatgtattcatttataatttcactgggttagctgggcgttgtggtgcacacctatagtccccattatgtgggaagctgaggcagaaggatcacttgaacgcaggaggtaaaggctacagttagccatgtttgcaccactgcattccaacctggacaacacagcgagaccctgtctcaattaaaaacaacaacaactaagtataatttcactgggcacatatgtgtttgttgcttcttacaaatcattgtcataataagaaccatgatcccttactgttaacattgacaacatcattgtcataaaagaaatcacaaagtctatgagctatttatattcactgaaaatgttaacagacttgcaaattaagttctgtgaagtccccgatttcagatttaacatggaaatttctcttcctgaagtacagaatatagtatataactcttctcatctgcagagcattgaacagagaccagacatataaaacaagggaagatcgatgcattaaaatgttctcggaaagagataagaaaaattatatggccaactgaatctaattaaaaaaaaaatttgtttttgaaatgaaatatggaatgaaaaggatttttgcaaaaataaaatttacagaagaaagtagaagaatcttccttagggaagagatgatgagagcagttgatctaaaatcagaattttgaataaaaaattctgtaggccaagacattgaaaaacaatttttttgttagctattattcccatcaatacgaaagctacccagacataaaagaatgtggaactaggataaatgctagtagcagacaaaaactattagatatggagattaagaaaaaaaagaataaaagtcatttttcctattttaacatatatttaatgaaaataattaaaaggtaaagtgagaaacctgctatagtgtctagagttatatagaaatatgctcaggttaattatataaaaactagatataattatcactccctcatatagatttgataattttcatataatcctttatattgtctttataaataagataaagattattccttttttcttttaaacttttaaagtaacaattaccaaattttattcaacatttattgtgtatcagacatgatgctagcagaggcaagatttcatttattctaaattatactatgagatagatacaattgtttttctattcttcaaataatattacaaaactccagggaagtttagtggtttctctaatcacataagatatgcataaatctacacaatagcagatcaagtaggggctcttgatctgtgcactatacctgagtgaatcagctggatatctaatggtgttccacaaacaaggttttggttcccagcagtgagcacactaaataggatcacccttatagcatcatgtacaacacttcacatggtctaattctatgctctccatagaggtaccatacattatttaagtcacatattatttaaatgtaccctatgacatagaagacctctagtctcggcagaaggagtgctaaatattttctgtaaaggggcagatagtaaatatcttagccttttcaggacaaacaggctttattgcaagtactcaactctatggttataagcagcataggagctatagacaacatggaaacaactgaacatgggtgtgttacagtatagttttatttatagatactaaaattcaagtttcatataattcttatgtcataaaacattcttcttggttttttctcagccatttacaaatgtagaacaacattcttgtttcaggaccatatgaaaacaggcaatggacctgatttgactcacagacaatatatagtttgctaatgcctagctctacagtgattcggttcttagtggtagtggcttatgcaactgtgtattattgtgtattaatatttttaagggttttttttgttgttttttggtttttttttagatggagtgtcactctgttgccaggctggagtgcggtggtactatctcaggtcgctgcaacctctccctcccaggttcaagcaattctcctgcctcagcctcctgagtagttgggactacaggtgcacagcactacacccagctaatgtttgtatttttagtagagacggggtttcaccatgttggccaggatggtctcaatggtctcaatttcttgacctcatgatccgcccgcctcagcctcccaaagtgctgagattataggcgtgagccaccacgccagcccagttatttttaaaatgaataacacataattgtacatatttaatggggcacaatgtgatgtttccatctgtgtatacactgtgtaataatcaaatcaaggtatttagcagattcatcaccttaaacatttatcatttctttgtgatgagaacattcaaaaacctctcttctagctagttaaaaatatacattatcattaactctattcatcacaccatgcaacagaacatcaccacttactcctcctatctaattgtagtcttgtaaccattgacagatctcataaaatcctctattactctaacctgctatttacattaaatgttaagctttaatttactattttgtgcaatctttttaaggtactatgcagctttgagatgatacaattaattatacctatatggcacaagttaagcaacccatggtcatatagggaacaagacagagcttatctttaaaactaacttgtatttgccataattagaatttaatcataggtcctggaatcaaggaaaaaagcattgggaatttcttctgcatttgacagagtgagggttgggaaatatttatcctatgaatcatataaagtttgtcaaggagtaacttacaagattcccaagaatcttttctcagaaaaaaaagatatctaatttttttctcagaaaaaaaaagatatctaatcttttctcagaagatttctactggtatatataaatttaactaccacagataaatttattatcattttttgtacttctcttattctttcaagaaatgatgcccaccatatttttacttgtttttgattacttatctaaattgttatttgaattataatccagttttttttaaatccctttcaacttcatcttttcagcaaagccagtacccccagaaaaccagcaaaaacaaaaacagaatatctgaccttttgctaattttgacagtgtttctgggtgtaattgtaccttttgctataactatggataatactcaaaaacttccaggagacaccagtagcactaactttagtttattcccacaactggaccaacaaattgaggaatttgggatacttttatactaagctttaaaattaatggaagaaacatgatacattattttgtcaaatggccataaaatgaagcaaaatcaacaaatcctataacaacaacatattttcaagctttccccatagccgatggtggctttgcagacatctaagtgattcaacattggagttgtcctgatcaacctactgtcatcattcagtgttggctttaagtccaagtcaaggtagcctttcttcttttacaagagcaaagggtatataatgttttactttttaacttacagcagctaaaatgaaacattacaggaaggaaatttaaaaaaggaaaagccaaaggatctatgactttcatttatacaaagctttgaagtattcaatatatggtaacaaacttctccccagctgaacttcacaggaacgctgagtaaaacaaaggggaggagctccttctaaaatagcagaggctctctctactttgccacatcatagctgatcataagaaacaaaaaggagaggctagaattgaataaagagaatactacttgaagtactaggaaattaaaacctactttaaaagtaaagcaggatattttcctgatccttttcgtgggaattgtgagggtgcctcatttcctcaacctgccgctctcaacaatttgacggagggagcgcacaagtaaacaaagcgggaactggagtgcagaagcactggaaccagccagccgcttccgcacctgcaggagtgaactccacccctccaggaggcaacacgcaggagagtgggtgcaggagccagggcgaacacttttgggagctgggaggagcaaactttgtgcgggccccatggcaagtccaggagggatgccttcaactcctgaagccccagagggcatgttagggctttttagctctgcagtccatggacggctttaagcgctagcagctcagtgggtcatctgccttttcatgtgaggcagctgctctctaccggtgagggtaaaggggccagtgtgacagcatcctgtatcctcacttgtggctccagaactcttgtccagcatccaggaaaaatgagatcgcaagaatgagtggaagaatggtaaatgcaggggattttattgctgatgaaagtggccctcagtgggaaggggagctgagaaagggataaggtgggtaggtaatcttcacctgaagtccggccatctgcggcaggattattctctgaagttgcaccgtcaagctgtccctctgaagtcaagccgcttctgacatccagctgtagtccctgacatccagccactcttcctctctgccagatgagcttagggtctttataggcacaggatggtgcagggctgggccatgggtggtttacgaaaaggcaacatttgagtggggaaacgggatagaagttctcactttgagccacggtctcagggtttttggcttgagggtagggcttcaccagggacccatccttttctgcctagaatttctcttcctcctgtctctatcaaaagtacagtaacaaaaagaaatgcatccagtgtatgaagcaaagtaatggaatcttcattcctcaagattaacaagaatggcaagaggagtaaagccaaaagacaggatctcaaggtatgaaatgggatgagtgacaattcccagcaatcagagaggaaatgaattgttaaaaaaaaagaagaaaatttaccaaaaaaaaaaaattattgtgaaaacctttggtgggaatttgttatagaatctgttaaagctgtcccaattttctgatggaccctgcagcagcgggatacttttctcagctgaacttaactctctgtattcccccttctttcttgaatggatgcccccatggaaaatggtgttgcttgatgggactggaagacctctattgataagtgagctgagaaggagaaaggaatgtacaaggataaaatgtaaaatagaaatttagaaaaataagctagaataaaatgtgaattaggtcacttaaaaatgggaaatgaaagcagtggttattcttaatggaccaatgtattatttttcctctttttgacctctcaagatcagctgtgagccttggaagtaggcactttggttacagccctcaaagccatagctttgtgcgggccccggggcagcataaagacattaatcctcaactttgtggaaactgtacttagtttcaatccatttgcctagttgttactatgattgtttatgtcacaatttcaaatgctttgccctcaatgtctggcattcgaaatggaatgaaggccattttcatgtttttgtctttcccctaatggtagctttctcaagttctcaaaattctctgagttcttgttaccagggtgtgaagcatcattctgctacttccaatttgacttggcatatattagggaggatggagaagagaacaacaattcattggaatggagccctgagtaagttaaatgcttcctgaataaatgtgcagtatctctttcccaggcctaggtaattgcttttttatttatctcaaaccattttcatcctctcctatagcctaatagagtcactctctgcacacggtgcatttctatcacagaagctcacaggatgctggctctgctgataataaataaataaataaaatcatggagtccatattacagctagtggaagctgaagttttacatttatatattaaattaaaatgctttctgcccatattatacaaaatgtaaatggtagttaagtcaggcagcagacagaagttggctactttttgagcagagatgtcttaaatgtctgtttcagggcaaacactcctcacggaccacacagatatttattaagaagctaatatggctgtgctcattctaatcacatttagtatttgtcttctgaaagagtataagtctggttgaagaaagagaacattaatatcttttaaatgagcatagttgattaatactctacttttttcataaagtaaatgaaaaaaattcaaatggaaagaaataattttaagtgagtgaaaagtgaagatatgaagaatgcattatcatgctataatgaaccattatctatgtcaaaagattcactccttaacaccaatcagaacttgatactcttttcctttaaccagacattcaggaactgtgctatatagtctgtgcaattgttttagtgaatagagagccacaggccctgaattataaaaatacattttagtaatgataaatctttttcatcattaaaatacggattatttcatgatgctctggaagccctataactaaaagacaattgctagtagcagacaaatgtggacaataaatatgatggcaccaaatatttttgctttgtatttagccagcataatggaaacatatctgattttagagacacaaacacctttccagaaaatagtgcctgtgacttcaaacctgcttcaaccttctctgctctcaaatttggtgcataatgactgttctagttaaacaaatatttgggatagcatttaatctatcgatgaagaatgacaaacacctggcaaatgtgccaacattctcacattctactctcagaagagacacaactaattcattatggcaccttttccaccaagccaataattgcacgcagatgactcagaacatgaagcagcagttagccattggtccgtgtctcagtttcttaattattagtataggtaaacaaacttctggcttacagggttgtatataaaattaagaatgatataatgaaaaatgtattctaaaaatctagttagtataatcttattttacagatagagaaaataaagccaaaacaggtaagtgatttacccaaatcaacagttacttttagacccaaatcaacagttatttgtagttcagaaaaggtccctggggaaaaaattaatccaacccatccatttcacagatatggaaactggaactcagagcagaaaactttgcccaagaacaggcatcacctctcatactgatacggtttggctctgtgcccccacccaaatctcatctcgaataggaatccccacctgtctagggagggacctattgggaggtgattggatgatgagggcagttttcctcatgctgttctcgtgacagtgagttctcaaaaaagggctgatgattttaaagtgcagcactcccccatgctcacacgcacactctctctcttctactgccttgtgaagaaggtacctgcttcccctttgccttctgccgtgattgtaagtttcctgatgcttccccagccatgtagaactagaagttaatgaaacttcttttgcttataaattacccagtctcaggtaagtatctttatagtagtgtgaaaacagactaatacccataccaatcacaatcaattgcaacagcttcctggactattggtgttgaggaagattctaaagttgagtctgagcctaatggaaaataatgccttggtcaaccaataatttgtcttagctttgtttgtgggtaaggacgggcagaagaaaacatgctatatgttatgcattatttaacatccttatcctgagccaaattgcaccaaaataagtttataataatgatttagattcccacataactccccccaccttcaaggagagaatgctcttgtcatatttgtataaatattctagctcataggaaagtaatatttgtcaatagctataaataagctggtattctgatttaatacaacaattctgtgaacttagttaatgctcctgagatctagtctcatactgctgacaaatttaaatttctgagtcttcaagtttcaaggtcagactctggaatacggtatccttaccaaagtaatttgttttgggggaagccagctgactttctccttataacatggctctgtttcttcttgtgccatgtaccgttttcttcaaactttctaccagtatatttgtacctatttatagtcaacagtatagaaaaattgcaacttagaaaacagaatatttcacattttaaaaagtgtttatcacaagatctctaacaacaacaacaaactcctctggtacaattcaaataatatttgattctcctgcattatttaaaaataactgtttagtaacatatatgcacacaatgaataaagtaaaattcacatggccatgaacaatatctactataaaacaaaagccaaataattggtaaggtaaaactatttcttattctagagtcagatggtacatggtatttcacaagatctgcttttgaagagtgccaattattttttactgtggagtcactaaagacaacacaaatgatggaaaagaattacaaattcagctacaaaaatcatcattgttaacaacttgtatgtgaaaacttaactaaaggacaattgaactatgtttggaggaattctgtttctttcttgaagaaatgtttggttgtctgcatataaagtaggtacatttgccttatgtgggtaaggagaaacaaaacatcacttttcatggtttcttgtttattgttcacatgtgtttacaagaagataaagatattgagcaatattttactgatctttctggatagttgttgttgcccattcgttctctgctggtactacatttgattgccttatgcctagcttgcaagaataccagtctctgatgatgacaaatacatttcacactctgaaggaaaacaggcaaaagctagattgaatggtgaagcagaatatgtcaatgtcacttagactatcccattttataaatatatacatgaagctttcctaggaccactaaacaattgtagttcattactgatccacaccacaggggtcttgtgtctagtggtatcccttggtcaaagatttctttgtggcttttatcaccaaagcacaaaacagagatgttggttttgttgttttctttaactagcatcacaaaattgctatactcagcatgtgaatctgaaaactggcaactcttaagaaaaatgcagttttgggaaaaagctaaaattgtgtattggattattaaaaaataacagaactgttggaaaaatagacattatagttggaagctttttgaattaggcaattattttttaaaaaagagaaatcattatttctttcaacagtaaaatgaatcccagttggcttttgctattctacactagcatctataataaattattgttacttcctaaccacattttgaccacatttctatcacatgagtgtattgggagaagtaaatattctattaccccactgagatacagttactgcagtgagactcacatggtatgaaagtaattaagattgaaatagttattttattttatttttttgttttttgctttttgtttttgagacagagtcttgctctgtctcccaggctggagtgcattggcgccatctcggctcactgcaacctccgcctcccaggttcaagcgattctcctgcctcagcctcccgagtagctgggactacaggcatgcaccaccatgcccaggctaatttttgtatttttagtagagatggggtttcaccatgatggccaggatggtctcaatctcatgacctcgtgatccgcccacctcggcctctcaaagtgctggattactggcgtgagccaccgcacatggccgaaatagttattttttatcaaaactcatggaaagaatatttagatgttaactattgatatacagtataatattttgtttgtagtgatatgattcatatctttgcagaaaaatcagaaatatattgagcttatatatagaagcactagtttaaaaaagtaaataaattcataaaattattttcaaaagactaagttggtaatgacaagaaaaacaagtcagaattttcacaaataattacatctatgtttatatgtagaggtatgtttattactctccccctgcatcatatttaccttacctgttttgattataatagcagcatatgctctggttaaagaatttgccatgtgaaactcaaaaatatttggttatttccattttttattatgagtaacaatgtgatggccatcactgtctgcatatatgttaaagaaattcactgattcttaagaatagatttgaaaagataagattatgtgctaaatgctacatacatttgtaaactctccctatatattacaagatggtttgcttcaaaagcttttttctcaccaacttattcccacaagcagtattaaagacacctcttgccaaacttgtttgtattgagtgccatcattggaaaaaaaaaaaaagtgtttaccattttgaaaagcaaagacacatttagacaaaacaaattgctataaatccatttaaaagttatattgcattctgcaaaaagaaaggaaacacaaattaggttaatgaaagatctgccccatctatgcagacacaggaactaactgctgtaactaactgccgtatatccaaacctgcctggtaagtgtcagtagttcttcaagatatgaagtgaaaacaaaacaaaacaaaaagccatcttccttgggcttagggagaggtttctcaaagctttttcccatattttctcatccctgttttaattttctgacatggcaaaggcttcagaaactgcgagaatcaaaaacacctgcatctgattgaaagtgagataagaaatactactcagaggagaaatgatttgtatgtagaaatacttgttgtggtgtgttgagctgagctccccaagttctgcctgtctctgaagaaagtttactgcacatgctattggtggggggcgggggggggagtagtccctcaaacaccaaccctaacacttaaccaaagtatgtattggatttttaagaaaagtatctacaattttctaagatgcttctatttaagtctttctgtatacattctatttcaggttttcttgtgccttttctgttatgttttagtagaaaaaacacaacaaaatatttggggcattgaaattcaccttatttcataaaatagtttgtaaactttttcaaccattatttcttcaataatataggagacttaagaacaaatgacaataggaaaaaaagcactttgtagctcttttttgagattttttaaattttactcattcaacaaaaatatttgagtgcctgaagtatttgagtctagaaaatgctgaattaggaaatatgaagataaatttgacaaatctcttcacttgaaaagctgacaacagtccacagaaaagatgagagagaagtccactgcaaattctaaagcagattaaaggttcacggactaagacaaagacagaatggaagtggtgcaggggagttggattaataactatttgagatacattctaaaaaatttgataattgataaaggaaagagtcaagaatgaatctaagttttctagctcgacacccgacagtcatatttttaaatgtaaaatcaagaatgtaagagtgagcatgtttgggggcaaggagggtatagtgaacgttgaatgtgtctgatcagtttccacctcatctttctcccattgtgtagcaactaaacaatttgggggaattgatctcatgtccagagacaaacttgattaatctaagctaatcaagattatgacatcctccttgccaaagtaatggcttcagaggaggcaaacttgagcccattgagcaaggcattcttttccttttccccagagatttattaagaatggacatgtgaccctcttacgtcactgaaatatttgtgagagggctattggagatgaaaagagacataagacagaattgtcctagctactataaacaaacttcagaaagacactctcttttgtctgtgaacaaggtagcaagaattgctattccagcagccaacctacatgcaggacggaaaaaaaaaaaaaagcagtacaaagaaatggacccaaagatttgattgaactatacctgatccctgtccagtctctgaattttgcagttatgtgagttattttgagttggttgatttctcatttattacttgctagaaatatccaaaagattgttccatatgaggcctagtaagtttgaaaggtttggccgggcgcggtggctcatgcctataatcccagcactttaggaggccgaagtgggtggaacatttgaggtcaggagtttgagaccagcctggccaacatggtgaaaccccacctctactaaaaaatacaaaaattagctgggtgtggtggcgggtgcccgcagtcccagctacttgggaagctgaggcagaagaatcgcttgaacccgggaggcggaggttgcagtgagccgagatcgcgcctctgcactccagcctgggtaacagagtgagactcagtcttaagaaaaagaaaaagagaaagattaaaaaaaaaaaaagttttgtgggatatacagatatagctatgaagtaagaagttgggaatagaggtctagaactgaaggaaatacatggggtgtgtgacatagattccgtggtctgcaaagtatgatcagaaatacagaaaacactaatatacagtttctgtttcggattttgttgtttgtttttactttttgtttgtttgttttttgaggcacggtctcactctgttaccctgactggagtgcagtggcatgaacatggctcactgcagcctcgatctcttgggctcaagtgatcctcctgccttagcatcttatgtagctgggaccacaggcgcacaccaccaagcccagctaattttttaattttctgtagagacagggtgtcactttgttgcctaggcttgaactgctgggctcaagcaattctcccacctttgcctcccagagcactaggattgcagacatgaaccaccagccccaacccagcttctgtgcacttcgtagtaaagggtgcattattcacattaaaatttattacacattttatactttctagaagatttcatctttaaaaattatattttaggataaattataaaataatgatttttaatgtatttctgatattatggtgtatattatagattctattaaatagattatctctatattaaaacataaacaaaaatacctctatattcttatttgaagtgtgatgtattttattgtgttctaatttttcctctacaaattgcaaatctactgtttctaaaagatcatagacaatgatatttgtaaaagtttatgtatgcattgggatgaatgacaaaaacatattcctatttcagggctgtgtgtcacaagcaataaatctatttacatttgaaaatcaggttactgctattgtttaaacgtcccttccaaaagtcacgttgaaacttagttcccaatgtggcagtattgagaggcggaggctttaagaaatgattaaatactgagagctctgccatcatggatggattaatctattcccagattaatggattaatgcattatcatgggagagggactggtgactttataaggacagacagaagcctttgctaacatataagcgtgctcagcccctttgccatgtgacactctgtgtcacctagggacaccacagtgtccccacaagcaagaagattctcatcagtgtgccctctcaaccttaaatttcccagcctccataactgtaagaaattccttttctttataagtcacccagtttcagatattctgttataaacaacagaaaatggactaagacaataatgggagaaataagaaagttctctgtaattaccatcaagatcatcagttggttctctggtcaatactctgtaattttctgctaaaagaatagttcccttactaagaaatataagctatcttgggtatttattataacatgtgataacaaaagtaacattccattttagccgattaaagataatttagctcttttcaaagcaagtctcataacaccaatttcctcatgtcgtttttatctgtaagaatctgtaatggcttccaattgtccacagactgaagacagcgtccctcagtgtgttcctcccatctgaacaattcaaggaagagtcccagacactgctcccttctaatcttctttgttcccttctcatgccattctcgtacacttgccttcctctgtacatatgcacttataaacacggttatgtgcctctgaaacctacttctttttcatttaaaatttatctacatttaatatctagttaaggttatatccattttctaaaatatgtctaagttgatttttattccctagactgtttttaatgttagtaatttgtactacacactttagaatctgctatatatgtcatagccttaatcagttgtagttttgttaacattattttcatgaaagtgaattacatagaaaagtatttcataacacttattacagtgttatagctttaggaataatttgatagctttaaaaaatgttaagtaagcagccacaaattcccaagacatgtaatgtggtggccataaatatgtttttatacagtatgaccagaaatttttgtctcttaagcaaaggttctagataaagctcgtattcttagaattttagaggctcttttggtgccatttatatcaaaaagaaacaggtaataagattagttatatacataactatccgctcaaaaatttaaagaggggaataatagtgaaaataaaacaaagtgaaaagtagaaggagaatatgttttaaattttcttcttgaaattagcataagcttctattgagatttctgggttgatttcaacatttcttagataattgtgaatacgcccttgtggaaaacatcttttatattttatgactgtatttatatcaaaatatgttatatttataaaatatgttaagtctttaagtagcttctaagtttaatgcctaaacacaacttcagtaatgctactcaacataactggaaaatagtgtttcaaatgtatctagaacaacaaagttcctattaaaccgcaacagtttttgctttttggtggggtgtaagtacagcttatactaatttgttctttcatattttgtttgagtatagtcatgttatttcttttggctttatagtattcaaacttagtacttagactggaagttttctctatatagactcaaagtttacaaacaaaagggtttctttacaaaatcatagaggttcacctatgctactgttccaattaacggaaaaggagtcaatattattgtatatttttccctaaagcttaactggtaaggattaaggattagaacccaagtctcctgataagttgaattacttgtttattttcctgatcacatagttggcttactcaaagatacgattcattctgctttttaaatgggagttcttaggcagctatgaataatgaaatcattatacccagtctcaaattatcttcctatttaattataccatattctcaaattatgcctcttgttgggtgggattaaaaattcctttattgatttatgatacctatcttccaaacagattcaagatattctgcatgattaaatatggtacataataaacatattttcctcaacatattgcttctataaataatattaataaaggaagaatctcagaggaactgagattcaaaataatttcctcataaatgtgaccagttgctatttcaaaggagaataaaaaataaaaagctcttggctcacatgaaaaatgaagctaactgatacttcaagaaagatataatctccccaaatctaggtggagaaaagtatccggagtccctttaattctcaactcaaacctattgttttctcttaggtcaagaaattatggagttggcaggcaagtaggtttaagctcaaacattaaaaaggaacttcctcctccatggtataaaagcatggcaaccagtgaagaagattcaaaatgggacagaaactgaggagaccttggccccagggtaggggaggcaagtcttctgatccccagaaagaaatctggaaggagccaaacatgagtaagactgtttttctcactccacaaagagctgcacatgagctgaatagctagactaattcctttcccctcacaaggtcaggggagtataaagggacttggtaggaaaaacggccttctcctggaccaacctgattgatggtgtgcctacagcccacaggtgcagatagaccactatgcttttggcagtctataccgctgcttcaggattccaagcagctgagtcctagtgagtagaacaaaaatagttttagcactgtaaaatgttcattagcttgaaagagaaagatcaaagataatcatcaaaacaaacctctaatgtgagatatcgaagatgacagaaaagaacttgaagttataattaatataataataattacagcaataatacaagtagagtaaattaaatacagtccaaaatgcttttctggaataagaattttttaactaaaattttgctatatacactgaagaagaacacagttcctgtcataactctagttattggtgtgaaagagcaagtcaaagatcaaagtagaatttaaagacattgtagtcaagagagaaagataagagatttggaggtagattcaggaaatatagcttgagaataaaagctttctatgtgaataaaaagtagggatagaaaggtgacaatgagataaattattaaaaaaaaaaatccctgagcgggagaataccctaacgtgcagtgtaacagggtttggctagtttcaagcagggtattatgaggaaagatacacacctaggaatatcctaataatatacttaaactcctggaacaaagaaaaatgaaatcttaaaaactttcaaacagaaagcacaaatgacttataaacaataaagaatttggctgttattaaatctctcatctacaacaccagattctaaaagttgatagagaaacttctacaaactcctaagagaaaaagtctgaaatcaaaattcctttatgtaagaaagatatccttcaaccattgacaaggaaaaaaaagaatatttgcaaatatacaaggattcagggactatatcattcacctgaacaaatgcatctaattaagaggcataatttgagaatatggtataattaaaagcctgcatgcagcaaccaatacatcaactacttacataaaaccaaaactatgaaaaatgtatgaaattcaccattggaggtaaaatgaggacagatacttacttttttataaattgataaagggaatcaatcaagcattatcttgacttttctgaacaaaccaaataggctgcaaatattcatgtgatcaaatggctgacaaaggaaagtcttctttatggaagtcttgctaacaaatgcagaagaaatgttgcatttagaaaatcaccattttaaaaccactaataaaacaatgtggttagaccatgattattaatggattccaaaatcatcaggtgaaagttgttgggacactttattaagaatggattaggttgacaccagctgaattcacctatatcttctctgtggacactacctggactcacctatagcttctcttttattgtagaacgttccacatgctggatttgtcccacattcagattgtatctgacattgtatgtttcctgacgggatataatagcaagcatataatgccaccaatgaagtattctttgaaaaagtaaaagacaatacctaaatctaaccaaaaatctagatgtaatgatcaaacataaaacctgggtgaatgaggatggtttaaatgtcatcaagagcaagcctgcaggaaaatctagaatgtggaacattctataaattagtaacaaaaacagttttcaacaagtaaactgcattaaaaaaaatacagaggaaaagaaaggagacatgcaacatggagaactgtttggagactatgtgaacaaaccaactgtaaaaatacagcagagattgagacaagtgggaaaacaattagagaacagccactagatgacattaagcaatggttgctaattttgtaaagtttgtccatagcactgtagcatgtgtatatatgtatacaaacataaaatatttgttagcttacatcaatattatctgttagggtaggtcctattgaagtatctacaggtacttgatacatatatcttaacatgatatcttagatttgtttcaaaatattatacaacaaatggaaaaggtaatctctaagattggtaaaaaggtaaaatcattgaagatgggtggatgggttcatggagactacttatacaataatttctattttgaagtatgtttgaaaattcccgaataaaaagatttttaaaattcaaagaatcttgatataaaaacaattataatgatagatttcaatatatcattcttcttcaaaatctcaatggatacattagacaaagaagaaataaaataatgaagttaaatagggcagcctacaatctatatttactatagacaactttgttacttgcatatagattttcatatatccacagaaaatgtaaaataaataagttgcccataccctttaatatgctcataaagttgagattttacagcaaccttttttgattataatgtatttcatttgaaataaaaattacacttacaaaatattgttgagataattatagtaatttctataagaattacttattatttatattatttctatttcactgatgttaaatttcttggttttgataatgctattttggtcatgtatgagaatgactttgttcttaagacatgtcttctgaaagatttgaggatgaagtgtactgatgttcgcaatctaatattaaataatttagccaaaaaaatttatacacacactccaggggaaattgcagataaagggaaagagaaggtaggatagacacttagtgttgaaatatcttaacaattgttgagcctggatgaagggataagggatatatacgtgttataacaacatacattcaactttctgtacatgtgaagtttgtgtggcaaagagttggagagagaaataaaattaagacatattaatactaaactgttcaattaacaaattactactccataaaaattaagagatgtattcatttgatcccttgaatcagaaaggataaaaatatgaatttacattctctctagtctaaaacattttgtacagatactaatgggttcaacaaaaggtgttatatgaaaacttgaagcctacaaaaattagaaagaaaataaaataatttagtccttacattaagaaattacaatataaaatagaataaaccaattacaagtcaaacaagagagtaagtatggatacaattttagcttcatgaaatagcaaaaataacagtaagaccaaaagggtaggtaatgacaattgcacaagagaaatccattgacacaaaatccttctgagaagtttaatttcatgtagtcttgtatccttgatggagccttgtctattctccattttgaatattttctgatattttactgcaatatcctctctggtttagtatacgaaaggatgggtgaaaaccaagagagattggattcaggggagccgctgtatttctaactctagctcttcaaggaagctcaggggcagagtgtaagcaacctaacctccttgggccctaagattatcttctggaaaggggcctgggaggagaagtgcaggggcagagggtaagcaacctaacctccttgggccctaagattaccttctggaaaggggcctgggagaagaagtgcaggggcagagggtatgcaacctaacctctttggaccctaagattatcttccggaaaggggcctgggaggagaagctcatgggcagagggtaagcaacctaacctccttaggccctaagattatcttctggaaaggggcctggggggaggggttggcttgatcttttcctttaacaataggaatgcataagtctaactattctaaataaatcataataacaaaaactaaggtttattgcctattttacaattgccagacaaacaactaaacactctacatgtataacttcatttaatcctcaccacaaattcaagagtaagcattagtatcctcctgacttgacaatagtaccacagactattgtctgtggtggggtcatgatggctcccctctataattgttcacactataatcactcatcagtttcatcttgcacttatccatcaaagttggcaatcaccatgttcccataaacgaaaggtatcatttcctgtgtctaacttagcataatgattaaaagtgtaggctctgaaggcagccagcttgcaaattgaattccagccagaatatataggatccatgtcaccctgggcaagtgatttgccctcacagtccctcaatttcctccacaattaaatggagactcatggctgtaattccaatactttgggaggccgaggcaggagaattgcttgagcataggagtttgagacaagcctaagcaacatagtgagaccctgtctctacaaaagaaaattttaattagctgggcatgggggcacatatctgtagtcccagctactctggagtctgaggtgggaggattgcttgagccgaggatatcgaggctatagtgagtcactgtactccagcctgggcaacagagcaaggccctgtgtcaaaacaaccaccaccaccaccaccaataaaatggagataacacagctttacaaggagatagaattacatgagatagatacacttaaaggacatagcacagtgcctggtaccttgaatgtatacattaaatgctagatatcatcatgatggtacattacttagtgaagtaacttcaagtagtttttaaaaaagtaattgagtatgttcccaaatgaaaaaccttcaagagaagatggaggagaggcagaaactgaaagcagcaatattaatcagctaagtagaagacagcctatattcaatcatatccgcaagcagagggcctgattaatatttattaagtatgggcttgataaacattggccaaataactcaacaatcaatgtctaagcactttacaattgagaagagttagaagatcaatactattttgataatcctttttaaaataagaaataatctatataataggattaagatatgaaatgtggagtgtttaatgattattccatgaagtcagcacatttcactgaatctcctaccatagtgaaggaagatccgacgaagaaatattatcaaagaaagactcatcaccaatgtattgggaacattcagcactgtctacttaacatggaaagataaactgttctaacctttcatgtaaataaaggttttcttttgagctctctgctttcagtggtggaaacattagccttgggtggctaacctgcacctctccttcctattttatcaaaggaataattaagaatgaaataatccttaaagcacaaagcatggtcaatatatttcccatccatttacaaaaaaaaataattatccagaaactcataagctctaactaaaacctggatcttacttacttttttttttctataagggcagttaataagaggtaaagtaacaatgactctctgggtaatttaccacagagtccaaggaggagggcacagaatttgttaaaggaaatactgctcccttcctgcattctacatctccattaatgccatgcctatagttatctaaacatctaaaatataacagcaaattagaatgtagtttgctatttaaataacacgaattatgtaaatgctccaaactgagataataaatgagcattcttaattcttttaattaaaatattctttctccatcctgaggctcatatttctgagtatccccatagcagcataagttacagaagcatatctcaagacctattgggaattagtgttatgaaaaaagaaatgaagacatgcttgaacttggtaaatcattttaatgggttttatacttactaaagtaaaacaatagctgacgtgtattgaagtagtaatagtgtatattattatatataaaagaaagaaacaaatatgaccaagagaccaatttcttcttaaagcagattttaggattttaagatatttttaggacctcacaacagatgaaatgtttttaggacaaaaacattttaaaggaccttgcccttgtagaatagagagtggtctggatgagtaagagtaaaacaaaaagaagggtaaattactatgtataataaatgaacagaagcctgtcaaggggacatgccagtgggctgtggagtgagacaggaggccgaagacgagagagagggctatgtatacaggggagctctactagtaaagctggctattattcatttttaaatgatctaatttttgattatataatccctagccataacctccaaatcttaactaaaagtctcttaaaaacaatcaactacattacatgagtgatgttatacaggatatcaatattatatacatttgggtcagaaagaaaggaacagtcacaacatatgcaacgcagaactggtggaaacaggaagttaaatgtaagcaggacttaaatgtaagcgtgcctttcaccaatccagagacctaaaacaggtgctagatttagcaaaatgtatttgaattagaaaggaaagaaaatgaactcaacttacatcattctaattcctcgttctcttttatctcaaataataaactttgaaatatgtttttgctttctatcaagcaatatgttcacagtcctccagtcaaacattaaatgatttatttattactcagcacaagacggtctccctaaatcacgtgaattaatgcttattcacatgtacttgtgaaattcctgtacatttggaaacgtatgtaggatagatctaaaccttaatattttgtgtccagggaatttgagattagtgatacattatcctgtggtgcagtctgtaggctagaaatataaaatactttccaggataaaatcttatgattccaaggtttataatagatagattaccttaaaatttctgagcttttgtccaatcatttgaataaagagcacaatcacttgtttcctgctacaaaggattctgagaatgattagataactcaagtgaacacaatggataagttttaacctatacatcaataaggctttttattgtaattcttaaatatttagttcttactgagatcctgcattctctagtcagtttaccccaatgttctctatacctttgcctagaacagtatcaacttggggccctagataatttcttaaaattatatatcttttgagatcctttatgtttattttacagagaagcaaaattacacatcactaataatgcagttaggtactgatattgctaaattactgaggaaaaataagttttattgtacagtaccctagcctggatgatagagtgagactctggctcaaaaacaaaaataaaaaataaactttaaaaatacaaaggctggataatttcaagaacattgaatatctgttaataacctaagtaggatgcaaaccaaagagtatctgaccaatctacactgccttcttattttactttgcatatgctttactctcaggaccaccaacttagataactaccagaattattgtaggttaactattagaattattaaattatctaatatctaactaatagaattattgtaggttaacaatgtcttatcagtttggaaacacagtctgaaacctagtacttagtaataacgtagtttctgtggatccatgctctagacagctgaactaaaagcagagtatttggaatattaaccctttataaataaaaaacatccaggtttaagacaaaataacaatccacaacaccagttaatcttagtaaaatgtgataaatattaatttatgttaactgataaaagttaaaatactataaaaaaggaaatgcagagattggtgaatacagggtccaagataatggttttctctagtgaatggaagcagaaagatgggatgagagagacatatgactactgcaggatcatctggagatcctgactttgttttgcctggtgagtttgcaggtgcttaattcattattgtaagaaaaggaagcaaagaaggaaggaataaaggatagttggaaggaagggaggaagatgggccatgcataggccagtaagagattgtgttttgaaccaaggattatgattactatgattatgggtacctgagttccaatggtgagtcagggaagggatagagttagatttcacatttgctataaaaatttaggaaacttagttgtacacaatcagatttttcttgtttatcaaaatgaatatatgatttctttctaataaagaatcctactaaatgaaacaatcactgaaaaggtcttaggaaaaatactttgaaagactctttttaaagtagggcttcagtagcaagcatgcatttagaaattttggctaacatctgtgaaatttcacttatatttaaacggagctgtgaatgtctcttcagggcacctacaattctattttaattatatcacctcgaaaaaaaaactgttttaacaactaacaaagcacacatgatgtgaaaacacttgttaaaccacctctgcagttttaacaataagacaaatatgagatcattacatttcttaatgctcattatatgagaattagtgcagtggcactatttttggaaagcatttgcccttggcagcatctcctttttacacatatttgtcattttgggagctctttctcaaatttgctttatacaaattctatgtcagaatcatgcaacatcataaaataacactatgttatgttattgtggtgacacaaacatactcaagaaattcaaaataatgacggcatgccatgcattaaggatgactttaagtcatgtttttatgacaaactgtcatcttaaaagacaaattacaggatttttactcattcgtgtcacatcaaatacattatttaaatagactaattttattttaagaaacaagaaaacataagttgcctgtataaataggctgaattatttatccttgctgaagttttgggttcagttacattgctcaagccacttatttaagctttttgatgcctgaatgctacagaattcaagcatccaggcaccaaaaagatctaattacagagatatatttcagctgtcatttgaaatttatcatagtaattcttgggatatagtggtagcacttcagtatggacttggttaactagtgagtcatgcatctcctgagtaactggtaatgcaggtaattctatatttttcttataaaacagatagtgacccaagaacaactgtcttgggacaaaataaataaatattagcttcataaatatactcttttcctccacagtccaatgtcatggggaggataagggaggaagatttgaggcaaagacttcaagccacttttcctccactctttagtccaagaggagaaactttaatttgtgatatggatcagtaacaaatcagggattcttgaatgatatgttagaaccactgtatgaggtggagattcttttctttttcatgactcctatgatcaaagtgagagtgaatcttaggtgaaaggaggaaggagaatgttttctgctccaagacttcatagttgaaggtaaaaagaattcttaattattgtgttgggtacattctagatcaccaagataggaaaacaggttttgattaagtgtacaaactcttgaagaaatgctgggccaggcacagtggctcacgcctgtaatcccagcactttgggaggacgaggcaggcagatcacctgaggtagggagttctagaacatcctgactaacgaggagaaacctgtctctactgaaaatacaaaattagccaggcacggtggcccatgcctgtaatcctggctacttgggaggctgaggcaggagaattgctttaccccgggaggtggaggttgcggtgagctgagatcacgccattgcactccaacctgggcaacaatagcaaaactccatctcaaaaaaaaaaaaaaaaaaaaaatgcatgtttgcccttctcactatatccatcggttgcccctctaaaattcaagtataatctcactgattgtttgatcagataaaggaccctgccaactgtggtagagattaaagaattcaacctcttctcaggacatccagctagagaacaatagtggctttagtatgcttaattttattgaaatatacttaaatactacacaaaatacctgagaaagtatcacgcagaaagacattcatttagtcacataggaatatatatgtcatgtactagttattacatcatgctagatattatatgctatgctatttgagagagttccaagagcttacattgtagtggaagtgtgagtggacctaggccatcacaatcactgggaatgctagctatcgtgggagaattatagggacagcatactgaggggacacctgcaaacttgcagagaagactaaggagagtcatctaagtgaagacttaaaggatgaataggcattatccaggaggggcaaataaatgtaatagcagacaaattaacctgaatgtaagagacttggtaagttagaaaatagagaaaatgtttagacctataagagtaaggtctgtcaacctaagtcctgcgtacattgctggatgaatgatagaactcttggattgtttcttcattttcaaatagcattgttagaatgaactgtctttaagcataacccaccaaatagagcataggtggatttctcataattgttagatacttcctgccttaactttcctctatctacattcttcttctaataatacatggcttttatcacatgtattattagaatttccacaactaaaaaagatgaagaggaagaaccatttttcctttaccttcctccttccctccacaatcaaacatcagctattgatgtccttatcagtctggactttattataggctccagtcacattataggttttgaatgaatggatgaatgaataaatgggaggagatttgttactctatgtgccctcaaaatagattattttatcaaccctcaaaatttttcattcagtattttctatggtgttttataattctatgttgactatcaagtcttctttctgaatgtgaatctataatttagccttaggctccattctccatagagacagagtatgaaggactagagaaattgtaatcagtagtatttgcccttttttcttttgtttattctaaaggtttttcaacctccttagtattaacatttgagacagataattctgtgtcatgaggggctatcttgtgtgtaggttgtttagtagcatccctggcctctatccatgaaatgtctgtattacttcactcccacttgtgatgagaaaaaaatgcctctaggtagaattgaatctgcctaagggcaacctccctcccccagtgagaaacagaactatactataaacaacattccattcaaaatagcttgtatcatagaggaagtgattgatttatcttatttggaaaattaaatagagggtaaattctgaggattgaagaaaaaggtaaaattgaagcttgcaagtatttgacactgcaacaattatatatttttttccaacacaaccaactctccactcacatctgtcagaccaggaatatactgactaaaattgacagagatcctaagtgaaagtttaggttttttgatttagagaacagaagcctcaagatcaagaggtgagatgtctctgagataagatcagatcatccccagagataagaagcttgaaagggtggaacatttcttgcttcttggtttttctgatcagcttaatattgaagaacagcttgaatttccagttcgtcttgcttcagagagcctggagataagaataatcactgccagttgggtcagtattgccaagaaaattatattggaagtttgaagctgtctataaactttatgcctgaagtaaaaacatgtctgaatttctttctacaggtgtgatatggcttgcctctgtgtccccacccaaatctcatctctaactctaatccccacatgtcgagggggggacctatatccccaagtgtccagggagggaggtgattggatcatgggggcagttccctgatggtgttcttgtgatagtgagtgaactcacaagatctggttaagtgttctcactttgtgcactctttctctattgcttgctgccatgtaagacatgcctgcttccccttccgccatgattttaagtttcctgaggcctcctcagccatgtggaactgtgagtcaattaaacctcttttctttataaatcacccagtctcaggtagtatttttatagcagtgtgagaatggactaaaacaagatgcctaaaagataactacgtggttaatggctagcatttaagtgaaaatgttaatgtactcctcagatgttatttacttttttagaatttcaaaaatcagatatcaccattatcactgtgtataattctaaacagtatagaatttatatacaaattaaaattatcatatataatcttcagatatttacttttatttttgtatcaggtatgagtccctagtttactttaccttggcttcaatgcactagaggagaatttaatttgtttctttgggactctgtgtgtgttgtgtgcttgtgtgtgataagcagtgttttatacacactgagcagtaattattattacaattcattttttgtaactatagtaaaagatctttttaagcagatgctatttagtggtgagactattaaattcagccaagcatgtatttctattgatctgttagcctcagaaagttccttagactgatgctgctttgacctttgctggtcatttatttttttttcctactgtctgaaactgacttttggttgttttattttggaaaataattacatatttgtatgtgttcgaaatagtttaagtgaacaaaaatctttccttttaccagtacctatgtgtagtcaaaaagtattttgcataggcacatttggaaaccctgcattgaaaaacatttctagttaaagtacgagaatgtctggaaaagtctcattagccattttggaagggtatattctggaaatccttgggcagtgaagtgaaacttcactcaataatttttttaaaaaaataaattctatattagacaaaattagtagttttttttaattggctaacactgcagaatttggacattcaaagaaaaataagagtaaacagctactttgggacattcaatcatcttttggatacatatctacaacttgactatcagctatttaatatcagactctaccatcaatttatttctctcaccattgatgtttctatgattactattttgcctatctcaaactatgagtaattcctacttccccagttctctgctcttgtaacaagatcaagagcttcgtagtctgacttgggtttgagtctaagtttaccagggcaggttacattatttctcctccaccgcatcttcatcttttataaacagaaaatatcatcctacaaggctgttgtgaaaataaactgggatgattatgtaaagaactcccaattatacatggaactttcagttagctttggaacttcagttagctttgggggcatagcaaagagctggagggatttatgaaccctggtatgatagattggttgtattaaggtgccactttaccgcaaccgtctcacacccccacatctcactctgtgaccttccagggttctgcagctggattttcagagtaaccatatcatttgctttagccaatgggatatcagtaaaaataaaaaggagaaacttgacatatgccagaatgactaggtttgcatcctcttatacctctacatttaccacaagaacatgcctgggctagcttgctggagaaatgtgaaagaccataggggcagagtcaagtcacccaggcaacaccctgggcctgtaaaaccccatccaacttccattgcttttctcaatttccaccatggattgtatagtgtaacactttgcaagttcttcaatatctatatagttgaaaaaagaatgtagacagactaatatatattaagatttccaatgacctgtatttaatattacatactcacacaactttaatatttattggtataacacatatatcaaatacatagtttctctcctccaacatgcccttcaccacctgaatttttttaacctctctcctcattatcatgtctctcatttttttgattgtaagcagaaggatcgaaattagaatattttctagaggttcactaagcactgagttgaaactgagcaaaatctttgaaaggttttcccatcatttttgcttgtatctgtttcatataccatttatatttggccaacgcttggtcaatatcatgatccaaatggtgaagttggtttcttctgctgagaaataagtagtcccaccattctaggcttgaggatgaagggtactgatatatttttattttataaaagggctctactttagaagttctaggcatataatttatatccaacctaaattaaataacctttctgaaggaaagaatgaggtttttcttggtgttatttcagactctgagaattatctataagcccactgtaaggtggatagcaactgttgaattctccatttaggttgtgcattaaatgtctttatgttcctgttaaggaggaagtcttgtccacatgaccctccccaacccccctatacacccccagacccaccctgatgtgatttggatatttgtcccctccaaatctcatgttgaaatgtaattcccaatgttggaagtgggggcctaatgggaagtgtttcggccactggggtgaatcccctgtgaatggcttagtgccctccctgtggtaatgaggtcacatgagttttggttgttgaaaagagtctgaaacctcccttctctctttctccctcactggccatgtgatggtctggctatccctttgcattctgccatgattgtaagctacatgaggtctcatttgaagccaagaagatgttgtcatgatgcttgtacagccttcagaactatgagccatataagcctcttttagttataaattacccagtcttaggtattcctttacagcaacgcaaaatgaacaaaccccccaagaggcgaactcccatccttgaaggtgcttatacttttaaaagataatacacaagaaagataggccccagataagtttattttttcaatcttctcttgttgctgcaaacatctcaacacaaatttattacttcctcttcattgatagtcactgtcatttctttattctgagagaaacgctagaaatttatttataagtagaacaggctgtagggaaaagaaaaacaaaaacatctagaaaccaacattcaaaagaatagagaataaggtgtgaagaggaggtcaactaggagaacaggaaagtataaatgatgtctggcaatcaggggatactaaatgtgcaaagatgtttcaggtacttcccggttttcactctcagtgttacatggtctcttaatcaattatgaattttaagaagaatagatcatcttttaccaaagtcaggcaatcatatatctgctctttcaaaagtaaagcaatcaccaacaattctaaaaatattttggtgacatacaaccactgcctcacatgtactctatctaacctcttagccagcttttattaccagtattaaaatagacatatttatcatttagccgtatactgtgaaatttttccatcacttggttttctcattttccagggcaaacttttcaatacccaagggaaaacaactgaagtagaactgtaccaaagtgcatttccaatgtcatgcagcagaaataatgttcaatgaaattattctgttagtagctcctggaaagtcaagctgaatactctatgctttcagtgagtatttgacatttcttccttttttttaaagtcctggaacttccattctttgttttatcccttagtacatatttatttggaagatatacattatctaagacttattcccaaatatttacctagacaatgaactaaaggatacgcagtaaacacagctgagaatatggctgattgtgttccaaactatgtagcagtgaagtttattttggtccctctaagcctccccatcatccttcaaacattgactatggactgtgttcagggcaccaacatttgacattgtgaagaatggaatgagggataagacacagagttcagtctttccaacttcatacctttatgttgttcagaattttgtttttatttatgattttcttcctaccctaaaagcaagaaagcaacaacatctattctttcaccttcagtgtacatgtaagtcaggaagatacctcttctcagattctatctctgtaagaaagcccttcctcaatattatagcagagctcattgtttacaaacatttaccaccaccaaactaaagcatgtggcatatgtctcctaaaacacacagcaaaagctctgggaatagatggcaggtagaagctggaaaggccttgaagacactatttgtagaagtctgatgagcctagaggagtgatatggtttggctgtgtccccaaccaaatctcattttgagttatagtttccataatcctcatgtgtcatgggagggacctggtgaaaggtaattgaatcatggggatggttacctacatgctgttttcatgatagtgagtaagttttcatgagatctgatggttttataaggggcttttccccacttgcttggcacttctccttgccgctgccatgtgaagaaggacgtgtttgtttcccattctgccacgattgtaagtttcctgaggccaccccagcccaatggaactacgagtcaattaaacctctttcctttataagttacccagtctcatgtatgtctttattagcagtgtgagaacggactaatacaaggtggctttcagaaaagcaaagaaaacgttattggcatctagaggaaaggagacatttatagtggcagaaaggctagtaaaactggtgcctgtagtaacacaaaaaataaaatattccttaaaaattcaatgatagagctaagtagattaccaggcagagagcttaaggtactgcatggtttcctctagctacttatgatataaaaagaaaaaaagaaattaaagaagtattaatatattgaataaaaattagaaattactaaattgagaaggaagggcccagaagagtcctttcaacaagcaaaagtttctcaaagtaagataaggccaacgtgagataaattcctttgttaagatgtaagaaagatttaagatgatgcctcatagaatctttaacctacacaaaagttccactgagaatttcaaggacttgcatctcagatccccttcattatatgataaggcttctaaggatctgaggagtttccctcagcagcttcacaggggtcctacagatggatatattacttacatggcaaacggactttgcagatttgaatatgttaaggattttgagatggggggactagtctgaattgtctagatagacccaagagtccttataagggaaggagaagggagggtagttttagagaatgaaatgtggccatggaaagaggttggcatgctatggggccacaagtcaaagaatgtgggcaacctccagaaaaggcaacaaaataggttatcccccagatcttctagaaggaaaatagtctgctgaccctttttagacttctgatctccagaactgtaagatagtaattttgtatgctttgtgcctgtaaatttgtggtaatttgttacagccacaacaggttaaaaaaaaaaccatggccaaaaagaagagaagggcctatctgcctatctgaaagagatctgtgagtgtagattttgtctaatgtagtggattagcatttgataccttacaaaaccccacatattaaaaaaaaaaaagattcaaagttaaaatgaaaaggataaacagtgccaaatgaaaagaaacctttggactcctgaactgctatggatagaaaacagaatgagaatgtttctcatttatacacaccagccacttccggaaaaagaatgatgcccaagggatatagccaagagacatcagaggacaactccagagagcaagattaggccctaaccaaagaattatcaatacatgtctggctgcatatcagaattgctatatgcccgtcactgctctgggtctcctgttttatatgtttgaattggaatctctctactggttatctcatatttctttaattcacgggcatttacataaacaagagtaatatgtaatgaactgcaaatagctttcttcacatgtggacataatataaaggatattagaccttgagcccgaaactattgccataaaaaagggaggtttaaaaggagagtcctgaagaaaggaggctgtgtatttttcccatgggagggatgtaaattgtggccagaggtcagaccgttccacagtgtattttccaaaatgactgtaccaatatcttctatctcagaagaaattctacaatgtgatcttgacagttctgtcattgaaaagaggtgtctataatctctgctccttgaatctgggcaggaatgggacttcattgtactacaagaatgaagaagaagtaacactacatgacttttgtggttcagttaggaaagacaatgcagcctccatcttgtttgctggaacacttgccagtacactaagttaccatacattttgttcagttgccttactgctgccatgctttgatgaagttcaaattaacccacgtggagagaccacatgggaaagcctttagactacatggacatagaaggtctgtcccagatggagcaggccagatggagcacccagatgctccagttcttgtctgacttgcatccacaccactgtccccaaacacctcccaaattcctgatccacaacaaaccatgagaggccataaacttgtttttttccgccactaagttataaggaaatttgttttgcaacaatacataatggaataagtcccttctcccataccttggaaacacagtgacttacacattggtggcaagtcatttcttctcatactttcacttcaactttcatattttttctcaattagaaagccttctgtcaatatcatagcagaattgtttgttcacttcaccgtatttaccttatttaccaccaataaaccatgaaaattttccttgacattgttcactgtattggatattgttatttctatacctctatgtttttgtcactgagatatgaatcctcaagagaaagagctattctcttctcctgcaagttttgtctcctgcagtgaaaatgcaaaggatacatatagtcatgtgtggcttaagaggctgcaatacatataaaaaaacatgatgcataatacttgtgtaggaccacacatttggaaggagcatgaagcagctgatcttatggtaaagcccatcatcaaggggcagaacaacattagatgttaaacttccctgtgggatgaatgcaggactctttagtgagaacatcagtgtaccatgtactcagacaaacctggagagtcaactggttgcatgaggcgtagtagaaaaacagtttctagtgaaagacctaacttgcacttccttaaaagtatttaatgggaggtggaaaaattagagaaagctaaatatacttttcaggagtagaaagttttactagtaggaaaatgtggagggggcaatatttttaaaatactctttcgtacactgattcagctgacacgtatttatggaatatctattccattacctgaaaaacaaataagacaaatgtgtcccagtaaacatgggggcttaagtctaatggagggagataatacactcacatgaaaaataacaaaataaattcagaaaatggtaaatgccgaaacagaaaatgacacctgacgaagggcaagacaatgacctggggaaactggcccgttagcaaggatggttagagaaggtgtagcacacgttgttgtctgcctacccagcagccattcctctcccttcagtcctaagggaagatcaaatctctcaccagttcttcactttcccatcttcccacatagcaaatggtggaaagtgtgaaacacaattctgagatgttatggaggaatctgtcagtgaagtgaaagtagaatatggatattcccaagaaaggtgttcctgtcagatgaagagcgagactctcctgaggatagtccccaagtcattatctactttggacattgccttgtgaagacaagatatagaggactactgccatcatattgtgaggcgatgagtatacagtttggatatttgtcccttacagatctcatgtgaaaatctcatcttcagtgttggaggtgggggcctaataggtggtgtttgggtcatggggagagggttcccttgtgaatggcttggtgctgtcctcaaagtaatgagtgagatctagctctatgaacgagctcctgggagagccaattgttaaaaataggctggcaattccttcccctttttctttcttccttcctgtcacaatgtgatgcctgctctcctttaccttctgccatgagcgaaagcttcctgaagccctcagcagatacagattcttgtgccatgcttctcatatggctgaaccatgagccaaataggcctcttttctttgtaaattgcccagcctcaagtgttcctttatagcaacacaaatggactaagacagatagggaagacaaagagtattgtagagaaactgacccaacaccctgatttcattgagccagcaccaaatgttagatcacctattgcagtacctctttttatgagaaaggcaaaccctaactgtttagaaaaatttatggtattagcacccaaaagtatgctgaaaaatacagaagttctaggacattatattaagtgaaataagctaggtacagaaagacaaacactgcatgatctcactcatatgtggaatctaaaagagttgatcttatataagtagagagtagaatgatggttgccaggtgctgggatggttgggggtggtggaggaagttggggagatgtaggtgagaggatacgaaattttagacaggaggagaattatttattgtacaatgtactgatatataatagttagcaatatattgtattcttgaaaaatgctgacagtggacgtcaagcatcctcaccacaaaaatggtaactctgtgaggtaatgaatgtgttaactagctagatttagtcattccacaatgtatatatgcttcaaaacatcatggcatacataatatatacaattttatttttcaattaaaaaatacaaatttaaaagtatttaaataaatatagaagtcctcactgaggaggcaactcctacactgagatacaaggagtgcaaaaggaggacttatagattcggatgaagactattatgagcccagagaacaccaagcctctaagttggtgctttagtcaggattttattgcatatatgtgttagtaattgatttactgcctctcagccccaattccacaatacattgcctgttctgtgacaaagtagctggactctaaatatttctcctttgctgtctggcactatattaagcgagctatgtccatagagggccctggagggtcacagcaggatagaggtcctctcttcctgattctgttgtgcttgtctcagcaagttcctgctgagtgtgtgtgtgtgtgtgtgtgtgtatgtgtgtgtgtgtgtctgtgtgtggtctctgcaggggcaggtttctgaagggtgcacgggttctccagtggccactgccagcagtacatggtacttccctgtaggcactttcctgaagaacggcagagggtgaattatcagcaatctggctagcagagggcagttcagcaaacttctccttcatccagtaagccatgaatccaccctcccaaagaggcatggatttcagatctaagaaaggagcttctctcttaaattggtctgtttcttgggtgctctatgttagccttaaaagtagtaatgattccctttatatgacatttctgattttttaaaatatctctttactcctcactagtaaattaaggttactaaatatcctattaacatttttatttttttgagacagggtcttactctgtggcccagggtagagtgcagtgatacgatcctggctcactgtagcctccacttcctggcctaagcaatcatcccaccacagcctccccaatacctgtaactacaagtgttccctccacgcctggctattttttttgaattttttatagagatgagggtcttcctatgttgcccaggctggtcttgaactcctagactcaagcaatctgcctgccttggcctcccaaaatgcttggattacaggtatgagccacatgaccagccagtaattcttcatattaaacttttactattaaaattgctgtgtggtttctgccttttgattggctcctcatttacataatatgccagaattattttacagtatcatcagaagcataaagagcaggttctgggatgggactcaatgaatgacccccaaaacaatgttgcagaactgacccacagagactctgtgcaaaaggtagggaagcaggaagttactggtgccatttccagaaacacaccatcaatcggaaggggtgtaatttccaccaattggaaggggaaagcaggcgcctattctcaaatatactatgtctccaatgatgcctcttaaacactatatccttcagacactcctgaatctcttctctcttatcctatttaattccaaaattgattttgcataagaccatcagagtagctgaatctaaattacattgaatttgagttcaccatatctacatcgctggcagtaagacatagaaaagaaaaacatgcaaaatggaaatgcaagttgattttttcccgtctataaaaaccttcatggaagctaagattatctttcattgactgaagcttggtcatatggtcatgtcttggcaactattggaatatggctaggaaaaagggaaatgtagacgggattgtagtcagccaaccaacggtatatgcacagttatgtatacatctcctgttctcttctcccatccaactcagatttaactttcccagtggtatggggatggggatgagatggactttcaaagaaatatgcaataaactcccaattattttagactttttgttccaaataattaaagaataccaaagagatattaagtttgaaagtaataaatggcatcaggaaaacatacactttttttttttttttagcacagaagtatcattctgcgaaagctgtgagcaatttgtcatttagcatgtagagaaagccattactaacatatagaccattatttcttctgtcacataaatgctatgtatatttctctgcatatttacactcttaacaacacatatgagcttatttttttgacagtactttcagatttaactatttttgaatgctgatacaggtctattccacttcatcaattagagtttgatggttattgagagtaacaggattttttttcagacctctaaacacagatcactggtcaaatatacactatttcctatttataagttgagaaatattgagatgttttaagaatagtatgactggactttatgtacataggcacataaaacttactaaatatcgactacatatgactggaagagttcagttcaagcttttaagtcataagatttagattttatcaaagtattttatacataatttcagctttttgattaaacaggatttaatgagctataaatttaatttaaaaactaaaagacatcccacatattttactatttatcaccatgttccaaggctaagctagaaaacagaaatggccctgttttcttcattttatcagataaaataagttgagaagtcactaaactaaaatttacttttaatttcttctatgtacacattcattcataaaatgagtatttattgaatgcctaccaggttccaggcctagtaaatagacaagtaaaaaagtacaatttattttagggcaggtgctgataagttctatgaagaaaaatgaatcagcaaaaggaaaatgtaggaagaaaagtaataaaggaggaaaggaatggatatttaaataaaatagccagataaggccttatagagattacctttgaacagatacaaaaaggaggtgaaggaacagtccccgctggctttcagaagaagagcaatccatgcctggcggggaggaagtgttgattgacaaaaatgcaaaaaccctgagagtgtgtgcacacttgctctgctcagagaacagaaagtagatctagggcacagtgagccagacggaaagtaaaagtagagaaatttgaagatatagcacagaaaccaaatgattcagatcattgtggacacttgtaatgatgttggcttactagtaagatggaaaaacattggaactagtaagatgaaaaagcattggaacattttgggccaaactgttgggaaatgatctcactatgtattttaaaggatcctaaaatctgctggtcaaagacagactttggtgatgcatgagggtgaccaagagagaaggtacactggttaggagcccattataataacgaggtaaaaaaaaaaaaattgtgtcttgttcagggaaatagcaatggaaagcttgagtggtataatatttgaatacaagtttaaggtaatgttaaaaagacttaaagaggtactggttatagtacataagagataaaaagagtcaaggatgactcaaaggtttcagtctgaaaaaataaaaggagagattcattatggcgtatgttgggaaaatttgtaggagtaaaataggacagtggtgttagatcataaatttggttttagacaagataaatttggacatcagacactcacttagatatgctgagtaggcagtgggaagtaagagtatgaagttcaggagagtgcttcaggcctgagatatacatttggagaatatcactatatagaatataatcagagctatgatcttgttcttttttatggctgcacacactaaagtacacagactagtgacactacaaagcaaccacataaacaagtctgcaaaataagcagctagtatcatgaggacaagatcaaatctacacatagcaatactaaacataaatgtaaattgggctaaatgctcccaattaaaagacacagagtggcaagctagataaggaaccaagagccattggtatgctgtcttcaagagactcatctcacatgcaatgacacacatagactcaaaataatgagatggaggaacatttaccaagcaaatagaaaacaacaaaaaatatttctaatagatttctgcttttaataatgaaatatgtcaaactcctataaaaactatatgtaggaaatataaaagtttatatataattcatgtaatggttaatagtaactgaatagctagtattgaataaccaagcttcttttgttgttttgacattggagaattgaacatgcttaaaagttattggaaaggacccagttaagagagaaagggagtttgaaataccattaagatccttcccaatgacttttaaacataatcacttatcatgttaaaaacaacagaagcttggttatttaagcttggttacctcctctagctaccaccttgtcttcttttagcctgttccttttatgttttgagttttttttagagacaagatctttccctattgcccagactggaatgcagtgacatgatcatagctcactgtaaccttaaactcaaacaatcctcctgtctcaaccttttgagtagctaagaccacaagtgcacaccaccacaccctgtgtttgttgttggtatttggtagagaaggggtttcacaatgttgctcaggctgatatcaaacttctgggttcaaatgtacttcctgcctttccttggcctcctaacgctgtggaattgccagcatgagtcaccactcccaacccttttattttaatatgtcacatgaacacctctatatctccaagataatatctatcatttctcccctaaactccttcaacagcctcctggctggtctctctgcctctgttatgggtctctcaaatcttttccccactcagccccagatttcttctggaaagcaattcagattatagtatctcctcatacttaaaaccttttcacctgtgcattaagaacaacattctttaaaggatcctgaaggccctgtgtgatctttctactacctctctcaaggctcattgtctctacaatttgcctttagctcattgtgctttaatcagattttttaaattcaatttttaacttgtatttaatgtttcatcctgccagttttccttttcctgatacacctattttcttttcatatttgtctaatcaactttcactcatttttgcattgcagttcagcaccatcattttttcacaactttttcactgagttccttaaattccctctgtactcccacatcacactgcatgcttttcttcctaagaactttcataacagttaccatttcacatatatttgggggatgagctaaataatatctctcttttttattatactatatattctatgcattcggagatttaatttgttctcagtattgtaaccctagtgccagcacagtacctgttacatacacggtaataagtgtttttgaataaaatgtctgttttttttctgacacttttgtttctttttgagatgtttctctgattttaactgtaagaacaaaagagccagaaatggcttttgattttaactctaagaacaaaagagccaaaaattcttgttttctttaaaatatttctagaaaaaatctttctagaaaaaagcaaagtacagtctccgggtacacaatgggttgaaataatgtgtaaacaatgcctacatatttctaaatttcttccagatgagggatatgagttacaaagcaatttgaggctttggctggttgtaagactataaaaatgaaaattgtcttctttccttacaagtacttgttcctgactcaaaagatgcatttgggttaaagttcaagaagaaatatacataccaataaaaccaggaattctgtttgttaccagtaagagaaaaaaggaacagaaaataaaatataaaatacaccttaggtggtaacagtgggaagggggaagaattctaccaaggacttttaaattgggaggaaagagatggagataagccatgtatataccagagcctgagaccttatatgtatctgaatagttcaatagaatgtttgataaatttttcttttctttttaaaatttttgctgttataatgattatttaaatttttaagtaatttttcaaattgacatatcaactgtcatgtgcaccatgatgaaaagtttatctcatagaagtagggactacaatggtgataaccagaatccacgatggttacaggagagggagggtttggaaaatgatggtcaaatatatttacagttacacaggaggaatatgtttaagagatctattatactacatggcaactatagtcaacaatatattcttgaaaaatggtaagaatgagcaattatttttgtttcttcaaattgtaaaatgaaggactagtagcagctaaatttcagtttagtgctcatggcatgcagttccttaaaacctcattgatttatacacttggttttttatagttatgataaataacttaaaaatcgagtctatcacgaaggtgatgaataaagtcatttttcatttataatggaaagtctttcttgaggttatatggcacgtaggtagaagctaaacttactcagagcatgaatgatgggtagctaaagggtccgtttgtcacagttcgtctactgcaaacgagatgactacaaagcttagggcccatccatttgtttacagagacagattaatttttttcagcttttattttctctttgggagcttagtttacaaatgaagggagctgaagtcttctctaaacacacacaaccatacacacatacacagcatatgaaaatgtgaaagtcttattaaaagcacatacataaaatatgactatttccatgatatcagggtctctattttgctggagcaaatgaaagacttcggaaagttttaaagacaaggtaagaaaagagtcatggacaaagattaagattcagctagaatgtcagacctttcaaaattatttttttcagcttcaaatcattttttcacatgaatacatcttcactagtgcaaggtttcaagcagctgaaactggaacaggcctcttctgtttactcttagatagtgctttgaattttattagcataacttctgggaaatagtctagtgcatttggatagctaaacacattttttaaaagaaaggaaaaaatctacaatgattggcaaaagaacaacataaaaatcatcagaacatttatatttttttacaaaagaatatcctccaacgaattagatccgaggaattcatatttaagaggatcagtctaagaagctaactgactcatggattacaaaagaatactttaaagaacatatcagaaaatacagttgctttgggcatcaattgaaatattagcaattatcataattgagtacattttcaaatataaatataatgtaaaaatgacctcagttgccatttatttgaattataatgagaaatactttaaataacatattagaaaaatcattaactggagatccatccactaagtgacaataataaaaattgatgagtgaacgtgagcagatttatatttgcaatctcaaagctttctgtagtttctcaaataatctctggacttgcagagttcctcaatggaggcaatgatggtattttcaggagaacaatgtttccctttgggatttgccatatatcacaagaattttgacattcctccttcctgggaagtaaacacttccctgtcattaaaacaaaaacatctcttacacttacacacacacacacacacacacacacacaccgctgctaaacaccccctgggggttggtaaaggtaatgcctaatgcctacttcagaattgttgcttaaatctagaggcagaggtatgagttttcaagcaaacagtccacagttgactctgacttactaatttgctatatgaaatctatatactttaaaccaaagaatatataaagacagtattatgaacctacacacttccaccaagagtttttaaaagaaaaatatttattaggatttttgtaagtaaaaaatacatatttgagggaaagttgaactctacagtaaatctttaggaaaccaaaaaaagtttattcgcaatatagttaatatttttcatctatttttttcttcaataggactatatctatgttaaaatatctgtaacttattttaaaatacccccataggagtatccttgtactttattgtaaaataagctttctgactgagaatatatacagtattacaaactatgtaatatggacaatttaaattatagctgttgattcacctattgattaggattttactcaaacataataattttacatacaatatattatttttagaaacagtattttaaactacttatgagcattttattttaaacttgatattttttaaagtagacaatgtacacttaactgtttttctgactcttagctaaattcagcattggtaagctttcctctgtaagagcctaatagtatacattttaggcttcacaggtcagacggtctctgttgcaactgttcacctttgacggcagtgtaaaaaggccacagaaaacaggtaatcaagtaagcatggctatgtttaaataaatctttacttataaaaacaggtggctttggtgcacaagctgtagtttgcttaattctcatctaaattatgtaatagtaagaatatcttcaacaacatagagaaactaaggaatgcctgttttctcctgtttttaatttattcataatgtatgaaacttctacagttttaaatatgttttagggataaactaggtcattaatattaagagattaacacagaaatatagaggtctatatcaatgcgtcaattaaaatttcagtaaatgaaaaaagtaaccatttcattttgggactggaggtagtgaattccttattcaatggtatgctagcctatttaatgaaggagatagattttaattagctgtttacatacatggtaatgatgccttgatattacttgattatcaataaaagcaggactcacacctgttcatttccactgaaatgagtttttttcagatacttcatgttttattgacattttatttaacagagaaagataccgcatcaaggattacttcatgtgatttcatatgaagctctagattacgctctagatgcgcatgctatttcaatttaaggaatccttagaggttagagacagaagtcacaaaaagattcttttgtgtggttgctgcactgaagtgttgtggttgtataatgtcacatatgctttatatgaacttcaggaatggattgagatatttggcatagaaatgctatggtcttaagtctagtttaagaaaccatatgctgtaatatattccacttgactaatgttctaactttggtcctctgacctcctttattagcatctcttagtgaatttttaaaaagacgtatgttagtctgtatactaaacccacaggattaaaatctctgtgcatagtgactatgagtttacgcatatcccatattctccaggattttcttgttttcttttgaaaggaaaaacaaagctgtctttattcatggattcatgattatctacataacaaatccccaaaaaactaccaaacaaaaattttctgtaactaataagtgagttttgcaaagtcacaggacacaaggtcaatacacaaaagtcaattactttctcatatgccagcaatgaacaattagaattgtaagtttaataaataacttttactatagtataccccaagaagaagtacttaggaacaaatctaacaaaatatgtagagaatctgtaggtagagaaccacaaaacagatgaaagaactcatagatctaaataatggagagtgtgaagagagactatgaaatgggaaaaaagtactgtacttctgaaccgtgcatctaataagggattaatatccaataaataaggaactaaaacaactcaatagcaaaataataataatttatttaacaatgggcaaagaatgtgaatcgatatttctgtaaggaagacatacaaatggctaagtatataaaaaaagttcaataacacaattcatcagggaaatgcaaattaaagccactgtgagatatcacctcacactgctgttagaatggttattatcaaaaagatgaaagataaccagtgttggtatggatgtgaagaaatgagagctcatatactcttggtgtaatttaagttagtacagctattatggaaaacagtatggaggttcctcaaaaaattaaaaatagaaccaccatataagccagcaatcccactactagatatacctccaaaggaaaaaaaaatcagtatgtggaagagatatctgcacttccattttggttacagcactatttacaataacaaagatatagaatcaacttaagtgtccatcaagaaacagataaagaagatttattatacatgcagatggaacactagtcttaagaaagaaaaaaatccagtcacttgtgacaacatagaaaaacctagaagatactatgttaggtgaaataagccaagcacacaaagacacatgacaaacctgaaaaaagtagaagtaatagaagcagaaagtagaataatagttaccagaggctggggggaaaacaagaaaaaaatgaaatattgaagaaatattctgtgttcatggagtgaaacacttaatatcatgcaaatctctctagcaagtggttgttccacagctgcattaagttcttccctgaaaacactccttccttccctaccacatgcccaggctgcagaattttccaaatttttatgctctgcttccattttaaataaaagttccaactttaaatcattttgtactcccatatttgatcaaaaatttttagaagaagccaggccacatactgcatgctttgcagcttagatatttcttcttctatcagatatgctaaataatcacccttaagttcaaactttcacaaattgctagggcatggacccaatttagccaagttctttgctaaggcaaaacacaagtgacctttgtttcagttcccaataactttctcatttttatctgagtcttcatcagccttaccttcactgtccatatttctatcagcattttggtcacaagcgcaagtctctaagaagttctaaactttctttcgtcatcctgtcttcttgagagccctccaaactcttccaaagtcggcctgttacccagttccaaaggtgcttccacattttcaggttttttttttttttgagatggagtcttgctctgttgccaggctggaatgcagtggcacgatcttggctcactgcaacctctgcctcccagcttcaagtgattctcctgcctcagcctcccgagtagctggaactacaggcacgtgccaccacacccagctaactttggtatttttagtaaagatgaggtttcaccatgttggctaggatggtctctatctcttgacctcatgatccgcccacattgacctcccaattttcaggtatctttatagcaatgccccactccttggtgccaattttatgtattagtccattttgcattgttacaaggaaatatctgaggctgagttactttataaagaaaagaggtttatttgtctgacagttctgcaggctgtacaacaatggcaccagcatccacctagcttctggaaagtcttcagaaagcttacagtcatagtggagagcaaagcaggtgcctgtgtataacacggcgagactggaagcaagagtggattttctgatataaccatcccaattatatgtctcggactagcctttagcagccactgttttagagaagcttagcatacaatatttttaaagttctaatatgtcattataattataaaacaattttcagagttcattaatgttttctttaaaactattagaccttcgatgttcaacctcctgaaatagtgcttaaaacctagaggcaacatgtgggataagttgtcataactatggatgagatcaaatcttaaaaaatgcattgcaaagataatcctctttcattatgcttttacaaaaggatgatgctacattaacacagtaatttctgataaataaaatatattaaatatctaagaattaacagttgctggggaaatatataaccaaagtttaaaatatgtcagaatattttaataaattattaaaataaataaattcttaataaaaaagaccagagaaatctgacttctttctttctccgaagctagtggtgagttgattatattagttagttctcatattactataaataactacttgagattgggtagtttacaaagaaaagaggtttaactgactcacagttctggaggctgtatgggaggcatggctggggaggccccaggaaacttacaatcatggcagaaggcaaatggcaagcaagcacatctttacatgtcagagccagagagcaagagcagggggaagtgctacacactctcaaaagactagatcttgcgagaactcgctcaccatcatgaaaacagcaaatatttttatttagatagtcgttaggattgtatgatctgtaattttcatattacatcttctatttcacagttagtatcatatgaactctttgaaatcagacttcctaaaatttagctaataggtctggtaaatacctattggctgcttctactcttaccaactttttcccttctccaaaggtttactgttttcatataattgatatgtgttttccatcagccttattgttgattctattttataattctaagcttgtgtgtacgtgcatcagcgcccatgcatgaatgtctgtgctctctatttctttcttatctatttttaatttacagttatctcactgtgttctaatttatgtatctttgtgaatacttaaataatttttgcaacatcgtgtaaaccaaagaaatgaagaattttagtttcccataccattaatgtattgttttcatttcctgagtatgattctttagtttctttttctgccggtgctctacttttgaataaataatcatataccaatcactaaaatgcaagagtcatacatctgaagtcatgtatgttgattacataacagtgtagaaatttggtctcaagataaccacagtatttaaaacctcaattttatatttaaataaaaaagaaactagcacatttagaaatgcacacttcaactttgctcacctgactagcaccatgtatctgtttatttagttgctggcttgtgaaggtattattgataacacattcaaaatcatggggtgatgatgagttcagatacagatcagtaggtaggatgatagataccttagatacatagataaaactcaggtgaacttggagatgtaaaggtgagctagagctcatctttcattcacaaactttttccaagcacactgtagtatgaattgcgtttggacatttaggtgatagcaaattttcaacacacagcaacattttctacatttttttgtttgtgtaatatcaaaagtgtgacgttggctaacagtgaaaataaaactgtagctcactctaattctgccaaaatatcctatattttaattaagggagttttacctgagtgaaaaacatcgaaaattccagtaaaaatcaaggattttacatatgtatatgtgtatttgagctaaagacatatattcttaaccacctgtagcatgaaataagtaatcaaatgtgaaagaaacagctaatttgttgaatcaaataattttcttccaatgattatatatcttgcatagcagaaagattgcatgcatatgaatgaatgcatttgcttcactttatattttcttccctaatagttttaattttttattttctaatattgtatgtgatgaagaactcgagtagtattttaagctattactttagatgcttaaagaccattagcactctaacaaaaattgtcattgtctttataaagatctctgtgcctgttgccacattagtaaaactgagataatcatagaaacagtttcacaagttggtgagaaaatattgataaagcacttagaattccattacacacagatcaggtacccaataaataatgggtatttctcatgaaacagattagttctgtatcacttactttacatttccagcatagtacacagtgcctgagactgagaagcagctctgttaatatttactgaaagaatagcattaaataatacaagaaaaataagatataattaaacaaatcaatatgattgatctctgtggacgtccacagtttaaaaccattccctctttcttctttctgtcttaccctaggatcagggatgccaggaaattctaaagtacttgaagtttttcactggatcatcttaactctctagctttatctaattaacatgaagcaccatcatgactatgcatcttattcaatgtgtttcagaacaactgtcttctaagttacatttgaccataacaataaactcggttttcaaaatgtgtcaatcaactaatagggtcattgactcacaacctacagacagtaatagtaacattaacctctatcttgggtcaaagcccctgcttcacttttgggatcatcagcaaaccagttacccctggcaaagttcagtcctccaggtgcactgatgatagtgaaaagacagtttcccaaagcacagcttgttccttttcatcatctcacttctctctcttctcacaaagaatctctctgtgtcagacaaagatgggtggtacagtgtgtctgggtctaaagctggaaatgtttttcttttctaaatctcaaatatgttttcagccaaacgtttgatgaactacaagaaatgagaatcaggaagtcagatgttcgctaagataggtcacttctgtaaaattatcttacactgactaccaaaatatgacaattatttcaggaaagggaacaaaaaaacgcttgtgattagaagattggggaaaaggactacctcttctacagttgttttcaaattgaaatctttgtactgttattttaatattttaaagtgtattcactttttgttattctgaatcctcaattagactgtaattatctcaaagggtaagatcacaaaccaaaggttatgctctcaactgtatcactaaaaatggccacagtaatttttttagccttagcttccttccacacctacaaaataagcagaaaaatatcctgtctcaaaaggattaaatgcaataatgcatttaaaaaaatgctccaaaaaaggtgaaccattagataaacataaggcaaaatataaggttaaaaagacagagaataaagcttaaacatctttttaatttgagaaaatgtaatgacacatgcaaatttatttggaaaatagatgacataaaagacattcaccgaagttttgttcaaccaagatcaaactcagagaaatcgtaggtgggcaatgatatgccttggtgaaataacgaagtggggatttaatttctcatactgaaagtgcctttaatctgtcccatattgttattcagttcattaaagaacaacatgcataaacatggatttttttgtgtgcttaaatcatcttcctaaatatgcaaatcagtgaggcatatattatcagtgttctgtttaatattcattgtgatctactcagtagttttcctttctaatgagagcataccatctaagtaactcaccttcccatgcctgaacttagccaatttagttcgtacttgaacacgacattttttttcaaagttctttctagaccattacacatacgtatgtatgtttgtatctacatatcttctgtagctcctcatttactttgcaaacatatagtcaccctaaattcagtttgattattgaaagtcagggttctttttttaatcagaattatatttcaggtagagttttaaataattagctcaattgttgttattgactagtaaatgaacactaaagagcatataaaatacattctaaatctaagtctgcaaacaactatattgtcacatatgtcatcctcatatacgacaacaaggtttatggctacatacaaaaacttggctctacatacctatatactagttatcaagccagtcagatacttatcttaaaaagttgttcaataaaggaaattttataaaataactatacacatgtgttcataaaaataatatactggtccctattctcagaaatttttacaaatgacatgctataaaactcagcacaaaacccaagatatcatgtaattaaatttcctactgcgtaactatatttgcactactaatacagaagaattcaagacactaagaggaaaattaaaccaaaactggacgagtagataaacagacaaagaatatagacattactatagtcaggaaaaagtatacaaacaaggacaaaagagagaactaaacagaacataggggcctaaggtataagtgcaaactcatgaggaacctgccttgactggagaagcatgtgtgtggagaattaacagactattaagataaggtgggaccagaatacggtggttttagttgtcagagataaaattttaagccagatgctctaggcaatagaagtctttgtaacttgaagtacagctgagaagcatgttgtaaagctttaggaggacacagaatagaaaaaatacaggatgcctgcgaggcaaactcctggagttttgtgcaggcatacaagttattcaagtaatctagtcatgggggaagaagagagtgtcaggctctagtaaggaaaagaaaagaggagaatcttttaaagtacaaccagtttcatgacatatttgttataaaatattaaggaaagaaaaaaagagttaattcaaaatttttcatcttggatgtgagaagtgtgcttttttgtacgtatgtgatacagctctaggtccctccagtaattccaacttcactctatactcaattgttatcgttgtctttattttatatagactacactatacagataatcattgcttttatcttatcttttactggttaacctgtattggtgcctacgtaatcagtaggcaactggttgaagcttttcgtttattttctgttacatgatgatagttacattggtcatccaaaataaatgcttaataaagaagttagttgaagacagacattcctatgacacatttatttaagtcatactacacttaaataattccaaagagaattcatttatgatgttttaactcacctatcatataatcagcatttctcaaggcttagaatgtattatatgtagacaattcataggaaaggaaaaactcagtatttttaattaaattgaaacccacttttcaaaagtgtatgtacatggagttttttgttacagaccactgttagttttcaaaagcacattcataagattattctctttcaagaaatctaataaattccttctgaataaaaaatcttgatagattaatatgagatctggctcatagaacttattcttaattcactgcgtttgtggcctccaagatttcagccatactgacaaaagtgaaaaagcaccactgccaaaattaagatgaacacagcagactttaggaaaaattacctaagttttcttattttaaatctcaccccccatactctccccaacacacaccaaatccttatatggtcagttcctaatgatgagaggagttcagctagcatcttccaagcaagagttctgtgtccttttttgcctattccccaaactccaggtttttgttttgcggtggcaaacacagtctaattaggtcatgtgcaattgtcatatacatgatgattatcaggagttttggagtctgttatttcacttgggttcttatataagcatcattgcacaaaacatcctattattattatattagtctgctagggccgtcataataaaataccacagactgggtggctgaagcaatagaaatttattttctcacagttttaagaggacagaaattcaagatcaagttgttggtaggtctggtttctcatgaggcctccctttctccacggcttgaccatggttgtcttcttactatgtcctcacatgacatttactcaatgtacacatatcactgatgtctattcttcttcttctaaggatatcagtcatgtaggatcagagtcctattcttctaacctcatttaaccttatttcttttaaagctctatctccgaataaagtcacattggggattagggcttcaacatatgaatttcagggagacacaattcagtcccataaaagtgaacactaaccaatttcagaaaatactgtcattcctaacatagccaccatttacacaattaatcatacaattctcctaaccataagcactctttaaaatcagaaccctactgattcttgtaatgaaaatagtgaatcacttaacagttgtcattttcatcactcataccagtaacatgtattatagaattataaattactatgaagcttaatggaaaacaggtgtaacaactcacaatttttgcaaattataattgaatttaatgtattaatgtatcatgtacctgacctatagcatcttatactttgaggactatatagtatacagtgagattataatatgagaacatatacaccaagattaggataaagagaacattaagacaaaaaaaaaaatcttagaatagaaatgagaaaataaaattaacagaaaaaaaagtatctagttgggcaaaggaaaagtccatggagattgaaagaagatggtaaattctggaataaaaattaaatacctctctggaatttacacatatagaacattcctgctcaatgtgcctatgctggcagtgattgctgtatcatctgagagttcttccacactaatagtatcaatagctggtataaagggggagtgtcaaggaagggaacagagggcatttcaactggaacatgtgaacaggtgggaaggggtctctccagcctgtctgaggactagtcctttgaaagtactggatccacaccttgttaaggacattttcactgtaggactcaaaggaaacagaattgtacttgttgagcatcctttctgctgggagtatgtgccatccacagggttgttaatgtatattatttctcaaatgatagtccacagataaaatgaagtattaaacgttctggatgagggaaatgggttttaaagatttagttgtctatgcagtctttaaaatatatactttctatccatttgctatttaatatgtgagttttctgttctttatcttgcttatattttttctgtgctggttgcttaatatatcaagtatttcaggagtgatgaacaaacaaaatataacatatttatctatgaaacttatctttgggaagtttttgaaaataggcactcatacaaatgctaggtctaagaataaaaatattattgtctttggtatctaggtcggtaacacttctttggagtttaatggtcagttaaaccaaaatattatacagagagaagatataggctatattcctcaatttatctgaaactattatatagcaagtggtttaaaattgacatgatcatatattaacatcatattctatcaatatcactgaggtaaataaaggatttttttcacatattttccaggattgaaaaagcaactccaaactactgagctcagaatttcctttttattatggagggagtagatgtaatgatttttgattgctgatatacatattttgttcatcaaaaattaaatgaagcagcacatttctacctgaaatggcatatctgtcagctgtgtgcttagagtgtatttttcttctctcatataatattgctatggatgaatagcatgctgatgaatgggattttaggttgagtttttaatctgaaagttttttttttttttttacggcttttcctattaatttaactaacaagattgctgggggcaggggcagctgctaggaagtaatattggaaagactttaaaatatttacatatctgtataaatgcaaatttattaaaaatgacagttgaaaaaaagcagtgtagtattgagttaaacataggccttaacccctccattctaaatgcattattggttgatatatttatatgaatttattattaggcactatcttagacatcactgtaaaatgtataaaatatggggcagtttaattggtgtaaatatgtcaaaatgtaaaattacttttttaatttctcaatttaatattgtcagacttttctttatagtgcatttatatttcaatgaactaattaagaaattgactaagttgacttcaacatacagacatgtgagcctttgggacatcatttgtggattgaatgtttttttttgtcatgagcatgcactattcactagacctgattcaacatctgtttttgcctataagttcaattattttttccctaacatgcagctagctgtatatttttttctttatagtaaagtaatacatattctttgtaatacctatagatagtagataaggcatgcatacaaatgacaaaatcatcctatcagttagagaaaagttctaattccttggtgttactattttatggtaaatatatggtctctggagccataacctcaggttcaaatgctggctcaactgcttactactttcttgacatcttggtcaagtttgtacctcagctttcatatctgtgaaggcagaggacaacagtatctcagttaccaggattaaataagttacatacaaagtactcattagagctcctggcatagaataaatgttaagctgatgaaaattgtattattgtagagtttcatgcaaacccctgaatttttacataaaatagacatagtttatgaacatttttgctgcttgatgtaatgtgaattttttcatctctcatgatacatgtgtgcaatcttttaaaaatatctgtatagcaattttcagtcaacatctgtatacgagtatgcagttctgttcaaataatcccacgattttctagaagaaaatatactgagctgaaagaaatgtattcttgaaggatgtttgaaaacatacgtactcctcttgacagtgtaggggtctgaaaatttctgttcagcttttctagtacaaagtattgccattaactctcttctttttctagttactaaattataagtgtgttgcttcaatttatatttaattgcttgtggaattaggcattgttttttgttatttaattttgtcttttatgcattatatatagatgtatttgtcattttcttattaattaccatgagatcatttgatacaaaacttgagtttcttaaaatatcggatgaaattattaagcaggtaactgttttccaagttctagtgtgaagtcatgagactcctaatggactgaataatacttggaaaactgagaagttctgagtttaatcactctaaagtgatttcaatctttgtcaaaacccaacaatcattacattatgggctcgagtagcgtagttctcattccagtgggaatcattttctttagaaactacttgctttggtttggtgtctagtttccaattcattgtttcatatctggatttgtcttttggctaactccttacagttgatagtttgttcttccatttccagtctgcttggcttgtaatcctggtattgctcctgttctttggtttattgtgtggataatatacatcagccccatcctctcctttaacaaggctttcacatttctagctttagtttgtttgggaaggtagacagctatgacaacaactattatccttgtcaggaaacaaattccaaggctggataaaatattgctctcgtcccatactgcattgtgacacttcttatagctaaatgcaagaactcttacttagagtctctgtgtgtgattctatctaattaaaaagaacacttccaaacttgtttgaatgcaaatgtgcatgaaaatgaacattagccacaccataaagaaggcatttagaaacgcaaatacacacgaacctcatgtcagagttgactcccttaccatttgttatggtttggggtttgttaccccaactaaattaccatacacagagttatactgctaaaataaaatgcagtgtaaaatttataatcattttaataaagttaacattctggaaaacaattatttcattttcataataatttgcattttatcagacttcaaaaaaatgttgcttttatatttccctttagatataaactttcataacattcaaaatgccaagtaactgggctaaataacagtaggatataggaagcaaaattaatataactttttatttctacttttaagtaaaattttcaggatcataaataagagaaaatgttaataaaataattcattttaaaaattttcctgtggtgatgttgtttaataaaaccacatttggaaaactaaatcttcaaaagtggccaggtcatttttacttaaaatacaaagagatcatctgttttttcttgtcactgttatggaaccagcttatactaccataattcattagacttaaaagtaagatcttaataatgtttatttattaatttgagaatgtcaatcaagaataagaaaaaataaagtcaataatctacagccttgctgatatatctgcaatatatattgtaagtgggggaaaaatactataaaataaaaccttgatggaaattcagtaaatttctgtcaagtatatttagaagtaaaagtgaaagcaaataaatacacttttttaatcgtttaatttaaaatcaaaataaaagataaaggagcaggtcagcccctctggaaaacctgccacttcagttgaaaaaacaaaggactgtcatttgttctgagttggaatatacaaactacagcatacaaactaaaacatttgtccaaaatttagagtcaactcatttatcatgaggtagcagtctcccttgtcaaatgccaactttgattatgctgtaaattccactatttctctggggttatcttggactcctcagcataaaataatgttctttttgccatatgaattaaggttgagattgcactgacactcctcaatagcacatgttttgcctcatcactacctagaaataatttggtaatgaagctcccctgagagaaagctgaataatattaaatggtatcgttggcaatcagtgctgaagcctgacacgtgagtttgcatctccctctggtggcagagagaaatgaatagccagtaggtattataatccataattacaattacaactgcactaataaaatgatgtcagaagccaataacccaagttgagaatgatattccctagactatccagatgtaaagattttttttctttttgtaaacaaatgtgattcaatagcactgagaatattgcaagagtttttatattttgctaatgttctaacttcctcataggaaagaacataaaaatagagtataatcaatgcatcttacaatttcctaaaaactgatacttttttgctcttccttctctctttctttatgaatgcaaataaagacaagcacattaaataacaatcagattttctgtaaacattcttataagtttttttaagtctgcttatttcattttataagatcatacaaatatgtgatcgatcataaatttcctgggatatcaacagaaagtgtgacaatatagctccaataaaaaataattccaaattacattctaattgctatataaattcatttttatgaaaaaagaaaagtatgttatgcatagtatttcactgttaatgtggttagctacagagcaacactgaatataaatttccttaatctttgataaggagtcttgatattagtcaacagtgataatgaatctattcagcatcagtatttcccaaagtaaaagaatagtgataaatacatgctatataaattgcaggaggcataaaagtgctttaagatcaaatagggaaaaaaaaacaaaacagagtgatctcatcaagatggctgactacagatgcctagcattcatctctcccagaagaaaggaccaagttaatgaataaacagctaagattggactggagtgtcgaagggaaaggggagtggagatgcaccagtagtgactggaaattcaggagggcagcacagaggcacccagaatctgcagacccatctccccaaccctgatctaatttgctgagtcaggagggacttcctattgccaggaaaaggtaagcagaagaaccccacaagccccattgcctatgtaaacatctacagtctcatacaacaggagaacttcacagtccacacaaaccctgaaaccagtttagagaattgctgggaattcattaccctggattaggagcacaaggtgtgtactctctccctccacctcccacctcccattccctgccattagccaagctgccacagcatgttgccatctcaagatcagagccacctctggaatatgcattgttctgggggccaacacagggcaccatcttcattatgacaagccgacaatagtgactgaatgctacaaccccagctatgtggactctgggcctaggatcagctgtgattctggtcctgtacagtacagaaaccagtatttggtaccacacttctagccagataaataatcttacagtcctgccttgggcaaacccacccttgaactagccaaatgctgcactcctttcccaatgcaggagagaactccgaggttctgagcagctaatacacccccagactagtggagcagctatgttcctgcattcagggtctgagaaacagccccacagcaacccctgctactccagacatgtctctggcttgcttaacagccctgtgcctgcagtcagcgtttgagaaacagtcccaaaggcttcccctagtgggcacacccatgggccaggaaaacagcaaagagtatatgtcttgggccttgagcttcaggtgtccacccctagtggacatgctgagtagccgtgtagccacgtcaggggcctaagaaataaccctgtgcctgcacttagcagacacaatcagaggccagccaaacagcctttctctcacattctaggcctgacttacagccttgcagattgcccttagaagacacacagccaggctggctgaacagctgagggcctgcgttccgagtacgtgtttaccgcgcctgtgttctggcactgtaggcaacccacagcaaacatgcacccagaccagccaagagagcatgtgattgtattctgagcttgaaaaacatccccatacataagctgactaccagcagacacactcccgggccagctgagcctgcttgtgctcatatctcaggcctgagaagtagccctgtgggtcacttgggcaaatatgcccccaaactagctaggaaactgcttctatgtcatgggcctgcaaaacagacccacaggctgcccttggaagacatgcttccaggctggcagaaaaactgcatgcccatgctcctagccagagtaacatccctgtagccccaaacccagtgagccagacaccaagttgttggactcactgtgtgcacacatatgcccctgacctgaaaaatagcccggtgagccaactttcagcaaagcctcgccattatcaccacaaactctcttagcataggctactgagcaacttgcaaatgcctttagcatgggttagagctgtagaaacgacatggagacaacacaaatgtgtctacctagaatgaaggcccacacaccctaccaaactgacagcccaagacccattcgtatgaacatatctttccatatgaaactaacaccataaaattaaactagattacttttctaccaaatgcatggaaattaatgtaggaacacatcaaacataaaaaacaaaggaaacatgacatctccaaaaaaaactgattatctagtaaacagataccaatcataaggaaatatatgaaatgccagaaaaagaattcaaaataataaatcttaaggaaactgtgagatataagagaatacagataaacaattcaagaacatcaggaagacaactcatgatttgaatgagaaattaaataaagagatagatatcattaaaaaaagaaccaaacagaagtactaaagctgaataattcaattaatttaaaaaaatactattgagaactttaacaacaggctagaccaccaagcagaagaaacaaatttctgaccttgaaaacagatctttttaaatgaaccaggaaaaaaaaataaataaaaaagaatgatgaagaaagcctacaggatttatgggagatcattaagtgaacaaatatgttattataagcattcaagaaaaaaggtgagaaaatcatatttaatgaaatgatagcagaaaacatcttgttttgttagagggatggacatccagatccaggaaggtcaaagaacttcagattgattcagcccaaacaggtctactccaaggcgcattatagtcaagttgaagaaaatcaaggacaaataattctaaaagctggaaaagaaaaacattaagtaacatataagggaatttccactagattaacagcatagttttcagcagaaaccttagaggcaaggagagaatgaggcgatatatccaaagtactaaaattaaaaaaaaaaaaacaaaaaactgtcagctacaaatactatattcagcaaaaccatctttcaaaaatggaggacgaatgaaatgtttctcagacaagcaaaactaagggaactcattactactagccagtcttacaagaaatgttcaagagaattgtagctctagaagtaaaaaggtggtaaataccatcatggaaacatacaaaactcaaattcactgatacacacaggagaaagagaaaagaataaaaccatatcactatagaaaaccaaccaaccacaaataataaaagaaaaaaggaacaaagggtatataaaacaacaagaaatcaatcaaatgataggtgtacgtcctcacctatcaataataactatgaatgtaaataaactaaatccccatttaaaagatataaattggttgaatagatttttaaaatcctctctctatatatatatatacatgtatgtatacatatatacatatatgttgcctacaagaacctcatctcacctttaaagacacatatagggtgaaagttataaaaaaagatgttctgtgcaaacagaaaccaaaagctaacagtagttatagttagatcagacaaaacagaaaaacaaagaaacatcagatttaaacttcaccatagaacaaatggatctaatttacaaaacatttcattcaacagttggagaatacacattctgcacatcagcacatggaacattctccaggattgacatgttaggacaccaaacaagtttaaatattttttaatcaaaatcatatcaagtatcccattgatcacaatagaataaaatgataacaagaggaacatttgaaataatacaaattaatggaaattaaacaacatgttctctaataatgggtgtaggaaaaagttaagaatgaaatttaaaaatctcttgaaacaaatgaaaatggaaacacaatgtaccaaaacctatggaatgcagcaaaagtagtattaagaggcaagtatatatcaataaatgtctacatcaaaaaaaactagaaaaattgtaaataaacaatctaacaatgaatgtctagaaaagaacaaactaaatccaaaattagtagcaaggaagaataaagatcaagcagaagtaaacaaaattgatactaaaaaaatttttaaaaatccacaaaacaaaaagttgggtttctgagaagatgaaattgacaagccattagctagactgaaaaaaaaaaaaaaaaaaaaagagagtagacctaaataaaatcagaaataaaatcaaagtcacaatggagatcacaggaatacaaaacattattagagaccaccatgaacaactacactccaatacattttaaaatccagaaaatttcctaaaaaaaaaaaaaaaaaaaatccaggaccagatgtctttaccactgaattctaccatatctttagagttaacaccaattcttttcaagctattccaaaaaaatgaagcagaaggtattcctcccaaattatttgttgaggtcagcataaccataatatgaaaagcagacaaggatataaaaatagctaaacagaaaactgcaagccaatagcctgatgaacagagacacaaaagtcttaaacaaaatactaacaaaccaaatccaacaacacatcaaaaagataacacaccatgattaaatgggagttatctcagaaatgcaaggatggattaacatgcaaatcaataaatgtgatacatcacatttgtagaatgaaggacaaaagccatttatcaatacatacatttgacactaacatcctttaatgatttaaactctaaattaattaggtataaaaggaacatatctcagcataatggaggtcatatatgacaaacccaaaacatcttactgatcagtgaaaagctggtatctttttccctaagaacgagaaaagacaactctcacctgtcttattacacatagtattcgaagtcctacccagaacaattaggcaagagaaagaaaaggaatacaaattggaaagaaagaagtcaaattatctgtacctagatgacatgattttgtacatagaaaaatctagagagtctaccaaaaatctcagacttgataaataaattcagcaaggttgcagaatataaaaatcaatatgaaaattaagtcacatttcaatacaggaaaaatgaactagctgaaaaagtaatcaagaaaactatctcatttacaatagctacaagaaacttataaaatacctaggaataaatttaaccaaagaggtaaaaaaaaaaaaaaaaaaactccacaatgaaaactacaaaacattgataaaaataattgaagaagatacaaataaaaagacaccccatgctcatggattagaagaatattgttagaatcacaaaactatccaaagcaatctgattcgattaaatctctatcaaaatgtcaaggatattcttcaaataaatagaaaaaaaatcataagatgtaaatggaagcacaaaatacttcaagtagccaaagccatcctgagacaaaacagcaaaactgaaggcgtgacgctaccagacttcaaaatacactacaaagctgtagtaactgtaaaacagcataacactggcataaaaacagaaagagaccaatagaaccaatagagaatgcagaaattaatccacgtatctatagccatctgatttttggcatgggtatcgagaatattcactgttgaaaaggtagtatctttaataaatggtgctaggagaactggatagccacctgcagaagaattagacccctgcctccaaccctatacaaacatcaattcaaaattaatcaatacctaaatatacagtacagtcctcagaaaaatggcatatagttacagatcaatgaatgccattattgttttttattctaattttaattaatcatactaatcttgatgttgaggagatagaataacatctggcagccttttatttgctaatgttaaacaactaaaaatagctttaaaaaagttaaaatatccaaatgaatgacaatatttgatttatataaaatgaataagtcatattatttaaattttagggtgtttttgctcctaattttttgttactctacttttcatactgatttagcacctcttaaaaacataccctctcttccttctaactagtttcaggaccctattaccttgacctccagtcatctctctgagtcaattccattgagctgggtgaattggtggcttggcccaaacttcacctcaacccagtctctctttgggcaggaatcaaagtccccccacaggaaggaatgtatctttcaactcatgtgccatttttgcagaagcttttcagacacctcccttaccagtgaactcagtttcccaccctttagatggctgtggagtcctgcatgtgccgcattcggataattattcaaatgaagtacacttaagagcttgcattgtctaaaggcccaatgattcatgtaactcccctatcagcacaaatgagaagttcctgcctgaatgcagcagatggaaatggaaattacagactttggtaaggcagactatattgcagcttaatgatttgcattttaaaagttgggagttctcataaatactaaagagaaagaacaacgggctatattaggtagtttcaggtgcttgtatgacctggtgctaactatttaacctgcctgagtgagcctcagtcttcgttactgcagcatttgtaagatatcaatgcctgtttgaattcatgtcttactaagctgctgccaggattgagtgacatgtggatataataggacttcaggaattacagtatttcataaatgcagtaataatctgttacatttgtaacacctatacgcttttctgtttctatcttcatatacaccttgaagttttttttcatcataatcaaagatcttttcttgaggttacaataaacgggatttaacccataagcagcaatgttagcaattttcaaatttcttagacatgttttaagttttacatttaaatcagtgacaaaattgttgtcagttttggtttgtgtcttccaaaacagtgtctcaggcacttgctctttgatgagacactgtgcaaacgttgaaggatattagaaaacagaacagtttgtttacctcagctttttgtggtctggataatttgcacactgcttttcaataagctgatttgtcttcttgtttacataggctgtgctatagccatttaaagttcaaaattactgctaaaaggtaattgatcctctacttcaatatccctgctgtttcatgagctctctaacaattcgaaggaatctatttctcactgatgttgaaaaacataataaggtcacagcagggaggctttagcttcattaaagaacattattataaaaataaaatgatggagggcaaattgtttttgtccttgtggtactgtttctgcagatccacattaatctgaacgtttaaagcaacaataaatttgttacgtcctctttatcattcacttcaccatggtagcccctagtggtagaaggagatgccaattgctcactgctcaggttccaggggatttcttcctcagttgaataagaaggagttaagcctctttagaaaggagggctatagcctgtcgataactaaatttattcctgcttttaacatatcagaattctgatgtccagaaaatgtagatgccagcattatttaaaaactgagtagagaagtgaatagaaattttgacccactccggcttccatctatcatgggagcctataacgcaggatgaacgaagaaggatttaagatagaagatcagtgattgctctattaatctagtttaactgatactaaaatctgacagagcgaattacaagttgcaggcactaaggcttatcaattcattactactttcaaggctctaccttgctttctttttgcctttagctcctggcaaaggacagccttttacagttcaatttctcagtttatttttgactgcttttaattaaatttgatggcctgcttctgcaccactgaagttattggagttgcaaagcactttgctgttataatgatagctcccttgatgtctgttcattattaactgcttttcaaaagtgctgctttcaactctcattttataaatatttaaataattgtgaatttctataacataaatgtctgtgcacataagatagggtttctgtttgcctgtttaatacatagtaaaatagaaatctctttttgtaaggttatataatattaattaagaatgtgtccttaattcattcctaacataaattctcacatgaatagcagtatctcaaaataataatgatttaagagctatgacactcacacatataattaattctagtaaaatatcttagaatgatttttttaatatatagattaagaaagtcctgattctttctggtcttaagatgaaatagagtatattcaagagaacttacaaattacataatagttttactgctcaggggaaaaaaatggcagaggataaaattaaaagccctgatttttttttttttaaacaaagactgatgaattaacagtaggtatcaatctcttttccttctccaagcttcagacaaattatgggaaaataatttttaaaaagccaatttatagaagtaaaaaaaaaaaaactaaagatagtagaaaagacaatagtgtaattgagagcagctgatattatgtgtcccacactgttctaattcatttagcaaccataacattcctatcattacctccattttataaatgaggaaatggtgaatcattaagcaatttgctgattatcacatattcagtaagtggcaaagctagtattcaagtccaagcagtgtcgttgtaaagtcatacacttaatccctgtgccataattcaataaattgtggaggatgggaagcaggtggagaaatgattcatatagcagggctgagaaagtactgcctatatgcccacagtgtggagcccccacaagaagttagcaaatcactcagagaagctgtgagcaactcaccacttggaaaaactgagtgctttagaaggcacgaatgaactgcagttctgaacagagaaaaattcatcaagttctaaggtggttgctctctcttcctctacagtgggcaattacctcttcattcccatcacctccctttctctcaatcccttgaatccgaagtatactattctgtgaataaattaaacctgttaaatgttagattttgatcagagctattattggaagttcacataatcaagggacctgtaaccttctttccctttttggtttctagaacaccaattatattacccaagcccccattctaaaattcccttgtgaaatatgaatgaagagccacagatcatcagcaatggaagcaaaatttcagcatgagtagttgagacctacagtaacaactaaaaaggactgaaatagagataatgtctataatcaaagaacagggaaatattacacataaccaatgttggagtgagaaaacagtatgtgttgtactaaatcaaaaaatgaatgctataaaaaataacaaaaaagttattggaaaagtatgaaaaataaaatttaaaaaaccagtagaacataagacaaaccaaaaacaagaacattctattaaaaacagggggaattttatctttaaaaaatggtattgtcgtgaaaggcaagaaaagctggagaggttttccagattgaaggggactgaagagatatgacaactaattgcaatacatgattctaggttggactccatgctggaggaaaatcatgctataaagaattggctcaattgatgtaatatactgctagtattctaattctatcaaagtattttatcaatgtcacatttactgaatcttactaccatactgtaggtaagtaagactatctttatcttagaaaacacacattgaaatatttactggtgaaagaccatgtaacgtaaaatgactaaggaaaaaaaaaggactgtgtgtgtggggggtgtgtgtgtgtgtgtgtgtgtgtgtatgtacagaaaaaggaagcaaataagacaaatgttaactctacagataatctgggtaaaagatagtgaggtgttgtatatttttacaccctttctgttagttttttttttcaaataaaatattgtaatgaatagaagagtggaagataaaaatcaagaaaatctatcaaaagttaaaagaaagacacaaagagatggaaaacgacaaaagacaggaagaggagagcaatgcagaaggtccaatggctgattaatcattaaaaaaatatttgtgacagttgcagttgataagactaaattatcaattaaactatagaagaaaatttctgagcacacacaaaaaaatcgatctccaaacgaaatcagttccacacaaaggtatatcaagaatttcagaaatgcttaaacgtttcctacaaagaaaaagcatacaacaaaacaatttaaaaagtaaaacaagtcatctacaaacaaaaagggaatcaggctggcatcaaagtgatcttttcataattgtgagcaagaataatcttcaacttaaaatctcaagaaaatgctcaatcagatggaagggtggaggaggtaagctcattgaagagaagtacacatctaaaatgtatacttctcatgggccgtattttttagaaagatactagaagttgtacttctgcaaatatgaggtattgaaatcaaggagaatgaagtgcgatctaggaacaagaagtccaacagagaaaaacaaagacagggagtcttagagagcaaccagtgagaggggagcagaaggatgaaaggctagaggagtgaaatctaaacatatgaaggatggaattaaaatattttcattattttgtatatttgaaatttgaaatcatcactaacaactttataaacttcaggaaaaataaatatattgtgctaaaaatgtaaacctagagaataatatttatgtagtcataatcatgtaaataggaaataatgatttcaccagaaacaacacattgagagaatagtgggaaaagagtcctgtaattggtgcacctgtcctaattcctatgtaggcatcataatagaagttattaggtaatgtttaaagttgataaatcaagataataatacaagcatattaaattaaaaacaattaaggtagttaccaaaaggaccagatacacgagctaaacattgctttctctattgaacaggactatagcatagagaagtgtcaaacaagctgccattattctgttgctgttattataagcctcttaatataatactatttgattactagatcatgagctcctatttataaaaataaaagcaaattttaaagttataacaactcatgttgctacaaaagccctaaagtcatttcaacaatacagcacactgatgacactttccttgcccgaaacactttccttgcctttccagtacgctttcactttcctttccttgtttagaaactttttaaaagaaacatggtcctgtgttacatgtaacatgcttttgaaataaaaaccatctcctatcacaaggagtttttaaaagagcctagatgttcttattgtccttcgtatctctaaaaataattgctttaaaaattagcttattccctttgacagatacttgaaagctaaagttttgtgggattcagtacaaggataggcataccacatatctctactttttatgaaatttgttgctagtaatgttagaatatgtttgaatgaagcaccttctgtccttgctttcaactcctagctagagtgcatgaaatactaatcatctcttgtgttagtaatagaatttgtaaatttccacaaataaaatatgtttactataatttctaaatagtcaataccgagtagcaatacctttgactttagcagctggtatataattgtctatattacagtgtttatattataactagtatatattacagatagtgttattcaactattatagtaggttgtagcagtacaaaattaaattatcacaaatctacaatttgctcacaaatttttagtggcaatgatcacttatactactgtagagaggcagtagttgcccatgtgctgcctaaaatgtgagaaagttcttattacagggtaggataaaattgttgccttactaaacagaaattcacatatttccctctccagaaaaacaaaaatgtgtatatttaatatagtcaaagttgagtttttaaggtaatatgtcatctctaacaggagggtgactgctgaatgtttggtatttaaggtcttacatacaggaccttgaaggaggttctatattatataaataatctttgaagagtgatttatggttttggataactaaaagaatatgtgcttcacttcacattagtttttttaaagcatgtttttattattataacagtaatattaaatatagtggtcttttttcagtacttctcatttttttcagcattcagatgacaaaattttttaaaaaaaactcttctaccttacctacctgcataactaaactgagattattccttctctcactcattatgctaacttctaatgtcgtgtctcaaaaaattttcttctatgcaccttttttccttttatctttgtttcattgtaatgctagatagatgatgacttgtgagaaagaatctcaaatctatatactaatctccctttgtttgtttgtttgttttgagttagggtctggctttatcacccaggctagagtacagtgtcatggtcatggcttactgtagctttgaactcctgggctaaagagatcctcccacctcagcctcctaagtagctgggagtacagatgtacagcaccatgcctagaaaattttttttaagtttttgtagaaatggggtctttctatgttgcccaggctggtctagactcccaggctcaagcgatcctcctgcttcatcctcctaaagtgctgggattacaggcatcagccactgcacctggccaacttctcttatacgttccaggcttgtacttctaaattctacctatcttatacttacctaatattttcctaagtcaagcccttgaaaactcagtatgagcaaaagaaacattaatattttttgagaataactgtatggtagtgttaatcatctcagaagaattgctgggaaacagtacaataaaacaggaaaaatagtggatattaagacagaaagggatcatcatcatacaaatttttagttgtatttgcccaaattgtgttgaaggggataaagccagggaatatggaaagaaaaaaggaagatatcaaggaggctatgaaagaggactcagatcttggaacgatgtatttttttcagtaaatacatgatgaatgcatacaacagagaaaaagagcagaaaagagaaagaaaaaaccaaactctatgatttaaaatttcactgaatgtgaagataattgtatcattaaaataactgagaaagggtagaaataaaaatcataagcttcaaatatatatgacttattgttgacaaaaatgatagttgaaagctaaagccaaaatttctaactagggttaatgtgaagatttcaagagaaaatttaataaagaactacttatgcaagtgttttgagaaatcaaaggtatagtttacccatgagcatttgtttagagagataaaagtcactgaaataaaatttgtattttaagctgtacattttcagtgttatatcataaattggaattgtatttattacaaatggaaaaagctttcctgtagcacaccaagattagttttaataggttcaagaattgttgatttgtaaccttaagactattagtgttgtggaaaattaaatataattaggtattgcaggaaaaagtgttcattgaagtttatattttatatgccttaggagattaattttgcttattagttttgtgatatttaagcaccgctataaacatcacagattttgtaataaccattatatacttaaccagtataaaatattgagtatttctatattagaatatttaaaagcatttctacttgtgatttcactgggggtacaacacaatgtaaactatacccactgctggaggaggagcatgaaataaagaactcttcgggcgaacacttaaaacccacctaaatcaatctctgtgttttcttttcagtattaccttccattattactaccctttattatgaaagcattgctagctgtcctttcctaagtgccctctacattcaaattcaccatttctgtatgtactattccctacatctgcaatgccattcccagcccacacatctgccctattggatttatatcaaattcagctttcctcaagaagccttctcagttgctttaacaaaaattactggtctgtcttctggaaaacaattggtgtctgatctctccttatcttttagcacctaacactaatagtatagttatgtaaaggaatgcgtgtgtgtacataataacatactatttagtatctaaatacaccgtgcatctcctatgatggataaattacaagtatattattaatatctatctatttttcccatacatctaatgcagtgcaatgttcatagattcttaatattgtttgaaatattgcctctttctttagtcattgagagccatctttttcagagtcaatttcattcttctagccctagcttattttcatgtcatttgcattttcttgagatatgtgaataaaggacacgggaagaaaatgcagttgagaggttggcgagtagaaagctaattcactcagattttactacatattgtttggaagcctaagttgtttgggtacaactaacataaaacttgtttttatgtattataggcatatattcttaaatgactaatgaactctgcttcatgtgaacaacgtttcatcttctgatcattttcaatattttattacactttgaaaagtattgtagtgctccagaaaatataatgtcaaccgttaaaattcaactttactacagttgttggcaatattaaataacttttgttgctgcatgatgttagctgcagcttaaatttcagatcatgaagtgttattaatattacatggttagaattaatttccagatcaatgaatcaatgctatcttaatattctttgcctttaaatttcataccacattattttgtgagtggatttcataaaaggaagatgctttatgttgccaagctcattatcttgagtttttgtccagaactgaattccctttgttatcaaaggacagagagagcaccttaaaaactattgaacaatgctgatttgatgggcaggcaatttacattaaacttaaaaggagggaattttctttgcaaatatgtaaagatcacttacacaaagtaaagagatatttcactatgggaacaacaacaaagacagactcacaatgccataaagtggaaaaaatgattaacatggaaaaatccattactactgttattagaatattaactaatctgaatattttatttgtaaactcgactagtgatacctgaccttgtatttggtgaaagaaaataaagaacaaacttaatttcacacctaatacagtagcagtcatctctctctctatacacacacacacacacacacacacacacacaatttgcattttggaagaaaacttaattttttgaagccagttattttctttaaacttgatgctttggtaagctattatttcacttggtaatatcaattagttttcacacttataaagtacttaaacatttataaaatatttgtaaaaggctttcacaaatacagtagttgatttataaaatagagactatttagaacaaataaatgatttaagtctcagaggttcgaagagacttatatgctctggtctgtataactcatacatggcagagtagataattgagcctaagcaatagataccatatctgtccgctatacctattttactatgtcactaactctgtgatccttctagtctccacttagtgtttgttagctcccacatttaggatgtgcatactgggggagaagaacacaagaaagaatgatgaaggattatcaagagtaaattaacaattaaaatgcttatattcacaaacttgcccctttggaccagtaaagttaacttgagtctactcagtcaacctgggcagcccttcctctataccccttgctatcaaggagtattttgctttttgaaacttgataatggggagggccagaagagaaaacacttgttttttgagacagagtctcactactctgtcaccaggctgaagtgcagtggcgtgatcttgtctcactgcaacctctgcctcctgggttcaaacgattcttctgcctcagcctcccatgcagctgggactacaggcatgtgccaccatgcccagctaacttttatatttttagtagagacagggtttcaccatgttggccaggatagtctcaatctcttgacctcgtgatctgcccacctcagcctcacaaagtgctgagattacaggctcaagccacagcgcctggccaagaaaacacttttaaagaggtttctgaaagagacagggcctggataaggttgatttaataatggaggatgtccctaggaagtttaaatttaaaaagttacatagagctatgtgatgaatgtggtctacttgtactacatcatgttctacaaagagaatatgagttattttgaaattacagctggtctgttttcttttgccatagtactgctctgattttggatgacatgggtcacaatataatgaggacaccagagataatggacagtactcatactcaaggttatactcatttaccacctagttcaggagtcagatactcagtctgtaggaaacaaaacaaaacaaaacaccagagcataagaagtactatgagataaagcagagctataggaatacactacttagggctgggagctccaggagtatctacctgaagaagttacacaaatgagcgctcaagggaggaaggaaaaaccagacatcagcactggaaacagtttaggagacctgcagttcatttggtatgttgatctagtacacaattagagtgtgcctttggttagagtcacagaattgggaatatcgaagccatggacataagtgagatcattcaaatagaacacacacagagaataaaaagggcaagaatggacctggaaaccacagtctatggggaagacaagaacagagaagtctgagaaagagactgttaacaatatttctacagagtttatttttaaaatgacattttcacataaaaacaatttcttgtatgtttgagttttcaaatgtaaacaaatgtacaactcattcatgtgtcactcaaactggataaagaactgcagaaaaagcattgaaacagaagtaactttgaatatttgataaagaaaaatcttattgtgattatataatgtaatttttattaaaaatgcagtattttaaagtttaagtatatgatgaaagatagcattgagtatatcagtatggctattctgcttacacttgacacaaatataatatttaaatttatgaaatatgtattatttatacttttccacaaaatgaagcagaacaatataagtgagcataatatgtatgtttatccatgtaaataggtcaattttgattattataaacactattaaaagcacatttctgtatggttacccttgaagtccctactcaaatttctttccttttaaaggactttacgcatttactagataggaattactaccatgactctcccgaattcataattttccttagtataaaataaaaatatatttaaatatgcttttaacacaaatagaattttactccaattctgtattataacttgattttaatccctctagaaaatatggtgactattttttcacaacctcattattcttctatcctatttttatgaaacaatttaattgacaattttcaaaattagaagttacttttttcctatagaaaaaaattgattgtaacaacaagttaaaaataaaaaaaagaattaaaaattactggggaggagccaagatggccgaataggaacagctccggtctacagctcccagcgtgagcgacgcagaagacaggtgatttctgcatttccatctgaggtacagggttcatctcactagggagtgccagacagtgggcgcaggtcagtgggtgcgtgcaccgtgcgtgagccgaagcagggcgaggcattgcctcactccagaagtgcaaggtgtcagggagttccctttcctagtcaaagaaaggggtgacagatggcacctggaaaatcgggtcgctcccacccgaatactgcgcttttccgacgggcttaaaaaacagtgcaccaggagattatatcccgcacgtggctcggagggtcctatgcccacggagtctcgctgattgctagcacagcagtctgagatcaaactgcaagacggcaacgaggctgggggaggggcgcccaccattgcccaggcgtgcttaggtaaacaaagcagctgggaagctcgaactgggtggagtccaccacagctcaaggaggcctgcctacctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagagtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaatgcagagtgcctctcctcctccaaaggaacgcagttcctcaccagcaaaagaacaaagctggatggagaataactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctaccagccagaaaagagtgggggccaatattcaacattcttaaagaaaagaattttcaacccagaatttcatatccagccaaactaagcttcataagtgaaggagaaataaaatcctttacagacaagcaaatgttgagagattttgtcaccaccaggcctgccctaaaacagctcctgaaggaagcgctaaacatggaaaggaacaactggtaccagccgctgcaaaatcatgccaaaatgtaaagaccatcgagactaggaagtaactgcatcaactaacgtgcaaaataaccagctaacatcataatgacaggatcaaattcacacataacaatattaactttaaatgtaaatggagtacatgctccaattaaaagacacagactggcaaattggataaagagtcaagacccatcagtgtgctgtattcaggaaacccatctcacatgcagagacacacacaggctcaaaataaaaggatggaggaagatctaccaagcaaatggaaaacaaaaaaaggcaggggttgcaatcctagtttctgataaaacagactttaaaccaacaaagatcaaaagagacaaagaaggccattacatagtggtaaagggatcaattcaacaagaagagctaactatcctaaatatatatacacccaacacaggagcacccagattcataaagcaagtcctgagtgacctacaaggagacttagactcccacacattaataatgggagactttaacaccccactgtcaacattagacagatcaaccagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaaggtctcctcagaaaatgtaaaagaacagaaattataacaaactatctctcagaccacagtgcaatcaaactagaactcaggattaagaatctcactcaaagctgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaacgcccacaagagaaagcaggtaagatccaaaattgacaccctaacatcacaattaaaagaactagaaaagcaagagcaaacacattcaaaagctagcagaaggcaagaaataagtaagatcagagcagaactgaaggaaatagagacacaaaaaacccttcaaaaaaatcaatgaatccaggagctggttttttgaaaagatcaacaaaatagactgctagcaagactaataaagaagaaaagagagaagaatcaaatagatgcaataaaaaatgataaaggggatatcgccaccgatcccacagaaagacaaactaccatcagagaatactacaaacgcctctatgcaaataaactagaaaatctagaagaaatggataaattcctcgacacatacactctcccaagactaaaccaggaagaagttgaatctctgaatagaccaataacaggatctgaaattatggcaataatcaatagcttaccaaccaaaaagagtccaggaccagatggattcacagctgaattctcgcagaggtacaaggaggaactggtaccattccttctgaaactattccaatcaacagaaaaagagggaatcctccctaactcattttatgaggccagcatcattttaataccaaagccgggcagagacacaaccaaaaaagagaattttagaccaatatccttgatgaatattgatgcaaaaatcctcaataaaatactggcaaaacgaatccagcagcacatcaaaaagcttatcaaccatgatcaagagggcttcatccctgggatgcaaggctggttcaatatatgcaaatcaataaatataatccagcatataaacagagccaaagacaaaaaccacatgattatctcaatagatacagaaaaggcctttgacaaaattcaacaaccattcatgctaaaaactcaataaattaggtattgatgggatgtatttcaaaataataagagctctctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagaagacatgattgtatatctagaaaaccccatcatcgtctcagcccaaaatctccttaagctgataagcgacttcagcagtctcaggatacaaaatcaatgtacaaaaatcacaagcattcttatacaccaacaacagacaaacagagagccaaatcatgagtgaactcccattcacaattgcttcaaagagaataaaatacctaggaattcaacttacaagggatgtgaaggacctctccaaggagaactacaaaccaatgctcaaggaaataaaagaggatacaaacaaatggaagaacattccatgctcatgggtaggaacaatcaatatcgtgaaaatggccatactgcccaaggtaatttacagattcaatgccatccccatcaagctaccaatgactttcttcacagaattggaaaaaactactttaaagttcatatggaaccaaaaaaaaagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgaccaaaacaagcaatggggaaaggattccctatttaataaatggtgctgggaaaactggctagccatatgtagaaagctgaaactggatcccttccttacaccttatacaaaaatcaattcaagatggattaaagacttaaacgttcgacctaaaaccataaaagccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctaaaaaatgggagaaaattttcacaacctactcatctgacaaagggctaatatccagaatctacaatgaactcaaacaaatttacaagaaaaaaacaacccaattaaaaagtgggcgaaggacatgaacagacacttctcaaaagaagacatttatgcagccaaaaaacacatgaaaaaatgctcaccatcactggccatcagagaaatgcaaatcaaaaccacaatgagatacaatctcacaccagttagaatggcgatcattaaaaagtcagtaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgtaattggaaatcatcattctcagtaaactatcacaagaacaaaaaaccaaaccccacatattctcactcataggtgggaattgaacaatgagatcacatggacacaggaaggggaacatcacactctggggactgttgttgggttgggggaagggggagggatagcactgggagatatacctaatgctagatgatgagttaatgggtgcagcgcaccagcatggcacatgtatacatatgtaactaacctgcacaatgtgcacatgtaccctaaaacttaaagtaaaataataaaaaaaaataaaaaataaaaaataaaaaataaattactatattggtctcttttatcttttttctctatatacacataaaagttatcttataaagacattttaatccaatttctaaaatttaaatatatgcctgctccttctttcatgtcagaagtattttttctcaagcatgtgttttaatagttccatagataaataaaaaaaaaaaatagttccatagaattttactattagaaaaaatattttataaattttatacaagtatatatttgggctatttatgactataaaaacataattctgtttaaatattttcagatattcctaattatttactcacattaaatcacaagatacagaattgctatggaggagggattgttgaggtatttcataaatagaccaaatacttattacatgtttcttgtatctattttatagcatttgtcctagtactgttgatgagtttatcttctttactattctttgaaactgtggaagacagattgcatgtgaattacccataagttatgtgtaggcccaccatgtagttcttacagtgtatgaaaatcatttaaaaaaataagctgtataatacatatatttcattccctaaactgttattctattcagtttaccaaagtttcatattaatgtttctacatgatgtgattaatatattctggctatggatttctgaaggtacagactcagagtggatcataactggaattggaggcagagatcttacctcttgtaattttaagactggtaatcgaggagtcttttgagttattggattatctgcttgcccttattgcctaactctggaaatgacaaaacctgaggtcctgaagggttactcggccctcaggtgattaccagtaaggtggcactgaacaatgtgtcagttgaaatgcttaatgataactctggtttcccactctggatcactactacaaacagctttcagtcttatgaggttctagcatttactctacttctagctcagatattttgatcctcagttcagaaagaaatccattcatagttacctgttctacaacttgaaattaggtggattaaaaagtatatgcattgacctaaagacactatcgaattttaaaattatactattttaaagaaatgcagtgttttcgtattttgaaagcgtaaaagggttgatggagttacatcattaattctgtagatagaagtccaaaaaatacacatcttgtgtcatgggaaactagcatacccagtcatactgaactcacctggagccgaagcccatcgcttccctcggtgccaacatgctgtcagtcagacacctctaactggaatatcacgggccaggaactgcttgccttttattttccacctggaacaaaacatagtgtcagtcatttcttcatgttccttgaagcacaataagatattcattatgttatcttttcctgtcacattagacactcatttatcagaatgctcaacacaaaggaaagaagtataaactcttcacctctataatttacatctgagggattaatatagcacctgtataagtcaaagggaccatctatattttatctcctataaaatcttccttataaaaggttatttattacttgagcacaatcattcctatccatttggtataagtaattgatgcgttaatttaagaagccattttccatatagtgtccttggaaacagtaaatcaaaatacatttttaaactccagagagaagctgatgttgaaaataattcattttctgaattcctttttttttttttaaccatgaaaaggaatctcagtaggaaacagaatgtgataatgcaattgcattagttttatgcctatgctcttttgtatttctcaacttgagagacactgataaagaacactgatgttttctcaaacgcaccagagtgttgctactatggaaatagaccgcttgacctcatgataaaaattataggcttgacgaaaaccatagagcagggctcctgtatgaatggaatgtgccaggtagggtcttgtactgcacacaaatagagctactgacctttagtattttagccttgctccagtttggtagacaactgggtggttgtaaggaactctaaaaatgcaagagatgcagcactgtagcagtcttcttgtggcttgtgcagtctttgatttgtctatgtctgcctccccaagatttggagtttgttgctgaactgaattcatgatgaagatcctgcaatttggtgacctcctttttgatgctcactgcttatctgaatcttcaaaaccaggattgaccaggtcaataaaacctatttcttgatctaactgccagagtacccatttacctcttgttgtacctacttggtattaattgcttgcttggatcatcacctgatgcctggtaacaccctctgtgaatgaatcatgtggctccctgtattttggtaaatgcagtgaaatctgtcttctggtgtcaagcttggaaccacttattttgtctcatcttgctaatactcatttagcttaagagttttttctatgcagtacgatgtgaagggctcaagaaagtcccaccagaattgcttaatgtaaatcaaaccttaagagcaaatatcattctctccttgtagccctttttaatctcagatcattctggaatccactttatcaccttcatttcttctgctactgccacaataaactttcatcagttctcacttagataataacttcctgaatatggatcttgtgccaggtgaaaacagatggcactttcaaattagggtaacttgagtagagcttaataaagaactcatttataaaagtgtgggctgtatgtggggaaaccacaaggaaggtatgatggagttgataccatctctagacttgcagggatgaggggagtgagcagttactgacatctaagagtcagatatatagtgggcctcttggagaggagcaatgatcttggtttgggagtcacaggtagcgtaagatggcagcacagatggaagtctgaggataaaggataaaccccgctcatcttctcccttacctctggtttcttgactagactacctatgggacaaacctcactggaagcctgagtgctttggagcctgtcaatgaactccatcaggctagttgccaggggaataggataggaaagaaagagtgagtctaaaggaaaaacggaagagatccagctaacactcttatgcatacttaatggggtttgaaattagatttgagtcctatctctacctagatgtataattctagaccgataacttttataaatcttgatatcattatctgtacaacagagataatacattcttctgagttttgttaaattaaatcgcatagcatacctggaggctataatattaacaaaagtgtcaacagctctcctgttgaaatacaaaaataaatcaacaaacacatatatgctccagtcatgctgagctcttcaccacttgttctaattgatcatgtattttcaaacttctgcactttcgtaagggttgttccctccgcttaagaatgatttctcttcctacatttcaaccctgatttgcctagaaaactcttgctcatattttacaatctatgagatatgatctgaaggctttctccagctttttaatcaagaaaaggtgaccattcccttcttgttcttccatggcacacagctctccacaaatcacttagacctgggggtgggcaagcttttggcttccctgggccacaccagaaaaaaaaagagttgtcttgggctacacataagatacactaacactaatgacagctgatgagaaaaagaaaattccaaaaaaatctcatgttttctcatgttttaagaaaatttgtgaatttgtgttgggctacattcaaagccgtcctgggccgcatgctgcctgtgggctacaggatggacaagcttgatttagatcatgcctggcttcctatatgactatgagggaagggaaaagctatgtctgacagatttgtatgctcaaaaggtggttcacagccaggttcttaatattcaataaacattaagtgaatgaagaaatatgtgtatcttattttagacagtctcactctgatgcccaggctgaagggcagtggcatgatctcagctcgctgcaatttctgcctcttgggttcaagtgattctcctgcctaagcctcccaagtagctgggattacaggaacccagcaccacgcctgggtaatttttgtatttttagtagagatggagtttcgccgtattggccaggctgttcttgaactcctgacatcaagtgatccaccggcctcagcctcccaaagtgctaggattactggcgtgagccactgagcccagccaaatgtgtatatctataataaatttgtcacaatgtaaggaaagggttcagtaacttcaatcctcttttcccaaaggacagatcggcctgtgacaactggtgcatggtggagagtagaacaactctgaagaagaggtcccaaaggaaactccagtcacttttgtaacttttctctgggaagccttgctggaaaattcatgtcattcattccaaggttgccaaaagcactacaattgattgatttccagaagaaaaatcagtagttattagctaactatgacaacaaatacttctgtgtatatctaatgtatttgaatgatttaaaataaagagttgaatctccaacattttctgaaagcccagccaaaagttctaccccacaattgttaaaacatttattccattttgtgactaggtaatgaattcctgtgaatcatgaatctaagccacaggaaatagtacacaggacaaaatattactctcacacttgcctccatgcttcccatttcccaccctcaccaaaaccacattgattggcatctgtgtgtctttgcaaaatttccttctggaaatacaaacgaatacaaccatacatatattcttattctccacctcctttaaaaaaattcaatgatttaccaatattatgggtcttacatttttcacttaaagttaggtgggcattatatcagtaaataaaaagcatcttcatcatcttcattattttcagctttatgtttttctattttactgatataccataatttaaccagcactctccccaaaacgatttaaaaaacccctttacctattaaagagtttataataaattactatttatgcatcaatttgtatataagatgtacatctgtagaatagatttctataagtatgtgtaggaaggtcaaggggcaaatgaatctgtaactatcagatatagtgcccaatttccttccttgagaatcaaactaatttgtgcttctaccgacaatctacaagattgcttgggtgggccgacttctacaattttgcaaatcttacaggtgaaaagttttatatcaatgctattttaattagcatttaaaaaattataaggtagtttgagcatgttttcataatatttaaagacatttgtgtgtatttttctgtgaaatttgttaatagctttgccattttttatccaagttgcaatttataacattctttatcatcctatacattttcaaaatgaatgaaagccattaactacgtcagcaaaacattgctctgagttgtttttttttttttttaaagcttttgtcccaagcttttcttgcaatcccatatatgaaaactgaaaatcacaaagcggtgccacagtgccctctggtggcattctgctccattgcatcttccctgcactaactcggggcaaaagctgatagtggatatagctggatgtcagtcttacataggctgttagcctacccaagtctccttggtcctgagacaatatcgtagtacaatcaaactcaaaatgaagacatattagatctgttttaacccttaaagaaccagattagtacctggaacttgttagatatcctaataggcaggattcatctccttcctagttgttacaaaagatggccttggaatattttgtcagagggctgcagtggaggtttattctaggcagtcaggctctgcttcattttcccctgtacagtagtcagattaaaagggctatcatcactctctggaatttttagtattcaatgtatcacaacgtcaggtcagtaagaagtttgaaattcattcattcattcattcccaaaatatttgaaatactatgtgtagtgttctaagtatttgtcaattatgttattgaacaaatcaacaaaaattactgtcttcatggaacatatcttctagttggaggagacaatgaatagcgaacatgtaattaagcaaataatatgctatattagaagatattagaagctgtgggtttgtggctgttagatggcgatattttagtttaaaataaaagtgtagtcatttcaagaaagcaacatctgaataagaatttgaaggaggtacagaagctaattgtgcagttctctagaggaagagccttctaggaagtagaaacagccttaaacccatagcatgcttggtaagtacagtagacaactgaaaaatcctttttcaggattaaaggattctttttttccaagctgctgggagtgctgctggactgctagccccagctctcatcccaatctgcaaattgccctaagctgtccatgctccttcaccaatgtctcactaaatatatcttcctacatatttcattaacagctccattttactttttcttgatttttatcttcatgtcagagtatctaaaagttggaaaactcaaggctttagtcttcttttcttttaaatgagcccaacgactggtaaatacagaggagaaaggcttagcctgttagtcacaagacagaaaaccttccagtgacgttggctgaagcctttgttgagattgcattgcagctcatctttcctgtttgcccattcttgctttgttcccttctctttcacagatgtcaatcactacaaaactccttaacaacctatagtagatatctacttataacaatctgtctcagtccacctatttgaggagtagtaaggtatccagtgtgcagctgacaactcgatacaacatttattcattatttccataaacattttttgagtatctactatgtgctagcactaaggctggcacttaaaatacaggagtacaaataaaatgcacacacatttctttctccatatgaagctttaattatagtagagagtacaaaaattaaataagattaataaaaagattaataaaaagatttttttaatatgggaatgaggtaaattcttactaaggcaacatttgagtgaagacctgaaggaaaaaagggagtcaggcatgtgtataactgggtgaagagtattccaagaataggccacatgaagagcaaagtctaagaagagagcatacatagattgcttaaaaacagcaagaaatccagcttttttttttccagtggattgaatgagggaaagacatgaggagagtaggtcagggtaatgaggagacacataatctaaatttgagtaagttattttaaaaactggagacattagcttttacttcaaatgaaatggaaagccagtggggtattttttgagtagaaagcagagaaggtccagtttggccagatgtagagatgagactgaaggaagttaaaatgagaagcagaaaaacaacaaaaaggcctactgtaaaagtctagaaaagagatgaatatgaccagacaagtagtggagaggtgttgagaggtagctagaatatggatttgtctgaaggtaaaaagaatttgtgagcagatttgatgtggtatgttaaaagaaattgataaagtataactgtatagttttagatctatgtaagaggttaccatttttcagttaaagttgattaccaagatagtggcttggatgggattattaggagatccacgtggaagtgtcagttgtaagatgcccgttaggcatttgaataaaactaatagggaggtaaataaacctgagattacggagaaaatatgcctggaagcataaatttggaagttattaggatataggtggtattataaacatagagatcacatgaggtcaccaaagggtgatgaaaggaaaagagatttaaaagaaaagaagactaaagccttgggtagtccaacttttagatactggtgatatgaagataaaaatcaagaagaagtaaaatggagctgttaatgaaatatgcaggaagtcagagagtggggtcccagaagccaaccaaaaacagtgattcaaaaagaagtgttctcctgtgtccaaggtggcagttaagtaatgcaagttgaagaattgcacattgcacatgcaacacagagctcatgggtgaccatgacaagatgtgctctagtaaaattggaggaggatgctggattgtaatcaagataatttaagaggggagaaattagagtacctacatatattattttcacacataaatagaacacttctgaaagtcaaccagatttatgctgaaaagcaaaccttaatacagttccaaaaattgaaatccaatagaccatgttctctgaccataatcaaaataagttaaaaatcagaaacaaagagcacacacacaaatctatacgtacctgaaatattttttaaaagatggttactgacatttgtaaataaccaaagaactattattgtaaaatttaaaatgatacaaattaaatgatataaaatttaaaatgatacaaattaaatgatataaaaactactatatgttagaacttgaggaagccttttggatcctttcccagttgggaaagtcatccttcactttcccaagctggacactgtttacagaggagtacttaaatctgccatgcatactaaatcattaccttgtaccttctaagataataaggctttgtggttttcttcttcactagattgcaagcagcttaaacacaagcaattatacatcttgctcattctcagcacttggcaaaatacctagaaaataggtggtactcaatacttgcttatttaatgaatgggtaaaaatgtgtggacaattaatcatgttacaataagtataactgagagatgcacaaagcactacatatggctgaaaacatctagcttagtgagtggcatgtaagaggttatacgttaaattgtgtcaaattaattaaaaaataaactccctcttcaaagtagctgcaaaataaacttacagaaagagtgcagggttcaatagctgattattagtccccagtagggatccacttctgattctggctgtgactttttgcctggatcttaccgaggcacactctttttgcaaagggaaacatattctttccttactgcaggtctccagaccactgctcccccaaccctcctgcatcgacactggcttctgggagaacagcttgatcagaggaaaaactgggaactatctcgcacaatacagagaccctctaatgtagtaacagacatctaagctctaaaagcacaaatgttgttttacttcaactcatgcctaaaatatcaagggattttaacgatagaattaaagcaaaactcaagtagttccactgaaacttaaaatatgctttaattgaagtgcaatattatgtgaagcagaactatgaatatttgctgacacattatcatttttacaatgcaaatgacagaatgaataacgattatatatattaaaatcctgattttggaagccatgcatagagttctatttgcttgtgaagatcagaaaatgccttagaaaaatgaagtttttatcccaagagccccaaaataccacaaaagaaatgatctttttataaaaaataacttggaagaactgaaaagttgacacgtccctttatcatgtattcctatatgtacaagaggcatattcagtacaatgagtagttcagctatacagatactctctcatttagttttcagtaaggtactttggaatataatggtacattttagatatccaaattcttttctagttatacttaacatgtgctctggagattatatatatattttatatatatattatatatattatatatgtattatatatataatatatattatatatattatatatatattatatatattttatatacatattatatataatatatattttatatatatattatatatatattatatattttatatatttttatatatactatatattatatatattttatatatattatatatattttatatatataatatatatattatatatattttatatataatatatatattatatatatattttatatatatattatatatatattatatatataatatatatattttatatatatatattttaaatatatattttatatatatatatatacaccatggcatgtaggtagtaaaaggtcaagttagattttcgttctgatttttggttctaaggactaaaatacttgaagttagcactgttgtgagaagttcatcttccaagagacttttcctataacatgtatgaacctaaaaaaaatccataaagagattcaagtaatggtgcctactaagcttattttgttaaatcagccatccctgacagtgaatatatctatttttagatagaatgaatcaagaaagacagccttatagggagcagatcagtagggaacttcatttgtctagaagttatctacgagtttccttgttgcaggaatatcctggtagcaagatttttttcttcttgactttatgaagaagggagatagatgaagaaaggtaaaaatgaagacagaggaaaaaggagaaagctcagaacatgaagagtagtcaagatttttattgttgattataaaatgtgttactatttatttgccttatggggtctgctcatcattcagggccctattcaaagtcaccttccttgtgaacatgaggctatcctcctaaagcacagtttttgttctattactatacttatgaactgcactgccattctctatcaacacgactttcactgtatctcaatttttaaaaaatgtgactatcttccctcaatagattgggatattctaggaagggatgtgtattccttattgctgccactcttctcccaaaatttggcctcaccgtactccattcccaatatcaaacaacatgcctgaaaaagaataagtcttactgaatctttggcaaataaatggcaggtgatgaacattttaaaaaatgtgagacataaaggataataaaagtaaaatgtagagataaattaaaagtccaatagctgcacttttagcctcaactctttagtgattggcttatgtatctgatgacacaatattctgcaaaaccttttttccccaaaggttaaattttaagggtaagtatgcaatacttagccaaaattgtaagaagtgtattcacttaatttctgtaatccaatggcagtaattctaggggcattgttaaaaagataagagaaaggagatttattagcctaacccaataaataggtagtattatattagatctgatctcaacagtaggtataagggcaaaaaagattgagtagagacaaattttatgacaataaaaagataattgcaaagaacaagatatggcagtcaaattttgagctatttgaaatataaataaagcagtagcattatctaaataaattaatattacagtgcaatgagaaacactatatctgatgcaatgtcagcatgggggggcctaagatttctgtggtgggataaagggtgaagaatacgagaaaacaagatgtagagcaaaaattataagaattgttcatatgtctcaaaatcagagaaagttcaaacataaggggaagagatggaagcaattattttatgtttaattacctcctccatgatctgtagaaaatattccttaaaaagtgtttcattaatgtttatgagtttctcattttttatattttccacaaaatggtagccattttctaaacactttttagagattttaaaaattgagaccaaagcagtgcatcttacacaccaaggcttcctaacctttaaaacattataagacttaaaaattatctcccattaacaccttcttaattatttgatgaaatccacattctatgatgttttttatttttaaatttagttgatttttaccaataagcaacaacttactgattgggataatcactcttgttttccttcctccatcttcatgtggatacttcttctttgcaacagccctcgtagggagttaatgatttattttcccagggataatgctactcacataccaaagggaaaaatcatacgacctaggttaagccaatcactacatccaggctcctagtcctactacggagtaggcattttctgaatctctacactttcattggaaactctggcaaagaaacaaacaaacaaactaacaacaacaacaaaaaaaatgctttctcattcttgacgaatggggagcaagtatgtagactcaggtcatgtgttatcttcagatcagatgtgacatcaactttagactgaagccaacactctgaagagcaagtagagatcaaaataaaggaaattgaatctttgatgaccgcattgagttattgaatcatggctcttctgaagccagtattatcaaaaaatttgtttgtagggtcaataaatttccatttttctgtaagtcagtgtgaaattgatttttgtttctgcaaccaagctatttccttaagtttgattcttaacataaagtctcttagttattcttaacgtaccatcatagtccagcccatagatatcagacacatttcctgtatcacgtcaggtttccctggccttgttttttgtcccagctgtcactgtgacaacgacctttgtgtgaactgtggctgactttatgctgacctaacctgataatgatttgtcttaaacctgtgcaacacacctctcgtcttctctctgggacttccatgtgacatccagatggggatgctgtgaattcttgtttagacagcaattatgtgcaatgtagaagtgtggggagttcatttcccaagaggcacaactttgacaaatgagctagggaagctggtggagaaatttctcacttttctttatttggaccaactgtcttaagacctagtttatttggcttttaagaagaaagtggaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtggacgcctgtagtcccagctacttgggaggctgaggcaggagaatggcgtgaaccccagggggcggagcctgcagtgagccgagatcgcgccactgcactccagcctgggcgacagcgagactccgtctcaaaaaaaaaaaaaaaaaaaaaaaaaaaaaaaaaaaaaagaagaaagtggaagatcaaactatcttttatacccctgaatcaataatgcatctttttattattttcctcatttttccttccctcattcctattacatgggagtatggtctcaaataacagtagcagcacataatttctgttctaatttctgggaaaactaggttaaagcatttgaaatcaggcatagcagcagaaagctgactctaagaatagaatttgggggctggattactcactggtatgaaagtaacaagagattctatttctggtagtagctgaggtgatgataatccatggcatgtaaatgcgtcataagtaccaggaattttcacctcaggttaattagaataagatgtaggaggagggtgaaatatgtatatgtagccctttaatgtttcagggacaatggaactatgaggtctagcttctattaactgaattagaagctttgagggaaaaaaaagtgataagtcttggggcatccatctccaatctaaggcaagctataaaagcctaagggcctcaatggcagtgtttgaagatattcttatctcctaaaattaaaaggccgactgtgttaaaaattagacctaggttttaattatgaaagtggtaggcctgtaaacaccatctagccttaatatatttatgacaaagctatggctcttattgaaaaaatgaaacaaaattcatgagaaactatgtcctagggagggacacttgagcggataagcattaagaattttgaacccctaaattcttctgaatcctcctggctgttaaaaacagcaccccccaatgtttctgagtaaagtttcccctccccttgcctggagggcatacatggatattatctgagatgaatttcttacaagttaatgtcgttctcctcaacattccttcctacagcccctctatgccttcaggcaaataaccagggtgaggtttcagtatactttgaacggggaagtataattctgcatcaggaggaaacagattatacatcacaggaaaggtagtgcctagccagtatttatagcaggaaacaagattacatatgtagcagtcaattcagtttatgggactaaggtggcggagcaatgtaaagactaatatgaagagaatttattgatacccatcatttactcatgatcttaattgagtacttgggtaagaacacctggccctggcccaaatatatatgttggaatcacccccttgaagtctgcacacaattatggcctacaggaaatgaaataaagatgctggaatatttttggcaaagtattgaggagggacagaggctgaggatggtagtaaaattagaatggatttaccagacaagatctgagaactcaccacctgaaagttatgtgcctaggagagtctagaggacacaatcctaacacagtgaaaaagtacattggtgaaaggagaaatggtaactttgaagagctcaaacgtggctatgttcttttgtcctggttaaaggtgggacattattgggctctgtagtggaattctagaatgtaagaagccaggtgatggtacttaaacagaaggtgtatataaaagatgtaaaatgtgtaatgctcagcaacacgtggtgccttgaccacaggcatttttggcaacaaccgggaaatggtgttcctggggcaagatgtaggtataacaaacaaggatgttgttcaattacaaaactggtggaaaatagaatgatggtaagcagaaggccaacatcgttcattgcaatggaagattgtttctcactcgttctgacaatcaaattagttcacagaatccagagtacaatgattgaatggaaggctggttttactgaggaagaccagcgctattaactatatatataataactattctcccttccctaaagagtccttgcaccattttgccaggataactattcactggggaaaggtgaatgcccagaaatttaaaagatggttagaactagggtttaaacactgaagatagagtacctgtaatactgtcatgaacctccagttagagtgagggctatggagaccaggagataaatttattccaaatccactgcacagtgtttctgatctgttcacttatctggctgctatttcccttaaaaatgtaaatatttcttaaatacctatataagaatgatataattggcaagtagaagagccctcatactgcttctcaaacctgtggggtaaggaacattgtggaagccagaaaaaatcctatgcaagaatgaattttaggatgaactgcagaaattagtatcaacatcaaagacttgaaaaatgcaaaaggtggtgacccacatcatatgtctattagatttatccattttgttcatacagaaccaaaatggatggttaattctgtgtgtcaactttcctgggtcatggtgtgcagatatgtggttaacattatcctggatatttctgcagcagtaatcagtaaaatttgtgcacgcagactgccctccacgatgtggacaggcctcatcgaatcagttataggcatgaacagaacaaaagactgacctcacctgagcaaaagggataaaaagactacatactgggtacagtgtacaccattcagtaacaggtgtactaaaatctcagaattcaacactatagaattcaaccatgtaatcaaaaactacttatgccccaaaagctactgaaataaaaaaaattaaattaaaatagagggaattgtggacacacacacacacacacacacacacacacatacatacacactcacttttggttttgtttctctggagaattctaacacaatgataagctaccataacattaaacaacacgtcatgtaggatctggtatttgtactggagcaaattaacagtctgtgatattggtttatctgacttatgctcactgagatcccctcagtcccatgtttattgtaaccactgctgaagcaaccggttttaaacatattttaactagtttttgcaggtaccatctggcaatgctttatgtcatgctcatgctacatagctcactcttcccgccatagggttttatcgacatatgctacatgatgcccagaagaaattgtttggcatacacacactcaatgttgcaactagcctttgcagttgctttttgtgtaaagggaggatttctttgctgtgttttttaaaattatatttttccatccatttgctaccttgaaggactctaggtatatagggcacttgattgaaagagcaggctggttgcggtggctcatgctggtaatcccagcactttgggaggcggaggcaggtggatcactgaggtcagaagtttgagaccagtggggccaacatgatgaaaccctgtctctacaaaaaatacaaaaattagctgggtgtggtggtgtgcacctgtaatcccagctacttgggaggctgagggatgagaatcgcttgaacctgggaggaggctacagtgagccaagactgtgccactgcattccagcctcggtgacagattgagactctgtctcaaaacaaaaaaaaaaaaaaaaaaaaaaaaaaagatcattgtcctataaacagtattactaataaactcatctatttagggagtaatgtaattgtatcatctttttttctattaagtatacttattctaaaaagcactaactttaaacatgttgttttaacattatgaaaatacttcttgtaagagaactattaataagaacattacttataaaatacataatcagacaataaatttttcatagtttaaaacaagaatataaaataatgcagaaatagaaaatctgtcatttatgagagcacaattaatataaaatccatgaatattaactagttttcttttagaatactataataggtacataacaaacatccttatacatataaaatagtaatcctccctcccatctgaaacagttcctattttttatatcaatttctgtgtatatcccagcaatgttatttgtgtatagaaacatagattaatacagtaatagatacaagtaactatatatacaatataagtagaattttccttcaaatggctatattgattagctagacaaatattacaaaggaatgagatcaatttgcatcttattcaaaacgagattcacgaacaaacaaaactcagttttaatattaaacctctattaagataaagataccatttcagctcactttataaataattgtgcaagaaatgttaaaggcctcccactaaaaaataaagagtacaggtcaaactaaatgctaaagagcttgcattttagtgaagtaaagaatgaagaagataggcaatctactcccatcatatagtaggcatagaaagcctaacagcaatgtagtcaggtcctcttaagtaagcactgtcagcaaacaaaggaacttatctccagtataacactggaaagggagcatgaaattgataaagaacaaatgaataatgcatgaatgagtgaacgagtactaaacggtgaaagtgtaaaatgactttatcatcctgaaaggaaccacaagaacataaagcagtaaaggatatgtacgtatttaagctatattcttaaataaatttttacttcctttttgtgattctttatcattttatgaatcttaaaataaaaccttgtcttcttaccgtttgttatatatcaatttggtacccaactttacattggccacaacattgaactctggatatttgggttttcgttttttttgttttgttttgttttgtttttttttttttttgagacagagtctcgctctgtcgcccaggcttgagtatagtggcacgatcttggctaactgcaagctccgcctcccaggttcacgccattctcctgcctcagcctcccaagtagctgggactacaggtgcccgccaccatgcccgactaattttttgtatttttagtagagacagggtttcaccgtgttagccaggatggtctcgatctcctgacctcgtgatagcccgcctcggcctcccaaagtgctgggattacaggcgtgagccaccacgcccggcctatttgggttcttaagaaaataatcatactgctttcaaataacaaagattttccaaaacttaatgtaactacatgttcctgaaacagtatcagaaggactactcaataaagagttatcaagccatttttaaattataacaggagtggtgggggggatctaaaatcttacacaataattatttgaggcaggccacatttatttgcaaatgtaccaacccactaactgttgatcacgtgttaaatgcaagcttttaaaaaaatatatagattttgctcatattttagaaatgtccaatctaatatatggtcttcatttcatcataaatataatacattttcctttggagaggtatttttcttcccatcaaattatgttactttttgttctttatggggaaaggaaataatgtaaaagagattaaggtgaggtttacctcagccctgattaaagtcaaacttaaaaaaaaaaaaaaaaactctaccaaattggtgagtgttatgagacaaaagtagtgtagtgatttaattgaggctgagagtcagatgatcagaaattttttatttctgcacgaacctgaaagattaaaatagttataaataagcactacttgatttcagaaatccagttcattgtttttaatatgtgcctgtgggtttgcaaaataagtggattatgtttcaagtggagagaaacccataatattaaaaatattcaaaattaatacagaagatacatatgttttgttatgtggtttatcattttgtcacacatttaatctagtattaaatacttattcttcacaaatagctatttcagataattaaggtaggacatatgtgaatgagacaagggaatggcccatacatgaatgagacaagggaatggcccataggagctagttacctagtaatagagacagatcaatgtattagcattaataaatcacaagttagagagcaatgagattttgttttctagcactgaagaatctaaataactgaatcttctccacataaaatagaaagcacataaaatgtatgaataaattgtaatcaatatcaactttaaacacatattagatgaaaagaaaagatgatgtttatgttataactgcccataggtggtagcaaaaaaaatcagtgcccgtaactagctaagggtcagaacctaacaagagaaactattgggctcaagttaagttgaaatttggagttgagaactccatgtatagctgaagctcatggagaacatacaactaatttaaaaataaattgtttgagaaaaagcatgcccactgtattcattttgactccacaaaaaataaatcccatttatatgtatgtatatataaacagacacaaaaagtgatccagagctactaacatccatgggaacattaacagaggcaaagaatactcctctttttaagatatctcataaatccaaatcatatggaattctgaaaaataaaatcctgtgaaacattaatgtacaacctaaaattacaaaagacatattgatacaaagcttaacaagaaaggacttgtacacatgcagacaataagataatacttaaaattattaatgtttcaaaggaaaaaacagataaacaaggtaaaatgttacaagagagcaagcatatttacaaaaaattatacaattaaatatccgatgatttaaaaataattgaaattaaaattcaaaggaaagcagaaagaatactttctatctcattctatgaggctatttttctaatgccatcaccaccatagcaaaaacaaaacaacaacaaaaacctgtagggaaatatctctcataaacaaaaagcaaaaaaccttaacacaatattagtgatactgacaaatgaatcctaaaatttatatgaagaggcaaaagacccagaatagctaacacaatactaaagaataaagttggaagactgtcacaacctgacttcaagacttactaaaaatctacagtaatccagacagcctggtgttggtgaaacaaaagatacaccgatcaacagaatagaagattagcactataagacagggtgagaaaaaaaaaaaaattagaagagcccagaatcagacccacatcaatacagtcaactgatctttgacaaaaaagcaagggcaattcaatggggaaaaggtatctttcagcaaatcttggaatgactggaagttcatttgtgtatgtgtaagagagagaatctagacatagagcttacacctttcataaagcataacttaaaatagatcaaacacctaaatattaaatcaactcaaaaaattctagaagatacacaggagaaaatataagtgatgttgagtttggcaagaagttttcagatacagtaccaaaaacaatctatgaaacaaagaaggatacattggactttattaaaaacttatgctgtggctgggtgcagtggctcacgcctgtaatcccagcactttgggaggctgaggtgggtggatcacctgaggtcaggagttcaaggccagcctgaccaacatggtgaaaccccatctctactaaacatacaaaaaattagctgggcgtggtggcacgcacctgtaataccagctactagggagactgaggcaggagaattgcttgaacccaggaggcagaggttgcagtgagccaagatcatgccattgcactccagcctgggtgacaagagcaaaactccatctcaaaaacaacaacaacagcaacaaaacaaacaaaaacaaaagacttatgctgtgtaaaacaaactgttaagataatcagacaagaaatagttgggtaatttatttacaaaacacatatctgccaaaaaacttttatccaaaatatacaaaggacttttaaaactcagcaataaggaaacaagtgacccaatttaaaatgcataaggtatctggacagatacttcaaagaaaatatgcagatggcaaaaatattaaatgatgctcaatatcataaaacctcacacctattagacactactatacctattagaagggtgaaaactaaaaatactgacaataccaaatgctagtgagaatgtagggcaataggtgggaatacaaaatggtacagccattttagaaaaaggtttggtgggcttttaaaactacacatagtcttaccataaaatcaaacaatcttgctcctaggtataaaccctgttgtttctaaaagttatgttcacaccaaaaccttcctgcaaaagtttacagcagctttattcataatttcccaaaactggaagcaaccaagatgttcaacagatgaatgaataaacaaattgtagtatatctatataataaaatattattcagcaataaaaagaaattgcctatcaagccacagtaatcttaaatgcacctttgatggctaagtgaaataaaccagtattgagagctgacatatttgtgattacaattatatattattctagaaaaggcaaaacttgtagaaatagtaaaatgatcagttgtttccagagcctcgagaggaaggaagaggggtaaataggtaaagcacagaggacttttagaacagcaaaattattccaagttttactgatattgtaatggtggacacatgacagtacatatttgtcaaaacccatggaattttacagcacagagtaaaacttaatgtatagacatttaaaaaatttagcagattggatgatcctagaaaaacttcctatggcaagagaatctatcttcctacgacaaatatatgaaaaacctcactgaagagaatgaggtagaaaggtgctgacctaaataactttgaaaataagtcaagtctataatgctagaggcaaaaggaggtgcacaaaaacagtgtacttgagttgataaagttgttttccacagggtacaggttaacaattctgatactgctacatgaatgtattggaatggaactgaataaatggacagcagatagaaccagcagtgagctttttcagataagcaaggagaggaagctagaatgacttatgttgtgatggattagagttgtagacattggtatgaactcatatttagcataatatatagatgtttacatatagagatattttagagagatatgtctatacatgggttatgattaagcacatatattttttgctctgtctgcctagagggcctagaagaaatggcagacagtagcaacaaacatgcctagcaccctgatactggtttctaataacattctctaataaaaagaaattagggctccttaaataaacgactgactctaggtctgaggcaggaaatatgcaacaacttggaacaaccagtagtggcagaatgcaaggacatattcaaaaaattttaaaaatgaaaaaaggagtatgaaaaaaggagtatgaaaatttgaaaaaaaaaaaaaaatagtgtgtcaaaggagcccaggagcaactgggatagctcccaatggccaaagctatgacagcttgaataacaaaataaataagaggtgatgaggaaaacaacccacgtagaataattctaaataatgtatgtagctactctatctcaagaaagtggagcgtaactttccactcctgcgctgtggcctctatgtagggacttgcttccaagagtacagtatggaaaggggggacaggaggagactaacttagcagtggagaaacctgacatatactacctcagcgaggtgatcaaggccagtatcaatatgatagcatgatagcatgtacttttgatgggatgagatgaaaatggtacttgacctctgtggtatttcctcccaacaaccaattatcttaatcttacgtagagaaaaacaggagacaaattctaacagaggggcatcctgcaaaatagttgagcaatactcatcaacaataaggaaagtcagaaactgtcacaaccaagaggaccctaaagacacatgataactaaatataatgtaatatccatgaacatttattaaaaacaaagaaaatagaaataaaatatggacttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaacaagtgggtgaaagatatgaacagacacttctcaaaagaagacatttatgcagccaacagacacatgaaaaaatgctcatcatcactggacaccatatctcctttcaaatatgaattacaactaggttaaatgaattactgatatcacttgtatatacatatatatgcatatatttaaaatttgtatatataaatatagctcacaagcagatacatactctttcctttcaagaataaggattactatatgtatcttgcactccctatcaaaacctggaattggaattttcaaaaccaaggaacttgaggcacaaacaacatgcctttgtcatctgttccttgtttgagaaacaataggcaatgtatttgctgaaacagtggtttttaataaataagtgaaattgagaacaaacaagaagaatgatttcctatggaccttttgttttgaacattaatttaatatgataaagtcggctcatttgcccacaaggttgaaagttcccaggagcattagtaaaaattcattcaaggaccgttaaatggagctggctatatagcaattggtgtgcttcattttggaggttaaatactgaataaagtattatttttgcccttacagtgattacttgactgccagcagagtgtgggaaatgttatgacagagtgtgggaagcaggatgctggcaacactgagtgcaattccatgccttcacttactctgacaatcagataagatgatgaaatacagcactgtaatacggtgcttggcaaacatgatgatcaattataaaaatgtaactacaataaaatctagaagtcacagtccattaaaatgcaaaacatagttattgtcacatatgtctcttattagtcatggtattatttccactagtgcttttaaaaacaatttcatagaggtttaagatgatgaatatgctaattaccctaatttgacccatcaacatatacaattattatgtaccaatttaaaaataaggaaaaaaagaatttcatagaaaataacttagaatcaggtagaagaaaataatcccatagaaacaagtataagcaaattttagttcacctaagttgcagaacatcctgggtcttgcttctgacagcagaaccaaatttttaaaaagttaatgattaaaagaatactgttaagctttctaaaatcacaaaccaagcaatgaaggctgaacatatcaaaatacgtcaggaatttatgactggtcaagttatcctaggagaaagaaaagcatgctaagtttgaggttcattttaagacaaccaaattgagaaagtgataacagaaaacaataattaagttatagagaaacacaataaaggaagctaaaggcagtagttaattaaagaattaccaacaaacaatttgatttcctatctatccagctaaacaaatcctttataaagaaaattagaatatctgttgaacatattgaaccttatataaatgttctcacttgtgtgagaacatttaaagcacaattcacccaaacattaagccattaagccattaagccacagtcaatatttagaaaattgcctctgtaaactccgttgccctttttttctacaactgccaacattatttcagttgtctaaaagttacgattaacggtagacataaatactatgtccatccatccaccttttatacttcttttcgtatggtctaattgttgtatgtatctacatcttatcacctcatatgaagctgaatgtctcttactggctgaaactacacattcaataagtttcatatttatacatctgacttagaatcttagcagaaatataagagttcaataaagactgttcccaaaagaaaatatagtagcacaattttcaagttgtaatgcaccataacttgaataaaacaactgaatgagaatgaataaacttacgtcaaacactagaaatataatgggagtctgctgtggccataaagtaatagtatagtagtaccattatagtagtactttatatagttacactatataaagtaaaagtagtatttaaaggttatctgacaagcctagggatgtataagagatttattatttcagccagataatttgactttagtaacaagtttagtagaaaagtaaatcaggtggatttaatgtcttcttccattttaaaaaatgtttttataaatccataatacaatactgagatttaaaaaatccttgtcaaattcaggcaaatttaaaaaagaaaaaaacttacttgactccattaaacacaattgtatgtacctaaatttcattttccattactaacatctaacactttaagtctatttggcactcaatagatccctgtaagtcccattaacagcaatgggaattctatgggcagagagaaaagagaaatgcctctaagtgtaaatagtttctcctttataactttataattaacctctgctttctacccaattttctatgttggatgttttaattacttaaatgaaaatgactggattgtaatggaaaccagatggaagcatcatcgaataaatcaaggaaatacagtggcaacgtcactttacacaagtatagagtttattgtcataaaaaaggcagcataaaatatgcagtcaaacaacaaaatttgggtaggtagagacagttgatgtttaatcatgtaacagagcctttcctttttggtaataaaaaccccaagttcagaccaagaaggacaaagcgattatcaactaaaagctttagaggtgatatatgaagagatgaacttatggcttcaatttagttcctgaagggtaccatgcactaactcaatgataattagaaagctgtcaaaggattcatcaacattggaaactaaacacttggattcacaaacgttttaagtccaagtgaagttcttatttacaaatgattctacttgctccatggaaaattatgcctcatttccatttttatgagcatttctttcatgcattaatatatatgaatggcacatcagagatttaaaatgtgtatgagtcagagagacacagacagagccagacagaggcagaggcaggcagagacggaggcagagacggaggcagagacagacaaagacagagacagagagagacagatgcctgtatgggcttttgaaatataaccagaaagatatctatttcaatttgaaggtttctcaaattgggggaaaaaagaatcatcaagtcaatactgaatttagtttgggagtgagggaatcatctatcaaatatttaaccgctactaggacaagaaagaatgtaatagcaggcttgttagaaatacgttctctactttaaaatgcatgatgtattttgaagacaggtgcaggtcatggtgtaaatatgttgctcataatttcttagaaaagttttgagagaatgagaatgttttctttccgtataattccacatacttttaaggatgcagagtaaaatctaaagaagcttagcaggataggacaatagtttccttcgcaggaaaaaagcagaaaattttaccttaattatgactcagtggaaacgggaggaaatcctcttgacgtgggttaggagtggggcaaatctacttttccattagaaccttacaacaggtttgattttctttttagtttataaagtttttaaaaaatgtttagtttataagcctattcaaactgtggttagcaggctaaatgatatttacatttctttaggaaaaaaatacattcatttttatctccattgcttataacttagtgttcaaaagtgaaaacattttaacaatgtaataaactaaggcttagtttgtgaggataaatacggaatttgtatgctttctgtttcaaccaggaagtataatatgtactccaagatctaactaaactaatttttcatttgaaatatagggaaataaacttatttttgtcctaatttttcttctcttacttgcaagtaaaatatgttcatgcaaaaataggatgctaacaaaaattcataattttattttggtattaggactcttatttcaacaatgtgtaataaattaagtctgttcattacaacagaccttcaaatgaggatgcacaaacacacacaacgacacacagagtccaaattagcaaatttttcataacgtggatagattcaaactgcccttaaaaattgcaagaatattagttctgggaatgctagaaccatagaatcatgaaaaataaactgctgtggaacctcaggttggggtggttgttaattttactttggagtggatgcagcaggtagatttaagaggagcaacaggcaaggcttctaagaagaaacaatatgtgagttgggtgttaatgagaggagaaggctttcaaaacggaggagactggtgaggcaggtataaagacatgataaatagtcacggattagcagaaaagggaacatctcaggatgggcttagagcacttgtcggggacaggagataatgttagacaatgagattgaatatgtagacagcaggtcagttcaaaaggacctcatgccatgctaaggagattcagagttaattgtggctctaatagtatttattaaggaaaggcaatatttttctgttctattacctactccttcttttctcctctgacctaatacttgtttcctaagaattatctggagccacacagatgtgagttgaaacatcggcttttaaattttggctgtaagtgttgggtaagtgttgtaagcccctccactcttcagatatcacaattgttaaatgaaatagtaacagtacttatgctacattgtcaacattaaaacttagagctcttgaaaatcatctaggacagcatgacatacagtaggtgtacaatgaacactatttgtttatgcatattagcatgtctctttccttagtgagcatgttgtatgatttaacatatcaacagataattgcatgtatgcatgctctcttttgtttgcttttgagtatattgctaaaagcaagcacaaaaagtcaggtttttatattacttatttgagagaggcttgggactgcatagaagcatgctgttttccactttggtatttacacatagagaaactatgccctcgactctactggctttcggttttttaataaaggatagataaaaggagaccatcctaaattggcaattctatttgcacacctggacagaaactaaagacctaaggctatttttcgcaacacaaggaaagatttattctcaacttctaatttatcaataaaatatatattctatgcaatcacctaagttcatatcatcagtcacatttactaaaatcttcagactttctaggttcatagacctcgtgattatttttctttttgacacatcatatgttctttcaaagtaaattttactaaaactgtttctaaggtaggcgtgtgctatggcagcaaggaggtaccttatcagtaaaagctcttgcttccattgtagagctaaggggtttcaatgtgaataacaaattattctccataaaaggctgagctattaaaataaggatctccacaaaaagattacaaatcattttaaaaagatatgccctgcttattatctgaattcacttaaatatgttgtagtcacattgagctgtgcaaactgttttaggaaaaaagtcatgaatggggagaagtggatttgggggaaagtccatcatatgaatgatggcagatttcagttgtacactccttcggtcagtgttaactgctcctgaggaatcaaggagacaggaggaagattaacttaaaaatacaaaaacttacagatgctttagacagagcatcgaggaagagaagaaagaaaactggctgtttctagccattaacagaaacagctcacttttactcatttccattgtagcaggcattgaataaacccctttaaatactgcctctgtgaattcttacaaatgctagtcccatttgacagaagtagcagcaatctgaataatggagagtttagggactacagatcacagataggagatagcaatgacaggatctgaccttaggcagcatgtctccaatggctgagaacttcaccagggtaagtccctgtagtataatgtttcagtcaagttctgtagtcagtctgcctgggacccatgccttattatctgcacattcttagacaaatgcctcagccactctttgcctcagttttatcatcagcaaattgtagatataaaaatagtgcctccctcagagttgtgagaattacatgcactacactgaatgttagcaattcttgtcattatcattattagcaataaagtgacaaatttgtagaaataaaggcccttaacaactagaatttatgccaagttgtcattaacagaggaaaatagagaagggtcgtcacagtaagcctcttcccatcctgttttaagttctgtctattaaggatagtgcagaatcattggttgagagagggaaggaagaaaacatttattgagaaacaattatgtattagaaggtatgctaggtaattttacatgttacatcattcaatccttacagtgaccataaaagatgaatattatctcacttttcagatgaggaacatgaggttcatagggtttaagagactttcctgaagtcatagagaattaaaagttgtattaggattaaaacagaaaatgagaagtttaagcatcccatggggttggcagttttggtttgcaatgtgctttcgcttttttatttcaaaatctttaagaactattgatatagacattgaacatgcgtaaaaagttgaaaggtaaatcaaagagaattgttaactcaaaatccttttaagcataccatacctgagaaatagcaaaaattaataggttttacaagtatacttgatagaagctttgttttcaatatatactgatattatgatacataaacatattaagaaaaatttgtcacaaaattttagaatttgatatccacattagagaagcttttgtataaactattcagatcagaagacagtgataaaaatgttctctcacgcatatcataatgactaaatgtacacaggtccattactttaaagattttggactaggtaaaagaatcctattttagaatattaaaaatttatcacattttaaagggaacctattattcttcaatgaaaccatgaagccacaattttgagtaataaccacatgcagtgtgctacactaggacatttgaaggccacagatttttcaacttccagtgaagctggagaggaacagagctgatttgactaaaagtgataatgacatttctagtagattcattcagtagtacaacccctaaaacgtcattttgcactgtcttattaagaaacatattttaagatacgctttgagtaaatgtaacagcaagatattaaaacatacacctgtaaaataatcaagaaaatatatttgcatatctaattataaccattcaaattagctataaagaattaaatgcaaaagtaaagagcaactagtcaataatcttgacatagtggtccagagaatgctgtactttgggagagaagcagagagcaccaaaaagagggtctttgcctaatgtggtgtgttttgagaatggaagggaagggtaggcttcctgatcaagttgtcagttcctttctttatgaattctgaggattcccaaaaagaaaaattcctcttccactcctacaaaaaagctaggtcacagaaacaacaacaacaacaaaaaccaaacaaacaaaaaattagcacaacgccgttaatctcaaccttaattcagtttggcattagagaacgagaaaggaaagaaaacttaatgaaaaagaaccaaagacacagaactaaggatgtgataacttaataactgaataagttattaagaattcttcattgagcaactactactgaccagtaactattcaaggcccccacgataagctggtaaattcatgagatgtgatcttggcctcatagatactgcagttagtttagtaggagagagtccatagtcaaataattacttaaatacttgtaaaattaaaaccattgtgccacagtctttggtcctacgaaagcatgtgacacgtccataaaagtctcactgaggaaataacaaagctatgacctgaggttacatagaaattaggtgaaaggatgagagctgaggataggatttagcgatcaaagaattacacatctgaagaaagagaaaaaggctagggtggctgcagcacagtctcagggatagtctagtgggagatgaagctgaacactagcaaggaccaagtcctttaagatcttgtggcctcattaaactctctctttcctcctcaacttcctcttcttcctactcccaccaatagggtacccttgaaaggttttaatcaaggagatagagggtactgtagtcaaatgtgacaggaattgatttcatattaaaaatctcaggtatgcagaaatgcaacttactcaacctctgcttttaatggagtttcaagtcttggaagcaaaaagatttaaggagtcactttcaggacttctcagtctaattcagtgtgaacattatattgtaaacacagagcacagaatgagatcaaagaacaagtttacattttacttttgtggctcattaaatctgctccttggggctgccgcttctactgcccctggatgacttctctgatcaaccttgaatagaaataattcctacagtcattttaagtggcaatgcccatcaaatctgtaattaaatatcaactttgcaatagcaaaagatttcaaacttttaaaaaattaacatgtcttcccacccaagcccagttttactgcttgcagaaagctgtagtggggaagcaggaacttgtatacatttttctcctggcctctggcatttctaagcctccccagcttgctaactgcactgtgctttcttatctctgtccactcctttatgattcaagatgcatctggagaactgtcattcagtagacattagagaaaaatgggtacatggggacagtggcacctgtatgggccttaaggtgaaaaggagaccgtttgtatttataaggccatattaaggattataggttttattattaaggataatgaggaaccagcaaaccagcaaatggttttagtcatgaggtgtcacagacatgtttgcattttaaaagaattactttactttgggaggccgaggtgggcggatcacgaggtcaggagatcgagaccatcctggctaacacggtgaaaccccatctctactaaaagtacaaaacattagccgggcgtggtggcaggcacctgtagtcccagctactcgggaggctgaggcaggagaatggcgtgaacccgggaggcggagcttgcagtgagccgagagcctgggcgacagcgagactccttctcaaaaaaaaaaaaaagaaaaagaaaaagaaaaagaaaaaaaaaattacttttgtggttgaattacctcatctggttgggtggacagtcagacatggctcttagtgcagcaggtatgtacctagtaggaaaaaaaattgtcctcctccccccacacagggcagacaagctaaaaatcttagcaaaagatttgtatggatctgtcaaacggtcttttgtttaggtagttacagagaacatgaagaaagggcattcaccaggagtcgtcccgctggttgaccgaatagagtcctggtcagattcaatagctaggcttagctgaatgggaaggcagagcttctggagtatcagtatcactgtttctacattgctctggcccacagaaaaccatggcttagagaaaaataaacctggaatgtcacactggaacatggcgctaatttagacaatctgcttattttccaaggaactggtagttaaatacagactgtttattgttctaaattttaaatttaaattttcagctttgttgctatttttaatgaaatatccttttaaatacaaaatgttattcaagaatctcagttgcttttatttagaatatctgaaattcttaagtaacaacctacaaagatagaaaatttttaattggttctatttgtcaccctgcctaaagaacttttataaattcagtattcaaaaggagaaatattaaataaaaaggtaaaacaatcatgtgattaacaataagctaattaaaaaaataaaaacatcaggtaagatttaagttccttttaagtagtaattcttcagtctgagtggttatcaaaagcagctgaacaggttgaaataaatacagatggatttaaattcactaggtctggagtagaaaccaggtgttgagcggtatggctatatttggaggaagaataatagatgaagcaacttagatgtccctgagttgatagttgttcattttgaaggtagaagattattttaattttatattaaaattagcttgaaagcagtataactctacttttgtattttgaattttccagaaagaagtttttataaaaagcaacaaaacttctcaactctgaggaattcaggcttagaaactaatgagttagattatggcataggattcaattaatttatgttggattctgaagaaaattcgagaatttactttttagtatttgtataggaaaagcattcagcatgctttgacaaggatctttgcactggtttggtggtggctgtgcaaatagcaccaccaagctgctgtcatgatttatttagagagaagtaatctatgactcatgtaacaatataataatttcaaaaaatgtaactttatcccataatctctttgtgtacttaaattttaaactgtataactacttaatgctctcggggcatatttgggatgggtcacaaattcacaatttgtaaatagtatttcatgaataaaactctctttggaaacattgctggtaacatattagaacttcagctttagtgacaaaattgatcaattaataaaataactgaatttttaaaaatatatattaagttcttcactttaaaaagtttttcttcatctgaatgaattgcacttttcccagtaatacaagccacagttgcagcatttgacaatatgcaaaaattatactatattcctatttatctggttacgtagaaattgacagtcagaaacatgactttgaattatgttatagcccacagagaaaattatcaagcgcatcttaacatttctagtagtgttctttcttttgccacattaaatagcaaacatacagtgtttaacatgcacatttcctccttacctctgttccagagtgaaaacttgcccctatttttgctcttctcaagaggaatcaatttaaaaattattagtagacttagagaacacccttggacttttctgtttcggtaactgtcatgatagtgacagtaaggctatggcgaaacttactgctattcccacattactcttttgggttagcaatctgaatttaatttcattcactcccttcatattatagaaattacttgagtgcctatttgtacaaagtccaggtgaatttgtttcttattgctaccataatacattatatacacattacaaatatagtagcttgaaagaacacaaatttgttattgtacagttttggaggttggaaatccaatatcaacctcactatgctaaagtcaaggtgtcagcaaagctggttctttctggaggtcctgaggggacagtccatttccttacctttttcagcttctagaggctgcctgcatgccttgtcttgtggcttacgggcatcattactagcttttgcttcctttctcatatctcctactactaactctgagcctctgcctctttcttataaggagccttctgattacattttgcccacctgagtactttcccattgtaagatccttaattaattacatctgcagagccccttttgcctttgtaaggtagcatattcacaggttcttaaattaaggcatagacatcttttgcaggacatgatgcaagctagccaaaagagaaggagggaacacattaaaaactgatattggaaagtaaattagaaaattccaataagtctagaatttagttactcctaccagaagggaatagtcatttctctctctctctctccaacagggttaactttttgaacagtaactaagttaaaaattagcagatgtggctgggcgcagtggctcatgcctgtaatcccagcactttgaaaggccaaagcgggaggattgcttgagctcaggaatttgagactagcctaagcaacatagtggtgagaccttgtctttcaaaaaaaaaaaaaaaaaaaaattacccaggtgtggtcgcttgcgtctgtcgtcccagctacttggaaggctgaagccggagggttacttaacccaggagacaagagttttcagtgagctgaaatcatgccattgccttgcaccctgggtgacagagtgagaccttgtctcaaaaaaaaaaaattaaaagtagatgttttcatgacaagtagagattgacttggtctaacttattcagaaaattgccttaattcctcactcactttagcattctaaaactaactttcttcgctaggaaaggaagaagctgcattctctttatatctgtaaagaccaagtacatggggcactcacagatagacgagtctaaagtaaggtgtcttctgtgggaattttagagcttaggagcaagtactttgagctaagaaaggatatattggtgtgaaaacatgttacttggcacagagtaaggagtctttttttttcatttatatttttatttgtattttatttgtatttttaatcatcttatttttagaaattttctaattagccagtaagtgcaaatgtgctctaatagacacttatgtgaactaatgaaaaattgagaggtgatcacaagctttctataccactgacattgatttgatatttttaaaagagggagaaaacatattctgatggttctgtaaatagatttgttcccatcataggaatttagaaattgtgactcctgagacaatttgcttccaattatattatggaaacagcttttatttcaggcagctagaattaggcttgctcaacatctttaacttgcagaataaatggagaagccatcctcaatttctattctatgtatcagagatttgttttgttgtatgtgatctatgacacatatgtaacgattacatagcctcagtgtttgattttaaactgcttaactctccagatgtttaaattataaaaccaccaggtaaatacatttatttttctatacaagtatgcacagctggctaataccaaatgatgccaaaatgtctgcaccaagcctttctcctttgctattaaggaaactgcccatgggttcatgtggacagagaataaaattcatttaacagtaaaatatcgtattttgtccccctttccacaacagttctttgacttcagatcaacaactctggccaataaggtcacctggcataaggatattttatatttttctctatttgaaaataacatttaaataaacctccacttaatctttgaatctagacctaattaccccactaatttccggataaatttcctaggctgagtgtttctctctgaagcttccgacatcttttgaaaacctccttaaaacacttccatacacagttatggcaagcatattttattccttcttctaccctacctagactgtgagctctttgaggatggggactgggtcttacacctttaacttcttacctattggttgacataggaaatatttgttgacacagtaaatattcgttgaattaataaattaataaatgtagcatgcagtgagtgagaacttgctgagttctttcattcagtgggaaaaggggagaaaatgtcataagccttatttctgagatatttatagtatattaaggggtagagagaaggaaaactggcgaagaatctgaaaatactacatacaattaaaaagcaaggacaataaatgctcaaaatttgagattttctaaacacaggagaaggtcgtatcacaatcaactgaggatttctttctaacccactctcccgttagcactgtctttctgtaaatgtgcgctcccatttacagagggcacattattatgttgacagctgtgcccagtagacacagtaagactgtggtttgacatgatggacttcagtcttaccatatccatggactcctttatttttctttatctagatccccagataagctttaagacaaatcctctagctcctctctttgaaccaacccttcgtatagtttcagacataaatacttaactgtggttctttgctttcactattatcctgaataacatgtgagagcttttcaaaatttagttgcttttaacctctcttcaaatttcagtagtggacaatgcgttaagcgattttgctgtgtttccaggattgagaactgttgagccactctgagtgaggacctaggactagcagcactacatcacctggaacttattaggcattcagcgtctcagacttttccaaagacttcgtgaaacagagtacgtattttaacaaaattctctatgtaactcccacatgcattaaagtttgtgatgcaatgctctacattatatcaacctactaaaatacacaccaccaccaacaaggagatctctgttaagataataagaaaggctcctggaggaggcaatagagcccgtagatacacaggttctggagtcaatctacctggattctaacacttattagttctgttaccttgattgcattacttgttaggcctaaacttcagtttactgcattaaagtggggatactgataaatgaccaaatccgtaagatttctgtgaggtgtacagcattatttggcatacagtatccctcagtaaagttagtgctactaacgttaagtgaactagacctgaaaagcagtagaaggcattcccttcaggtcattatcagctttggatagctggagtaaactagaacaccagtcttcaaatgaggcccacatattccgaaaggtcaatgaagacattccagatgaaacataggaaccattcattttaagtggaacattttcagatcccccacatccatatacatccatttgtaatttatctgaaattaaaatttgatatgcctgcagtagtgtgtgagctttgtctttcttttccaacttgtctttcacaaaggtccccctcccagtttacaaaatagaaacttaactcccagccattttaaattttagtctagtatattctctgaatgaaaaaacaaaaaacaaaaacaaaaaatatactttgtcaccacaaatacactttttatgcatcatccaggtgattaactatatttatttttattttttttgagacagagtcttgctctgtcacccaggcaggattgcagtggcatgatctcggctcactgcaacctttgcctcctgagttcaagagattcttacaccttagcctcccaagtagctgggattacaggtatgtgccaccacacctggctaattttttgtatttttagtagagatggggtttcaccatgttagccaggctggtctcaaagtcctaacctcaggtgatcccccgccttgacctcccaaaatgctgagattacaggtgtgagccactacaccctgccaccaaaaaaaaaaaaaaaaaaaaaaatttactttttttatgtctaaatagttagtcaccactagctgactattaatggcaagtctgtgttcttattctctagctagctatctgtcttcttagacagttcactcctgagttgtctgtaggagtgataaataataacaagttaaatttttaaaaaaatgaaataactctttactcacaacaaatttgatttggcgattggtttggcaataaggattaactttgctgttgaattaggatatttttccataaattgaatagctaatactgaagatacaaagtttttgcagatatattttaaccacatgaaaatatatagcactggcaaaatagaatatttatgactactaaacaaacaatatataaaattcagatgtcaacctaaaaatttaagagcattatgttaagttttacaaaatctctgaagcttgcagattgcactttggtgatgtcagctcaggaccttgataggtggattcccagctctgctactatttgtgacgtactataacacactgggaggtctaaagtagaacttaccaatttgaagctcaaaagtgcatccttggcttaataaaaagagaaagtaaaacagtttttggcacatatctttaacctcaaggccctattggcaccctaatacatttataaatataatgtgagatttcaaacatatttctgaaggaggagagcctagatgcatgcatgaagcatagagttttgtactctcagatctatgtttaagtttttaatgttgaaaaaataaattcataaacatattatcataagtagcatgtaattagacattaacactatgaaacaaggaggtaagtgatttttaaggggtttccaagcctttgttcaaaaatactaagatataacaacttggcttaaaaatgataagtgaacgcaataaaaattgccatgagtacgactgacgaggacatatcaattcgcgtttgatgattcttattatgtttaataattatccagcaggaatagaattcattgttattttgctttgagttatttaaagagaaaagtaagaaagaagggaatttagggtttatttgattgtggttataattcaaccaaagccggtttgaagaggcaatggaaaaataagacatttaaaggtctatttaaatttgaaatgaattaatatttcttctgacataatatggcatttgaaaaaatatatttaacatacctttccagaaaaaaaaaagttatgtgcttttgctttcatctagcacatggaaagtgggaaaacctgttgcttccaatcaaacaatgaaaaaaagtcaaagagaactatcaaagtataacttttctcaagtccatcagatagctgatattgtagagcaaccacttagccaaaattaaaacacacacacacacacgtgggagaaagtgattggtaacatataaatgtgtaagagtgattcagtcaaaatcagaaaaccaacaaaaaagagtgaaaagagataagataatcaatagaactggactcatagatcacctgagtgttagatttactgggtaactgctttaaaataactatgtgaaacctgttgacaatctagtaaaaaaggtggagaacatagattaaaagatggggaactttagcagagagataaaatctataagaaaaattaaaatggaaacgctaaaagtgaaaacataatgcaagaattgaagaattccgtcaatggatacataagtactcggacttcatctagctaaggaaaaaaataaaatgtatgcttgtaaaaatgactgaaactgaaacacggaaataaatgaaggtaaaatttaaaaaataaataaaaaagcagagcattaagaggcatgggacaccatcaaatgactattatgaatgtccttcagtcccgcagaaagaactgatggagaacagaacaaatgcacgcatgcatgtatagatgtatataatatatgcacagatagatataatgactgagaattttagaaaattaaggaaagaaagcacactatagatccaagaagctcgaaaaaccaataagcagaataaataacaaaataaacacaaaataaacacagatcgaagagtacaggtacacactgagatacatctcagtcacactgatgaaaaccaaaagagaaaatccttcaggtagccagagaaaaaagaaaagtcgacacattatacaggaatgaaaacaacaacaacaaaagaattacagcaaaattcttatcagaaatcatacaagccagaatattcagtcacatctttcaagtactaaaagaaagcaaaaactatacaccagtaattctattctcagagaaaatattatttttttaaataaggataaaatagttttcagacaaaactaaagctgatttattgctagcacacttgtactatgagaaatgtcagaggatgtccttcaggcagaaggaatatgatatgggacataaacttagatttatacaaagaaagagtgtcaaaaatggtaaaaatgagtataaatataaaagccttttaaaattatttttcatcattctaaaaattatgaatgattatggcaatattttaaaataaaatttcaggtattttgcttttccagatgaataattttcttaaacccaataataatttcagtaaggtttttaaaatttaacagttaagtgtgtatcttctggaaaaatatacaaaaattgaatagtggtagttatctgtaaggagggggagaatgagagggagacatttcaataaatatactcttattttttgaatttttagatattaaaataaaaaatcaacacaattaaaaaattaaatacagtgatatatacaatttaaagatggaattgtaacatataagtagaacaatgatctcaattggaagattcaaagcaatcaccataagaattttacctgaaatattatgaagaactcaacaaactatagaatattaacaaagaataatttatagattgtgaataattaagtaaattctgactaaagattgcaacgagtgggaatttaccaaacagattttaagacatactgcaaacgcacagtattaaagagtatagaatgatgagtgagggagaaacccagctaactcagacataggtctttatatagatgaaaattagatacatatcagagattgggcacagcaacgggcaaaatacgggatgcttgataaattgtcttgaaaaaatccagttatgacactgagaaaagtaaaattcgatcctgatcatagactcttgttgtattaataatccacatgtgagaggagaattataaattgaataaaagggcaaataggaaaatactttgtaaaccacaattgagaaaatatttattaaacaagaactaaaagagataactcataagattggaaaaaatcaatatttcaaaattaagcattcttttcaacaaaatttaacagatatgaaaatactagctattttgataaacaaaaattaacagattaccgtagtagaaagttattttaaaatattaaaaccaatgagtgatttttaatatataaatcatatatatacttgtaatatataaacatataacacatatctgtggtattaaaacttcgtggatgggccggttatggtgggtcacgcctataatcccaggaattgggaggccgaggtgggcggatcacctgaggtcaggagttcaagaccatcctggccaacttggtgaaactccgtctctactaaaaatacaaaaattagccgggcatagtggtacatgcctgtagtcccagctacttcggaggctgaggtcggagaatcgcttgaacccgggggggcaaaggttgcagtgagcagagttcacgccactgcactccagcttgggtaacagagtgagacaccttgtcaaaaaaaaacaaaaaaaaaaaaaaaacaaaaaaaaaaaccctttatggatcaaaattcttaggaaaaaaaagtctctgaaagcttcacagaaagggtgatacagaaaaaaaaattaacactggattacagaacatacaaagaattctcataaatcaacaaggtcgcaaaaaagccagaaaattaatagataattaggcaaagcgtatttataggtagttcacagaaaaggagtttaaatgttcaagcttgtttgcaataaaaaatgctaatttaaccatgttacattcattagaaaggcaagctattgagagaaaagggaattcattatactctggtaagaatatccatctgtatagtcattctgcagaaaagtctcacactattcatttaacctgaatatgtttaggtccaggatttccattccaagatctatttcctaacaaagttctccaaaagttgatgaatgcacctccacaaagtctacatcacgttattattttttagtggaggaattcgtagcaaactaaacatctaatacaattttacttattggcataaataaaatgcagtggatgtatactatggaaaaatcggcagcaggtagaagcaagtaaatgaagtgaacatacacagtcagatggatgagtttcaaacgcagttttaactttaaaattgtaagatgctgaacaacatgtatggccaataacatgtaggtaaatttaaaacatatactcacattaaacaattttttttttttttttttaagacagagtctcactctgtcgcccaggctggagtgcagtggcacgatctcggctcagtgcaagctccacctccagggttcaagccattctcctgcctgagcctcccgagtagctgggactacaggtgcccgccaccatgcctggctaatttttttttgtattttttttactagagacggagttccaccgtgttagccaggatggtctcgatctcctgaccttgtgatctgcctgcctcggcctcccaaagtgctgggattacaggcgtgagccactgcgtctggccaacgattctacattcttaatatgagtgcaagcgcattaaattgggttccaatggggaaaaagaaatagaagtaatgatcaggaatgtggagataaaattttaaaggcgctttttgactcgtatcatactctattttcttcatttccataacaactatcatctaaaatcatatttattttacttgcttattatttaatatctgtctctttcttttagaatgtaagacacataaagacagggcttttctgttgttgttcaaggtgtctcaaacacaaatatattttacattaccacagggcatgacacattattaggtgataaaaattacttgattaattatcagtaaatgagcaatgataatttaccataatttgctttaccagattgcttcccctaggttggctcagtggaaacagtatgcctctccttggtggacagcttcttgagccgaacatatggtgaagcacggcttctatgcttcctgtaattccgaaagggttgccaaaatacagatctgtgccaagaaacctctggcttcctaaccttgacaagcctttttgaggcacttagccagtcgtctttatattcatctttgtcactgaacagatccacaaggaccaaacaacacccatattttccatatggatgtaatattgcaacacattgtctttaagctaaaatagcatttttagggcacaattatttatgtgctagttatggatgctatacaaattatttgtcagtaagtcatcaaaaatctcttatatattcaaatgtgggtacatagatacatatattgttgttgtggtggtggtggtgtgtgtgtgtgtgtgtgtgtgtgtgtgtgtgtgtgtgttggcataaactaattgcaattctcttatttatgatcacagaaaagtgacttttcttccctcctgaggtaagtttctttcttccctcaggataagaatcaacacttccagttgcattgtgtattattagaggttatgcaagaatccagaagtcagatcaaggctttcctatgattagtttttgttttgtatttgatgctatctgttaaggtctcagagcaaaaggtcctaaaaattaaaaaaataaaataaaataaaagcttaatgaagcaaggaggacaatatttcacttcttgattatagctttctatttataatgcttttctgttttacattcagcttcctcacaaatcaagcctgataatgattcatgtgctaaacactgttctgacgaagatgatttctgtatagttctaaagttttctgtatggaaaaacaaggtgatgtggcggaaatctggaatacatgcctgcctaaaatcaatggaatattctatattttaatagattccctttagtgtaaatcaaatacttaaatatgttataccaaaaaaaaaaaaaaactttattactgggactcatttgtcgctagggtacagataggtgatttggatgcaaatcaaatgtaccgatgctagactttgattcagaatggattacactgggaaagaggaccttgattttgctagtgctggtagcagcagaggtagccccattctgggcagagttcatggtggcagtagcagcctccttgctaaggggacttagaatagttccacagcatttctgccagagttcttggaatcttagtgcagagtcaacactgctgcctttccaaagaatctctaaactatggaataaatacactatagtaaaatgtcattccaaaagatgggaaaaacagaacaaacactctgtatgtaaaagtatgcaaagtcaaacaccaaaagctggcaagtattttgtaaagtcctttattacaaccaacaataaaatacaggcaaagcacttagtaccagctacaccgtaagccctatgtatagagccattaggcagctatttctttaaatatgtttcacatgggaaccaaaacgtacactcacatacaaatacaaattgaatatcatgaaatgacacttacactctctctacttcaattctgtttaagttaaaaaataaataactgcaacatacttacgtgatttcacaactaatgtgatcaacaatttgaaaaatactgtcatagaatgtccacgcataatttcaatttcttaattgatgcctaattgagcattactgaaaactaggatattggagtaacaactctaatctttggagggtaatgacacaggtagcagttcaccgatttattcattaatttatagtatcattctcttcccagcaattactctctagtgccctcttagagacataactaaggcttgatttagtatgcctattcctttgtcaacctgtaattgaagatcagatatcgaagtaaaacaaaaaaattgagaagcagtagcagtgattggaaaaatgactttttaattgttttattcatactgttttttctcattttaaaaaatcatgattattacaaaaaattttaaatataagtgaataaaaataataaaatagcattcattaataattaaactgcaaactaaagattattacatggagtagtctgagtctgatcatgagaaagaaaccacacagtgattttgttaggggacatttaatacaaaaattattaaatcatgaaaaaagattatagaatataagaaaacttttctatctctggtactctaggactgggaaaaagtagccacagaaggacaaatttggaaagagactcccttctcaaggctggggttcagaccttattggagaagatgtagttgtaacccacaggatgacagagaaatttatcggtgtgccagactggacatggtctgtagtcatgaggcaagtagtaagcaacattcagagtgcagattggacgcaggtgagccacaactggtaggtgggtgtatgggtacacagagtgactttgggccccgtggctaccttctggaatacaagtgatgtcaggcaagctatagctagtggaggtgcacatgggcatttacacttaatgggagtaggggaacaggcacagcaggtgaattgatacaatatccctgctgggaggaccacagtgtcctgaagaccttgggacacaaacctggggcagcagagagaattagggtgctgctgctgctgtctctcggaggcctggaatacccagtgtccatgtcaggaggacagtgcattctgggagcatggctgggcaagcatcatcagtgtcctcactctcacactcctgaccaaccatgcacacccaaaaaccaaaggggagtgccttcttcctgcaatgtgccctacagctggatactgaggaagattaacatcatgctcactataaaggagagatgcttaaaggaatttcattatcacacagcatatattaagggtttaaatatgtttcacatggcaaccaagacatatacccacatgcaaatacaaactgaaaagttaaatatcatgaaataacacttatgctttctctacttcaattctgtgggttacaaccagtgggttacaactacgtcttctccaataaggtctgaaccccagccttgagaagggagtctctttccaaatttgtcctcttgtgcgtacttttccccagtcctagagtaccagagatagaaaagttttcttatattctataatcactcttttttcatgattttataatttttgtatttgcaatccttaataattaacaatacacaatacagttaagttttttttagacctctccattctttgaactgtagccattactactctgccagatatgctgttttaaattattttatttacaacatgctggggccatgccatataatctttgggaaagattcttttacagaaagtagtcaaatattgaaacaaatgatgtgctagtgatacagatgatggtcaaaatgatatctacatttaaagacttattcataatccaaacaactgatttataataaaaggaactttaaatacttattgtattggagattctatagatacaccacctttcattattttatgaaacaattatatttttaaaatattatgtccacatggcataaatataagtgatattagaaaaattgataagatattatcatttataataacagttttttgattatgaaaaacatttataaataatattttatattattaatgagttatcatatttgaaagaacactattgtacaattcaaactttattctccctctcctaaacactgggtcagaacaaggaaataattgtttctaaccatgaaaactaatgtataggtagagttgaaaactctgaaaataactaaagaaaattcattttactcattggaagactacttaatttggtttggggaataaggaggacagctacaggcacccaggaattttgtaattcaaaaatctctcttctacacttttcactaattaaaactgtattcattaagcaaaatttacaaagaatgattattaactgttagctggttggggagaacaagccttcttttacactgctgagatataaaaattggtacaaagttctgtagaacgctccagaatgccgaaagttttaaaatgttgtatttcttctgatccaaaaattccacatctaggaaataactggacaatagtaaaaggtgtaaacatcacttttgcattgtagtattagtataatagtgatgaagtgagatagactaagtgtctatcaacaggaaattaaataaattataggttattgatataatggaatactatgtatttattgaagtaatattgtagaatatttttaggtgatatgacatgtgattaagaactataattataaagtaatatcactgctgtaagtaaaatgtatgcatgtgtaaacccaaaagcctcaaagcataatctctaaatgattaacaatagttatctcccacaggtggggcaatgagaggcttgtattgttttcttaatatgtgcatatattacctaaatttttaggttgaatataagttacttttataataaacaaaagacaaatttatgttaaggaagaaggcattcaactgggttaacacatttactttttaaaatttatcacttagaaaataattaattcacttttgtgattgaaatactctctagagttactatacaatggatatagagtttcaataatacaagatgaacaagttctgagatctactgtacaatgggcatatagttaactgtactgtacacttaaaatatgttaatagtgtagatttcatattttttttttactgtaattaaaagatactctctagaattctgaatatttaaactggcccctatttcctgaacaggaataacttttagctgaattcagtctcagagatgtgagagtaattcaggaaagtagctagtgtataagagagaagatgaaaaaagggaaatcgagagagcttgactggggaggaagttatatagcaataatcaagcagagattagactgtaactcaatagaattatgttttttgaactccaaccaacaaccttttctctgggtaggctgactattaatagaaataataaacatgggtagtgaatctccaacccagtttttacatatatgattagtacttacatattaacatcaaataataatttcatagattagaatttgtgatgctgtgttgtccattttcacactgctgataagacatgccggagactgggcaatttacagaagaaagaggtttaatggacttacagttccacatggctggggaggcgttgcaatcatggtagaaggcaaggaggagcaagtcacgtctaacatggaaggcagcaggcaaagagaaggcttatgcagagaaactcctgtttctaaaaccatccaatctcatgagaccaattcactatcacgagaacagcacgggaaagacctgccccgacaacatgtgggaattatgggagctacgagatgagatttgggtggggatgttagccaaaccatatctaatgctaaagtaattatacctatcacttcttaataaagattcattaccaaaagtaattccttcagttatgcaactttggtttaccttaaagatttaatatgtatctcaaaatagtatttaattgttcatactcagtttacctagcagcatagtaatgtatggaataaattctttcttatatgactttttcagtatgctagttgcaaattggatgaagacaactagttcatttaaactctttgtttttttacatttttgcagaaggaatgttatttactattacaagtaataaaatactatcaggcaggtttagggtaatattaagctgacatatttgccgtaacagcagtttcattataatcgagtcaaaacatttcttctaagagatatcaataacaaagaatttatgcacttgtctgcttttaaacaggtgtctgaaaatacaagaatatttatttgggagtgtttgatagctaaatttatcataactcttatttcaagagtaaattgcttgtattgattatgcaaacataatgattaaattctgctacaaaacacataattatttattgaacatcaatatgataaagcaaaacttttcaaaaatatttttgcacatattgatcagttttcaaaacatattttatgaaattatgttagttatttttaatttcttcttgtctgttatttagtgttttgttttctctatcagaagttcagacttgaaaactgtttattatgaatgccaactttccagtctttactaaattgatcagttcaagagttccttgacctccaagcatgcagctcaaactgatttccttgaagacaacagatgttattatctattaaattagatttggtatctgtatttttaggtttacattttaaggacatgcagaacataagtctcaaagataaagtgccagacctaaatctgtcaaccataaatgtatcattagtgctgaattttaaatctttttttctgcctagtaaagtaaaatagcccaaataatgtcagttctttttattttattaaaaaaccccagagtaatttttaataacaagtgctgttacatatctaggtatagtagagctcagtatataaaaactctaaaaagtgtattaagtaatttttaagatacatacatttattttctttgttctaaaaggaaggcttttattttctttttatggccacacattatataagggatatcttttaatctacttccatcaggaaaaataaacaattgacctttgaaatctagagaaataaacagaaaaccaaaatgagaccaattaccttctggaccaatgactgtacaacatatgtactgtcaatgtctctctctcccaaacatcagaagagcccttagtttcactgaccaaaaaaaaaaaaaaaaaaaaaaaaaaaaaccacagactttacacagttgcacccaaagagttgctctggggaggagttatgtcctctgccaaaattaagaagttcatttgtagattctatatttttttcatatttcttacatgtatcaacatagaaaggtgttgatacagacaggaatcagggaaatactgggtagaagtggatgtgggtccctggcgagggtccatcctcaagtctggacccacggccttaaatgagagcatgcattcctgttttcccacttgaatgttgccttttccaaaaccaccctagccttctctgcccccacattctgtacccataaaaaccccaagctccactggtagaggagcagagcggcagagaagaaaagaagagaagagaagaagcagctggatgttggagagaagcagcctgacttcagagggatggcttgatggcaggactttggagaagagttcagcctgggacagccgaactccattatcttcccattccatcccccttctagctccccttcttgccgagagccacttcctctgctcactaaaatcttccatattcaccaccctccaattttttcacacgacctcattcctcctggacactggaaaagggcacaggtgtgggtgcaagaggctgtcgcattgactctccactgaactgtttaacatttaagcaatccatggatggcaaagctaaaagagtgcactgtgacacacacccgctggggctccaggggtcatgggcaatgcctaggcactgccatgggcccctacggggttcgttcttgctggtgcccaaagttgcttgccccagctcctgcacctgctcacctgcatgctccctgcaccctccccgctacctccaccacgcaaagggtttgagcactgtgggctgagaaagcaagccaccccttcacaagtcccgcaaaggggtcaaggggactatcccatctcaactgggggctctcccaggattcatcagatgtgtgagtaacatggggatctgtctctccttgtcctcggactttcctctgagctatgccacttacaggggagaggattcaaccatctctctctttctatggatgaaaggaatgttggttcagtttcccttcacagaggtttagtcattacgtgggaccaggacaaggtcctggggcaactgaaggtgttggccaaggtcctcaggttttcctatggtatctttcctttcttctctcatggtttgaaatgcctcctatctcttctttcataatgttaagtgttttgctgcaaactactgaaatgtaactaagtacaatgtacgtttggcccagccatcagatgtgcagttcagaacaatgtgatttctgtttatggaggtgtcattttcaccccaacagctgcaagtcagtgagggggcttggcggctcccctccttaccacctcccctcccggctttagcacctgggtgtgcccattccaggcatgactgtgcccagtggccaagcagagcggaagtaagctgtgcacactgcccaggtcctagggaaatctcagaggcccaggcccctacacaatcagctggaaatgtagcttcttcttagaaaatagaaagtagtttagccctgggctgggatgactgtgaggggtgagctgcccaccaactcagccctgttgcattgattttcttaaagtttactctggcaaaatggcatttgcttacattgggcattattacaaatatctccattaaatttattatcatgttaccctaaatacattagagaggatgtgctcaccacattagatactgtccactctatgagggtcctcaagagagatatattgtctcagtgtcaacatagttttgtaaaatcaaaatgtaaaatcttctagggaagatgagtaaaatagtctttttttttttttttaagacagaatttcactttgctgcccaggctgcagtgcagtggcgtgatctcggctcacaacaacctctgcctcccaggttcaagcaattctccggcctcagcctcctgagtagctgagattacaggcacccaccaccacactcggctaattttgtacttttagtagaaacggggtttcaccatgttggtcaggctgatcctgaactcctgacctcatgtgatctgtctgcttcggcctcccaaagtgctggtattacaggcatgagccaccatgcccggctgagtaaaatattctcataaacttggggattggaaaaatttcttatacagaacacaaatagcactaactcaaacagagagtgaaaaaacaaacattaaaattcagagattctctttatcaaaatatacttttttttttctttttttgaaatggagttttgttcttgttgcccaggctggagtgcaatgttgtgatctcagctcactgcaaccaccgcctcccaggttcaagcaattctcctgcctcagcctcccgagtagctgggattacaggcatgagccaccacacctagctaattttgtatttttagtagagatggggtttctccatgttggtcaggctggtctcgaactcctgaactcaggtgatccacctgccttggcctcccgaagtgttgggactacaggcatgagccactgtgcccggcccagcccaaaatatacttttaaaacagtgcacagtcaagtcatagagaaagaaaagatagggatgatgtatataccaaaggtctcatattcacaagatgaatagaacttccacaagtcattgtcaaaaaccagacaattccaataacaaatgtgcgagggacttcaacagcaccacacacacacacacacacacacacacacacacacacgagttccaaatggccattaacataaagaaaaggtggtatacacattcagtagagtaataatcagcaataaaaaggagtgaagtactgacacaatgctacaacataacgaacctcaaaaacattacgctaaatgaaaggagtcagtcattatatgaaatgcccaatataggcaaacccatgagagttagaaagtagattcgtgattgtctagacctggaggctgtgggcggtagaatggacgagactgctaatgggtaaaagtttctttcttggagtgatattctggaatgagatagtgacaatggttgcatgactgtgaatatactgaaaaccactgaattgtgtgttttcaatgattgaactatatgtgatttaaattatatctcaataaagctactaaaagttagatggaatgaaaataaaaagttataataataaaaattcgtggtaaagaaaaataacgtattctagcttatcagtcatcattggaaactagttcaaccattgtggaagccagtgtggcgattcctcaaggatctagaactagaaattccatttgacccagccatcccattactgggcatatactcagaggattataaatcatgctgctataaagacacatgcacatgtatgtttatagcagcactattcacaatagcaaagacttggaaccaacccaaatgtccatcaatgatagactgggttaagaaaatgtggcacatatacaccatggaatactgcgcagacataaaaaaggatgagttcatgtcctttgtagggacatggatgaagctggaaaccatcattacgagcaaactatggcaaggacagaaaaccaaacactgcacgttctcactcattggtgggagttgaaccatgagaacacatggacacagggtggggaacatcacacactggggcctgctgggggatggggagaggggggagggatagcattaggagataaacccaatgtaaatgacgagttaacgggtgcagcacaccaacatggcacatgtatacatatgttacaaacctgcacgttgtgcacatgtaccctagaacttaaagtaaaataataataaaaaaataaaataaaataaaaagaatttcaaagttaaaaaaaaacagttagatgccaatgtgaactttcataaatagttgttggttaaatacatactttagaaaatttaaaagtatcaactaaagctgaaaatcctttccttctggtccagcctttacattcccatgtgtataatcactagtatgagttggcaaagatgtggagtaactggaattctcatattctcctggtgggagtataaattggtctaattactttagacatcatttggctatatctactaaatatggacatatgcataaacaatggcctagcaatttcattcttaggtacatatattatcctctccctccaaagagcaaacgataaacatgtacatcaaagtgcgtacaagaatgttcaaggtcgtatgtttttttgtaataggcacaaactggaaacaacacaaacattcattagtagttaaagggataagtagtggtgagatgatcttataataaaatattaagcagcaatgaaaatagatgtgctacaaccatgtataacaatatggataaattctctaatataaagttgaggatgccaaagtaggaaaaatacattttacttgattcattttatatataatttagaaacaaaaaattgctctgtgacgctggaagtaagactaactttggagaggaagcaggggtttgtgattagcagaggtatcaggggctaatataacaagagtgatatttactccttgactgaaatactaattacatgcgtctggtcacttttgtgaatatttaatgagttagacatctgtgattttttgcaatttttctgttatacttgaattaagaaataaaacagaatctgcttttctccaccaatgagatttttaaaaatcatacagacacagtgaatcatgttaactgatcatggtgatcatggcaaagaaaacttagagctagatgtataaaccatcttttagagtactactactgctacttgtaaatatgtataatacgtactagacatgattctaaatcatgtgtactcatttaatacaacaattttttgagtgggggacaatttatccccattgtacaaataagaaaactgagatacagaaagattaatttaactgcctcagatgatagctagtaagtaaagtcagagcttgaaaccaggaagtctggctctaaagtctttgtccataaccacggacctaatctgttgctctagcagggatttgggattttattacacacattttgagagctcaccctcttggatgcttcctttctatatccttcctttttcctcatttgttccatcttttgaaaatacttttatcttatggatattaaatttgtaagatagtttctttaaaaaagataacattcagcaccaatgtactttattacttaaacttcacttacctctctagaataatttatgtttatctcttctcccatactgtatattaaaattcagaactgacgtcttatctgtttgtttatctccctccctaggatattgtctggtacatcatagatgcccaataaatgactgttttgaactcagctgttataacacaatctgttaaaggacaaagaacagtgtcctttgtcaaaaagaacaaaacctaaaagcataaaagaaaaaacaaacagaaaattacaaaagtaaaagagagaaagtggggatatatatgaaatgtcgagtttatactcaataaagaccatgtgcatcttaaacaatcacaaaacatatttacaattgaacaaatgtttagctaaaatatttatcaattgtattacattttaattttagaaggcaaacaataactttttgttttactaatgatgaaaacttcttgctttgtctaaaatatttttaggtgagagtagttaagtctccaaatagcatattatatataatgttaatattggatactgcatccatgtttttaaaataaaactatattcactgtattttaaattaatattcctttagtacatttaaaatttaaaagcttaaaaacaggtacatttacatatataagcaaaatgagtttattaagtttaagcttatttttgtaaactgaatttagatttttatgaattaatctaatctctttactatgtagaaacatacaattaaagggaaaaatattattctggctactttttgcctaaggctatcattctattttctaataccaaaagctaaaggcctccagaaaaatttaaagaccatggagctattggtttggcagcatacttcacttttctttaggtaaaatagggcttttatagcattctctaaggtattctgtcttcccaatatttgcagatggtgaaactaaaaagagaacaatcaaacaaaaacaaggcccccaacagttgtaaaggtaagctataaattacaaagtttatagctttgtcatgctaattcatgaggtgtacatgtcctgtggagatattaaaaatggtctaagagataaaagtttataaatctccctcacggacatatgtgctacttttacttgcctcttcagatccattctcccttttctccaccccactctgtatcctgagattgctgggcagtagcttggcagtggccactttagtcagattgccttttcctaaacctcctggttcaaggagctgtttcctcctgttttgctcttaggccttagaagtaactccctgctgtttccacgtctgaatgattctcttttactctacctacttcctattacccaattacagtgtattgtgtttcttgttgggaccctgtcagacatgtttattgttgctatttatttgatacttttctgcccccagattatattcttatatttttaggtggtaaaatgctctgtaaacccacaattcaatcccctattactcagttactgttaatttacattccacttgaacattatcagtgactgggagctcactacttccccttcccaaaacaatccatttatttctaccagatcttaattgtataaatttcttttttcttttattctactgtaccataatattttgccatttcatttttacctacatttccagctcgagtctcattttttccagatatttccctttccttcatttgaaattcatgacacatgtattaaatcatttaaaaatattatctttctactgtgattatatgtcatagaatgtattgcccagaaataaatgaaggactgatatccttatattggtctgatatcctactatggtgttagttcataacttaagttgggagttactccagtaaatgaagagagttttcatatctaataattattaattaaattgattcaaaagcctctcagaagacaaaatagtaatttgttacacaatattaccatagtgaattaggatattaaataaataagataagctctcagtatgggagaggctgataaaataaaagaaaacaaaacactggcaaatgagatgtccatagagagctctgagagaatgtaaacatgcctggaatcaggaagacttatgcctgggcaaggtggtgtgaatgcccaggactgacctgagggtccctaatctcttacttctagctgaccttgagcctttgtgaaagcagaaagtgaagctgaggaaaatatgtaaactgccttgctaagtattgaagttgtgctgtattaaaacacagaggccttctgcaaaggttgggagacctattaattcaaagcatttaaggtaattattgtctaattattagctgaccactataaggtcctcagaagtgatttcagtggcttcatacggcaaggaatacagactttacagaattcatccaggaaggttactaaagaaaataatattaagaagaacaacaagacaaccttcaacaacaaaccctgagagaaagaagagctgattttcagagttggcatatttatattagattaaatatccagttatcaaaaacatacatttggaaacatttaacaaaccaggaagtatggcctgtatacaggaaaaagagcagtcagtagaaactatctttgaagaagcccaggcattgaatttactagacaaacacttcaaattagctattgtaaacataatccaagacctaaagaaaacaatgtccaaataattaaggaaaacctaagaataatatcttgccaaatagagaatctcaataaatagttagaaattataaaagtgagtcaagtagctattctaaaattgaaagcaaaataactgaaattaaaaagatattcactagggagacttaacatttgaaatggcagaagaaagaatcagcaaacttgaagataagcaatttttttttttttttttgagacagagtttcactcttgttgcccagtctggagtgcaatgatgcaatcttagctcaccgcaacctctgcctcctgggttcaagcgattctcctgcctcaacctcccgagtagctgggattacagacaggcatgtgccatgatgcccagctaattttgtatttttagtagagatggggtttttccaagttggtcaggctggtcttgaactcccaccctcaggtggtctgcccacctcagcctcccaaagtgctgtgattacaggcgtgagccaccgtgcctggccaacatgcaattttaataaaggaattattaagaaataattttaggcagatagagagagtaaaaagagttcttggtaaggctttttcttttaatagaaacagctcctgaaacgtttttttctagcagaaaggcagcttgaaaagccaggctggcaagtattgatatgctaatgtgggtgattagaaagtaggtgcacccaacatggccaacatggcaattcccaccctcttctccttgtcaccacatatgccaggcatcatggccacccccagatagctccacatgtgcaggactacatgacagctataatttgcatatttaaaaggctaggatgggagggccaggtttttcacaggctacatgaatgacacacctggtgataccaatcgcctgggccatatgcaaatcagacaccttctcctccagcctctcaatattaccaaccacttttctgccccacacagagtttctttcttggaacacaaacctgcacgctgtgcacatgtaccctagaacttaaagtataataaaaaaaaaaaaaaatatatatatatatataaaagaagaagaagaaggaatgcccaggcagcaagatgaagccacctcgaccctgtccagcctgtggtgaagaccactggagacagaactgccctcggaggtggaggtcactgggtggagtctcacagatggtccagcaggattgatgggtcccggggctcaaaccgtgggtccagcagctcaaactgccattatagcacaggagccccaggtgattctggaaattgaaggaaaaaaagtagacctccttctaagcactacagccagtctctcttttctcctctctaatccaggcctctccccttcccatagcatgaccttaaggggcatctcaagaaaaactctaatccaatatttttctcaaccttagttgacacatacttcccagacattatcatgatagctctactagtcaaaaaaaaaaaatccctccaaattaaccctaggacgtaatttagctgtttacactcaacataatgtggcaggatcactgtcctctaggggagctctaagctaacaaatagccaggaaagcaagaagtacacaaggcaagataagcagtagttgctctaaataacgtctctctccaggcacaagtgctcaattagctgagctaatagctctaacaagaccacttgagataagcgagggaaaggtagctaacatttttactgactccaagtactctttcctgattctccatgctcatgctgccatttggaagaaaagacattttcttaccatcaatggatctccaggaaatatcaccaagaaattaacaggttattatcctcagttttttttccttctataagaaatagcagggatgcattgcaggggacatcgaaaggaaacagatgaggtagccaaaggaaatagattagctaatcaggcagctaagtcagcagcaaggaagcctcaaggcattagcacaactagcaaatggccaaccccaggaaatgaaaccacgtttatttaacccaggagatctggtattagtgaaaactctcacttctgctttcttccctacgctcgggctgggaaaggcccgacactgttcttttgacagttacaggaatcatctcctggatgcaccacactcaagtcaaagcctaaaaagctaagggagcaacccctgaaagcccagaggaaagtcctgaatctcaatgtggagaaatagaagaccttaggctgaaaatcatgaaagataagtaactggggaagggctgctcatcttactcagtcccactgctacctcaccagactttttattatttctgcccttccctctcaaaatttgccaccaaatattagaacttctttttaacacatatttgcagggagaatttaattatacatgggattgcatttgtaactttgtagcttcccaaagagaaatgttgtcttggcaagtaaagttttaaatggaaattatttactacgtcactctcatgggaattgttatagtcacgctactatttgcaatagaactatacactatgacacccacgatgtggaattctggttgtaaaattctaattgctgtaatattttgcctcattatacttagagcaggataagtagttacaggaaagatttcgtcaaggttgttttgcttacagcaggagtaatagtttttactatcattaagtttgacgggactttttaccgaaggttgctaatgtgatgcactctaagctatgaaaaggttatagagaaagagattttatataaggaaggatcttgtttggtaaattcttgtcctaaaaggaaatgaccggttgtttagagaaagaatgtttaggacaagtcagaaagtttaagtctgttgtaagagggtctgtgaaagtcatgaaaaaatttaataattaaaggaaaggaattgtcaagattaatgccaaagttatttagccaccgaataatgtatctctcccaatcatactgcaagttataaaaattgcctaagcctaaagttattctccaatggcaagtcaagggggaaatgtatgctcttctcaaggaaaatgttgcttttatattaatgtttctggtaatgtacataaacatctagtggaggcaaactggtgttgcaatacatgggtgtaactaacaagagtcaaattacactgttagttatagtctataggacccccactaacagtgataattttaatactcataatccaaccctatatttttaaccttcttgtaaaatttatctcttttcacctagaaacgatcaaactcaaaatggtgctgcaaacagagccccacatggacaagccattcttccaagtacccttaaatccacctcaggagaagacccaactgctgttccccgacatgacgccccttttcatcaggaagtagccagaaataattgtcgtccaacacccactaacaacagttaggtttacttctcttgaggggggaataatacaggagttattaagaaataattctaggcagatatagagggtaaaagttcttgataagactttttcttttaataaaaacagctcccgaaacatttcttttctaacagaaaggcggtttggaaagccaggctggcaagtattaacatgctaatgctggtgattagaaactaggtctaaccaacatggccagcttggtgattctcacccttttcttgtcagcacgtgtgccaggcatcatggccacccctagctatctccacgggtgcaggacatctggtggcctgcatttgcatattaagagcctggggtgggagggtcaggtttttctgggctatgtgaaatacacacctggtcaaaccaatccactgggccgtatgcaaatcagacactgctttctccagcttcccaatattaccgaccactttttcgcagcagcacacagggtttctctcttgggaaccccgctccctctatctctgtagcggggagcttttttttcttctttcttgactattaaattctccactccttaaaaccactccacgtgtgtctctgtcatttatctaaattggcgtgagaccaatgaccctggtgttcctccagtcaccggatctgtatcaatttgacatcatccattccgaagagcagaaagataaagaataaagaaaaatgaaccgagcccccaaaacctgtgggataaagtatatcagcacatataaaatgaaactccttgaagaggagagaaaaaggggtccaaaagaatatttgaagatataatagtcaaaagtttcccaaatttggtaagaagacaatctgtatatccaagaagcttaataaattataaggataaactgaaagagatccacaagtagaaacatcatagtcaaattatcagtagacaaagataatcttaaaagcagaaagataaggaacttatcacatacttgtcactgtcaataagattaaaagttgacttctcttcagaaatcactgaagccagaggcaatggaataacgtattcaaagcactgaagaaaaagactatcacataagaattctctacctaacaaaattattttttaaaacataggagaaataataaaataaatggtttaacacataaaattaattaatgtaactcaccatactaattaagagaaaaactaaaggaattcgtcactagtacagctgccctatgagaaatactaactggagagtccttcaggttgaaatgaaaagtctctagacagtaacttgagtccacatggaggaataaagagtacagacaaacaaacaatatagggaaatatacaagataatgtaaatatatttttgtttaaaacgcttttatactcctacctgacttaagagataactgcatgaattttattaatgggtttaaaattataaagatgtaatttttatagcaatgttaatacaaaagggaagctaaagaaaggagctacattggagcaatgtttctgtaaactattgaaattaagttgtattaatctgaactagattgttttaaattaagcagttaattgtaatcccaagcacaataactaagaaaataagattttaaaaaatagaataaataacataggaaccaaactggtatactaaaaatgtttatcacaaaaaagagcaatattaaagaaacataggaacaaaaaaaagacacaagacatacaaaaaaagtaaaatggcatgcataaatgttactttataatttgtctttaaatataaatatatatatatatatttatataaagaattccaatttaaatgctgaggttgggagaatagattagtttttaaaaatcaacacttaatctacctatatgttgtctaaaaaagaaacactaaattcaaagacacaaatcagttgaaaataaaaggatgataagatacatgtcatgaaaactgttaccaaaagaaaactaaagtgtctacagctactatcagacaaaatagacttaaacctacaaaattttactagcacaaaagaagaatattttgtaataataaaatggtcactctttaaggaagacataagaactgtaaacacatatgtacctaatgacagagtctcaaaatacttgaaaaaaaaaacttacagaaacaaagagagaaatagaaaatttaacaatatgtaggtactgtcatacttcactttcaataatagataaaatgaaaaagtagatgataaaaaaaaaagacttcaataacactacgaaatagacctaatgaaaatctgtagaagatatttcatacactagccgaatacacaatcttctcaagtgcacatggaacattcttcaggatgtatcattattaattatatcttatagtaagcctcaacatatttaaaataattaaaaatttaaatttaaatgaaagaccaccaactaaaatgagataaaattacaaatcaattataagagaaacagttaataattaataattacttggaaataaaataaaggcactatgaaagaggtgacatatcaagtgtgtcttaaaggaaagatagtcttctgttagtcaagggacataagaaatgagttccaggcagaaggaagaataaagccaaattatggaattgaaaggatatgacacatccacagaattacatgtagttatatgcctagaatactggatctatggagatgatgaggaatgaggaagtgagataaaggttagaaaggaagacaaactactaagatacttagatttcataaatagatgatgcaggaccactgaataatttttaagcaataaaaccatagactcaaaattacattttagaagataatttgaagttgggggatattaagaaaaatgggttggagatgaattaagattgaatatatatgaatccaattataagaacaattgtgtgttctgaattagattaaaaagggccgagatggtataagagatagtgaaactaaagaagagaaagtgctattattaaaagatagaatctcaacttattccaatgataaatctttttataagagataaagttaatactaaaataacccaataagattaatattgggttaatattaataacccaataaggctgataaaacatatgacaacaataaaacaatttaatgataatatagccatttgtgaatactattttaagtactttatttataacaactcatgtggtcctcacaacaggcttattaaacaggtactattattttccccaatttgaattaaatttcaaattctaaatttttttaataccctaatggccaaattttaaaaagccgacatacccgatttatttgcttacagaccctaatacaaattattcaaaattaattttgaaataaatattgccttgcaagattaagctctctacaaataagaggaaaaaaagattggaattgagaaacttcaaaggttattttatttaaccctggtacactaacagtcttcaaaaaataatttaatgggtatttatggaggaactaatattcatcaaatattatactcagcatgtggctacaaaaaagaaaagaaatatatagcccctgacatagaaaggttttaagtttgatggagaaaatgtgcctaaatacattaaaaaaaatttaggttgtatatattgggtgttgtttttccagaagataaaattgttaagtatacctggagaataaaagcaatcattaggctatattaaagccacattttgaatgataagagggaatttgccatgtggaaacaaaggagaaagtcatttcaaaaaactatttattgaggaattaagcaaattaatacattttatatttaaataatatttgcagaaccccaatccccaaaatgtatatgtgtatggcagataattcacatcattttcttttcttttcacataaaaatatgcaatcattcattacccaccggtcaagagaataggtatataagcagaaaacaaaatatttttaagccacatattatacaataaataattaaataattttaaggtgccatttagctctctgataagttttacattttaacacacacacacaccgcacacacacacacagtgtaaacataacgtttttagataattctatttttaaaataccaaatagtgtcataattttataaacaccaaactttataaaatcaatggttcccaagtacaacctttcagtaagcaaactaagtttacagtagtgtattcaataaataatgcaactcaacaactgaaagttgtcacactgagatttagttctgtttaaaagcagatcagggtttactattcactcattccctcgaaggactggctctagcaaatttttccaagttggtgttttctagcagagggtcttaaaattaactaactcaaaagtagtccaactgtaaatgctagtttcatgccatgcttaatactaatggaaaaactttacttttcttagcttgatcatatttctttgcaatgaaaaataaatgcctaagtgtaaaacgtggacactatttcctataagatttttttttgtcttttatttttcagcccatttaaaggtcattgtataacctttgggcgattataataactgttactgtcctagggcagcagataaggcacaaagctaaccttggtgtttctaaagcacacaaccaacagctttttaaagtaaaagagaccttaaaacatgctaccactcgatgattctgatactaggctttatttctgtatcatgatggctatttcttttcgaggccaacagataagaccaagattatcaaaaagcagttgtaggttctactgtgctcagttcctgcggactgctgcttggctaagttgcagctccctctctccttggcaggaagcctggacaagtagcagaacattgtcaaaattattattgtttctgttttttctttctttttcagatagctcaaaaatggttatcagaaagtcgagaatttaagagtgtgtctttatctcctttcttaattcttcctaaagaaatagtagaaatgtctagggcagaaatgcataagcagatggttatgtgccttcattaatcaaatgcagcttttccctcacctatcttgtccctctggcatgacactataaaaccttctggaaaggtacctcgtaatatatattgataaaatgaaaatatacatagtctttaacccagttattgcccttagagagaccctctcctcatttaacaatctgaaatgcacacaaattcataaagatatttcattatagtattagatataaaagaacaaaattgtactaaaatatacaaaattatggtaaatgcttaattaaataatcagtcaaatgaggaaatattacagggcaataaaattaaaattctaaaatctaaactgaatttcaaaaatgcttatgacataagaacaaggcagggcatgcaattataaacatatacacatatgtacatatgcaaatatatgatggtattatacaaaaaatgagatgagaatcaataaagaaatattgcagttaatgatttcctattgcttttcatttttagatttcaaagtttttaagagaagcactaaaaatgtaaataagagtaaaacctggaaaaataatcatacaatttaatcattttaatacattgatgatttacatcagttccctgctagttataggataactcaactacttagcatttgatacaagcctttgacaatgtgactagtctgtgcagctctagtcccattattacaattttttcattgatttaatatatatagccactttgaaaattatgctatatgctgatcccacttacttaaaatttatttttcctttatagctttctaattattttatattggcaaaccgttacttattctttatgatctagtccatatatcctcccaatgttagaataagctatatttggatcatattcccgttttacagaattcagggtattagcatttctgcagagttgagagaatatgcatgaatataatcagagtataattaatattgtttcttcaaataactgagcagggtgtgtccctatgtcaggtattatttagttccctttacattggacgaataatcagagccaatatttttacttgattaggtaggatttcttctatgtttcttaccattcatccagtattgctccagcctatcaatgaaacaccaaagaatgctggtcaaagacttactacaatctagatatattctattgacaactttcttccattccattctatctactggtgtaataaccttatgaaaatatggaacaaggctattctgacattttacattttgactttcaatagtcaaaatttcttttaaaattattttccaataataataatgttattgctggtattatcactattggtataatagcaataattttaatgtaacaaatccccatgatataccaactctcttgatgataacattatagtctttgagctcctcaacaccactctaaggcagaagtgtttgtctctgtttttaaaaagaaaacattaaagatcaaagagtttaacttatttaaggacataagtcagaattgatatggtccaggattcaaatgtaggtgtttatctctgcactaaactatataaacctttagtgcactgtcaagcacatcattttgcttcatttttattacttttactttatcatgttggaaaaatagatcagaggaaaaataaaggacataagtagagttttaaaattcattaaaaatggcaattttatttaactctatagaagatgatctaataaacagtaaagggctttaattcgaccaaaagcaataccaaggaagaataaataattttcttattataacagtgagaatacgatacgaagaggcgttctgaattacttgtccttgggggccagttaaataagacagaaggccatctgtttggatggtttgggcactaaattgcaaagcattaaagagctgaaccatatgatctcacgaatgccttctggtcatatggttccatttcaacagtgtttatctcttccacatcaaaattgttcttttgagagaaatatgagagaggcaaaattttgttcataagccacctacaaccccatgcacatgaggaatgttttggctaaaatgttaaataaaattgtgaatagcttcagcatttaaaaaaatatatatttaaaatactaactgcttgtccaaaatcagaacttgttagaaataaattatctgttacaattgatgcataacaatcaaattttatttatcagccaatagttactttagtaaaatttaggttattctattaagatcaatgccatgttaaagaaaagtatatttattttctcatcatatttctatacttaagaaccattatgttcttagttctagttaacacttataaatcttagtaagtttataaagtaataaaccagctataatttgaggaaatattcataaggcaaacctgcaaatctgggggagctggcatttccaatttgataaaaggtgagaaataacaataaaatcttaagcacctcaacccgcttaacaaattccctgttggcccagggaacctcagagaaaccttgaaaactgagttctcacctgtgatgggatgggaggtcacacatacctcactatatcccctccctccctgtcagtagactttcattcctaaaagttgaaccaaaaccagccctctcaaaagatttgctgaattcccctccctttttgtgttttcaaccacattcaaccagcattccttcctgatgagagaccaccaactgtggaccagctgtgtctgacttaagagtctgaatataggaagcctgtgtggcctttgtttcacattttgacatatagagcctaattttaatgcatgtaaatgttaagtctccactccaaagtgaacatgggatatatgtaacatgcatgtttgcttagcatgcatatgtgtgccccatttcatgcatattcacagctcctcccatatcctgtgagcatatatatatacttagccaatccattcagcataaattcctgtctcatccttccttatttcaagtgtctgcttctggtttttgccagaagctaagcttcccagtctgcaggatggacagcctataggctgtaacctggtattaggaataaagctttccctataagtttaaaaagatcatgatacttcaattgacaagggttaatttccagtcaatcagtaattctctataacaaattcaagaaagaccaaaataaagaaccacacttgcctctggtgaaaaatcagaaaatggttaaaaatgagtaaataaattgactaacaataatataaataataattaataatcaatattagttaatggaaaataacaaatgattggattttattttttccctttttttctctgattgcttattgacaaatcaaacttgttctctaataatgaagcatggaaacaggttttaaagttatttaatgaaaagttactttgaaaaaatcaattacctaatgtcatagaaagttaaattaatgcaattctgttgacaataaggaaaatcttttagagtcttaaagctttcgcctggcacttgatgtatgctatacatttgtcaacaataaagagtcaaactctgtgatatatttaaaaaggtttattctgagccaaatctgagtgaccgaggctcaaagtacagtctcaagaggttctgaaaacaagtatccaaggtggttgggttacagcttgattttatacattttagggagacagacagatatcagtcaatacctgtagggtgtgcacgggttcggtccagaaagccaggacaactcaaagcaggggtttccaggtcataggtggattcacagattttttcattagcaattggttgaaagagttaagtaattatctatacacctagaagcaatagaaaggagtgtctggtttaagataaggagttgtggagaccaaggttctcattatgtagatgaagtctcataggtgcctaccttagaggcaacagactgtaaatatttcctgttgagatctttaaaaggtgctagactgtcagctagtctcttcaagatcagaaaaagatctggaaagggaaggggatttacggaatgaaagtttctcccgcaaaggacagctttgcagggccgtttcaaaatatgtcaaagtatattttgggataaaacattttaatttctttcagggcctgtaaagctctcgtgtaacgctatactagagtctgcttggaatttggtatatttttgctacagtctgttctgtcagtcttaagacctctgttttaatggtaatgctggtcagttgtgcctgaattccaaagggaggagagtataatgaagcatatccaattctcccttcccatcatggcctgaattagcttttcaggattactttgaaatccccttggccgagaggaggggtccattcagttggttgagaggcttggaattttatttttgatttacacatttaatctttagaacaatctaatcggttggtattattatcttcattttaagttgagaaaacaaatttaggaaattaactcacttgtccatgttcacccaactagaaattggaaaagaaactgcaatccacatgtctccaaacaccatgacctcagggcaaagagactgagtatagattttaaattattttaaaatgtaattcatttacatagtaattttctcaaaatgcattaagcaagatgtctacaattgttcgaacatgtgcgtttatataattgcctgtttgcctctcagattttcagtaatgtctgcttgtgttgatttttaaatttaaaatttaatttaatttaatttaatttaacttttggtggaaaatgagggaggggattggtgaaaaatgaggaaaatgagggaggacttattcaggtattgatgagttccataggatgagttccacacctgggtcagtgtagtgtaccttcaagtggccatgcacagcactcaggcaagttgtatactcaactcagttaatggtggctggatttccaagccagaggtaaccattaggtcccaacttctactctttcacacaaatgcacataaatagagatattttgagaaatcaatggaataaaaaatcgaggtttgaaaacaattttatttagatcattatggtaatgaggagaccaaaagaatgctatgaaacttctgtgttaaaactaacttaacactaataacatttttcacattcccaattattacatatgtctttgcattcaaaccaaggcaataattgttctagtcaaaagaaaaaaaaatctaggtaacattttaaatattctagtgttatcaggaaaattagatcataaagtaattatggacaagaagccaataccaaagtatttcatctggttaggacatggatatactgcaaatcctacaaagttgttcatttcatacaaatattaaatgaatacataaataattgctttaagaagaaagtcattctccacaatcccttcaccacaccttatacctgtagaaggcaattattttaaaaagaacataatcacacagattagactatttttcttggattggaaggttcagcagaaccttgacagtgttccaagttgttaacttttatttcaaatactaaaaactgaagatctgatcattagaaaagcattgaattgtaaaatattggtgggttggattgaatttagttaaattgtttccaattttcttttccttggtagttaagtcactacatatctaaagagatatcaagaagctggcatttcctagcaatttggaacttaaaatttaacaaaacaaataaaagaagaacttattctaactcattttttgcttttagctgtcgaatgcataagtatcttaaattagttttcattgactcctctactttatttaacaaaaaccaaggcacaataataaatagactagcatcaaaacataatgccttccctgctgataaatacccagtgcaagattggcttagataatatttgtgtttttggtttacttaaaaatgggtataagcttattcctcaaaaaaatatacattgtaacatgttgaactctggacatttgtggatttgaaatagtaatttatgattacaagtttgagaagaatttcagagtcattcagtcccttagttttctattaaaacattaatttgaatttagagaagcatttcttatatcttatcagtcacctcctaaaatggattgtatttaatcagtaatcagtaccctcagttttggaggtaaggatgcagagacagtggggataaaccttcatagagtcccttccattgtgtctggccagtggtattgttttggcctttgtatgttccggaaactcgcttttgttttgctaattaactttttatcacattaaatccttctttttcaattataaatattgatattgacaggaaacatgtaggtataactatttgtgaaaagtactaacatatgtaagaattcccttcatcaaatgatttttaatatttatttaattattgaaagttgtttaacattgtaagacgtatacaaatggaactttgcaagaattttgaagaattgtaaaaaagtacctcatagaatattaaagggataatcatctatatgaccaaattgaaatgaggttttaatcacaagatgaagtgagagataacaaaaagggggtagggtcggtggaagattcagacaagaagaaaaaaaattagctaaaaaagtggaaaagcagatggaaaaaaaaatcgtgttttccactgttcctttgagtactatcacagttgcaacttttcacttatgtgtaagatgattttttaaagtttaagcaattcccatctcaaaaaagtcattctccacaatcctttcaccacaccttataactaagaaggcatttatttttaaaaagaaaataatcacatacattagattactaaactataagagagaagtctagtagacaagaatgctataggaaaatgtcagattttactcactatttcgttacccaagactagcactgttattggaacatgataattcctcagtgtaaggttttacacctatcacaagaacactgcaatgctcaatatttgggtcatgtgttaaatatagaaaaaaggaaaaccccgagtgtgttcttgatagaaagatttccaaggaccaaactgcttgcataggtattgaatcatatgtaattgggatagctgcttagaaggtaaactccaaagcacaaaataacagaagacatacaacccagcaaacacagtcaaatcaatgagcatgagattaaattattacctggaaatgatctttgtaattttcaagatcatgaatagataaataaaatacttcaatattttaataatcatttccatgatctgttagaaaagcatatccgctagagaatagaataagcacaggaaacgagaagtggcaaatcaatgatttgaacttcaattacacaaattcaaagccagtattatttctaccatgttatgttgtgagtataccgagtatacctacaataagtctttattgtcatgattttgtaaaagaataaaagccttcagaagtttttcagtgacttttacaaggccacagatggacactggaggagacatcaggtccctggcctctagttagagaattttactgtgctaatgctggcgaaagacagttatcacagaaatcaaagaataaaattaaatttgtattcaaatgtaaatttaagtaaatgaatattccatttgtaaataaataatcaatcctgatttatgttatttgcatattttttaaacacttaagactatataggtactccttatttcctcttataacaagccataccaaaagggcaggaaacagagattcacctcagaattttttaccaattaatttcagaggtaaagtcagtgtacaaagctgaagatcatctacttcagatacaatgtagtagctgaaaaaaaaaatttcaacacagataagtaattgatggcaattactacaagtgtaataaattttacaaagactccagtacacatggatgaaatacttcactgagtttttaataaaaatagatgtaggtatgctgacaacttcagaattgtttttcaaggtgctgtttcaatgaaagatatattcaacttttatgttttaaatttctgctagctattttatattttggttcacataataatgttctagaatttgatattcttggttaatatgcagagtcatctcataggtttttttgtttgtttcttctttgtgtatagctctcaaaatttaggttttgtacccttctgcttaatagcattgaatgaaacaaaggacaaatctgtaattctaaacatgtgttctttattttattccttagtctaaagttatctccaaggttattagagtttctgaataaataaatcttcacatgtcagcccctatcatccattttcagttgccaactagaaaaatggtatcgtaaaagactagagagttgtttgcttaaagttacataacatttcagtcctgaatataatacaaaccaatttactgacatcaatcagtaatgataatgaaatgtcccttaaagcaggaaaataaatgtttttctcacttcacagatgaggaaactaagactcagtgaggctaagtaatttgagctgcaattcccattcaggtaattaggttgcaaagcccatattctttccacttctccattgtcttccaagaaggaatgttacatttacttttcacattttattatgtagactgttaattgcatatataaaagtccagtgaccatgaagcattctaggtgcattttgactttgagagttattgctgtattcaaatggttgttttctaatgacttggtaacatgaaagacaattgtattcactctagaaataatgcatttccttacaaaattatattttatttacatgtcattaacactttcagtatattttactttattgaaaagacacagcctcaacaagtcataaatgacaagaggaagctgactttacagatgagaaatgaaacgtgaaataagaatagaacaaggaaaggagagaaacactttgatttggaacaaatgcatatttttaattatccattaaaattatatgatatagacctattttggcataaatctgtattgcaacaaaagacctttgatgtgactaagtgcgtggttatttctatatttaattgtgttttttcttctatccttaaattgaagagacttactgccccactttatggggcatttaaaaaccgcttcagttagcacttcccctcattgaattgtttgggattgagtaattaaaatgtcttcaatatatgggatctgtaaatggtaatagccacatggcatccactagagtagttctattatgggtaatccacttgaagtaatttctgaagacaagtgtcttactcacaggtatggaactctcaccacctacctgggcagcttttctataatttacttttatggctttcagtttcaattggattttataggcttaatggcttgggaaatgattatgggcaacaataactcagaattgaccttttcagagttaccagctttttcattggtttagctaacaatgccgctaattgaatttttcagcaacaaaaatatgtgcaataacagctgctgacttagattttataattattgttattacactaaataaatatttaagtagttaagaaaatcatggcagtaagacaagattatccacaatagcacaaagtcaatgtgtctatgtgaaaataatttacactcaaattactcatgcctcgtttgaaagaaaccctttgggaacaattaaaggtgaagttgcaatcaactgacaattgagctctgaggctgtataggacatagtagaaatataaaggcagttagtattttataggatactgaagaagtaggagtcaatccaagcctcaactttaaaatggggatcactgtgagatttaaattgtgtacttacttgcaaagcctttaacacaaagccaggtaattctgatatattactaaaagaaaaagaacgagaaggaagaggagtagcagaaagaagagaaagaggtgggggaaccacaatagcagccagcagctgccaccattatcatagtatcttaagaaatttatttctcctctggtaggatctagaaactaagcaagttttataatgtaagatactacaaggtcattttgaaacatttcatttcaggatcacattgagaagtactgctctcctgatcttaagactttgtaccatgtgtcccataaacctctctctctaattaccagttgactgacaccacactctgtctacaagacaatatacttgaatcgacttctcctgaggcaggtaccaggctacaaccaccttcaatgactcctattggtctttgtccctcagaacctggaaatatactggctatcaatctcaattaaatcatatgtggttggtaaaggtctaatgtgatctccctaaatatgtatacaattttgggaggtttgtatatgtacatttgttatttcttcttttcggcaagtattagaaaaatgcttgtttttaaaaatttgctaatgacattgttttcttttaaaatacacttgtttatagtaacccatttacagtagtgagttataactatttgaataaagtagccatccgtgtgtccagggaaatgagatagatgatagaaagattagatagatagatagatagatagatagatagatagatagacagatagatagggaaattctttcttatttcagtatgccaagaaatatagataaaatgatggtgtctgtaaatcatcaaagaaagctaaaactgtgggtgaaagttagagaaagaacagaatagtctcaaagcatgtctctatagggtacttattaattattaaaggaaaattgcaattttaaagtggagaaatgtggagattgtttccaggtttgtctgtttatttctagtgaaaatgctactagaaatactactgaaaatgcctcctgtgggttgttttttttttccacagaattttgttctgtcagccaggctggagtgcagtggcaggatgatggctcactgcatcctcgatctcttgggctcaagccagcttcctaccttggcctccaaagtagcagggactacatgcatgcaccatcatgtctggctaatcttttgattttttgtagagacagggtctcgctatgtttcccaagctggtctcaaaatcctgagctcaagagattctcctgctttggcctcccaaagtgctgggattacaggagtgagccattgtgccctcctattgtacatttgtaagcatttctttaggatagtaatgagaagtttgtgtcacggttgaaacacctttagtctcataagaaaatatcaaattgttttccaaactgttccaatctacattcccaccagtaatgtgaataaagttcccaatcatacacatgtttactaacaagtagtaatatgcccaatgtttttagttttgacagtctggtggacatcgaatattaattattgtgtttaatttgcatttatcttattgatagcatattttcataaaggtataagctattaacttgtaaaatttgtccatttctttgtccatttattttatctttttttttatcaatgttcaggagtcctttttgtaggttttactgtttaagttatatgtgttgcatatatttaattttttggctttactaattttctttatggactataaacatgttttataaacagttcttatttttattggtataaaatgtattaatcttttccttcatggattataccttatttaagcaaagcttgtcttagaatcctccacatcttaactatacagatattttatttttcatgttcctcaagtctggaagccttgttttcaggtttaaatctttagttcatttagactgaatggtgtgaagtaggaggccaattttaatttttccatatgaaaaatcaattatcttagtacatatattaaataatccatcttttctctggcaatcgcatctctttctggaatctgtattctgttctttacttatttctgtattactaaaccaatgacacattttcttattatatttatttaatattttgatatttgggagaattaatttttcaagaatgtcttgatgaaactttccccaattgaatgccctcatgtaaaattgtaaccaacactcaaatgaagattaaaaacatttgaataccctcacttaaaacaacactcaaatgaagtcccagaacagcaggggtccccagagatctcccccatggtacattctaggacttagcttctacccaagtggagttattatttttagttttaacagcataagttagttttatttattgtctttttctgactctttacttttgattagtaatttcattactagattattaggttatgaaatcccctctcatacacaaatacacaaaaataaagaaccaggatctgatgagaaagaggaagaatgtgagggagggaggggaagaggaggagagagagagaaggagtaggaggaaggggaggaagacaaaagaaaaggaaaggaaaaaaaaatcttggaatttagaggttttgattgggatttttccctttctatctcttttatatattccaataaatcagaagcaataagccgtcagatacaggcagactttctcagtgtatctgtcagtttcagagctttcttaagtgtctagatctgtgtccccttataaatttcatgtttatcgtgtgatacaaatagcagataaaatttttattttttaagcttttaaaaatatttgttctcaaatataccattactctgctaaaatgatttatttaagaattacatttctttttttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagccaccgcgcccggccagaattacatttctaatacacacattgttaatatgcacaatactttaagggtatttttctgcaaaaatatttacaaatgggatctaattaaactaaagagcttctgcgcagcaaaagaaactaccatcagagtgaacaggcaacctacagaatgggagaaaatttttgcaatctactcatctgacaaagggctaatatccagaatctacaatgaactcaaataaatttacaagaaaaaacaaacaaccccatcaaaaagtgggcgaaagatatgaacagacacttctcaaaagaagacatttattcagccaaaagacacatgaaaaaatgctcaccatcactggccatcagagaaatgcaaatcaaaaccacagtgagataccatctcacatcagttagaatggcgatcattaaaaagtcaggaaaaaacaggggctggagaggatgtggagaaataggaacacttttacactgttggtgggactgtaaactagttcaaccattgtggaagtcagtgtggcgattccttagggatctagaactagaaataccatttgacccagccatcccattactgggtatatacccaaaggattataaatcatgctgctataaagacacatgcacacgtatgtttattgtggcactattcacaatagcaaagacttggaaccaagccaaaagtccaacaatgatagactggattaagaaaatgtggcacatatacaccatggaatactatgcattcataaaaaaggatgagttcatgtcctttgtagggacatggatgaagctggaaaccgtcattctcagcaaactatcgcaaggacaaaaaactaaacaccgcatgttctcactcataggtgggaattgaacaatgagaacacacggacacaggaaggggaacatcacacactggggcctgttgtggggtgggggggagctgggagggatagcattaggagttatacctaatgttaaatgacgagttactgggtgcagcacaccaacatggcatatgtatacatatgtaactaacatgcatgttgtgcacatgtaccctagaacttaaagtataataaaaaaaattatagtgctttcttagtggcattgtgagttaattcatatacaggttaatgtatataaacggtttattacaatgtttggcacaataattttactcttgttttatataactcagtttcagatgttgaagaaagacggaagttattaataaccttacttttgtgatttgaagaagttaaatatttattattaataagaatactatcttctattttgaaacaggaaccattttataaccaaacagtatttttaaaagttactattttatttggacattgttttctctgtgcttaaaatgaaccaacaatttggcaccgcacaatactatcccctagcttaggtgtatatcaatacaatattagtttctttttctttttcttttttctttgacggagtcttgctctgtcaccaggctggagtgcagtggcatgatctcggctcactgcgacctccacttctcgggttcaagcgattctcttgcctcagcctcccgagtagctgggactacaggtgtgccgccatcacacccagctaatttttgtttttttagtagagacggggtttcaccacgttgcccaggatggtctagatggcttgacttcatgatcctttttcacatttattatgccactagaatattcttagaaatacatgctagccacttaatatcaatgtgactggaaaatcctataattctcatcatccctgcccacttatgaatcccttgcttcatctgaaaactcttactcatcctctgtacggcaaacattaccttctctgtgaagatttgctagacttatacacaccagtatggttgttctaaactctgtaaaaacacaattgtgtagatcacttacgttaaacatttctggttgctcatcaacagccaaccgactcccacatacatacacttgcattcccttctaatagatctgccttccatcatagaatatgaaaatgtgagatgcttgatcttgtaatgctgctttcaaatgtggtcagtggcacttaagagagcctgcctgtacatttctgtagaaggtgttcaggcatgagaaaatcaaagcctttgaagcagtcatcttgcagtcaccttgtgaccgtgggtaaataaacccaagaacggaaatccgaggaaagcagagttacatacaattaggacttttcctgaatcctccatgacatgtgtgtcacaggaataaccaaacctggaaatttgaactttcttccttgttatgttcgatgataaacccctctaacataaggcagtttgggtctcatatctgttacttatttctgatacactgctctcatacatacctttctaatttattggcacacacagtgagcaatgaataaatgtttgttgaatgaaagcaacagagaatcactttccctttcatattcaggtgctaccccacaagattattagtattaggttgatgcaaaagtaatcacggtgtagcttaggtgtatatcaatacaatattagtttctttttcttttttctttgacggagtcttgctctgtcaccaggctggagtgcagtggcatgatctcggctcactgcgacctccacttctcgggttcaagcgattctcttgcctcagcctcccgagtagctgggactacaggtgtgccgccatcacacccagctaatttttgtttttttagtagagacggggtttcaccacgttgcccaggatggtctagatggcttgacttcatgatcctttttcacatttattatgccactagaatattcttagaaatacatgctagccacttaatatcaatgtgactggaaaatcctataattctcatcatccctgcccacttatgaatcccttgcttcatctgaaaactcttactcatcctctgtacggcaaacattaccttctctgtgaagatttgctagacttatacacaccagtatggttgttctaaactctgtaaaaacacaattgtgtagatcacttacgttaaacatttctggttgctcatcaacagccaaccgactcccacatacatacacttgcattcccttctaatagatctgccttccatcatagaatatgaaaatgtgagatgcttgatcttgtaatgctgctttcaaatgtggtcagtggcacttaagagagcctgcctgtacatttctgtagaaggtgttcaggcatgagaaaatcaaagcctttgaagcagtcatcttgcagtcaccttgtgaccgtgggtaaataaacccaagaacggaaatccgaggaaagcagagttacatacaattaggacttttcctgaatcctccatgacatgtgtgtcacaggaataaccaaacctggaaatttgaactttcttccttgttatgttcgatgataaacccctctaacataaggcagtttgggtctcatatctgttacttatttctgatacactgctctcatacatacctttctaatttattggcacacacagtgagcaatgaataaatgtttgttgaatgaaagcaacagagaatcactttccctttcatattcaggtgctaccccacaagattattagtattaggttgatgcaaaagtaatcacggtttttgccattgaaagtaatggcattacatttcagcaagtaactggaaagaaaataaggccaaaaggcacttgtagtgcacagaataaaaaacaaactacacaatttttacacagtgagtatttcattctaaactataggaaaaaaatcattaaattaatttattgtggtttatgtagattgggtagcagttaagatttacattgactaagttttattttagccactagaatgaataaaatgctataaaggggagccaaaatgctgaattcccattttaaaaatgatttcttccattaattgttttcctgttctcaataattcaacattatagagcagatagcccattgaattatatggttgtaattaggttgttcctttagcatgttttatgcctcagtatttttatgcttccagaaacatcttatactggctttatataaagctgtctttaaatggaattgtattttgcctcagaaaatattgtactagacgcatatattctttgtccaactgttaaaattaaaataatattttacctatttttatatgtatactacaaattctcaaatgaaaggaagatttttgacacattgattataagcaaaacttatttagatttctgtaaatcattaaatatgtttctatgtacacgtgtgtatatacataaatgtatcactgttacgactaatcaaattagaattaatcattttaagtgtataaccaatcattataaattaacagacaacaatttatcttcaaacttttctaataatggagaattcagggcttccattgggaaaggaacctgggcctctccagccatgccacagacatgtatgcctgaataatggggtattataaactgaaaagcaaggactcctgtccgtccttttgtgaaaacaaaattcaattctgcacatgatttcttccacgtacttgagaaagtaaagttctacatcttttctgtatataaagttaacttctgtgtttgtaccatcaaatatttcacaaatctttatattcacttgtttttttcttttattttcttcacatgatcatgatctctcatgcattttatttgccagaacttacatggaactatttttttttttctaataaagtgtgagagttactacagaattatgggaaattttactttcttattagcctcagccattcaattatatattgaattgcaatttagggcctaagtacaaatgctacagaagtgttaagtccaaaaaaaaaagctttgggaaaaaaaacttcatttaataaaggtttaataaaggttaacattcttcacattcatgatagacatagcagtgtttcttctcaaaaatgcttctttgttcttatgcttcaaaatgacttcagtggtttacaatataatgattatgaattacttcaagtacatatttttcacaatgacagctttaattgatatgctctaattattttggtttaaattaaatagcttattatttccaatcatgagtactttctatatttttatattaacactagatatattttcaatcatttttagatatatttccaaatgtcatgtgaaagtaatatttgctttgtcagtgtcataagatgtatttttaatgtgggataacaaatgtttcagtaatgtataatttaattatgataagcatttttatccttgttggttacagtattagtattttatttaagtaatgaatttaatttattctaaagtaagtttatgcactattacctaaatagagacttataaattctagctgcttctgaaccaggaaggcaattttctcctgaaaggaatttttatttgttgtttattttgttttattgctcagtgtgaatgcctggtgtcttgagaaaatggaaccccttattatataagtcttttgtgacagactcaacacttttatagtaattgtataattaactttcataatgtgatactttaaggaaaaatatgacatgctgtgttatattcagcactgtagtcatgtcctaattcactagtctcaagtgtttcatttctgaactccttacacatttccaattttgtccaaatccttcaagaaatttagaaattttatgattcttttttttaaattttattattattatactttaagttttagggtacatgtgcacaacgtgcaggtttgttacatacgtatacatgtgccatgttggtgtgctgcacccattaactcgtcatttagcattaggtatatctcctaatgctatccctcccccctccccccaccccacaacaggccccagtgtgtgatgttccccttcctgtgtccatgtgttctcattgttcaattcccacctatgagtgagaacatgcggtgtttggttttctgtccgtgcgatagtttgctgagaatggtggtttccagcttcatccatgtccctacaaaggacatgaactcatcattttttatggatgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacaatcctttgggtatatacccagtaatgggatggctaggtcaaatggtatttctagttctagatccctgaggaatcgccacactgacttccacaatggttgaactactttacagtcccaccaacagtgtaaaagtgttcctatttctccacatcctctccagcatctgttgtttcctgacattttaatgatcgccattctaactggtgcgagatggtatctgaactgcttacacatttccaatgtccaattttgtccaaatccttcaagaaatttagaaattttatgattcttaagcaattttgcctgagaatgataattataaaaatatgtgtagatgtacataaccataatacaaaccattagacagccagatttaagctggttttaccagattttgccaactttcatcataggagaattcacatttctttcagactctcttggtacatataaaagagatttagaatgggtgtttggctgagcacatttcaaatacgatgcaaattttagagaaatctgagaaactttttaaaaaattagataacctttaaatccctcacccacttttagaaaataagaaattggatgatatttgaagacgatttccttggagagagctgtgccgcctccactgactttaaagaaatttgaggtgtaacctattcatcccaagtcaagattgaaagactctgaggaaaccatgtggatgattaaataaacacctgtgctacagttcacggaacatttcaacctcaccacttgagaaatataaagggtaagaaaagatcctaaccaaaggaagaccaggcaggcatgaacagatctcaagaaagagaaactagagattaactcaggatacttcaaggctaaggaagggttaagcaatggatctcagtagagttcaccacttgcataaccagtgctgctctaatatgtctcttgcaattgatggtgtttctggagaaaccacaaatgtactgatgagaaagtgccagctttaaataacgaccagtccaagccaatgccagttaactaaaaatttgagtgctcctcatacagttctttcaccatgtcccaaagccaaacattctaaaactgcctttggctagctggaggaggagaaatagtacaaagattgaacaaggagatggaaagaagctgatgactccatctttcttagactactagcctacaaatggcacaaacttggcagagaagagaagtctcaacattaaataaccatgggactggaaataaactgacattgtttaaaagatctgaaatgattgtgaacatattttttagcatctaaaaattactagaaaagtcaagttgcctgcctaagtttctcaagagtcatggaaataactgttttaatagagtgaaacaaaaaagacaacgatggacaaaaaataatttttgtttatcttagcccataatctgtgctcatcctttggagcagtcacagtacagttacaataatacacctgccatcacaagggggcattgttttctcaatagaggagcactgtcagtaattgtaaacagcaaaatctgaacctccccacaatttcagtgtagttttcacaatagacaatattatgtatcatgactttgacacaaccatcacggtggggactggattccatgtatgttatacatttacaagaattatttcctcagaaaaaggaagttgcggtctcacaagcaagtaagacacttggtttagtgagtgtctttcaaaaaaaaaaaaaagacgtgagaaggatataaaattgcaacacaccactaaacctgcagtgcttctcaggtgacagagaaatagctccaatcgattttaacatcccattaaaggcagccagcaaaccagagaatgtattgtctgcaataataaagcatttctctagagacttggccttggtaaaataaataaaaaggggcaattctttctattaattcagttcactctggccattgataggaattagagtcagattcctgaaaatcttacacttggggggaaatgtctgctataaataaatagaaagtgaaatacaatgtgaatgaatatattatatcatatatctgtaggtaaccaaaatttcttcttccagtaattaaaatatatgtttagtgaataaatgggaacttttcatcatgttgttaaaaatagttgtttgagataaaagcacaggcaataaagctggggggaaaagaggtagacagaatttgaccttttccaagctgtcagggaaacaaagattccctagttcacaaacatggcccactatcatggagagatacataggtacctccttccaacagtattttgggtctgctaagtttctgtacaaaagtgccaaaacatgattaatatttggtcaagtgtaagcatgtcatgtgtattataaaatataacaggataagagaagaatatacatgttcagtcaatatatgtggaagcatttgttataacaatatatggcacataaggttattctcctttatactgcctattgaaaaattttgagcattgaacttgtcatggttatggcaaaaaatacattttttctaaaaatatttatataaaaatatatgcacatatatgtaatagaaactactaaagtattaatgaaataaaatcatacagattgaagtttccagtaaaaggcattgaactaaatggtaaaatataacagcattacctcttactttgatatgaattgcctttttctcctttagatgagggtgattattttgtttttcctaatggattttgtttccactgatgaattttaaacatggcttaaaagtatattggattaagtttttattattcctgtaatatctcccacctgtccattgatgggtcatatggtttgactttgtccccatgcaaatctcatgttgaattcccatgtgttgtgggagggacctggtgggaggtaaatgaatcatgagggcgggtctttcttgtgctgttcttatgattgtgataagtctcacaagatctgatgttttttaaaaaatgaagtttcccttcacaagctctcttctcttatctgctgccatgtgagacatgcgtttcaccttctgccatgatcgtgaggcctccccagccatgtggaactgtaagtctattaaacctttttcttttgtaaattgctcagtcttggggatctctttatcaccagtgtgaaaatggactaatagagtaaattggtaccagtagagtggagcgctgctgaaaagatacccaaaaatgtggaactgacttcagaactgtgtaacaggcagaggttgcaacagtttggagggctcagaagaagacaagaaaatgtaggaaagtttggaactccctagagacttgttgcatggctttgaccaaaatgctgataatgatatggataatgaaatccagactgaggtggtctcagatggagatgagggacttgttgggaactggagcaaaggtgacttttgctatttcttaccaaagagactggcagcattttgtccatgccctagatatttgtggaactttgaacttgagggggatgatttaggctatctggcggaagaaatttctaagcagtaaagcattcaagaggtgacttgggtgctgttaaaggcattcagttttataaggaaagcaaagcataaaagaaaatcccattttcgaggagaaattcaagtcggctgcagacatttgcataagtaatgaggattcaaattctaatcaccaagacaatgaggaaaatgtctccagggcatgtcagaggtcttcacagcaactcctgccatcacaggcccagaagcctaggagatggcagggtggggcccagggtccctgggctgtgtgccgcctagggacttggtgccctgtgtcccagctgctccagttgtggctgaaaggggccaacatagagctcaggccatggcttcagagggtgcaaggcccaagtcttggcagcttccatgtggtgttgagcctgtgactacacagaagtcaagaactggagtttgggaacctctgcctagatttcagaggatgtacagaaatacctggatgtccagaaagaagtttgctgcaggggtggggtgctcatggagaacctctgctagggcagtgtggaagggaaatgtggggttggagcccccatacagagtccccactggggcgctgtctagtggagctgtgagaagagagccaccatcctccagaccccagaatggtagatccactgacaccttatactgtgcacttggaaaagccacagacactcaatggcagcttgtgaaagcagctgggagggaggctataccctgcaaagccacaggggcagccatgggaacccatcttttccatcagcatgaccaggatgtgagacatggagtcaaaggagatcattttggagctttaagatttgactgccctgctggattttggatttgcatggggcctgtagcccctttgttttggtcaatgtctcccatttggaacggctgtatttccccagtgcctgtatccctattgtacctaggaagtaactaatttgcttttgattttacaggctcataggcagaaggaacttgccttgtctcagatgagactttggactgtggagttttgagttaatgctgaaatgagttaagacttcgagggtctgttaggaagacatgattggttttgaaatatgagaacataagatttgggaggggccagggacagaaagatgtggtttggctgtgtccccactcaaatttcatcttgaatttccatgtgttgtgggagggaccaggtgggaggtaattaatcatgggggcgggtcttttctgtgctgttctcctgatagtaaataagtctcataagatctgatggtttttgaaagagtgggatttcactgaaaaagctttcttctcctgtctgccaccatataagatgtgcctttcaccttccgccatgattgtgaggcctccccagacatgtggcactgtaagtctctgaaaccgctttcttttgtaaattgccacagtcacaggtatgtctttatcagcagcatgaaaatggactaacacagtgggtttgacaaggtttttcgagttaaatgataagataggtgagaaggtgagaaaggagtcaaatatatttctaggtttcttttggggaaactgggtagataccctttaattcacagaaatgagaaaacaaaagaaaaggtgtttgtgataatatgaattcaattttcacatattttaaggtaagcagctaatgtgctatcgaatagatatgttgatttgtttctcagaaataaggccttaggagtacctgttggtttgagtatcacgagatagaaatgacccttgaagctacaagagtagatgagttctatcatgaaagctatagactgaaaagagaagaaacatgagtgactagactaatgttaactcctaggagggatacctgggagaaggaaaggctcagggaaataagaagggtcaaatatatgaggggcctggtgatgggtgagaaaaagactggattccacgtggagaatctatcccatagaaaaattccagttgagaaaatcttggttttgatcaatggtatcctgtgtcctgaacactgcccatggattatttagtgaagatacaaaccaggtaatttgtcatactcccatcccgcttcatcttcaccttcggactctatggtttgtcattttattcacaagcaaccttgaactttgagtacaaagctgcttaaatcttcattgtgttctgggaaagtagcaaaccaacttttccctatttaagtgtttggtagatagtagataacacagatacctttgtgaagtgaatgactactcagaaaaaacccaatgcaaaatgaaagagcaaaattgattaatctatctgtgcttgtctttctgtagaggaaaaatatggacaaattccagggtccaagtatagatactgtagcgccaggtagtaattttcttttaagacaagctaataatatgcactatgacttggttaggcagaaattgatccctaaaatatagctgaatttaagtgaattatctaacagctgggtgacctgtgaaaaacgccataatcaatactttactggttaatactgttaactcgattggattgaaggatgcaagtattgatcctgggtgtgtctgtatgggtgttgccaaaggagattaacatttgagtcagtgggctggggaaggcagacccacccttaatctggcaggcaccatctaagtagctgccagtgaatataaagcaggcagaaaaatgtgaaaaggcgagactgtcccagcctcccagcctacatctttctccagtgctggatgcttcctgccctggaacatcggatgccaggttcttcagttgtgagactcggactggctctcctcctcctcaagcttgcagacagcatattgtgggaccttgtgatcatgtacattaataatacttaaaaaactccatatatatatatatatatatatacacacacacacacacacatacacacacacacacatatcctattagttctgtccctactacaaatacgtctttaaggattcacagagttgtgccagcagagcctattttttttatggagtttactagattcgtagatcaaaggaatgatgtagacacaatgtatctgtatttcagaaaggtatgcatattttttgaagacaagagatggtgaattggcccctggataacagaaaatttaaaaggattttgaattggttcagcagtattaggttttgaatgagaagtcccaaataagtggaatcaggaattaggaatgctttcatattaaagatttaatgtaggctgcctagtctggaatgtcttgaatttgtcacttaacatcctacctgcctagttttggagttgaactgaggattaattaaatgtgagctactattggaaggagtaggaatgggaagatctcgattaatactcaacactcaaaggaagttatctgatacactgtgaaaaacaactgttttatagaattggtggttcacacatgcagaaataacttgggttaaatggtttcttactatagccatttaattttccccttttctcttcatagtgtaacatcttgtagcccaaaactaaagacattactaagaaaaaaattagtaagcttatccatgactaagggattctacaatacagtgatcataaatgatgtgtgccaacagatggcaacttgccaagatatctttggagatattctatgggacacaagttattcttccctattgtttgactcttcaattctctataactacctccctgaaattctttcactccctaaactttccagaacagtaatattcagatgagatccctggggactcttctatgtctcctcaaactcctgatatagtgaattttttccacatcagccacatgtacaagcttacttgtatgtataaatgtaaaaacacacttgctaccttgcaacatgcagtatatctattcaatctaatgcttagaattagtatttttgaagaatcatttagtgtcaaatagaacttctggaagttgataaaaatcaggagaaggcgaggatttttaggattgattgggattcccaaaattttattctattaatttccatacatgacttttttgttatatctttttacatttcaactgtatgcaatttatatttttttactattatttatctataaagatagcagtaaatttgcatgattttatagcaatgtatatgaacttgagtgaagattgagtatttttaactgatgaagtattccacccaaacctccactaatcagaaagtgagggcatgagaagtgctgctgagtctgtagtttacatgaattgggaaagttgaaattaactaatggcaacctggatgcgataaatattttaaggagcatgtaagtgtgtgtgtgtatgagtgtgtttctgtacatgtacctacagaaacacactcatacacacacaaacctacatgctcttaaaatatttatgagagagagagagttggcaaatggggaggcgtgttgctgagaaacatgataccaagaaatactaatgctatatactggtaagagagaaacaatgcattgaaacataatagctacatatttgactttatggcataaaatgtatatataataagtatagtgtattagctttttacaagtcatagcttcagatctcttcgtggatcctcactcagctattgcttgtgagccaaggtgtcaatatatataatattctaaaaattagctaaaagtaatactagcacaactttaaaattaaaaatactgctttttattccagcacataatttttgttttatatctataagttttaatatcactcctattactagagtaattaaaaacaaaagtaaaatcatattataattatttttaaaaaagaattattctgtaattagtcaagcaatgatgttgacatcttttgaatcatgctagttttaccttacagccaagccaaagactgtattaaattgagcattaaaaagaaaaattagaatgagtgagacttaccaatgtacagcttccccctacaagatgattttatagctggaggatgaaaagtatcagactcctcaagatttccctgaaaggaaaagtgagagatcgctttaattcacattctctggcagttgtattatgtcacatttaagtcaattgatcagataaaaaaggaaaacaggaaaaactgccttgtagataaatgaaattaacaaattagggctaagaaatgataccttaaaatgagagtctatattatttctttgatgtaaagtattgtagcctataatatttaaagaatatacagaatcttttagaagaatcaatatcattaaaatggctatactgcccaaagcaatctacagattaaatgctattcctatttcactactaatgtcattcttcacagaataagaaaaaactattctaaaattcatatggaaaaaaatattgctctgatataaaagttcatgctgtaggacactaatttgttgattaaccacaaacccacttttttaatgccaaacaattgtcttcaattcacaaagaaagttaaaactaaatttatcatactgacattctttcttacgataatctctgattatttaacctctattccttctgctaaatcatttcttgcacataaattcctgccttttactatttcttcttctcgcactctgtctcagctcctggctctacttttttttttttttttttttttttaagaacttttaagttcaggggtacatgtgcagttttgttacatagggaaacgtgtcataggcgtttgttgtgcctattatttcattaccggggtattaagcctaatatccattagttatttttcatgatcctctccctcctctcaacctccaccctccaataggccccagtgtatgttattaccatctgtgtgtccatatgttctcaccatttagctcccacttataagtgagaacatgcagtatttggctttctgttcctgctttagttttctaaggataatggtctccggctgcatccaacaaagtcctgcacaggaaatgattttgttcttttttatggctgcatagtattccatgatatatatgtaacacattttctttatgcagtctattattgatggtcatttaggttgattacacgtttttgctattgtgaatagtgctgcagtgaacatacacgtgcatgtgtctttataatagaacaattcatattcctttgagtatatggtaataggattgctagtaataggattgctagtaataggattgctgggtcaattttatttttgtcttaaggtctttgagtagtctccacactgtcttccactgtggttgaactaatttacactactaccaacagtgtataagcattcctttttctccacaaccttgccagcatgtattatttttgacttttaataatagccattttgactagtgtgagatagtgtctcattgtgactttaatttgcatttctctaatgatcaatgatgagctttttttcaatatggttgttggccgcatgtaggtcttcttttgagaagtgccctttgcccactttttaatggggtatttttttttcttgtaaatttgtttatgttccttatacatactggatattagacctttgtcataggaatagtttgcaaaaattttctcccattctgtaagtcgtctatctgttgataatttcttttgctgtgcagaagctctgtagtttaatttgatctcatctgttgatttttacttctgttgcaattgcttttggcatcttcgtcatgaaatctttgcccacgcctatgtcctgaatggtgttgcctaggttatcttccagggttttttatagttttaggttttacatttaagtctttaatttctggctcttcttacttccctatctaggttgacgcttggtctacctctccacaccctcatcatttcagccttccttcagtctcaccaccctgctaattaacaactccagaccaatcttacagtccatttcccccaacccaaatgttatggtgcccaaatatgatagcttgagttccttattcatgaaattccttattagtggtttcctgctcaataataaaagtttacttcattaaaaaaaaaaataggcatgaaaagataagtgagtaaataccagcaagacagcatgcttctgacaactaactttggcccttgttcaggaagcggaaatctatatcttcatttgtttgtgtttaaaacttaggaggacataggtgagtgtctaaatcatggggtggaacatacctgaccaatgatcacttcagattcccactggtctgtaggtctaaaataaacttcactcttggatattcaacattggtatctggcagtatacccactgatacttatactgcatatcttccaaataaacgcagtattaggtatttcaaagaaagatacaaatttaataattattttaataaaagtcagaacaggttaggactgacagtctacatacactagtggaatctctgctttctcaggcctattttaatccctttctccttgacatctaagacatacaaatggtagattgttgacaggtaaatgatcatcaatgtgttacccgcatgcttaattccctgatgtatttccctgttaagcctggataaacattctaaagcccttttgcttattaagcatcaagtttatcagcatttaagcatcatactcagatcatagcccaccataaaatgaaaactgatcacttagatatcaaaacaaatagcagcaaggcacacatacacacactcatgcacacacacacacacacacacacacacaattttgccaggattccacaaacagcacaaatacatttttttttattttatttcattttattatatttttgaaacggagcctggttctgtcaccaggctggagtgcagtggtgcaatctcggctcactacaacctccacctcctgggttcaagtgattctcctacctcagcctcccaagaagctggattacaggcacgtgccaccacaccccactaatttttgtatttttagtagagacagggtttcatcatgttggccaggatggtctcgatctcttgaccttgtgatctgcccgcctcggcctcccaaagtgctgggattacaggcctgagccaaatttttattatttatttatttatttatttatttagatagcacctcactctgttgctcaaggtgagtgcagtggcatgatcatggtttactgcagcttcaatctcccaggcttaagtgatcctaccaccccagtctccttgaagtagctgggactacaggtatgtcccaccatgcctagctaattttttaatgttttgttttgaagagacagagattcactatgttgcccagaatggtctcggactcctggactcaagcagtccttctgcctcagcctcccaaagtgctgggattacagcaccatgcaccacaaaataatatttaaaatagaaaaccgatatggcttggatctttgtccccacccaaatctcatatcaaatcataatcctcaatgttggaggtggggcctggtgggaggtgattgtatcaggagggcagtttctaatgttttaacaccatcccccttggtggtgttgcagcaggagtgagtaacaatgagatctggttgtttaaaagtgtgcagcacctctctgcacccttcctcctgttgcggccatatgaagatgcctgctccagcttcaccttctgccatgagtaaaagctccctgagggctccccagccatgctttggtatattgtggaaatgtaaactaattaaacctcttttatttataaattacccagtcttgagtatttctttatagcagtggaaaaaaaaaaaaaaaaaaacaagctaattcagaaactgacacattcactttacatttaaggggtggtttaaccaagacaagttctccatgggaattgactactaatatttgagagaggatcaatcttcgttttcttggaaaagatgtcatttatcttacatgcaaaaagacgttttgttaacctgcaactttaatatctagaaaataattccattgaaggtagctttaaagagagctcaaatatctcatcttaaatgagaaagaaaaatgaaacaaatgaagctcttataggctttgcatcctacatagttattatgttcttcattttattttcagtaatgttctctcaaaaagtagtttaatttcactacctctatttccaaacctttcatcacaccttgtatatgagagtctatctacagacattgatatgtctgaaattgccaatgaccctcatatttataattccaaatgcagacttgaatttattttatctgtcacatctcatatttggttctactgaacatgagtaccattttacaacttatctcctgatttccatgatgctacttttctcttgttttcttcctgtaactctatttattccttcttaattattgaccatgtatatctcatgaaatttcttctcaggacttcatctttaacattttgcccttatcattctacaacatctctcatgatggcctaatacaaagccatagcttgaataataacctattactgataaatcccaaatatatagcccccaaattggacatttttacatcagtatcccaaagacacctttgattcaacttgtgaaaatatccaattacctttattctattaatttgattttgtgttctctatctcagtgaacaataacaatagataacattgattaagcacttataatgtatcttacacttctgatatcttatgtagttactccacaacctcatattggagatactaatattatcaccattttgaaaatcacagaactgatcctcaaagaggtaaagttacttgcctgaattcacacagctaataattattagagttgggacctgaacagactgcctgcacacttcaacattacaccttgaaaatatttgcccagttgcacaaatcagataatttggactcactttatatttttcttttattcatctattctcagagaactgtaatcacttagttctctagattatgggtataaaatgttgtattattattgtatctattccctcccctcaatccctatggccctgaccttggtttatatcctcatttctctcccagattgttttaacaattattgccctttacactagcctctaacgctgacgataaactttaatctctgaccttgattccaaacactttattcttttgttgcttacagtgagtctaggtacaaaaatgtatgactatgaaaaaagttaccctaaatgccatcttagtttttaattggctacatgaaaaagatgtacaggcatgtacgtaggtttgttgttcacaaaactcttcctatccctataactcaatttcctatagaattaaattcaaatcatcaaaattataattgaattcctgaaaaacttgaaatcatctacaaaaattatgaaataaaagtgatcatcctatttctactgtgacaatttaaaactttaatttgaatcaacagaaaatgaatacaaagaaagaccataatttatttgtcaggtaaagactgaaaaatcccaattgtccatgtccctatagccaattatttgaatgctatgtcaaaataaagttttgaggaaaaaggacctatatgagttttctcgaccaaaatgtaaggtatataaatctctattatctgtgtatgtttacatatatacaatagaagttgcaattaaaatggtgaaagttacacaagtaagctagattactactatgtattcaaacacactttaatttccacctgaaaaacattttccttatataaagaacacttagcttatgaactaaaactcctgggttaaaatgtcctagctatctgtgttctaaggaaagtcactaagtatggccctcagttttcttttctgggggaaaaaaaaacaaaggggtatgattgtactacatgaattctaagacttttttttattattctgctttaaccccttctgattgagatatatttatcaaattggatacgactgctttggtatcatcatgtgaatcatagagaggacaaaatttaaagatgaaaacaatcaataaaacaatattatgtctgtttggcaaacaaagaatatgagacatctatgatttaaaatttgagcttcacaattttaattattctaatttctaaggaaaatattcagaagcttaaatgccattctcctaaattgcctttagttcaagggcatagcagtcagaatttcaaaggcatgcacgttgttttcagcaatgcatggctttgctgcaaagtgaggataggactggaatgaaaatagtgaaagacagcagcaaaatcagtgtttggtaggtaatactctatctagaaaaataagctcaaattagagaaagaagtaaggtgagcaagctttttttggttaaacggattcataaaaatgaatgtgctgttgaccagagaacccaaaagtcttcccattttgttgtcgtttgatgttattgaattaggaacactgacagtttttatgcatgctggatgtagctttgaataaatggatagccatccagcacattcaacaatcggtcgaaacattttagatacacctaataaggggtacgaggagcagatgtgcttctgcccaaactacatactgagaattccaattatacaggcagccaaattactataacctaattgccactaccctgagtgtgggatgcaatcactgcttattcacccttgtttttccaaataaccattagtgatcctctcaacagactatccagctatgtagggagaatcagcagcaagctacttagcaacgagaggctatatttggtttctgcagacttgtttatggaactcacatagttaacttcttcctaaatcagtggtcatgggctaaaatggcttaaacattttcttccctagcaagaaaagattcttttaaaaatgagagagaaacaatgaaagaatctagtaaaaatgtattaaatgcaaaattaaattgagcactgataaacctcacttttaaaggtactttatcaaattgaaatgtgttcttccatctcagtttcacacaaagtgcaatatgtgctatttgaaaattagataatctgcttaagagctattattgggcaactccaccctcttgctaaccaaatttactgtaatgtgggtgagactgctttttctttcacaatttctatttgttgttttgaagagtgatacatttttaaatgtttttcatttgcttaaagtaaatgtatttcactgtttttgaaaaacaagaatgtaaaaacataatttttcataaaagcatatgctttctctaaaagaaaaatatatttaaacaactcacaaaagcacattatgcagtagtgaaagaaaacagcttttaaatataactattgtaaatgatattttgttttttcatgcccacacaaaaatttgtcatttgagacatgtgtagttgtatattgaggtagtttgaaattatgtgaaagactgactatatccttgaagaggtttcaatttttattttgaatgtgctagaaagtaaataaatagaaatgtgaaattcagtggaactgatttctaggaaaataaggcctaaaaagaaacagacttttagatcttatttacagaaagtagttttctgagtaggtcaataacccactttttaaggacctaaaataagataggactactgaaataagcatattatgttttagagcaactatttcaattttttttttattttctactgtataaaatcaaggagtggagaaggtgcaaaatccttcaattaccttgttatattagagactttactagattcatttaaaaagtgtaatatgagcaagaaacataaaaaatctcatcagtctaggtatcaatgttatgaaaatgtcactaacttatttaattttactgaaattataattttctttgcacaatcatatacagaaaatgattaagcacttttacaaaattgcattgctttggacaaagaaaaaattcatttcttaaagttaatgtaacttaaataagatataaactttagatctatgctgtatcccattaggagttgccttccctgtgaatcctaaatataacatatgatctcatctgctcatggcaaaataacatcctccttagaagcacatcttcagtgacagaatttctggaatgtattcctagctgaagtaaagcagcatctgcagtactacacaatcgtcctcagaagtattgctgtttggaagcagaatgacaatgaataatgttaagaaatagggcactgcccctgtgggaacacagcagcagaggtagcaaaatgctaaaactttcgactgcttttttccagagatttaaacactggcaaataaggccctgtaggcatataaaagataagagcaaatttaacccccttttcacctgttcagctgccacaggggtcatttctctatgtgtaatttaaaatttgttccatttctgccatactattatgcagttctgaggaatcagcaaaaagaggcatgcggagatagaagactcagagatgaatcctcaaagtagattaatctattaaatgcaatctattaaagcaccatagattgccaacttacacaaaggtagctctatagagctgcagaaaagaaacctacctgtccagaccatttcctgagaacccagaattctgctagccctgctctagggtagaattccaccctcagcacttttagactattgccatatgctgggatccttattaagatgcagttaccctcaggaaaggtaacaagcagagctactagcaggactactaacacattagtgttggtgaagaaactgacagagatgatgctgattgtggaaggtaaaatacaaagaactgagaaaattggaggaccaccagatgagggagatgcaaatagaaagactgaaggctacattggtaggtgtagcttggcaccaacactagcatacactgtccttttccccaccagacctcattcaaataaatctaaatgacaagtaattatccagaattttaaaaatcttgacaataatttattgcaaatggaaagaaaatttccaggaaattatttctttacctaatatgaatgtatttgtgaaaaagtctttgaatccctataacatgtaaacagttgaagagtttaatctaagagatcagtaaagaaagaacactgaattttaactgagaatacttgagttctaatctgagttctaacacaaatcaaatgtagtcattcattggatatttctgaattaaatttctcatctacacaaacagagggcagtaagagcaggtaatctctaggatataataaagctctaaagacacaaagctatagaaaataaaatgttttctggttgtgaattaaaaatacaaatgtgatattgcctctctgatacacttaggcatcagtttttataaaacctgcaatttatatgtaaaactagtatcttattagttaaataatcaaagtgaataaaatcacatgggtttgaaaggtagcatatccattgctttacttagagatcaaaatgatgcttgataaagaaagccattttcatattccaactataaagccctctctttaaatgtgatgttttatctatggggagtattgcagaaaacaaaggctggctattactcctggtaaaggagtaaaatcctatagcttagagatctttgccttctctcaatgaaactctatgggattcagaggtaaatttggagttcctatgagccttctaaaactgtctgtaaaattttgtgtgaggtgcatatgtacatttttctaagatgttttatagtttaggtccacaattcagagtgttttatgatgcaaaaaaggtgagatgatggttcacacctaaagatcaaaatgatataaagaaacaagaagaaatatgatgttgccaaggagacattctaggtaaggatgaagccactggtgctgcagaatcatcccttgattatttcatgtaggatctacctgcacacagctgcaaaattccaaagtctattttatctttagtaagataaatatccaaattagtgagtatacaaaatgacttgcagttccaaaacaagtattttgatcataagctgtgagaattgtgatttatattaactcttctattctgattactggctattttttattatttgtaacacagagacaaaagctcagaatttgtaacaaatatttagagccttcaagttccctttgtagagggtctaacatgagagagaggaggtctgtctcaggaatgtcatgaaagataccaggggaagttgtttcttgttcaacaccctggccatctactgttgaagacatctataattcactggaactgtgaatgtgtagaatggatattctccctataattgtgtttctgagtattttcaacatgagtaagagaataaggtctatgagtttttctctaaaataatactttctgattgaataatacagaggacataatagattatcatcaaattttagaggatataaattatgctactaaatttttctttatatttaaaaattgttcagcgatgaagcctttgttctgatttactgtgctggctctataccccaggataatatgttttcagatgtaaaaattggatcagacttagttgatagttatatttcttcataaaaagagaacaaacagaggtgttaaaatcattgctatctgaacaaatgtacaaagtagccacaaatacagggaatctagatttgagaattatcaaataatttgctctcatttttcatttctcagtgttctcaaacattatctcatttaattgtcgctagaaccatattagatcattaatatcatacacaatacacagactaagaaattaaagctcagggaggctgggaagttttctgaagttttcagagagagtaagtaatagagctgagactggaacccaaattaaaattgttattattataatcacacagcagcacaaaccttcagaagctatgggatagattttgcaacttcattggaatagacaagacatgattttagttatcatgggctcagtatccattacactgacattttgggacaattcaatattatctctccctttcactatcagtttatgagtcatttcaatgagagtcaactaataattacagttccagaatctctttcatattgcagcatatagaggctactctctatgctgttccagatggtatgcatagtcaatgcagaaattgctcactatgtattttgggaaagaacatttattcaagattcagaggtcaaaatgaggtctggtaatcatctatgaactaatttgctcatcctgtttttaaatttgaattattagcagacagttcagaaaatatctattttaacttttctttggccaaagtagtatccctttattaacaggcaaatttgttcagaagtttcttaaataaaaataatatttttttggaaaaacattttaacaattagcaaaacacttaaaatgggaaaataatgtttacatattagaacagtgacatagaactgaattcatataaattgaaagtcttgggacaagcaaattagcatctgtataaagtggctaccgtattttctatatctgtacttaatctgaatgaaaaatagccttgattatcaaggattgtttatattgcaactttaaaacaacaaatgtgacctcagaagtatccatctaaacaataagatattttttatattcactatctgcctttaggtgtatatgtttcagctatcattttgagaataatttctaggttatttggagtaaatgtaaaatggaatgaataaaatacatttagctaatatactcttaagatccacaaaaccatactgtatgataatcattcctattttaaatatatagcttatttgatataattccataatatataaagatgactacctcagataacatatctcataacaaagcaaacgtttgctacaaatgctttgccactagtctgtgctgttgtatcagaaacatttattttcatcaaatgatttttttaaaaggagctagctgcatttattctgtgttaagaatcacaattgtatgatacctcatgatgttttcaattttctataatattggggaaaatcgtcaattaaaactaaatataaatctatcaatggtcctttttgtttctaaatccaagaaagatggcatttttaatacttattgttaaactagaaaatatgaggcatgataagctacaaaataataccttcctttaatttgatatacagaaatattctagcagctggattttgctaatgatcaactactttgcacacattactaacaaatcatcattaagcggcttttccagatgacttcattagtgacaatagataaacacacaaaagtacaaagcattagagataatttcaatattatattctgctttatctaattattttctcagttatccatacaatttttaagatttccctgggtaaaacacaactgcatctttgaacttctaacattttatcttagaaaaatttcttatagttcactgaggaatttgagaaacttaaattatagccacaatattcaaagttgtttcagggatttagaaaaatatggacgtttaaaaccaaaactaatcctgtaatctttttttacctttaaaaaattatttttcaaaattccctacattgatttttctaggcacatgtcactctgaaaaacagaatgaaaaatattaaagattatcagaagttgcctcggatgcttcaatgtttctcacaaaacaaggcatatctaaatatagatgttatttacttgcaactatgcaatggtttgttttagagaaaaatacattcaattaaacatggaccacttacttgaaatgataagatggatgattgcactcagagagcaattaatattcctcactcaattaataaagattcacaagtatatgctgttattctgaataatatttctatagtgaagacaagttagtttaggcaaatgccttccttgtttaaaaatggaaataccacgaaaactgagctagtctcaaaacatcacgacacctgtcatataaaaatgtgttttgcacactcagtgaacaacaattacagacatccaaagtgaaatattttattgataataagtagatcaaatatgcatggaaattgtatattcaattttaaatgccaaggacattttgttcccatgagtgttttactacataaacatctttttctatcttgtatgacaaagaatgatttttaagagtcagctcacctatagtttgaatatttccacctatagcatacgtaagttaaaattattattttgtgaacataaaattacaatgtttgaagactacaatatgaaggagtggcactggtgtgcaaatctctgctccaaacctttaataaatatattgatctaggattgtatcctaatctatctatattttagtttcctcataggtaaaatgaagataaaatcaactaactgtgtgtgtgtgtgtgtgtgtgtgtgcgtgtgtgtgtgtgcttgtgtgataatgcctgtagatattttagcatatctggcatttgctgaacacacaatgattgttagatatatgttacaattatttatttcattttattagtttgaataaataaaattctgaagagcaaatcaggctctacaaaatgtagccaaggaaaatatcttccttgtgtttgcaatttagcatccctcaacttttgtttcaacactgcccacatacttttttgttcccacctctatggctccaacatttatacccctgccaaaatttgtgttgactctataactatgtaaacattgaaatttcattttttcttatggtgcatcactgcaataggaaaacactgggaaattaagttttattctcacagtgttaatttgtttacttccttgaaaaatcaggtgggtgaccataggcaattcatttaatttgactcagacataattatttcatctaccaaagacaactactaacttctcaaaattggtgcaagtgtggttaaatgggctaatagaggtaaaaagcctagcacagaaatattagctcctctcactacccaccttactctatttcttttcctgtctttccaacaggattaccaaataatcctcatttctgatagttcccattataacagagtgaactttccagtttcctaaataagcattagctgtctctgagttgtatgctagctctgctcttgaatccagccatctatttctcgctgcaaagcagaaaacatatacaaggtttcctacgtgagacagatatttgccacatttttattgcctggttttctagcatctagcagggactagttccttgatcttctgcattgctttattgcttgtcttaacctcagccctcatgtcctttgtactccttgttctgccttgctaaccttttcttcttaaattcttacttcgatctctgtttcagttctggtcaataagtactcaagactcactagcccccagtacttcaggtctgcttactgaccccttatattgtttatacccatgatttcatggtgaccttcaacttcggtgtaaatgctgggtactggcttcttatataatctttgacctgtgcttctgaccattgctatctggattcattccagctgtctacttgtttttatattcactgattcattttggtttccagttttattacatatctttaatccctactcttccagtgatagattcccatattttttactactaatttcattaatactctaaaaccactctagaaactgctgggggaaaaaaatcttcgaggaggtaggatttatgacctcagcatgcaaggcaaggaaagtagtttcctataacttttcattcatatatttaatcctcttagctccttatcaacccagaaaactaacgttgaccatcaactcccacccttccccaaaacaaatcctattatcaagtgtttctttcactaaaatgctaacaattcatagtaacttaaatggtaaactccccaaagatatctgaattttaacagagtcaaatttagcaagcagaaagagcagaaaggtggtggtaggatgattacgcaggattaggatgcctggaattataaggtatttgagtgattagggaggagccctgacactcgggtagttcaagagcaaaagagagctgcagtccttgaactggataaagatgaggtttgagaaaaaagatggagatgtttaaaatgtaagtggcataaaagaaatgagaaaagcagagcattagagaaaaaaagcagtgatgtcaattggcagctagagcagacactgataccacttcaatgtggcgtttgcggaaaaaggaggcatggagtgttcaggctggaagggatccctgcaatcatctagcgcagcctcctcatttttccaggacagacatttaacatacatcattattttcctgcttcttgtgggtccatacttagaaactggccctgcatcttcaatactttcagaaatagtagcttctttagaacatactgaactggattaaaaggagaagcagcttctctggttaaaaaaaaaaaagaaagaaagaaagaaagaaagaaagaaaagaaaaaaaaaaacccttctatatgtgtgtagaacacactttgccatctgttcctttttccacttcaagtcagtttcccttttttacatccagtgatgtaatgctgcaaaagatttgaggtcattgttaataaagttataagggaatcttttgaagagaaagttaatttgctatatatactatgtgagggatattcatagttttccaacagtaatgctctgcagtttataagaatcttcagtaaagaaagacgagtgtataccaagtagggctgattttatttcaaatatttttaaataaaacctttatagcagtgctacctgtaaatattctagtgacaacttcatgcttgatgagtagaaatgcttgtaggccaagtccttgtacttatctaaaatagcaaaacatttacacctgacaagggactttggtgtgagacagttagtcaagtttcattgtagggtagcatgacctgtctcagaatctagtcaattattttgtcatttatcacaatctaatcatagcacttatcacaaacttttttatgtgcttatttactttttcatcaggaagaaggttctgtgaagcctgagatctcatctgttagtgccattccctattaccagcacctggaataataggttcaaaataaatatctgtcgaattaaaggaccaatgggaattagagaagattgtggcatggggcctgagcagatccccaagaatgagggtgactaagaaaagaggaagacaaagcaattatgtttcaggggcagtaggtggggatgtgcttggccatacttgcaggctgatgcaatgaccttaaagaaattatgactcggccgggctcggtggctcaccctgtaatcctagcactttgggaggctgaggagggctgatcacaaggtcaggagttggagaccagcctggccaatatggtgaaacatcatctttactaaaaatacaaaaaaactagccaggcgtggtggcgcgcgtctgtagtcccagctacttgggaggctgaggcaggagaattgcttgaacccaggaggtggaggttgcagtgagccgaaatagtgccactgcactccagcctgggcaataaagagagagtctgtctcaaaaaaaaaaaaaaaaaaaaaaaaaaaaaaagactatgtcaatttaaaaactaactctaacttgatttggggcaataaaactaacaaaacttaaggaaatgttcaaaatatgtaaaattgtattttcagtaaatgattatctaataaaccaacaataagacaaatatccatggaactctcccaaatgtatatccttaccttattttattttatcgtatctttcattcttaaccctaaatttcctgtccaattttgggtgagttgtgggtctccatacatactggactccaaaaattaattctctatctaactatctattagaaaattacataaaatcaaatgttgattcactttcctgtttaaacattgtgaaaagggtaagcatatgtaatgcttatttttcataaatattaaaacttcctaaatagtgtaaaatatatattatcccatgctatgctaaatgtactttaagcataataaaagttgttatattctcacaacagatttgacacccacataaaaaagaaaaaaatgcagaagccactgaattctgggtacctaatatattactttctacaagcatagaatgaagtcatttttatttttaagcaaagggctcattttgtatgttagagaagaaaaagaaaagaatatccataattttgaagaaaagagttgtttcgggaaaacatgacttagctatcatttggtaattattgctcagtactattttttaaagtattagaaatagtaaccagtactcattcttctcctactgtgagccctcttgcagctagcacattttaattcctcttctcctgctgttagtcatctccagttttttcctccatgatatctgtgatattacaatcttttttttcagtttttttacattttattattattatactttaagttttagggttcatgtgcacaacatgcaggtttgttacatatgtatacgtgtgccatgttggtgtgctgcacccattaactcgtcatttagcattaggtatatctcctaatgctatccctccccactccccccaccccacaacagtccccggtgtgtgatgttccccttcctgtgtccatgtgttctcattgttcaattcccacctgtgagtgagaacattcttatgtcaaggaatggtgtattgcttcttctgtgccaggcaccctgtaccccttttctgtagtcaaaaaagaatattatcttcttcgacggacacaattactcttctctttcaaatatggttatgttttaattctctttttattcagataagaaatgctacacaaatttaattttcaaattcacatattagttaaaaatataccacagcaaccacatgttttacttaattaattatttaggctcctctctttttgtttttgtttttgagacaaggttttgctctgttacccaggctggagtacagtgttgtgatcacagctcattgcagtgtcaacctcctgggctcaagcaaacctcctgtctcaggcttccgagtagctgggaccacaggcaggtgccaccatgctcagctatttttctattttttgtagtgacagattttcaccatgtttcccaggctgatcacaaactgttattatttacattgtaatctgatcttcatatagcaccatcatatgcctcaagggctgcttcacctgcctttacaaatcaatactgcctactaacagaataaagtagagtacaagaaggaaactttctctaaggatgagctcattcaaacactgaggttaaaaaaggcgcctgcttagtggcaaactcccaaaagaagcagcacaggagggagatgtgctaagagttggaattgtgtcattccccaccttcaaatcatctgttcaactgtaacttgaaaatactgagaaacctgcctttaaggtaaaatcaggccaagctatgcaaaaaaggagaaactgacatttatggagcacctattatatttcaggtattgtaaaactgggtatttttcacacattctctgatttaattctgaaaacacatgagatggttattaccatctctatttatatttttttacaggtgtaaaactaaggctaaggtcacacagctaaaaaagatccaggctcaaacatgagtttctcattcaaagtctatgcttttcctcctgaaacatcacaaactttcttctttctatcgaaattctttctttcttcaaaatgtatccatctatccaactattcatctactctactcattctttctttttacctttccctctctatttcccatctcacctccattcctatggcaaagacatacttaacatttactctgtaccagttactacattaaatatcaggaactcactgtgaagagtatattttttatattatatttcaataattctttacatgtatttacttgtaaataactatctaagtggcattctaatgtaagatgtgcataatgcatataatgaacaaacatatatgtcatattaatacattttctcatgaggaaaatagataaggcaaatgttttgcccttgagatgctgatgtaagcaaaatatagagattaactacatgaaattccagaaagattgacttatgatccatgtatgcttaaaaggatgatttattgttaataaacaaagatgacctgacttttaagtgtacaataagcattgaaagctgtttgaagtttaatattttagctgcaacaattagaaaacacaaagaagcccaatgccttatttctgcaatcatattctcttttgttcttagtattccaagatgaggtagtctgagtttttgcccctcatggatatcagtaggttttacaagtgagggaacttgactgaggcatttggtcaggagtttaaatatttcatgaggaacgtgaaatgtgatgtattgtaactacagagagaagaaaaagctatggatcttctcagtgggtaaatactggaagcatatattcctatacctactatagataatgaatcccatcaagaaacaatgacctcataaatgaacagcagttgaaccctggcaactctttatagctcattgaggttttcaggcaatatcttgtatcttgtaatcatcacagaatgcttgatacattttaccattctaatttatgaagatactagaaagctatgatattagttctgtcttcattctgtataggacataggatgacttcgcaactttttttttggcaacagtctcactctgtagcccaggctggagttaagtggtatgatcttggctcactgcaacctccgcctcacgggttcaagagagtctcgtgcctcatcctactgagtagcggggattacaggtgtacgccaacacacccggctaatttttgtgtttttagtaaagacgaggtttcatcatgttggccaggctggttttgaactcctgacctcaagtgatacacccacctcagcatcccaaagcactgggattacaggcatgagccaccacaccctgcgactttaaaactttgattcaaatattttctttgtttattaaactttccaaatataaaaacttgtcacctgtctactctatttaaaactagtcagaatcataacaaaaaatccccaatggccaatgatggaaacaaaatatttgacagatatgtggtaatgacacaaatgatattgtgcttaataaactatagatactatttgtatttataatatctgtaatttgaagaggcaataacagataccagcagagaaattttatgcgtctctcattcatgaggactacataatctataaaatttgcaagatttgtttttaaagatgggattgctaggatattaatatttgcctagaaccaagatgcccttaaagtttcccttagttgactacactgtagaaaggcttccttctaactaattcccctgctgtccattttcttagagcacttactttagaaaacttgtaattgtaaatcctttcctggaccttttgagatgtgaatctcccacaacccagaaaggtctttttcaaggacgtgggagccattcctttgaaatggtatcaagatagggcccctgtttttctgtttcactgggagagtaggagtctaacttcaatatgcaggaattagcaaacacaggtggcctaatcacactgaccaggctttcactaatgtcagcaagcatttaaaaatcctcctaccttttgttttagtaaagttgaatacagtctttttcctactggaatagtcttaaagaaagtcatcctggcccttataaactgaatgtttttgtcccctcaaaatccatatgttgaagtcctcataccctgtgtgatggtatttgggggtggggtctttaggagataattaggtttagacgatgtcatgagtgctgggtcttcatcatgggattcgtgtccatattaaaagaaagaaaaaaagaaagaaagatcagtgttttctctctttccctctctttttctatctctctgccatgtgaggacccagcaagaaggtggccctctgcaagttgaagagggccttcaccaggaattgaatcttcctaatctttgatctttgactttccaccctccagaccctaagaaataaatgtctattgtttacgccacctagtacatggtattttgttatagaaatacatgctgaccaagacacttgcctgctttactggtctggtgcgacttttctttgacactcactatactaatgatcttctacttgtgtatttaaagtaatggagtttacaaagatcggcatgataaatatagttactatccattgaatacttacgaataggagacattttccatatactctttcacttaatttagtcctctcatctgtgttctaatggagtagttactatttttaagctcagtatatagataaggaaactgagacttggaaactcaaaatagctttcctgaggccacaaatctagcaaatggtcgatccaggatttaaacacaggaatctgactttagggtcctcactcttaatcacttcattatgatatatgggggcaattatcacaatatctgagatttcattcaactgtccaacatcattaaacacagttttattttgcagtatgtgtatatatactgaattatgaataaccataggaacaatacccatctttgcaaagagggctgcacccagaagaaaaagctagcatgttcccaagagaaattgtgattcagttaagtccagaggaacattatatataaatataatgtataatgtatacattatacattatgtatatacaaatgtatacattatgtgtgtgtatatatatataaatgtataatgtataaatgagtgtgtgtgtacttactgcaacatctgattaatgtgaaggaaagagaaataagataaagtagcatctaatgaagcacacttgtttctgcactgtagtctatgatttctgaaagtacttcttaagaatatgtcattaaagagccgggcgcagtggctcacacctgtaattctagcacttggggaggccgaggtgagcggaccatgaggtcaggagtttgagaccagcctgaccaacatggtaaagcactgtctctactaaaaatacaaaaattaggtagacatggtggcatgtgcctgttatcccagctagtcagcaggctgaggcaggataattgcttaaacctgggaggcggagattgcagtgagctgagatcacgccactgcattccaacctgggtgacagagagagactccatctcaaaaaaaaaaaaaagtgtctattaaaaaatctgactttctgaagatgcacctttcttcaggtgcaaaaagtatcaataaaagatacccacaggaggataacctcttttattagctgctggaaagaaaaaaaaaaactattgaataaagaagtcagtctttttattttgtatttaattaaaaaaacaaacattttactctgttctttgtttttaaatcgccttagtgtttttaatagtaagtcagtttgcttttaaaacagaattatgaataaccataggaacaatatccatctttgcaaagaggcccacatccaaaagtaaaagctagcatgttcccaagagtaactgtgattcagttaagtcaagaggggcataatattgatccaaaaacaaacttctctaccgggagtcattgaaaggaatttaatgagccacattctccctatgtatgggttatatcatgggaataaattaagctcttttgcaagctgtattaactcttacaggtcacttgagtattatttattgcacagaagcagggacttgcagacaatccatcttaaaatttataaattgttcaaccttgaaaattctgcctacatattcactttgggattgttatttttggttataaaaataggtgaatttgtatcaagtagagaattgtaaacataagcagaaatataatgttcataaatacaaggcaaagtagaaattaaaggataccaaattgcaagtcagcaaagctggttcctagtcccatcttattccccaaatatctaaccttggatggttctcctaaattttcctggatttaatttatcatttctgagatgctgtggctgtgaatcataaagttctggaaggctgtacaatatttataaagaatctgcacatttgcattgatatcaaacattatctacaaacatagtaaactactggtgcactactatcagtctgagtatagtcaggatcacaaaggccatgaaagataatttaacagaggaaatttaatgaaggaaatagtcacaaagatgttgaggaggtgaaaagccaccagggtatggaaagaagcccagagtttaacagcagcattagctgttttgtaccagcatcagttgaagtaaacttccaaacattcgcactctttctttcatagacctaaggacattaaagaagaaaaaaatcctccctaaacatttggagtattcttcgtaagttgcttaatatcagtaagattaaaaggtaagtagtgtggctcacgcctgtaatcccagcacttgggaggtcaaggcgggtggatcacgaggtcaggagttacagaccatcctgaccaacatggtgaaaccccatctctactaaaatacaaaaaaattagctgggcgtggtgcacgtgtctgtagtcccagctacttgggaatctgagggaggggagttgcttgaaccaggagacagaggttgcagtgagaggagatcatacaactgccctccagcctgggcaacagagtgagactccgtctcaaaaaaaaacaaaaaaaaaacaaaaaaaaagtgagtagtggaataattcaggacttgaagaagcacaccactggctcatgacagtgacatggatattaaataagaatgactttagtctgttttggaaagggagagtttattttgggtaacacgtaagatgattgcattttgttaaaggagagtattcttaaaatgccagtatacgggtatgtgtgtagtgctgagaagacaagagtggaaatgtaataaatgtttgattgttttggctactcaacaccctttctctcctgtgaaggtatctcttttccattaccttcgttctagtgattctcattgagaaaacaaaacaaaaactcatgtcttattctcccccttttgagttatgtattcacatcttaaaactgcttgatattaacacaagtaactataagttaacctagtaatgccacaccagacactgcaacccatatgttatagtttaacaatgtatagccaatcgatagctatgttattttaatgtaaattcttggtaaacaactcaagaattggccctcacttccctttaaaaaaaccacttgcaattgctacttatcaaaatgtatactccagacaatttaaatctatgctcccaggttacaatcttcaagttatcccaaataaactctctacttatgttaattttgcctcaatttctttctttaagattgataccatgaacctgaatatcatggatcctgctatcaactgagtcatgaggattagactaaggtggtagtgtttgatgcaatatgggccaattagattctctcttatgggaatttaaaacatttccagagacaatagcttctcatattgagttatttaatggaacattcaaaagaaggtccataagtttgcaatactgacatcccctgctcagtcacagcacctatatttcccaggcgctggataggcaccattgtttttttccaattttggagttatgcaccacattttagttgtaaatatttaacatgcctgttgctttgtttctatcgtttgaaataaaataaccttaactgagacagcacataggataatatctggttctctgaaataggtagaatttctttttttgtctcagtattggagcttttttaaaaccaacaaaataaaatatataaataaattcatttactttgaacatgtatgtacatgctaagttgaatttgacaaaattccatgaaagtggatcagtgagaatgtgtagaggcaactacttcagtctcgtctcccttgctaacagcattatgtgttggcctgaagcagtaagttcaaatttaagattattttagtgccagctgagtctcaagagtgagcctgaactggaaaaggggattagtttagacatgttcttcacatactcctgctcagcagttcagccaatatttacaacttccatgttgcgcaatactcatgggcttctcctcaaggatttgcatagcaacctcgggtaaatttaagagaaacatatggcaacctgtattcctgggaggccacagtcacaattgcagcatccattggaccattctattttacaaggcagttgctggtactaaccatttcttacagtaatatgcaaaggggtaaatcacttagggtgtagtttacttcttgccagcatactttggtatatattaaaggctcaagagaaagaggttttatttatggactatgaccttactttgaattagagaatttaggtgcttagcatttgaacagattgtaaaactcttgtcttttattattttctctatttctttttctcatattttagctatagatacaaaattagatatgaggattaacaaattactacatctcaaatcgtttttaatttgtaagcgtcataaacataaaaatatcttattggttgagaacaataataaaatatttaagaaattaaaaaaaaaacactaagctttacctgtggatattttaagagtatggaaaataaggttactttggaaaattcaaaataaatatgcttcattagcacataattggaatgacaatggcaaaaatgttattctcaaaatattgctgcattcagagataaaaatgtaagtaagattattatattgcacagatatttttactccttctaatattagtgttgactatcaaccaatgaaaaaatctttatgaatttctaggttagatgcttccgatattctatttccctgacaaccaatattcaaagaatataaggaggtacgactgcataatgtgtttgctaaaatagctttgtctaccaaagcaaaacctcctaaagtggccttaaacttgatgataataacacatttcatttctgtcctcagctttcaagtcccaatttcatatatgcgttataacgttaaattgaaggtttattggttaaaagaatatttttaaaaaatagaaggaaagagagggaaagaaaagaatggggagaaagaaaactactttctaaatgcaaattcactcagatacattgtcccatccacaaactctttcccgttaaaataacacaacgctttctacctactcaaagtgtcattactgccttcttatttgaattaaatataggtcagctcatgtgtgtaaaattacgaaaaccctacaaatatatgaggtataatttcatttgtccactagagggcactattgtaatctcatgaacatgacagaaatgtgtcaaagtatttttttaatgtacataaaagggaaatacagtgttaaaagcaaattgcatttttaattgccaccaacctctaaatacatgacaaattgcatgcaaattagatttaatttatcttatgttttataggttcacaaaaggctttttaaaaagtattatatttgaaagttcagtttctattttcccaccatcagcataccaatcacaggtcttgcttttctttctttctttctttctttcttcctttctttctttctttctttctttcttccttccttccttcctttcctttctttcttccttccttctttccttccttccttccttccttccttccttctttctttctttctttctttctttctttctttctttctttctttctttctttctctctcttcctttcttcctttctgtcttcttgctttctttctttcctctctttctgtctctctctctttcttttctctctgactatctctcagaacatgagaatacaaaagaaaaacaatggtcacattttggggtcaggtatatggtgttcagccaagggtatgatatattccttttgatttaaatagaaaagaaatacttgctcatttaagttactctccactgctaccctcctatgtaacaatgaaaatgcataacaagttcaacagccataatagggaaagacaatgcatatcctgcaacaggaaaggagaaagaagaaaaatatataacttgttccaatgagcaaatgaatcacagaaatagaatggaaaggacctattatgcattgaagactataacttagggaaaacacagttccacttatgtttatttcagattacattgcttagcatttatactgttcttccaacaacagctctctctttcgccttctcacatcacacacatctcataattgtctgtggtagcttttttctcagctcaaatgagattgctttgaagactaagttcacacactagagtaattaactacataattagtctagagtgaatcttatattgtcttctatgataccttcctattccccaccatgtcatttaataaaagctgccactatttctaatgcccaaattaggaaatttaagaggctgatttatccagccagaaagggaaaaatgaaaggacaagaaacattctttttcacagaggaatctgaaaatagtttagggctgcggaatagatgttagaatgaacatcttttcacttatgtaaaatgaaggtttttggggattgtaatgatcagcctaagtgactacaatttataccagtggttctaacagtatagtctctggacctgcagctttattatcacccggaactcgctagaaatgcagcaaattattaggccccacccacaaatactgaatcggaaactctggaaatggagtctggtgatctaagccttaacaagccctccaggggattataacgcacactagaattcgagaaccattgattgattgatactgttaaaagattgaataaaaaactaaaatcgtgactctcatacaattttcaacaatcgtatttcaatttactcaactcactaatgaggagggtggtaggatgttacaaccagctcaaaggagaactcaaataactacatatatctaggcattaaaagatgctgaaataaatttacataagatgtaagacttttctatccacagcgtgataagtaattgtattccaccaagcacaatccattagcctttctatggagcatttataaaattattggttttcagccaggtgcagtggctcgatgcctgtaatcccagcattttgggaggccaaggtgggaggattacctaaggtcaggagttcaaaaccagcctggccaacatggtgaaaccccgtctctactaaaaatacaaaaaatagctgggcgtggtggcagcagcctgtaatcacagctatttggtaggctgaggcaggagaatcacttaaacccgcaaggcagaggttgcagttagccaagatcactccatcgtattccagcctgggcgaaaagagtgaaactcagtctcaagaaaataaaagataaaagataaaaactggtcttctacaacagagttgttaagtagccgatagcacttagggagaggtaccctacttaggaaagtaatattttttttctctctcttgcccatttcaacatctttcacattttttttcccctgaaaatctatgtaactcatgcttcccaaaggctaattatggttaaacatctttcatcttggaatttctgagtcatgccagctcaacatactaattttaagcctgtgactcagtcttgctcccaatttacctctgttaatgaattagttgagacaacatgagaatgagagagatgaaatagtttgtcttattttgtaggtaccatgagaacattttattgccctaagaattaatatgttaagaaaagactgtggaaacagaacaccaatatattgaatttttagtatagccaataaattgatgtcatttgcagatcatgtgcatgggagtgaaattctgcttaattagcagtaggaatcgactgtaccaaatacagcaagtacactaatatgttattctatgtaacaaggtcaagttctgcaaagaagaattgtgtaaattcagcaaaattcaactgttccacttctgtcaacgttttaaccaattcatactgacatagctactcaagttataaaactgaatctgtcaataccagagaaaataaagcatttctcatcctttcttaagaaataaatgtcccactatacatatcagttgtcaatatcaaattgggttcaattatacatttaaagtatctattgataaaaaagagtaataacatatagtatagtaagaaaaaaagcgttatgaagagcaaaaagagaaatcttggggtttatgatctagatatctaaatacctagttggtaaaccttggaaatattttaacttccttcagtcttagctttcacatctttgaactgaacagatagctactctatggcagaataccgcatatgtaataaaagaatcatcagttctaatacaaaacacattagtgtcatatgtacttgattacaaatatacacaatttggtaaattacggtgtgaaagccctataatattcagatatagaatctgaggtatatgagggtaggtgaaaagtactccacatttcttgcaatgtagcaataccagctagttcagaggtaactggactgtgaaacatctattgcaggtagcagtactggggaaaaacaaaaacaaaaaacaaaaacaacacctcagaatctctagctcccagtggatagtcctcaaattacaaagttcaaagagcatgactattagccagtattatgactaaaaaccttccctcacagctattaatggaacacaatagtaaaaacacaccaaatgtgttccctaacccttcatatattttctgtttttttttcagagtacttttctcagcttgtaatgaatatccttcctttgttcttcatttatttaggtctttttttgtcttcaatgtgtaacttaaaagacaattttttttcactttttctgtcttatctttaccagaattattcctctttgtttctcttaaaaattctgtatacctcaagttagcttttatttaattctgcattacagtatggtgaattgttttgaggggcatgacaatgctgtattaacttaaaaccttaatgtccaacagagtactagaatcttaattagctgtacaacaaatgtttgctaaatttgaataatagatattctaatacccagattacctcaaaaaagatgaaaaacatgagaagactataaatcaaatctatataggcttcctattatttcatgtatctggaggcaggaaaatatatttatctctgatatctacttttctcttccagtgaaatcaaactcctttccatcaggggattgtggttaatggtctatcattttaagcaccatcatcacaaattctacaagcctgaacctctccaagaagctcagagtatgtttggtcttattatttcccaaacatcctccctcttacaaaaggggagatgtatttgagagacattaagcaattaacccacaaaaaccatatgaccaaagccatatgtcacccccaacctgagggacagaatcatttacaccctaaacctcagcataatgttataaacttgtataaaaaaaacttgcacatgtactccctgaatctaaaataaaagttgaaattataaaataaataaataattgtttgaattacttaaaagaaaactagagttgctattttatggccttggccagtgtcttacatattaaaggagaatgctgcactaaatttgactgctccacagtgactttcctaaaatttccagtctattcagtcaatagtgatttgaattttaacatttaattaagaaccagggaaatcgaactaggtataaaaagatgtttcaaagcatacatagtaatttgccttgcctagattgctacgctgtctctggaaattatcaaataaaatcttctgcctaatactttgttgtgacttggattagaaagaaagaaagaaagaaagaaagaaagaaagaaagaaagaaagaaagaaaaggatgctttgcagaggtccagaaacttatcatttccagtacatgtatttattgcctgagaagacaactctaacccaaggtagttggcgcagagttgcacgatgttagtcagtggatccatggttgctttctgttattagccaccagccccataaaagtcaaaatttttgacaaaaacaaaacaccatgcagctttgttgtggtcagatggctttacttttcatgctttgaagcaagaactccattaggctttttttttattttttttcttgggagaaggcctattttatttgcttgcaccactagaccatttgatttttgttatagtgctcaaccattttcagtacaaataaaatcaaatttttggtctgatacatttgtgttccctagggcctgaaaggaaatgttcttttaaaaaattttcttagctacagattgctttagttacaaaggcaaaccctaaatatcaaccaatatgtggaagagctggaaggttcagatagaaggactgcaaaatccagtcaagaaacaaagcaaggtagtagccctgttattgctccttaaatgttttcccaaagaaacggggaagaaaagtattttccggtgattaagaaaataaaggaaatcaatcatgaccagttatactggggggagtgggctgagacaactggtgtctatttccaaccaatttcttctttattagtatttctttgatgttactggtatcacaaagcaaattaagcaactgcaaaatttccttaagacatcattttgaagatagcacaaaagtagctaaattttatcattcacaaatgttcagattatttgatactaatatcttctagcaaaatgccatttcacatggaacttgaagtgaaatatttgtccctagtaaagtgaatggcttatttagtggatggttggtctttttgccaattctgcaggatactttttttttatttttaaggcaacaattttggcacaggcaaaataaagcatactttgttatgtttattgttatgaataaacaataaacaagtttatcattaccaataaagcttcacaattctgaactttaaccactatcctgaaaatatgtttatctatttgcattaaaaaaagcagtggcaaatttaacacccgtttcaatggattcctgatttacaaccatggttccttctcttgaggagaggccctttaaccacttcactaattgaagctattaattataattttatttataatttcattaccaggtttcaaaaaatgtatacataatcacacatatgactcatttcaacatgtatgacacttagtagctcttttcatggaataagctgaaatggagtagctcaaaagctgttatttttagcataaaatcatgcctccatggggggacttcctactgcatagcttattctccatgacattggcatgcaccacagcttcctttaaacttcttcaatgcaatatgcctgaaggaccaaaacgatgctagatttccctaagtctgagatactcagagcagtacacactctttgacactttcactaaacaaaagcattttttattattttattgttgtgtgcttgtttttgcttctggattgttgctggtttcaatactactatgtgtactcatatattctcacaatatttgtactgtctcgtgtttcttaagtctctgaatgctagagtaaaacatatcttacagaaatctcactccttgtctaaactgttgctttgatgtaagagttggttgtccttctggaaaaaaaaaaaataggctaggtttcagaagatgttctctagagtgcattcctctccaaacaggaaaaagaaacttgggcatttggccgtgcttatgagggtgatgttggtggcactattctctccaagtaagtactaatggatggtccaggataaaattgggattgcagtgcttggcattgtgaatcatataaaacaaaataatcaaaatcctatgttcctaccaatttataaatccacaggtcctttggaggagagcagtaccatttatctcctgttacttcagttcggcaaatgtagctctcccttagctggatttgatattttactgtattgtgtactaacagtaaatagctacaattataatggcacgtgtttccaaagggtcttacagattctaagaaatgtcatcagttttaaaactgtcatcagttttcaaagatattgtttttccaatgttatacatctttcacagagcactaacataattttcagtttactcatgtggaaacttagacacagaaggataaaaagcagtgagatatctaacaattctaatactagcatctaaaattgactgctttgcacttacatacatgattattaatcctgagactctgcgaggaggtattattatctcttattaacagctaagtattattatacttacgaaggattacaggcaaagaagggtaggtaatttggccaaggtcaccccattataatggtaaagctagagttcaaaccaaagtcttttttactctaaagaccatgctttttccattattcattactcatatccctatctcccaccccaacagcacaaacgagttagatgcagtgatgacctaataaatgtttaataactatctctctggatgaaaaagcctagattgtagcacttgccaatttttctggtgaaatactcccattatggtcaatttcaatctacccatgtgatgttactgaacctgaagttgggaagagatggctcttgggattttgtgctagctgactccagcgccacactgaatcacaatttaaacttttccttctatatttctgatacaatcctgagttccttcgctctaggtcttccagttctggtaaaaaaataatggattcaacaggtctattgaaattaccaacacatctaggaacactgagtttatagagttgtttttgctttacaagaaagacaactggttgcaggagaaagcatatcagacaaagagtaagaataattgatctgagcttacattccaaatctgccatttgctggataaccgaatgtggaaaaggtggtgaaaagcctttatctttcaggaacttggccttttcatcatgaaaatgaatataataacccctatatgaattgccttcaaggtgagtatcatataagataatccatcctgaagtattttatatataaaaatgtgaagaagatatagagtgtaaatgataccagtgatactctcctggtcctttggattggtctgctacacattccatgccctttcacacacaaactacttaatttcatctacgtaatatgggaatatgtcagaaataacatagactttgaagatgcgaggtatacaatagtggggactgtgttttcaaccaccaaaccatatttgtccctcttttttttttcagcttctctaagttaatacttagaaactggtgtaaccacaagagcttttgatgtacctttactctgtgcctattgcctctgctaggactgaatcagcatttctatttccaagttggagcaggtggaaggccactaacagtgaaaaaagagtggaatgccaagaagaatgagcacagaaatatactctccctttttttcactctgtttagtacacatgttgtctttgtatttttggcccttttaaatgcaccctacatatccataaagaataagcaatatttgaaataaaagccatcctgtgcattcgtagactgccttcagacttctttcaggttcagtttattcccaccatattaaacagtttgtttatcattataatctttgcccttcagcaaaattagttctttgtcctcttttggctgccagatcctattcagccttttggatctggcagcttggttttattgtgtcaacccatggtttcttcacaaaatggctttcatcattctgcctatccctgtggcattgtgcagcttccatctatctgacagggaagggagataagacatttcccccaatcttctgaatagacacaggctggagatggtaacccagactacaagaatcccagaatataagaaggcaacaaggtcaatgagtctcattactaagcagagtgcaaacaagaagttgttccctttgtgatactccattacagttccaggagtgtgagcacctgcaggaatcaggctgtgaacattagccccttgctggtttgtagtgctatactatgccaggctccctattggagctggattttctcctctacatacctttccaaactgcctgaccattttttaattgtgaatagctccagtggagttgctcccaggatttctctagagaaaataatgctttttctttctctcacaaaaccagatacagttattcagaattatggtgcacaagtctggtgtttgatcagttagcttaacactcaacataattagccactgagacttgactttgaccccaatacaaaaagatttcaattttaaaattaaaaagaagtagtgcatatgagtaatgactcatattcttagttttagggaaaaaacagagataattgtgaatcagaagtcatacactttgacaattatgacaattatgaaatgaacaaactgatatgtgttgacatgtttctgtatcttgcttcaatttttcctgctttttaaaataattaatatctactaaattatatatactataaaagaagagatcctatgtatttgctatttagcacacatagtataaatgatgctctaggatactatttcaaaatatgtgccatgaacacactgattattgttaaaacacatattcttggggtgaaaccaagacctactgattccaaatttttggtgtgaagcaggggaatgtcaaagattaataacaacaaaaaaggtaattcccttgctcagtagaagtggaaattaccaacataggactaatatatgggccagttgggcacagagaggaaattggtttttatgttggcttttctggcttaggcaataaactgtctgttttgtccacttttttgtccattgcaccatttttgaccctgcagcttttcaagctcttccattccctcattactgtttatcttaattacttaaacagtattcaaagaaatgacaaagtcaaagatagaggattataaagtttttctctaacctttgtatgtacctcttgttcaataaaattaattacagattgtaatttctttaagttgggttcagcatctttgtagcattgagagtaatatttagcacaataatttatgcatttctatgaaagattttcagctctttacataagaaatgctgcaacagaaagtaacactaggaataattaaaacatgcataaattaacaacattatatttgaataaaattaaaagagtcatttatggagatcataaaatcacattactatatacttctttgattacattttaattaataacagaagtatttaatcagaaaaaatattttgcttaggatttttcaaaaaattatgcagtcagtctttacatcaatgtttcttgttaaaatgaaattttcaatgactatttagtaagttttattatgtgtaagactctccaccggccactatcatatatattacagttaatttctaagctattctatcaggaagagattatgattaccttattttgtagattaaaaaaatagagtcatgagtccacaaaaatccctagaatgagcaagtgagtacagcaagtttcaggacaaatggtaattagggaaacatcaacttctttcttccatatgagaaatgaacaatttgaatttcaaatgtaagaaaagattatgatagtacaaaaatcaaatacgtggtataaatttaacaaatgatgtacagaatctgtatgtgaaaaactacaaaactctgatgaaagaaatcaaagaaaatctaaatacatggagagagatttcatgattacagattggaagactcaaacaatattgccaagatgtcaatttttccctacatgaatatagatctaacacaattttcattcaaatccaagcaagatattttgtatatatggataacctgattcttgattgtaaaatttatgtggaaagggagaaggcataggatatccagaacaatagtggacatgaggaacaaagttatatgactcactctacttgatttcaagacttaccgtagagctacagtaaccaagtcagtgggatattggtggaagaatacatgcatatcaatgaaacagaatacagagttcagaaatagacctacacaaatatagtcaacccatctttgaaaaaagagtaaagccacttcagtggagaaaatcattaccagaaatggtgctgaaatgtgtatgtctatatgcaaaaaaaggaaagaaactagacatagagctaataacttttataactcaaaactcaaaaattaactcaaacaaggattgtaggtctaaaaataagtctaaaactctaaaaattctagaataaaacatgagaaaaatttatgtgacttgatttggtgatgagtgtttaggtataacaccataagaatggtgcatatgagtaatgactcatattcttagtttcagggaaaaaaaacagagataatcaatgaccagaaatcatacaccttgacaattatgagaattataaaatgaacaagctgatatatgttgatatgtttctgtatcttgcttcaatttttttcgtttttttaaaataattattatctactaaattatatattctgtaaatgaagagatcctgtgtatttgctacttagcacacatagtataaatgatgaaaaaattggtaaggtttacttaattaaaattaattatactctgtaaaagagaagaaaaagattaaacatagactgggagaatatatttgcaaattacatatctaataatatacttgtatatgaaatatacaataattcttaaaactcatcaataagaaaataaagccattcaaaacataagcaaaagatataggtggcaagttaagtatatgaaaatatgctcaatatttcgcatcagaggaatgcaaattaaagcaacaatgagccatcactacatatctagcagagtagctaaaataaaataaaataaaaaactgatcatgtcaattgtcagtgagtatatagtgtgtccagagttggttccttccagtgggttcgtgatcttgccgacttcaagaatggagccatggaccttcgcagtgagcgttatagctcttcaagatggcacgaacccaaagagagagcagcaacaagatttattgtgaaggtcgaaagaacacagcttccacagcatggaaggggacatgagcgggttgccactgctggctggggtggccagcttttattaccttatttgtcccctcccatgttccatttttgtcctatcagagtgccctttttccaatcctccctgcaattgactgcttttaggatcgtgcttattgttgcattttacagagcactgattggtgcattttacaatcctcttgctagctacatagcgctgattggggcgtttttacagagcactgattggtgcactttggaagatagttgtgtagttttctgcaaagctacatgaagtcttatcatacgatccaattatcactttctagttatttactaaactgatttgaaaatatatagccacataaaatgtttatagcagttttattaataacttccttaaactggaagcaaccaagatgtccttcagtaggtgaatagacaagcaaattgtggtatatccatagagtagaatacttcaacttaaaatgaatgagctattaagccatacaaaatatcgattaatacattttgctaagtgagccaaaccagtccaaaatggtgacaggtaaaactatagagatagtaaagaaatcagtggttatatggggtttagtggagaggagaacgttgaatagatgaagcccacaaggttttagggcagtgaaactttaccttatgatactgtaatgggatatatatatagttgtgggataccaggatggaatgcaggctgtaacataagactctgtattacaaattcaggaaacaatctcattaaagggagtagggtgagcagaaggggctgccataagtaactttggaaatgaatgttgtctctaaaactaaaagcaaaggaaatttcacataaatactatactatagttgataaagttgtctgtcactgtcacagccaagaggagcctacagagacatgataatgaaaaacggtattctggatgtgatagtagaataaagaaataacattaggtaaaaattaaataaatcccagtaagcatgcactttagttaataaaagagaaagaaatatttgatttgctaaaaatcccaaagctgaaagatggcagttggaagatggttggtgactagttcccctgtctagttcctttgcctttgagtccagtggtcttcctactatgaggaaagaggtctcatcagcatgcattggacaatgactcatttctacatcgttgacatgtgccaatagttgaggaactaaaagcctcttattgacaagggccagattattcaactagattatgtcacatttatcctctactccctgttgtgagtgaactactatactgggttctgagaatttttgaaagatttttcaaaaagtgactaattttcttaaaatatacattaatagtttataaattgtatggactgacataacttttgaaaccagcatagctagaaaattgaattaaagagaaatttcaagtattcttgataagaggtaaagtgcacataaaatactgtgatgcttataatcaccaaataaatatgctccagggtgaaacattaccttgtgtaagctgtcacagaatttgcgtggaggtatttcagatacccaccacaatttcagttattcaaatggcctactcaattctgccgatgtttactggatagaatcatggcatcatacaatatttggctcctctcattggcctgcttatgtgccatttaagaccatgggccagttggctttatttctcatctctgcaggctcctatagtggcctgagaatgtttagataactataatatccacagcaatgcaaaatagcttgcagtttgtgagaccaaatccaaagccactgccatgtctagaaacacagaaataaaagaatatggctctattccagtccctcatcatgcatcaatgtactcagggtgttattggctcagtttggatctctggaacttctaaagctgacagaggagtagtatttattatttttaaaaggtgtgagaacattagaggatctgattaatgttttggatgctcttttcagaaaaaaataatgcacagacacattctattttcacttgatttcatgatgctttctctgatcccactaaagcccatggatagcagttaatgtcaccagtttttgaggttattcagaaattcctctgtaccagctctgatttagaggaaagagtgggctcctgtgaacttcctgcacatgttgtgcattcagcttatgtttccaaaccagagtagtgggaaggaaatgataagctctgctgaagcacacacagtatatatagcatcaatccgaagccatctgaaatgttgtaatatagccaccatttcaggcctctagtaatgatggaagcattgcttccctaaacctctttatgaaagatttttatttctccagaagtttttgagaaatattacttagtcaaacgatttaggtgtcctttcctttcaataagtgaggagataggggaagagagagaaaaataaaatttgaataaatcccaaatttataaattcattctgtgtggatttcatggagtaataagttattgatgcaaatattgatatgggcatcacatgaagattttcagtggattatattcatttctgtcaacgaataaaatacagtgaaataaggcttgtatcttttgctgagtacttgcaataacctacattcatttttattactgaaaacctacttgctaaaaatgagaccccccgaaggtgcataattattattaactacaaagcaaaaacttagtacattatttgacatctacttttttccacattttatttttatagtctccaggataattgtgaaaaaacagattcaaaacatatctaagccaactatgaaagtaatttacttactttatggcatgctcattcattttccacagtatttctcatcttgttattgatataactttttataacttatttgatttatatactttattattttatgaaataaataatattttatattaatccatcatgtatttattgttatgattatgggggattttaatcagttttgttcactgataaatcacaagtgtctagacagtactttgtgcatagaaggcactcagtatatatttgctcaatgaatacatcatttttttcatctttgtttctctcattttctgggggggagggggaaaattggttgtgctctggataaaagtgagttattatattagacatacaattccaggatctttgtaaaattgaagctttagagtctaccttaaattttaaacacactaatttttcaaataaccaagggctgaggttcttttcatttctagaagcatctatccaagatatctgcttcatcttctataacgatatgttatgaatatattttcttctacataaatgctttaaagaagtcttcacactcacagttttctttccatggagtagcaaaaatattctactcagagtacgccctgaatcagttaaactaataatctattttgagttcctgacaaaggttattaaattctggcctcagtacctccataatggttacctgatctattccctcttcccattttcactgccaacatcttcatattcccattatttgtcatttaaagtactgtatgtggccctctggcttcttgagtgcaggtttgagggtctacgtcttgcactgcctgccgcctctatctccctcatctccagttttatttccagtacttccacgtacatgctgcaagctatcttcttgaaccacggtactcatcatcctatactgctcaaaaaccagctggggagaaaggtttaagagcgggtgtaaaccttatctctgtgggaagattttctcagatttaccttcctcagctctgtttctttggaaatgtaggaaaaggaaactgtgttactaggcatcattgcttattaactctgactggaggactgcatctgtactgggaggaccctgaatggatatatagaccctgaaggtccatatgataaaactctataaaaacatgcagtaaatgagaagccttaacctcactgtttggtgcttcttggaaaaagcatggcccctgagcaggtctgtcagctcctctcacgggctgtcatatatgagccttgcctaggctgaagtgaccatcatgtactcatggggtcccaacccttaaaactgagcatgccccttgtgctgcctggggagcagtgccaagatggcagtaagaactccagaggaaaatgtatttgagaaaatcacgctgacatgctctctttccaatcttatatccttcctcacagctaaataaacctagcgcacattacagctaatggtgctctacgaacatgaaggtcaatttgaaaccaagaccattgctgtatttgtagagtagatgttgcagcaccaatgattctttcattgcttagccatatagcttggtacacactatgtacaacctgacttcaacattatttcccttttccttgcaaaacaaaatctgatgtccatagctgaaggtaaaacacattacatccggagacttactacagacaccaaacaaattgtggttcgaataaaacttcacgttcattttatttatttcccactccttatacatagtgcttgataaaatgttatgtaacaattatgtgaatgaattatcaacctagcaatacctgtagctttttttgtaatactttatcatcctttgcctgctcacccctttctcccattatccctaacatccacatctaaacatgttacttttctgtaaaatgtatcagagatttcacatatttccagtaattcatgcaaatgtactctagcttcctaacttgtggttctcaaaattcatttgcttaagattcacttgtgaagcttttagaaatgtacttttcaaatttacctctagagattctaaaattagagctagattagggctcagaatctgtatttaaacactgtgtttggagtatttattactttttttaacttttaggttcagaggtatatgtgcaggtttattatacagataagttgcatgtcactggggtttggtgtacagattattttgctatccaggtaataagcatagtatccaataggtaatttttcaatcttcaccgtcctccgttcctcctctctcaagtaggcacccatgtctgttgttcccttctttgtgtccatatgtactcaatatttagctcccacttaataagtaagaacctttggtatttgtttttctgttctcaagttagttcacttaggataatggccttcagctccaaccatgttgctgcaaaggacatgatctctctttttttttttttaaaaggttgcacagtggaatcggcatttttaaatagccttctctgttcattctggttttggtaatccacctaccataatgttagtattactatactctaagtaacttgtggacaccacattcatatttgtatctcctctacactttaaaaatagtaattgatatatgtaaattctcaattttgattggaatgaattatctacagacaagtggctggagatggaataattccaaggaccctgagaaatattagaaaataacttagtaactccaaaataagaaagaaaaaaaatctttaaacatacatacatttctaaatataatcaaatatcttataccaataattatgcaaaatcatagatctcagggttagaaagaacccacctagggccgggcacagtggcttacgcatgtaatcccagcactttgggaggctgaggtgggcagattgcgaggtcagaagttcgagaccagcctaaccaacatggtgaaaccccatctcttccaaaaaaaaaaaaaaaaaattagctgggtgtggtggtgtgcccctataatcccagctactcaggaggctgaggaaggagaattgcttgaacctgggaggtggagctcgtagtgagccaagatcatgccactgcactccagcctgggcgacagaccaagactccatctaaaaaaaaaaaaaaaaaaaaaaaagaaagaacccacccatataatcctatgtagccctctactcattgttggcatcattaaatatcccaatcagggggtgtttggtcatctagtctctccttcacttttcagacagtgagttaatcattatttaccaacttcataaaataacctgtataacaaatctccacagttctcttctgattgctgtttcaaaatgtgcctcctaggaatttatattcaatgtttcctattctttcttctgtgaaatgtctgcttcctctttcaggtgataattcttcaaatattttagagattgttttagtgttttccccctacacatttcctcctaacaacattaaatataagacatggttttcagactcctcaccatctggttgccttcttctgaaacttttctggttgaacattatccagcttaaatctactttcaatcgttaacatgagtagaacttttttttctttttcttttttttgggttgaaatttaaacaattatgtgcacataactttcagatctttgtcctttacacctgggtgtacctgtattttaaaacttaaaatgtcctcttaagagaccaaattcttttattgctatccctccctctaagctgatttcaaatacccattctgggaaggtaaaaatggtactggcaagcttccgaactccatgtttccaggttaaggttgtgcctgactgtctaatctaggctgatctgatccagacgggcgtgccattgcagctattctgatggctttactcttccagatggcaaattcactgttggccacgtatgcagggatttcattaaaagaaatggtaatacgctttttaaactaaaatatgtattggcaggaatgaaatcccgaggccacccctgggttgttgtgtttttgttgctgtatttttcccctcccctgaagcatccaggcaggaggcactccagaatcaagaccctttgtttttcacatggctctttttcaccatgccactgcactgccacatgtttgagtgtgggcatcaaggatagagatttggattttaattcaggccctgctgctaattctatgatattgaattaaatatggtaccttgaaactaaccctgatttctctcacttcagttgtttcatctgttaaaccccaagatctttcacagctgtaaatcttcgtgctagtcattctgcgagttggctttggatacattaaggttcgttttcctcacctttgtgatgtatactcagcaaatgcaaagtcattctgaaatctactgcaaaataggtctattgtcaccgaccctaaaggatatgaagtgcacatagttagatgtttgctatgaataattgtcagcaaatacatgaataaaacttcagagtatccaaggtaattaaatcttgcttttttttttttttttccagcttggtatgtacaaccccttcccaacacatgtcactgtcaaatgtgtggacagaataaacaaggaattttgtaacagcagagaacataacttaagagacaacaaacacaaatagagaagaaggggaaaattccactaatggtctaagtaaaacctaaatgcaaagagaacagcatacatttaaatgataagtgaaggaagctctctgtaacagcctgacagcatatcctctaaaggaaactagctacaaatcatcaccattatagctggtagcacagagtagcaaaacagttcacactaaaggaaaatcagacaggagcaggcaaacccaaaatagaaatagaaataatgacaatttcaccagaggacaaaatgctgtatctcctttattagactaaatgtgaaatgttaacactgtatgcagagtacatgtgatagggaggcattggtattcaaaccacttgtcattgctacactgtaatccaatcatgacacaaggagaaaagtagagaaattagaaatgcattagaagaaacaagaaaattgggaatgtgaagggtgacaagcttaaactgcttaaactcctagccctggcctcgcagaagactcatatttatttgaaaccattaagaaacatgttctacatgcaaataacagtacagttaacataaaaggctttgccttatctcaatataaaatgctagataaaatccattatcacacacattgtatatatttcaaaaaatgaaaataactccctttcttttctttatagggactcctactccttagctagggaggcaaagagaagtgataaaatactattttatgctcttgaccattaaaaagctaccattttgaaaattaaatttctggcaagctagacatactgagacatacagttattggtatgaatattctaaaaacattacgtaaatattggaacaaatacatctgataattaaaataaattatgaccatatatttgtttcttgcctactctcaggaacaattatctcttattttaagagactgtaggtacatcatttgagtaaattataatatttcttaatttataacacccaaataacttgtatggaatatctactaagaatatttctctttctcctttttttaaacctgctatttccatcttatagttaaggcataaggataaataagcatgcttctagataattctttgaaataaatattaattcttaaattcacagacattattttaaatattatgaagttaataactttcaaaataatactactgtaatatagcagtgtgcttgttcaagattctgatacacatcaataattagttacctagatattgaagactttgttttaaagattataatcaattataaagaaaaaggcaatgggggttacaattggactgaacgcttgtatcccctccaattttgtatgttgatatcctaacccctagtgtgatgatactaggaggtggagcgtttgggaggcaattaggtcatgaaggtggagcccacgtaactggaattagtgccctaataaaagagaccttcacagttctcttgctgtctttctacaaagtgagtagacagccttctgccagccaagagagggccctcaccgcaacctgaccatgctagggccctgatctgagactttcagccttcataactataagaaagaaatttctgttgtttatgaaccacccagtctatggtgctttgtgatagcaccccaagcaatgggtaaagtaagacaggggtgttattatatttttgatataaggaaatagcattggttttcacgttttggtgttgcaaatagatggagtttctaaatccaccaattttattcgggttttaaattttttcttagtcatgaaaatagctgagtgcttattaatcatttgattacggtatgatgcagtcatacacctctcatctgatcatttacagcataatacagtcataaccagtgttttgtaattaactaaaaaatttacacttaggccacagagagatttaggagaagctaagtttattctactttaattggactgaatataagggttatacctcattaaaatatcaacaataaatctgtgtgtaggtgacttggtttggaagatgcaaatgtgttggctccatacaaaatgaacctcttcattataatccaaaattcaatgatagcacagatcttctaagcaatttcacaaatctactttcctggaatcaattactgaattaagttagaataataaacgttaaaggatgcaaacatagtgtttgattgattagttggtacaggtttagaattatctctcatcacctttttcacacttatcaaatgaattgacacatttgacctgtgacttggggatgtcccaaacacggtcaagatgtacagcatatcataagagcaatcatcctacataagagttgctgctttgacattgacaaggcgtgtgcactgattatgctgtaggatgtggatgtactgatttatgtatatggctacaggatttgacagcaaacaattctatcaactggaaattagcaagtactgtgaattacaaattacaagacagaaaaagaaagagagggaaaggcagagaggtgaagttatgtagaaacttcatatgcatctcaagtttgagcatttgagaagttataaggccaaaaagtaactcaaaaatgatgcctgatccctagtagtgcacttaaatacatgaacttaagaacagctgacaaactaaatatgttgcttcatgtttattaaatgatgagagagagagtattttattaaagaagggaatctgtactaggaaggaaagcacacccctttcttctactcctcctacacacacacacacacacacacacacaaacacacacacacacacacacacaccctagatttattttggggttgtcaatggtaaaactccattatttgtttacattgatgattattcaaaaggaaactaaacgacagttcttactttaagaaaacaacagccacaacaaagactcaaaagtcaacattaaagactttctccctctttaattttcttatttgattttttgaacctatataaataaatcccatatctataatgcatttttccttcttctctctgcttctttatttatgatgatattctataccctataaaatataccctatccttaaagatttccctgaccctcttagtccccagaaattgttctcttattatttcttatgatagagcctatctaactcactcatacatgatatcttacagtaatagcttgtctttttacatcatattaaattcggtctccatttggattagaagtccttttataagcagttgcctagtcttataagtcttaagcattctcaatgcctatgtaggttttcatatacacagattagattttcaaaatgtggctgtatgaaaagggcatgacatgatacacaatgcttgttgtaaagagaaatagatatacttctgaatcatttgcttctcaaagcctggataaacagttagtgagctaatttttatcagcaaattcatgtctataaaacacattttaataaaagcataaagttttaatgagaacttaatatataaatgcaaattcaggttatttaacagtggaagatgacacaatagaagaagccctcacagccaacagtaatctacagtcatctagagcagtggttaccaatctttttggcaccagagatgagctttgtggaagataattttttctatggtaggagtcgggggtggatgaggatcatcaggctttagattctcataaggagcacgcgacctagatccctcacatgtgcagtttacaatagagttcatgcttccttgataatctaatgccacagctgatctgataggaggtggagctcaagcaataatgctcacctcttgctatttggcccagttcctaacagaccagtccctgtctgcactagtccacagcactggagttggggacacctgaatagagaactaggctcaaggtcatacttggtcacttaatgaccatgtgactttagatagatcatttaaacttcctaaaatctcctaagcctctatatcccaattttagaaacacagttaataataggcattgtaactatctcctaggttataagtactaagtgacataagttaaaatagtaatacattataatgttccacaatattttaagtgttgttttgttagaaaaaatgatgagtgattatatgagctataatatttgtatgcatagctatcttttctgaagtacagaaagcatattttaaaattttgtttctccaaagataatataaatccttctgtaatgttagttactatgttggaaatctatagctaactttcaaataatgaggtacgccaaactgtatatctgttaaattgtgagaagaactgaagaaaatataggaatctatactatgaataaaatgatagaagggaaaaaataaaatccatgattaaaccagtttttgtttatcatatattatttataactatgccagaattgtaacccactcacacattattctgcatgagtagctatggcagtgtttactggagttcttagatattgatattaatttccttataagtgtcactagttggaaagaacacttgattattgcatttgggagtcaacaaacactttctgtaaaagtttaaataatatttttttttaggttttacaagacacacaacttcgcaactctgccttgtggtgtgaaaatagccttagataatatgtaaaacatcagtcatggttgtgtttacatctttatttacaaaattcaatagtagaccaaatttagttcacaagctgtagtttcctggttcctatttagttcaacacagcatgcttagaacataatacataaatcttacagaaaccctagcatacatagaagatctcaataggagtctcaactctcgtagataaaaacacacaggatgatagcatgaaggtgcacagatataaaccatatcatgatttgaagtagtccagagaaataaatatcaatgtcttttaaagtaaaggatgtcctctgggtgtgtagtatggtgggctggtacatgaacattcattaggaatggttacaaaatatttgaatttctccttcattctcttttaatatttctatttgtgtaagtaaaataatgtaaaaaccatttagtacagtattatatgcataatatttgtgtaatttataaataagtatataccaattttgacaacacgccttctcaactgacgtggcgagaattttttaaaaaactacatcagtggggccaagataaccgattatttttaagttcctgattaacattgacatcatggtgaacctggccaaaataattttgaatataagaggtaataaatttatttataactgctggagatatttttaagcaataggaatagctttcaggatcctaaacctgtgacagaaagattgagttcttcactgagaaaccttgtttctgttggtcatttcatctttttgtgttgagaaataagactccagccagcacaatatgtcataagagatgtaagtggaaaagggaaagagatgctggtcataagctaaatctcaggaaatgagacacagagaagaaaagtgagagactcaggaagaatactggcgcctgcctgtgcatgcctcccatcaccatcacacacattcatagacacatacatgacacacacacacacgcacaaaggcaaagatggctatttgcttagcaacaactccccaggtgaaacacaagtaggtgaaaccatcattttgccatttatttttcaggtaaaacattctgcctcatcagtttccttagaggtcacctgtaacgttggtaaatgtttttcagtatatttcagggcagtgtgatgaactgccaaccctactctatgaaagtctctgatccatgaaatctaatatgatatgaggctaaatagataaaaacaacataaaatcctagcagtatattaagcaaccagtggtggtgcaatttaatgactatatgaccaattcaattcaatatatagaaattagttgcgaggataactgaaaaacactttaaaaatgatctgactataaatgtgtaagaattgataaaggttttagcatattgggggcacgtaatgagggctaaaaatgggtgtatttcatagtgaaaatgcaaagtctaatagtaaaaatcctaaatatatcatttgtgtaacagcgctgtagacttatttgcaattttagatgtgatcctccataaaaaatagtatacgactgatcccccatcagtactatgctgtctgggagtctgtttccttacagtgccgtaaaatttatcaacagtagaacaacccaactatcctctccttttcagccactgtgattgctactgaaggaaaatttcccataatatggagctcagtcccttaagtcctagttcaaactattgcctgtctcagtggtatgaagtggaaagcgaatctatttcacattagataggtctgtgcttgacttgaaatctctgtccctttctagctgttataaacttggacaaatacttttaatgctgtgatcctcattttaggcaagcaaagtgttccttcctgattgtgaggattaaggttaagttcaagtgtgcaggtcctatgtctaattatataggcaatgctgaaaggatcaactgcagccctaggaagagctccctaatccattcattattatatcttgtttaagataaatgaaacaaaaatgcaaacacaacttcgctgttgcaacttttctttcataatttgctttcatttcaggagatgagttcaaatctctgctccactatttacaatttaaatgccttttgtgtatatgtgcatccatctataaaactgatctatacaatttaatgaattaatacacataaaaagtttatagcagtctccacttttaggaaatattaagactgtgattttggacttccaaaaggactcaaacttaatttaggattcagcaatatcatttgctgacgattgaactaatctgctataagccttttacaaatttctgggataaatatttttaagaaaagaaaacaaaaaacaaagaatcaaacaatgcttgatttttctcaaatatgttttagagtttttttttttttagaaactgaaaagtagtatgtaatatgtataataaagacttcgcaaaaagttacacttttcttaaactaaactttatacatacacatatgcatattgcactcattttatatttaaaattcttctcccaaatggaaatgctcatcttcactttggcacaaagatagcattaggactcaattttaagccactaaaattttgaatttacataaaagtaatacctacaagtattattactagatgttccaataatgctaagtatgtttttacactatctattgaagatgtgggcaacttctgttctcaatattgatccttcagagtgtagtttatccattatatcactacaactacagcctcctatcaaacccgagcaaagtgttctcaggcagagtgggaccaggaagaaatctggtaacactaagagactaatattataataactgatcttccggagtgctatgagaactctccaaaacatcccttcacagagcacccaaaggaaattaagcattcatcttgctttgaaggtggaaccgggtgattcaatgttttataactgaatatactaatagaatatgagtgcttaatattgcaacaattattatgggaagcacttggcaccactatacaaacaaaaagacatttactgtgagggaaaatagaaagtatcacggtaacttctttatctaaaagtgtaaacttgtccttatggaaagtttatatgattcaatgtaatacttctcatgtaagcataatcattttgcagactactaatacagggtctagtttttggcaaagcataaatttttcccaagatgaaatcaagcatatttcatgtatgtgtcctaatatgcttgcaatacttagcatgaattactttatgacagtacaacttcaacttcttatttatgtattcatccattcacgaatttacttattcaactaatatttattgtctagtttgtagtaagaaaaaacattattagcaaacttgctgttagagacagccatctttttctattgcaatagcatcaggctagattatatcttcatgacaatccacaaaatgaactttatacctaccaaagtgtattgtaccagtaggaaatttcttctttacctaaacaccatggcttttcataggaaaatgtaattggaatttccagctgtgctgaaagaactgaatatgcctctattagaaacaattcttcaatatataagactttcatgtctatggaccccaagtacacatcttctgacttatgatcagataataggacaaatgatttagtgttaggatcctcttagaaaattcaagatatacactcttcaagtataaagatgaagaaaggcagatatgagtcctatagtttattagtctcttttctgtctatatggaagaaggtgatgctaggtccatttcatcttcaggaagataaaggaactggagttttactgaacacaaaatgtctgcaatgtgggggcagtagtcaagtattactgacgtttagcaaaactaatcagtctctctttattttagtttccttgtttataaaatagacagaaacatgtttcctatctacatctttggatgttatcagtctggtgtaatatacataagctggccagcataatagctaatcacaaaatatactcactaaagtttagctatgaatggatatcgtatttctttgttgggtgatggaaaaattctggaatttttggggtgatggaaatattctggtggtgatggctgcacagccttctgaatatactactaacaatagattgtatgttttaaagtggtgaatttaggggccaagagaaaaggaccaattgaggctaggaatcagagacaagcttgaacccatcagagacaagaccccatctctataaagatttaaaaaattagccaggcatcatggtgcccatgtagtcccagctacttaggaggctgaggtggaaggattgcttaagcctaggagtttgaggttgcagtgagctatgatagtgccaagcatcacagcctgggtgacagaatgagaatcagtctcaaaataaataaataaataaataaataaataaatagaaataaaatgatgaatttcattttatgcaaaattttgtttattatatcccaagtaaaaataaaaaatgtttagttatgatagtatttatgataatacaagttagtaatgcaaaagatcttgtatatggaatagacttattttgccttctttttgttttaaaaaagtatggcatgtaaaaaaatgttctgacacagtaatggctatcataagattgaattattgtagtaataccataaaatgtaataatggtgagtgggattagcaacaggaaggattagaagaatgtcataataatgttgaggtaaactgagttaaaaagatttgctgtgatttcatgatcatgatctaggtgattaagtatacctgcatattgctaaaagtaggcaatactgaagagtcatacaacagaataaggtataacttccaagccaattgaactactatttaaaaagtcaccattgagaagttagtaatttaaataattcccaatatctggaattcagattgtactctggccaaattctaacttctctacatatattaaatgaactaggtgacgggcatcggggcaaccagaaaacttgtaaaatcttttagttcaagggtagaaccatcagacacctgactgtgtgagctactaaccttctgattcaaatgtatgatgtaattaaaaatatcctgggaaagcatttagaatttaaggtgattaatgaaatagtctattatttagatctatttttcataaggcaagatattccaacacatgcagagagtgaaggacactatctacaagactgtataagaaattgcttgattgctttatctgggaattatggacagttcaaaatatacttctcactaaaactaagcatatccatatagcatagcaggaatttccatcccagtaactgttatttcactttttaaaatctgcttattactttccatatttaaaacattttagggttgttctaaacaacagtgtcaaaaatctaaatttgactgacttatgatttagtgtttattcattctactatcaagaacctgagacaatgtggaattagccagactagcttattcaccaagtaccttagtcattcagtagaatttgatcatcaaaatatagaattataattattcaggtctcaaacactgcagtgagggacgtatattgattcatggcaattcttaaagggcaaaatctgcaatggtaattctttaaaacctctgggaaaaataaagccattcaccatgattttaacaactttattttggttgattttagtcaaatattttcatttgatacatatttttaatgtattttaatgtattttatggtaaagggcaaaatactcacttgcagcccaaaagattaaagtatacataaataaaaaaaccaccaactaagaaccagaataaataaagtaaatgattttttttaatgtagaaagcaggatttatcatgctacatttagttgaatctagtatgcaaacttatttacatgttaactcagaaatagaatagcatattacaatcaatgacatattttgatcggcagcatttttcttagtgaactataaaatattagtgtatcaatcaccatgtaatatcttaaacggtaacttttgtcttacaaaaatctacaccaaaggacatttgtgtatataaatgaaatatacacacacacacacacacacacacacacacacacacacacatgcatgtggtagagtaactgtccagaggcaaatgttgcctcattttccatttctgacattagtcgctgctgtcatacatcatttccataattatacctggtatatgtaaaacaaataatggcagagcttgacttcttaacaggaaaaaattaatgagcaattttaaaaatgcatagattataaaatatgtaagatttgaactggaatttagaaattatcagaggtattcaagtactagtattaattatggcataatttgagataatcttttaactctcttctttcataaaataatcatttatgtctctctggcaagattgggatgtcccaatagtaaaaggagaattatttgaaaatgtatcattgagaagagttaattatttttgttactatatttaaaatacatccctctactgaccaattcattactgaactatccagtactgaaaactgatttttaaattgttctgaaaatattagcaagtagagttatatgtcaaaaatataaaaatatacatttcaaatgagattataaatactacttcctaaaatagaaattttaaatatttgttcctttggattggtatcacaaagtcttaagtctaaacattttcaagttagttcaaaataattgttgtttggaattgtcaactgcatgtcaattaaacgacaggaaatgtttccccaaataatacatttttagaatcttgatttggacattttcttgcaaaggttagaaagcagggtcatttattaataagactgttacagatcatgattgcaaatccatatattcttcataaataagaatatgtatctcatttttcttagaagcaaggcaggcatccagtttattaaaaaatagcatcatcattaagaaacaagttcaaaagaagttggttaccagaacctgtcctttttctctcccggaaattattaatggatcctttaaaggacgactccagatgacctcggcttcagagtagtagtacagtacaaggtgtgtatgagcatagataacttagggtttataatgagattgtacattttggcctacacttgactcctgtccacaagcttaaaaatgaaggaagtaatgattaaaggaagaaaccatataatgtattttctgccagagttccatgcaacgaggtaaaaagttgacagtagaacttaagggaatagctgtgtctaccaaaccacctatgcctcatgtaaatattgacctaagaaacactagcttgctgtgtgtcaagcaataaataagcacacatttctgagcaaaatgcccatttagatatataattgcagatatgcttctgttattccttaataaattttaggtatcatacatataagcactgaattcagaaaaggtgataatgcctaacttgacagaacattgtagaccaatccattaattatacagctgcccccaaacactcctctaaaagcatcactgatgtgatatttctgctgagaaaatttggaaatggtttaagtcatattatattatggtcaaaattacctgtaatcattatttgccaaaatgtgtcctacaaaaactgcaaattttaaattttgtataaaatattacattattcctttcaaaatacaatgccactttcaacagaaatagaaaaatgaaattattctaaaattcaaaaaagagcccaaatagccaagtcaatcctatgcaaaaagaacaaacccgaggcatcatattacctgattttacactatactataaagatatagtaaccaaaacagcatagtattggtacaaaagcacacatacagaccaacagaacagactagagagcccagcaataaagtcacatacctacaaccacctgatctgcaacaaagttgacaaaataagcaatgggaaaaagactccctattcaattaatggtgctgggataactggcccgccatatacagacgaatgaaactggactcctgccttttaccatgtacaaaaattaactcaagatagactgaagatttagatgtaaaacttcaaactgtaaaaattctagaagaaaacctaggacatacctgtctcaacattggctttggcaaataatttatgatcaagtccccaaaagcaattgcaacaaaaacaaaaattgaaaaataggatctaattaaactaaagcccttctgcacacgaaaagaaaaggaaaagagtaaacagaaaacctacaaaatgagagaaaatataagcaaactatgcatcaagaaaagtctaaaatctggaatctacaagaaacttaaatcaacaagcaaaattaaataatcaaattaaaaaatgagtaaaagacaggaacagacacatttcataagatgacatacaaatggccaacaaacatgaaaaaaatcctcatcatgatgaattatcagagaaatgcaaatcaaactcacaatgcgacagtttcttatactaccagtcagaatggcgattcctaaaaagtccaaaattgatagatcctggcatggcagcagaaaaacgggaatgcttatactctgttggtgggaatccaaattagttcagccactatggaaaactgtttggagatttcgcaaagaacttaaaagtactttttgacctagtaatcccattactgggtatatatccaaaggaaaatacattgttctatcaaaaagacatatgtattcataagttcattacaacaccatttacaataacaaacacatggaatcaacccaggtgcccatctatggtggatcggataaacaaaatttgatacatcttggaatactatgcagccataaaaagaacaaaatcgtgtcctttgcagtaacatggatgcagctggagaccattaccataagcaaattaatgcagcaacagaaaaataaatactgcatgttctcacttgtaaatgggagctaaacattgagtatgcatgaatataaagataggaacagtagacacgggggactactagagcagggagagagaagtggatgagtgggctaaaaaatccctatagggtactatgctcactacctgggtgataggatcatctgtaccccaaaacctcagcatcatgcaatatatccacataacaaatctgcacatgtacctgttgaatccaaaatcaacgttaaaaataaaataaaataaaatatatgtttaaagcttccagaattgtaggattagctgaccgctgtcttggttttaatattttactctgtctatcctcctatttatcctatttatttaaaataatttttccttctttctttatatataaatattcatagtaaattccaacccctaagagacctattatgatggctttaatgtaaaattactcacaagtcagagtcactggatgttgaatgagaagagaatgtccttaatataaatttgacatgattttccagattcatagagccacttgaagaaaaggcattgaaaatcaattccatgctccttctttcctaaacaatcatttatgtcttaattaatagatctaagaaaccagagcaacattaaaatcattagaaataaataaacaacagtatggttttttttttctttctttcttttttttttttttttctgaaatggggcagagtaactgttcagagaaacccgttatcttatttcccatttcggacattacccacatctgtcatatggagacatagcatatctataatcatgtttagtttatgtaaaacaagatgctgcagagcttgacttctcaacaggaattgaagtaaggaattaaaataatggctctcatggcaaaatactgctgtgatgacagtaagctaattttccaggcctaagaatttcaaaaaatgttttgacaaccaacagtgaaaagctttcatccttgtttcactcttacactaagtgccaggtttttatgcattagtaatcgtggactacttcaaaagcaagaatattagcattactgatttgttttccattctcacataaaggtttctcacactttaaaatgtcctatatgctgttttaggattcattacaataataataaacttctaagcggggtattacaaccttaaggtgtcagcatagaatttttttaaaaaatagaaaactatgcacaattttcaaagaggaaagaggcataggtgagatattttgtcattttgctgttcaaaaaaaaatcctgtatatatgaagtctcacaatgatacctcaaatagtagagaaattctttcactttaatggatttaactttatatattctctttcttttttcaatgctaaatctgaaaaacacagttaaatataaataagataaaagtacccaatatcccatagatggagcataatatagactacttcattactttttccaggagtctggaaatgcctgtcaggaatccatagttgttccatattttacttcagaatctatgaatgcattatccacaacatacctgcatgtcatctctgatactgacaatgcaacattacagaaaatagatcagccctactgacatgaatgcagtcttatcccttctgattactcataatcaacaactgcatttcaatacagaagactagacagtggtgccttctctatataccagacagcgtgaataacaaacatgatatttgataaaataatgaagactgagataatatgcatagattttattaacctaatgcacaaaacatatcaatattaatctgaaacagttaaacttcaaagtcattatgtgttacatgataattagccataattactctttacatgagttattatcaatggcattaatttatacaaccaaaatgcatcctacttcatggataaatacatgtatacataatagtttgaatgatttaaactgccattatctctatctacccagacctctgacattgaatatattaaagcacaagggtcatatgtactttttcctattaaaaagtcagtggttctcttgccattatatccaatctctcatgcttaggtgttgacattgctggggtgaactcatctgttcccattctatgtgaattctgtatattcctttgccctatatccacatctgaggagactttgaaacacaactaatattcagtaggcttaccgcattagagtttggattgaccattctgattacatacgagcgtaaacaccatcttgaacaatggaggaaatatcatacaggcaataatgttatttcttctacggtacactactagaattgggcactggtctgacatatagaacaggaaaagttactaagatataaattgagatacatatctgcaattctctttcatagctatcttttaaaactgaatctgtagaacaaccaaagtggtgtgaaacattctctatacatcaccccttttatctaactggctgacagaaactgtttaaaaaatgctacttctccacatcgtctccagcacctgttgtttcctgactttttaatgatcgccattctaactggcgtgagatggtatctcattgtggttttgatttgcatttctctgatggccagtgatgatgagcattttttcatgtgtcttttggctgcataaatgtcttcttttgagaagtgtctgttcatgtccaatgcccactttttgatggggttttttgtttttttcttgtaaatttgtttgaattcatggtagattctggatattagccctttgtcagatgagtaggttgcaaaaattctctcccattcggtaggttgcctgttcactctgatggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatgcttttaggtctaacactgaagtctttaatccatcttgaattaatttttttaagatgtaaggaagggatccagtttcagctttctacatatggctagccaattttcccagcaccatttattaaatagggaatcctttcctcattgcttgttttggtcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtaacaggatgcctccagctttgttcttttggcttaggattgacttggtaatgcgggctcttttttggttccatatgaactttaaagtagttttttccaattctgtgaagaaagtcattggtagcttgatgaggatggcattgaatctataaattacgttgggcagtatggccattttcacaacattgattcttcctacccatgagcatggaatgttcttccatttgtttgtatcctcttttatttccttgagcagtgttttgtagttctccttgaagaggtccttcacatcccttgtaagttgaattcctaggtattttattctctttgaagcaattgtgaatgggagttcactcatgatttggctctctgtttgtctgttattggtgtataagaacgcttgtgatttttgcacattgattttgtatcctgagactttgctgaagttgcttatcagcttaaggagattttgggctgagacgatggggttttctagatatacaatcatgtcgtctgcaaacagggacaatttgacttcctcttttcctaattgaatgccctttatttccttctcctgcctgattgccctggccagaacttccaacactatgttgaataggagtggtgagagagggcatccctgtgttgtgccagttttcaaagggaatgcttccagcttttgtccattcagtatgatattggctgtaggaacactttcacactgttggcgagactgcaaactagttcaaccattgtggaagtcggtgtagcgattcctcagggatctagaacttgaaataccatttgacccagccatcccattacggggtacatacccaaaggattataaatcatgctgctataaagacacatgcacacgtatgtttattgcggcactattcacaatagcaaagacttggaaccaatccaaatgtccaacaatgatagactggattaagaaaatgtggcatatatacaccatggaatactatggagccataaaaaatgatgagttcatgtcctttgtagggacatggatgaagctggaaaccgtcattctcagcaaactatcgcaaggacaaaaaaccaaacaccgcgtgttctcactcacaggtgggaattgaacaatgagaacacatggacacaggaaggggaacatcacacaccagggatggttgtggggttgggggaggggggagggatagcattaggagatatacctaatgctaaatgacgagttaatgtgtgcagcacaccaacatggcacatgtatacgtatgtaacaaacctgcacgttgtgcacatgtaccctaaaacttaaagtataataataataaaataaaataaaaataaaaataaaaaatgctacttctttcctacttgagcgcacactctcatatttcagtggaaagaggtagaggtatctttctgagccatatttttctcagactagcagagtaaaagagcagaacacagttttgtttttggagaaaaacattagttacttcaagtaactttcctacttcagtcagtttttaatgttctaaattcaagcctttagaatgtccaagagctgacctattatcctaactttatggatgaagaaactgcacataaaaccagttgaatggcaaagacatgcaggtggttaactgcggtactggaatttgaaatctgaactctgttcatatgattaaagatcactgcacttcaccatttcagttcccagtatacaatatttttctcatttctacaggttaaaaattggagcaagaagtcaaatagaatttcatagacagcaaaactgaccaaaatagaacaatgggtgtaccctcttttgacaatatcatcttttggaacattctaagctgcgctcagttacagaaatatgtggtagccctgtcataatttcattaataaatgacattgctcttgagttccatagaagctcattgagactagtagtttttgttatggttttaatttcaagattattttttgaaagtcagcataagtgtacttattaagagcctggggtctaaaatcagacttcatgggtacaaacccagaaaaactacattaagagcagtgtgtgaccttcagcaaattacctaacctctctatgattcagtttttttcacctgtaaaatcggaataaaataacatcctccaaaagggttggtgagaatcacatgagttaatataatagagtccattttcctaagcaaattaatgtaggaataaaaattaaatactgcactactatatgagttatagtaaattatacgagttaatatatgtaaattcccagcatatagtaaatacaatttaagtggttgatattattattttctattttgtgaaatttgcaattaactgaattatttgaggtttctgaccatgctatctagaaacaaataaaactttgatgtatttcatattaattattatgctcacttgaaaaggccatcctaagcaatgaggtagcaacaatgaaggccaagttaaaatgatctcacagcccatagagctttttcgctatcatcgtatgttgggtctgctttttttagtaataaaagagtgtggaagtggagcaaacttatcttaaagattcaagtttactaaatcctgattgttaaaagaagattgggtaagattagaaatttaaaaaaaagattcggagacattttatgaaagatagtttagaagaaaaaatggtatcacaactaaactagtataagacatactgcatcctctataatctatgaatgcacattaacattttaaaggatttgaaattcatccagcatatataaacatgtgtgattttataaattcaccttctcccaaatgtatatgtgttttcggtgtgagtatgcatatgggtaaaccttaatgagtaacattattaactgttcttccataggatatgttttgagaaatgcttgtcacctagtttacaccaagtattatttcttagtttagacttaattccacaattgaacagatgggtttttctgaggaatgaggtagaaaaatggtaacagcaacaaactgagaatgtttagtacatagcatttcactaagcactttccatccatctcatttaatagttagaacaatatgaagtctaaataccatattatcctcaatctatagagaaaatttaaatatccatcccaagttcaaatgggtagaaagaagtggaatttgaaccaaagcagtctagttgcaaagcctactctcttagactgatctctattatttctccaggtagagaaggcaattgcaagaatcaaaaatatctgacaaactagacactcggaaatacatttagaaaggaggatgatctcagagccactggaagtcatttacaaagaagtcagcaaccacagggaatatgcaacaatgagaatttcataggagttttattactgtaagactctttttgttattatttatagttttaatactaatggtaacagaaataaaaattttcaaatatatacatgttggagcgttacagattgggaagtaagaagaatgaatatatattgagcacctcgtaagtgtcatgttctgttcctcactgacatgcattgtcttactttacctattgatcctataagctggggacgatcctccttgttttgtagaagagaaaattgaagcttaaatctattaggaaacttgtcaatgaatcaaataataataaagaaacaaatactaaaagagcaggcagcatactgagataacgaaaaaggtcagtgagattattttaacttggtcttcattgttgcttcctcatttccttaggatgggcttttcaagttggcattataattaatattaaataaatattccaaagtttatttgtttctagacagcctggccagaaacctcaaataatttcacttaattgcaagttttacattcagatgggactgactgaaagtttctcctataacacaggtgagaaagtggggcatatgggaaactgcttggctcatgactgagaggaaccccaagaagcagaggaggtgttagcctagaaagcaagtaaaagtagatttactatgggactcgctgaaagtaaggaatgaaggtgtggaaattgatgtaggtgtgaaattttaaaaatgcctcctcaagcagataaaatgcaaaaagtcacccaatttgcagaagcataaattgcaatatgacagtcctttcactgctaatatagtgtcatcctaggatgtagtatcaggtaagtagagtatggctagtttctcaccttccatcctctgctagatacctttgaacagggcacaaacttagcaatgacaagagtgccactggacatgaggagccaacttaaaatttaaaggtgagcccactaaggcttttaccatagaaggatcaccttcaatgatagaaacagttcttacctccatttcagggcatatagtcagctttttccacagatgctttgcacaggtcctattactacacctatacggtatattttaagggtgaaacaaccacatacaaataaaagctaattttatattggaaggtgtattgtgcaatggaaaggtgacctcaactgtactcagtaagagtgatataaaatcataaatcctagccacagctgcggtatattagaggccacacattacatttgtaaacaattgcaaatccattctggggacagtgctgagtgacctggttttaggtgctgtaagggacagcattggaaacatgtatttaaggatacactgctaactccttagctacaagaagaaaagccatatgtcaattggccagccatacacatcccacgttttatagaaattctaaaaaggaggcacatttgtaatttatattttaatgttgattaatcacagatatgttaaatttttacccattttgttttaataaatacaaatgcatataataacatatttgagagcttttataaatcggttgttcccccacattgattacatgaccagttggcttttcatgccttataaaatcactactcattctctctcattttataatatgcattatcttttgagactcacattggatcaagatatttcatctaaaatttgccatagatccttcaatacattctgttgcctggggtattgaatttgatgaaacattcctcctgagtagaaaacaaaaacaactgtaaacaaaaatcaggtacagaaagctccagattattgctagaaggatgtcaatataaaaaaacccactaaacttattattaattttaaaactccctagaactaatgtcaatattattattttgcctattaatctcagataaacaaaacatgtcacaacatctaccatcccttgctggattattattatattacttatattaataaaatactcataaataaaatagtaaaacattcataagattctaatcaaatattgaatttatgcacaattttagcctctggatttcagatattcccctagatatttctcctgaggtgatattgttagtagcactgtctatcacttttgccaattcactctgatatatgtcttcagtttacccaagtgcttcaaaatgagtataaagaaaaattttctatttcataaaaagggttttcaaaattacctttacaaaatatcagaaacattacacttacattctagtcaaattcttacaatggaaaactgctcacaaaatgaaagctatatttttctgataattttcccaatgtatttcacattcattatcataataattacattcatttcttcattcattccttcaatatctcttcttcaaaacacacactttatgccgacttcaggaagaataagagtaggacttaatgtctagaaaccaattaaacatgttaaatttaataatgtaaacaacatgttaaagggattacgaagagctgagggagtcggtctatagacctagtatagctgagggagagaaaatggctgaacaaggagcacgcatcttggaatggttttcaaacaatttttacttacacagcactaatatctgcacatgcttttaattactttatatagcttgtcctttttaagtaaatctggagttcccttttcataactatctatatatttcttgattatcacaattttcttcctaaaaccaggaggtaagatagacattgacaagattattgccattgagttatgacattttaaactgcatattatatatatatatatatttatttaagagcattgcagtaagaaaactttaaaaatgaataaaaaccacattccactatggtttaattagcaaaaaatagtcacaaaagctcaccccaaatatctggagcaaaatggaaactacccaagagtctcattagagaaagggaattatacaatataagccccctaaagccctttgtggttttatggttgtgcttttgtcttaggtttcattttgagactcagtgtgaaggtctgagggttcattgtctctccttgatccctccccaccactgagttctattagatattttctatttcctcccaaatggagctctggagtcttagggatgcttatccttacaggcagcagagtcaggactggtccagacactcttccacaggccaatatatcatgttcttgcttggtgttctcaagaatttagaaaaattaaaagtggagttaaagaatttaatggcttgttgacagcaccattcttcacaatagccaagaagtggaagcaacccaagtgtctatcgatggatgaatggataaacaaaataaataaaatgtggtatatccatacaacggaaaatcattccaccttagaaaggaaggacattctgacacataccaccatgtgtaggaaacttaaggacattatgttaagtgaaataagccagtcacaaaaggacaaatactgttcgattccacttatatgaggtacccagagtagtcaaagtcatagagacagaaagtggaatggtgggtgccaggggctgggagaggagggaaggaggagtgattgtataatgggtacagaatttctgttttacaagacaaaaagagttctggagatggatggtggtgatagttgcacaagaatgtgaatgtacttaatgccacggaactgtatagttacaaatggttaaggtgataaattttatgttatatatatacattttataattaaaaaaagaatttaatggcttgatgaattctttaaaaatatctgttgaacttcctatatacacgaacacacatatgcacacacacataatgcaggtctataataatagaaatcataaattttatctggtatatgacaagttaaaattatatgcaatatgattatgtaactcatagccaaaattatgaaaataactataatgggattgttttgcatagcaattgtgtatattatgtcattacattagaatgcaatttgtaataatattttctttgattgctctcaggtatgctatttaaaagttattttatattaaaacgccagtacttataaaccagcttaatttgtggatttatctgaaaatcattattttaaactcaaagtcaatacagtaaaatggtcaaaattatttgttcaaaaatatttaaaatccaacatgtaggtggagtaatccaagtatttaagaagcaacagctttatactggtccttagcatagacgatgatttgctcctgccttagtctcctgtcgtgtttcctgctacatattccagctactctcatttcttggcagctgtattgtagttttcaacttttcaatgtctttgcacatgctaggctttcacaacacatttttctccctttgtatatctgggaaaagactccaaataatgctttacatttcagtccattaatgcctcctttgggacatctttcctgaactagcctttgtctcattctccataactctgaaatagcattatttacctttggaatgaggactctttgaggatgggaattattatcatttattattttactgattttttttctaatggctactaaagtactctccacattagaaattcaattagtcttgagggattaaaattagtcaacggcccatatttgaaaatcacattaattcatcttgaagtataagttaatatctattattgaagtaattgtctaaccacctagttccttttatggtactgtttttatgattgctgcaacataatttttaataagaatagttaggtagaaaagctacatttagagaggaatgttatttctgcagtggcagtgttttatggcaagtgcatgggattagaaggtaagaaagcatgattcttgcccctccacttttacctctactttctacgaatttctatttccttatctgtgagatgaagcagttcagttagatgacttctcaaatttttgcagctctgtgattctaacaattggtaatttgcccatctctcactccctctgccaacctgaattggaccagtttactattttctaaaaatccaggtttttaataccaaaagatgtctgaattactaacatgctacttgtgttcatattattgtatataagaagcttctgaaaaacctgttctatttttatttcaaaaacagtacaagtgaaagtgtagtctctctttcatgatgccaccatggaggcacagatttcaggacccctgcaatagggaaaggtagccaagggtcttacatgacattgaatatgctttttacttggaaacacaaaatcacctccactcacattttgttggccaaagcaagtcatatgatcaccaaggggatgaatgcccagaaagagacaaaacaagaacaagaatcctgatctatcacatattcaaaaaaaaaaaaaaaaaaaaaaaaggacattcttttgtaactactccttttcccctgacctaatttgtgcataatataccatggcactaaaaatattgcacttattgaattcaataagtttttgaattcaattttgtgaacagaccacagatcttttaacaagttctctcctctaccactactccatgcagaaaataaggttgattcctatttttctattctgcaatatattgttctaggacctcctagaaatgacattttgatgtcaaagataatccacatttaattttttgatcgattctttacatttggcctgcagaaagtctatcaatttaataatttattcattacaggctgaggtttatagtgtacctactgtatataaaacttaacctggaagttttggcttcaaggcagaatatgacatgcttattgaaatggtatgcataaagagggaaagtatagtaacacaaagaaagaaagaatttactgagctgtgaaagtgacggacacacagaaagttctaaacaaaatgaaacaaaacaaaagtggatttatctcagcctctaacaagaagtaaagtttaaaaggcattgggttatgagaggaccatctagatgatagaatcaacatcatcagaagaatagtgacaagaaatgttgagatgtatttagaaaaaaaaattgaccatttgaactaaaataaaaacgtgtctttctctttcttttttaaatagacatagaaaaaaagcaggaagaacatcaggctaaaatatacagaaaatttaaggtcagcttaaatatgtaaaatgtctatatgtttcattgaaacttttggcagtgacatacagaaaggaaagggagagtgaaagctactgccaaagtttggaattgatgccataaggggaaaaattttagtagggaggttggcagagaagaggaaaaggtaacagccactgtaaaggatgagatattaacaagctgaatgaagggatgaggaagaaatcgatgatgacactatgggcttgagcctggggaactagaaaatatgcagagcactaacttaaaatacaaatgaggggaatatgtgggtttcatggaagaacatataaatttacctttgaaacattaagactaatgggataacaaaaatgaaagtggacttggcagatggaaacggtaaatgaaataccggtcagagatggatatgcacacacactctcttagttgtggccagcaacattgtagaaatggatggaatctaagaaatctaatgaaggtccacatttgggagatgtgaggaagaggaggcgccaacaaaaatatgaaataatcaaatcagggtatggaatatcttagttataaagatcatgctgcataaacatgactcatttttttgttgtaaatagaattttacagaagcagccctggaattgccgttagaatgacccccagagtttattgattaactttgccacttaccggctgtgtaagcctaggcaagtttactacctgttcttaagcaatctcatctgtccagcatgaatgatgatgctaagtacacgtgtttgttatgaggatacacaacataatgcatgtaatagtacctggcaccattcctaacaagtgttcaataaatataagtttaatccagatacattgctttttagtctaattgtttccacagtatctggtaaatgacttatatgtagtatgtgctaaataaacatttgttgcattagggactgggaaaagatagacattagaactgcaatgtcaactgcaatatgattaaactcattgtccttcctggattattccctgaaaacattttctcagtggcctaaaggtattactaacttccttagttcaacatactcacaaacattatactttatatctggcattattaataatttctttagtgtaaaagtcattggttctgatcattcagatacgggtgattctctgcacttggaggcaaatggcagcattgtactttttggctgccatgtggttgaaagagggtgagtgactagcttaggatggatgttgtgggaataagtgacatctgtgggtgtccaatcaacctgattcttggagtcaagtcattgttgctgctttagaacactaggaatttgttatattgttttcttttcttttgtctttattttttaaattgaagaataaaaattgcatagttttatggtagacagcatgatgtctcgatatacatacattgtagactggctaaatcaagccaattaacatatacgtaacttcacaaacgtattttttttgtagcgagaacactttgaaatctactctctttgcaattttcaagtgtacagtatattgttattaactatagtcactgtgatgtatgatagatctcttgaactaattccttctgtctaactgaaattttgtatttttttttaccatctctctaatccccagcccaccccatcccagcttctggtacccaagatcctactctctgcttctataaatttgaacttctgaggtaccatatataaatgagcttctcaaaaaatcaaaaaatccaactgccatatgatcctgcaatcctactgctgggtatttatccaaaaaaatataaaatcaatatgttgaagagatttctgcactctcatatttactgcagcattattcacaatagtcaagctatggaatcaacttaagtgtatatcagtgaatgaatggaaaaaaatgtggtatttgcacacaaagggatactattcatccttaaaaaagaggaaagcctgtcctgtataagaacagataaacctggaggacattatgttaactgaattaagtcaggcacgtaaagagggtttttttttttgttacttcagcataacttattccataatataatactatactcagcctattgttgagaaagtcctttccagattccctcgcttgaaaacctcagcaccttcagtagcactaggactagcatatcatttgcacgttcacactttaagaatgaggtaaggcactaaaacaggctactgtatcagaaaccaactagcataaaaaaagaaacaatgtgaacatgttgccatatttttaagtagtcagcaaagttgattccttaaaaatctaaacaggaggctaaaaagaggttttctacaagcaagttctttctgttactgcatttttatttcttgcttctgtgaagttttgtttctgatagatgactactgtattctcatacggatgcagagaagaggactggtattaaagctgatgagtgatgttacagtcagtaaagaaacggttgatgttaaattggctggctagtagatattttggggaacaaagtaatttttcctaataaaagctgtcaagttgtttgctgtaagaagtaaaataaaatcgcatgtactacataattgccaaatcctattgtactcaaatatcctatcagatacctactactttaaataaatgccttctgaactaattctttaccaagtttgggaaccataaaccagggcaaatataataatcaacttttactcaggcaactctatttcagattttctactaaggtgctgactacctaactattattatgttcatcttctttgacccaagtcatatttaagtgaatgtgttcactgctgttattggtacctgacaacgggttgagtgatggggtgtctgatagtatttccatggcagtattactagtggttgataaagccagacctctagggtccaattttctgaaactcatggggaaaaataggagctagaaaatgaactatctggttatatatttttttcattgttgcaaggagactattttcaagaaagattgtgacaggaataaaaagacaaggacaagcagccccaaactgtcaaaatcctagcatttttcagctgtttcctgatatatgccaatgttttatgccaaaaagaaaaaaaaaaagcagaagaagaaaagtttcttttctcaaagatgatgtcaacatatctgatgcattgtgtgaggaaaaatgtagatgctataatttattgtttgttattaatttcaaggacagattaaatttcctcataatagggcagaacaccctgacacaaaccgtctgctaagtacttattgacacaaagttgaaaagcaattctttcatctagaaagacagctctctttcatctacagcactaaatcaaattatgaagtagctcctacattccaggctctgctctagttgcacaaacttggaatttcattctctaccatctccctgtgaagttgttattattgctgtcattctgtaggaagagaaaactgtgtcttaggttcggtcctttcttcaacatcgcatgactaagaagcagtgtcacagtgcttttacatttggttttctgtctgactctaaagggatgagctctccattatagcccagctgccttcctctcccaacaacaaacactaataaatgaaaaagtgaatcacagagagaaagaatttgaaaagaaaatgagatgagaaagggggaaacaaaaacatgagaaagtttggttgcctgagattgtttcaaaatggaggaaaagagcaattttgtctcaacttgccaaattaagcaaggtcagttaaaggctatatcttgccaaaagaaagcttactgactgggcattggcctatccaatccgtaaaaggttggcaaaaattattgtgggaaagtcacttaatacagaaatagctcctggctaattgagagaaaaaacagttagaaaggatatgacagcctccttttcttaaatattaggtagaatttattatgagacttaatttcataatatctaatgcagccgacttttaaactagctaaagcttaacaagaattttagtgaatttttttaaagagaccctcatgatctggactgctatttattttgtatttgatgtatgaggatttttgatttggggataaaattgtctttctggattcaacacatgagagagtgctgggttctagaactgtttactttctgtatggctttatatacattctttgagttcctgtgccacttttaacttatttgtaaaaaggggagaatacaatgctttaagattttattagaataaaattagataatgaatgccatgacattttccaaataattctatgcaaatgaaaatggtgtttataatctgtgtgcttccagtttagtttctttttttttttttttttttttttttttgagacggagtctcgctctgtcgcccaggctggagtgcagtggcgggatctcggctcactgcaagctccgcctcctgggttcatgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccccagtttagtttcttataccaatagaaggttcagttgtattattataatattggccacttcagtgactcctctaagttttcttcctctttaaccactcctttcttaggtaattttgacaattgaatgagtaggagcttgtaggttttctacttttcattctaaatttgttgtaataaaaatatcatggattttataatcagacaggttataggttctagaatcaaataaacctgcaagtaaatttcactgctacttcttagctctgtgatggcagacacatttagcctccccaagctcatttcttcatttatatattggaagcacgagaatttggaaagattgcatacataaagacaatggtacactaagactagctgcagtgtatttttctttatttctatcagtttcgcatttcagctaagtccagcagatgtactttcttttcacatgattttgctatgtaggcctgattgactgattgactatggtggtttaaatcaattgtgaataaacaacaatgtgggtaggccaatgaatatccaggtacctgaagggaagaagcatgccagatttccccttttgccctaagtgcttttttgtgtttctggaattgacaagcaaattcgctttttggaatggtcagttgtgagggcttaacttgctttatgccaccagaagccgactagccaggaagacaaccagtcacagctgagctcccagggtttcttggagcatgtggttggcatagcagcctaattcttattatcttatccatggagttaataggaggctcattagtgacagatactctgtgtttgccttgccaaaaacaaatgggcatattatttttaaagatttgttcaatgatgtatcttccaactgacaattatctattttttttttgtcaagctttaatcttggcactgaggatttttaaaaatataagtaaatgaaggtcactgctttctatgaatatcaaatttgtaatgaaggaggtgcagacatgcaactgttttacaaccaggatgaatgctagatgtgtaacagcatatgattaaccctgcccaggccgtggaggaggcagacttctcagataaagttaatttgttggacccagattctaaaagtcacggtaagggaacagaaaatctaaaattaaacaaaatgcatacaggctaggtttcaattttctaacgagccagaagataattcatttgctaggaagaacgagaacaatgatttttatacatgtttccccttacctctctgtagattcctaaggatgacccaatgttcacgtcttgtcttaaaatataattccctacctatatgtgactagtatagaccagttctctggtattttagagcttgtctgttctaagccacatggcttatttttaaagctggaaggaaggtgtgagggatgcttgccaaaagtggcgattcatcctgcccagacacaggaaggcttgactctgccaacgccaaccatcatctgggttatagtgagactctttctgtgtcacactcaaagttcctttagtctcagcactcacttttatcaagccagctttgtcagcagcgttttgagaggatgcaagtataaaaatcatgggctcattacaaagagttttatgggggaggctatatattcataataactaaacaggaactgtttccagtgctttcataaaaaatttatttgttcttcacaaccaccctatgaattatatatgatgattgttttcattttacaaatggggaaactgagagacagggaagtgaagtacctttgctagtttcactctcaggccactgggctcacaatgaagtcaggtacttatcattcccacaccgtgcttcctctgcacagatacagatgagttgttaaaactgctgctcaataactcaaacaccaacctccaacttcagaagtcaaataaaatataccagagactttgtattagagataatggatgccatgtttttcaaacttatccaatgataatgatcacctagggagcttaataaacatacagattccagacacctctccagacctagagaaacaatctccagcgagagatgaagcaaagcgactgtttacaagtgcctccagaacatttttattatcagttaagtttggcaaacaccaaatggggtaatttataaaaaaatctttaagacaatgcttcgccactttaatgtggacaaagtcacctggagatcatattaaaatgcagcagtggggcctgtgattctgcatttctaacaagctcttaggttgtgccaatgctgctgatacatgggccacattttgattagcaagaatctgggaaaagactcagctgtctaggatacgggattcatttactgttagccataaccttggcctttttaatcctagaatgtttgtaaaaaatgaaaattccagtgtctactcttatagattctgatttgaaaggacaaggacagttatcaggaatctactttttaaataagtaatctcaagtgatttgattctgatgcagatggttctcagtcccactttccattgacaaacatggaacatgctgtggaaatcaaagcactgtaaaggtggaaagaacagcagtgtgccattatataagtcattcaatcccttggttttatcacccacaacctggcgagaatattatgtgcctttatagagttgttaggataaaatgagataagacatgaaagcaaataacagctgagccaccctattgaaggggtcaaaggaaataggatatggatcaagcaaagaaccactttcggccaaagcagcagaaaagctttcctatattttcttgattcttaggctataaaggcaatttacaaaatcactacattcactctgtccgcttactagctagacaggaccaatacctgtccattattataaaattatactctctcgctcgctctcactctctctctcattctctcttcatatatgtgaattttattctcataaacttatacatatatatgtgcatatatatgcttgtattatataggtgtatatatatatgcatgcatacatatatttgtgcatatatgtatgtttgcagatatgaaatataagtgcttatcaatatgaaatatgcccacatgcatatatagataaattgtatagcttccttgtgaatctaaagacacatgtaatatagctaacctttaaaacaatgctaatatagctcctacaatatgacattttagcaacatgtttttaataatacatgttcttaaatgttaagctgattcatgttatagtcccaacttttagatctcaagttctactttagaatatcaatagcaatatggaaagatacaggattttattgtaaaattttctaaggaattatagtggtctgctattaccactgtgccttaccctgcttgaaagtttattactttttaaagggaggggttcatcagcttctttcttggagcattacttattggataagaaaaaaaaacgagaaaaaaaaaaccttcaaagtgctatctctcacagcctgtggcaaggacaaggtttaggtcaatgcctattacagaagcagtaaaaatacgaggattaaaaagaaaagacacacactatattcctttgggtgtatctagaaatttaaaaatgtggattaggtacaaacagtgcaaatatgaaaattacaatcaagtgaataagctttccatatgtttaatgttgtatatttatcagagcctttctgattaagtatgatacatatttattgaattatagagagtcataatatggaatgtaaggtatagtgcattctggcacattctgagagtgaattgtttcaatgtagtctataaaattatgttgcctttaggtaattaggtgaccaaaataatttgagaactactagttacattatgaaatttaaaaatcagatctctttgcttctttacaatttggccaagggacactgaaagttaacccacaacttgccatgttttaatgtccagaactatactcactttcaaggttgatgtgttttaagacttacatgatggtatggcacttcaagtaaaattatatttgttaaaactttacaagtttttttttctttctgttccccactaagggaaagattcactgtaaatctgtgtagctgtatttccttttgtaaactaaaatagtttagtcttggattataactggaatagtgtgatataacagagttattgacatatttgaataagttacttttatccagatgcctcttaaatataggacaataaatctatatcaaaaacggggtactaaaatatgtatgtgtgtatcccaaataaatacattcctaagtaaaaacaaaatctcttttggcatgtatgacttagaatctgaataactggttgtttatggaaacatgcaatacataatttaagatagaaaaaaaggagagatgaatgacttagatataggcatattcatgttatggtttattagggaacaaaatctgcctgtcttcatgtttgtatttataattatatcaggcttaacaagcgggagtaaagttcaacataaacaaaaacataattgctttttttctttccaatatctgaacattaagaccataggaggtttgcagttgcacattgaaataaccacatcatcataaagactccttatttctaactggtaaatgtcagtctgaattagatcctatgctacatggattattagtgtttatgcttctattgctgactaagtacaatactaatatagacaaatggttattaactttgaattagttcagggggtcacttaattgattatgaatataggcaacaagccatagtcatattcacagtatctgttttggtcactaaaagaaatcatagatattttcgtatcaattaatattgccacagataccttaatataccatttatattcatcactatttcaaaattatagcattgaatacacacattgttaggttttttagtgaaacacatatactactgtatctcaaatttgtgatatagattactttgtactccctacacattttaattttatgtacattaaaacattatttcgaacagtccagactgctaaaggaattcacaaaagattaaatgcacctgtcttaagcaggagtcaggtcatgtcactgcactcctgaaaaccctccaaaggctccccattggcttgactcatagtgaagttctgtagccttttggattccaccaacattagccccagacacatcactctgtttctcaaacatattaagcatacccccaactgggagcctttgcacttgctcttccttctgcctggaattattttccccaatatatgcataatgtactcatctgcattcatctagacttttttcaaatgtcgccttctcttttagatctatgctaagtattttattcataatcacattcttccatacaatcttgcttcccttatgcttctaattatactacataatttactatgtttcttttacatctacccgctcgtagaatataaattcatcagagcaggaatttgtatcttcttttttttcctgttttgttcacaacagtatcataacacattttaggtgatcgataaacatttgtgcaacaaaagaatgatatgtaaaagtaaatggcactttcaacacggcaagaaaacagagtaaattgcctacataacagtaaattagcccatttttagaactgctaaatgtagaacctgagaagttagacagaaagttgatgttattcctttagcatacttgttaactgaaagtgtctatggacaatgtattaatttcctagtgctgccataaaacattaccaaatacttggtggcttacaaaaacaagaaaaatttattctgtcacagttctggaggctagaagtacaaaatcaaggcattagcagggacacactccctacaaaagctctaggggagaatacgtccttgcttccttcagtttttggttagttgcagcagtattaacttcaatctacctccttcttcacttggccttcttccctgtatggattaaatctccccgtttttttttttttcttataataatagcagtcattagatttagaacccactctaattccaggatgatttcaccttgagaaaagaccctattttcagttaagggcattttcacaggaactgggagttaggattggacatgttttttggtgaaacaattcatgtcagaagattaaaaaaaaatcttgaaatttctgactaaagaaactgaatatgtttatttacctttgtctccagagaagatttatgccttcccaatgctttcatggaattacatgctttatttttctggaggatcttctaattgattttaaggaaaacaaaatgatttgtagctagaggtaaactatctaccaacctggaactattacctgatactttcccccctggaaaaaatgtggtaggaaatgtctaatgaatgtatatcactttctttctataggtgcaatagttcacttgtaattagccacatggaggtaccagagctagtaaagtcatctacctgtgaggtttgcaatggccatgataagggaagcattaaattagagtgtaattgctcaatggctgaaggaaacttctcacatttattatctatctatctatctatctatctatctatctatctacatatatccattatcttatatctatctatagaaacatttattatctatatatctatagaaacatttattatctatataactgtctatatatttaatatattaatgtacatatctttttggcaatcatgccaaaagaaataatatatgcttaattacttgatctaagtgcataaaagcacctagtttaaagagttgtcctggtgttaaaaaataaaataacaagccccaaatacttcacatagtacctgacacataataaagattcaacatatactactcaatattataggctatcgttattatcagaagtgatacatgtaaatttttaatttttgattcaaaatcataaatgtgcaagtaaaaaagaattggagaataaaagaattaaagatgttagttggctatgagctcaaaataagataaaaatgtaatataatataaaaattaataagcctaatgcattcttgggttaaattattggaaaaatgtgccctaatcgttggtatctcaacactacattttaatccaatcacaactagaatttgatgttgagttctaggcacaatgttttgagaatgactttttcaaaccataggacaactagaaaggtaaagaagctgggaaatacaccaaaaataaataaataaataaataaataaataaataataataaaggagatgaaggaagagggcatatttagcttgaaagagatacatagaataaaaacagcagctgtctttaataatttgaataatggtcatttagaaaatagtaaaacaaatccaaacaaaataaaatagactaaccagggcattaaagttacaacaaacgtagagttccacttaagaaacacctcctaagtaatagtactgctgagcagtgaaatttactaccttgtcagaaactaaagttccataagaaggataactactattcattgaggtgattggcacagagctaacccccccttttttaactattacaatcaaacccaacaataatcctataaggcagagattattatctccataccctggaaaaggaaatataaattatttgctctggtcatccaaagacagattctaaagttattatcttaaccatctccatagtgtttgccttctatggtacactggattgatcacatctgttgagaatcttttaaaaggatatcatgcattctagagtgtagtacatctgacttctaatttagtacatgaaaaatgtttaaaacggttctagtagtaagagtagttaaaatgtaatatcgaatgtgtaaaaggataatttttataacagagtataatcataactctcatccatatataaaataaacgtgtcaaagattttattcaagtcattcattattgagggaaccggtaagatattggatgataaagctggttgtgataattcaagaccccccgcatggaaataataaaataatttaaaagtagatgcaaaactgatgtgttccacagcaagaagggaaatcatcgtcttctgttagaacaaaaatttattttcctgtctataaaagcagtcatgtgcattactattagttatctacaatgtacagagttgtaacatagctccgagataatgagaggtacagagacctatttgaatcagaaaacgtaggagggcatgcttagaaaatatctagttttccaacgaagacaggcattttggcccacttcaaagtctttcacgatgtttccttcaagtgtttattattatgattgtacaagctacataaattggaaatctcaggatagtgatagaaacttagctttatgtagcatgaaaggtaatggcaatctgcaataagccacccagtgtcctagtgatgtttgtatgctgcataagaaaacaaaataaaactgacatttggtgctaagaattttacacttcataataacaaagtataattacattttctgtatgtaaggctttgtgcaaatgaattacttgcattatttcatataatttttcccactagtcataataatacaacagcagtagcatcaataaaagaaataataataatattttcctttagttaaatggttactgaaactcaagtacttatttaagtattatctcttttaatctaaacaaccactgctctgatttaagtactttttatcctcacttcattggtgaggaaactgagaactaaagagttcaattaatttttcaagctcacacaaatcataagatctcagtctacgtcctctgaaaacagtctttcattgtaattattacaccattaaactaaattgtcaatcataatatcagtgcactttgaagtaagcttattataaaagtatttgtttatgatgttcttagacacttagagaaatattaaatatgttaggttttcaaaaagtttctatagttctatacatccatcaatattatataaattttgaaaaaaaatttgcttaaaaacataaaaatttaataagaatccataaccaaaaatgacatttcttcttcaataaatcctacttgaggagccaacgataatcccatgaaagcagagagctttctctgactcacttatcttaataattgcaggccaaatattcaaccctgctatcaatctcacctagcattccttgatgcccccttccatagtaataatttcaataggttcaaaaagaaaagaaaaaatagacaaagctcacgtagacattgaagaggggctcaaaatacattaccagcagtaaaaatttatttatctttgataaagtataattattattttttattgactaaatagggttgtagaattgtattatggtttgtaccaaagtagacaattctaagaggtcaagggtgtttttaaaatacctttaatatttcaatattctttaaacttgattattagcttgtatagtattgtgaataagagtattgattatcagagataatttaatccaatcactgctttaatgattaaatatgccaaatttatagagactgttttaaattgtctttctttagccatgtaattggagggaaatggtagcatggataatcctaaatactgaatgattccaaagttttttagagttggctttgggatacatttcaatttggaagcagatttatttcctaattacattttgcttaggctaaaattaaaataggcaaatagtattcaatatggaattgatgtggccaaaagtgttgtcattgataagggcaagccagattgggctgtagattctactactaacaacacataacaaaacacgagcaatataacgtcaacaaaaaagaaagatacataaggaggaaatttacagcctatccaagaatattcaattgatggcatcgttaagagttaagtctaacttatctttaattcttgctctgctgctgttgtctctgtctatgagaatcttccattttcacttatctctatctcatacaatagttcaaagtaggcttcatgtcttacatcatttgataagcaataactctgtaacttaaatattgagtctctctcagtatttacgcagaccctttgtaggtaccatcctgtttccagagtgaattccaagatttttttccctccaaccatgaggattgagggtgaagtgtgacattctctactgttacctcccaaagaatccccactctgactttgactacaatttcacctccttcctgcaataccaactcatgttacaaaatctcaagacaaatctcacactcagtgtatttctgagatgttcacaatagcttcgggcttttatgtacttaaacttaagttcttggcctggtgcggtggctcacgcctgtaatcccagcattgtgggaggtcaaggcaggtggatcacctgaggtcaggagttcaataccagcctggccaacatggtgaatccccatctctactaaaaatacaaaaattagctgggcatggtggtgcttgcctgtaatcccagctactcgggaggctgaggcaggagaatcacttgaacctgggaggtggaggctgcagtgagctgagattgtgtcactgcactccagccttggcaatggagcaaaactccatctcaaaaaaaattaatttcttgcaattatgcaattatcatatatgaaataccacatttagaaagtcaatgaaaataatttatccaacaaaaattattttatttcaaatagatctagaaattaacaggtatcaaagggctaccgtgggaaagtatggttctagatgtttaattaaggacaattggatgcagagaaagactggaaggttatgaagaataagaaaaaaaaacatccttttggttgatatcatgctgaaatggaagttatgtttgcctactgaacgtaagtatatcaataaaaacttgattatcataccacacattgggctcaattaaacattagtgagaatcttcagttttctaaatcatccttaaaatttatgcatctaaatcacagctctagtttgcatatagatattaatagacaggtatttacaaatatccttaggcctcactagccatactcacgaaagggacctaaaccatattgacaccttccaccctgacttaaccatcacctggcagctgactaaccacagtgattatacagcagttgtaaactggaacctgttggtgagaggaatttccttgacagaggcagcctggaaacagatataaaaagattgcggcagatataaagcaggcagagctgcctttaagcggcccgcttgttaacaactatgcttgcctgagttacacatctgctgatgaggctgtctgcatgttccctgaatcccaggaggagaactaaagtcaaacacctggctaaacaaagcatagtaaaaagctggacatttaatgcaacgaacagcaaaggcacgtcccacaggacattattgctgacagtagacgttccctgaagcaaaaaagatattgagaaaggggacacagtgaattgaagctacataggtgctccttcctatcctttaaatttgcctctgggatttggccacctttagacccaatagactttaattataaaaattatctatgtgactaataagtggtgtgttagtgtgtgaacttgtgaggtgaggaaacatttaagattttctagactgctattttaggtcttttgtattttgcagtcatctctatgaagtcttgaattacaaaagatagtatttgcttttatttgcctttccttttgatacaggaaaaccagtgaagaaatgtcttggaagttgaccctagattttctaaagcctctctcctaattattctctatgatctccagccctgtccttcatgaaccatcttgttatataactactgacaaaagtggcttgtgaaaaagaatccaccaacaattcagatggacttttaaaagatgagggaaaaacgtgggcagatcaataaaagaacaccgttattttggaaaacagaaataaagaaaaatgaccgcattagttctaccttggaatagtgaatacgtctttccccaaactgatgctcatggtgttaagttctgcattattgccagtactgtgttttagttacattatggcttacactgttaggtgagctggctggagagtaactttctgtggacacaatgtcacatccatagtgctaagtccatggcaagtatctggtgaatgtttgtggacttaatgatattgatattcatgttactagtaagcatgtgttctttacaacaatttgccaaacaatgtaggtgtgaagctatctaattttgtatatggagtggaaaccctggaaggaacatctgagttttattgctactataagttgaaatgcacccaagctgcatttagagaactggccagacttaacttgaaagccatttactcagttgaggaacctgacggtctcttttaaaaagagcacaggatgcagctatgatttgttatatcatttgttatactgtaaatagcatttttaatataattaaaacacaagttagaagaagttactcatttcatgcatattcatataataagaattagttcatatacatttagtgaataaaaaggtattactttattttacaattttcccaacacattaatactttgtgccaccaaatattgctcctgaaagtaaagtacactatgcagctaaatgcattaatctgtggaagaatataatacaacacaccatgcgtattcaccccacattttttctttcacctcagtttggccacatgctctgaaatacaagtgcttattgtggataaatagccaaggattttgaatatttatccgtcaaatccatagttcttaggtcttagcccttccttagacctctttcttatcaagccatatatatgtctcctgcactttttctatacattgtaattttttgtttattagggagttagcataactttttaagtatgttattaataccaatttgttaggattattattgtttaattattattgtttctgctaatgttgtaataataaagttgcatgggctttgagcactctgctcttaatgtatttttccaattaatcattttatttacatcatcatttcgcagaatacaaaatttttctgaaacttttgtgtgattttataacataaacagatctatttgtggatgttttaaaggaggagggataatctaaaggcaagaacgtcaaaagagcgcactagtctccagaagaccatcttcagaaatggtagaggacccttgcaaatggctgtgaagccacatagctcatgacagaaaagtaaaaatacatcaaagcaatgactgaatgatcatcactgtgaaagtgaaggtggttgtctgttagcctatctcaagaaatgtatttagggtcccatttgataaatatgctgatgattttctgaggcagaattgatttgaataaaagtaggagttgtacaaacttaaaggtgggagctctgtgcaagacaatataatcaattacctttattaagatactattatactatcttcatagtccctagctgttttctctatccacattattgcctcatactcccttctacttacatgttgtgctatttaaagtggttgtgaggaagaatgtggtgaaccaaaggaaaataaatcaatcatttcttttttcttttcgtttttatcttcttttttattttttatttttatttattttgttttattttattattattattattattattattattattattattattattattttgagacagcgtcttgctctgttccccaggttgtagtgcagtggcgcaatctcggctcactgcaagctctgcctcccaggttcaagcgattctcctgcctcagcctcctgagtagctgggattacaggcgtgcgctaccacgctcggctaattgtgtgtgtgtgtgtgtgtgtgtgtgtgtgtgtgtatttttagtagagacggggtttcaccatgttggtcaggctggtctcgaactcctttcctcgggatccgctcgcctcagcctcccaaagtgctgggattataggcgtgagccaccgcacccatcttctttttaaaaaatattttagtaaaactataagttagaaacaggaaaatcagaagttggtattgatatatggatataaatatggatatagaggtcaatatagatatagcatgtaaaatgtctaaagatatggtaatatattgtgtgaccaagaaaactaaaaatgcataaataattttactatcacaataagatggtaaaatagattattaattttaaacctataaaacacattttgggaagagaacagaaatagaaatttttaatttaggctttcaagcaatatacggaagttgtattttctttagcatttggcatgtatccaaacttagtgattcaaatatcaatccaacaattcaagaattagattgtgaaacaaaggtgggcatatactcatactgttattacagttgagaaatagtgagctcgattttcctgacccccttctctacttgctttacaattaccacctagttttatacgacatggcatttacgtattgtaccagttataatttcccattaatatttaatattccataatatcatcatacttgttttaattttttaataactcacagtcttttactcattttcaagggttcagtattgaaatttgattccttaaataatactgttttatatatacacacacacacacacacacacacacacacacacacattgatatatatatatataaaactctcctggccacctaaaactttagaatcaattcgttacgaattttgtatagatatttgaccacatcaatgttgttataactcaataactagtctatactcttctattttcccctttacaggtttctcatcacttaactttcatcagcaacaccagaacactagattctttcttttttcttttttataacatgttcaggaaaaagttaacatagctgtctagatatttagaagggcctgctgacagggatgggtattgactgtcatctagaaattttgcttgagaactgttccctccatcactaactgataaggttgttccactgttcaagcttgacgaaactgtacaaacaatgtgattcataatgcttttctcctggcagtctagaatttggtagtagtagatagaaattgccatgtaaccagctcccagaatgccttagactctgagtctcaaatggactttttttttttttttttggcagaaacactgcacatgtgctattacatttcatttctgggtaacaggatattcagtgtggcctcttcagggaaagcaagggaaacatacacataaattcattcaaacagtgcacgtatttctccatcactaatccagcagtgtatccttactgtgctgctgtaataaatatcatacatgaggacaactatatcctgagccccatgtgttcttctagcaaagcactgaacttcaggtagtagtgggaccactgacacaaacggtgccagagtactggcacacaagaccaatgtcctgagtatgattcctctgtctgtaatggcccacaagacatttcttgttagttgtctttccattatctcaaaataatgtggcaaaagaaaataatgccttttaattcaataaagcacttcataattctacaaattgaattaatattctttaggatagtcacttatattcaacatcttaggttgatcctagagagcaagacagacatataataaagaagagaggttttgaaatcaagcatatttctctctcagctttaaattcaaatcccaatgtattagtttaatgaacttggacaagtaggacacaacttggaatggaatggaaatttaatatactgtaattatttattaatgatattaatcatattgtttcttatccttctaccatcctgttattattcatcaaatattatataaaatatacaacctacactggtaaattcattaacctcttccattttcccacttgtgccaccccaatctggcctcattttctcatctctaaactactgcaataatctattttgatctccagttcctctctttctaacatatttctctagatcagtcttccgaagtggaagtttttaaattctgttacaggtagccttaaaattccccgtcactatcacagagatcagtggggtatatagggtgtggagaatggcaaatcacaaatcatatgatcaccagaaaaactctgctttttatccattttatattatgcttctgtttgacatcatgtttggagaaaggccttggtagctacaataagtctgtaaaggcactagttttagctgactcaggatgaagtcagatctcttgtcaactccaggttcttccctttctggccccaacttttattccaatgttctgtatcacttcccttccacatgagtcctttgcttgactcaaaataattggttctctgagctctgctataggttgaattgtgtaccccaaattaatatgttgaagcctaacacacaatggcttagaatgtgacataatttggaaataagattattgcagctgcaatagttaaaatgaggccatagtgatgggactcaaatccaatatgactggtgcccttataaaaaggtgacagttggacattggcatgcacacagggagcacaccattgaagatcaaggcagagatcaggatgatgcagcagaagtcaaggaacaccaacgactgacagcaaactaccagaagctatgactgaggcatgaaacagagccttccctcatggcccttagaagaagccaatcctgctgacattttgatctaggactttcagcctccagaactgcgagaccataaatttctgttgtttaagccacccatattgtggcattttgttatggcagttctggcaaactaatagaatccttaaacacactaagcacattgccatttcaatgcctgttttctctctgcgataccgtctttagggactccctcaccgttaagaactagtccaagtttcacaaccatcacaaactgtttttctgctgcctgagctcttggcaaacttcaattttttgaaacacttaatagtacttaataagtcacctgggagatattacatgtgactttattaattaattaaaaataaaagccagactcttaatatagtcttatatatttaaacacaaagctgaattagagtgtcatcatggctactatcatcaacataaaataactgtagtaaattagaatgtatatattggctttgggaatacacaaagattagttttacaaaatgataaaataatagctactattaacaagggtagagaagacattttccaatgtaacaaataatgtatttcaactcctgatatgaattaagaaagaaagcgattggaccttgctgcttcttgtttgtgtatgaatttaaaagcctgctatttggtgatattcatcttgctttgtttatagataatttttgttttactagcccgaaagtacctaattatcattgacagacttcacaaagtccatgcatactaatggcatgtacggattttcaagagcactttgagaatcttttctttaatcatcaaaatttgtttagtgtcctttttaagatccctagtggcctcttaatttcaaaacttaatattctgttttcactgctgttcctacttgaatctgaaaacctattgacatgattgaccactctctggatctcaaattgctttctcacttggattttattctcttttttctttcctttttttttttttttttctcacttatctcactcgtcttttcttggttccttctccattgtctaccatctcacctactatcaagaaatcagttgccaaataaatgctagtgacaaccaggtctgaacctctggctccaaattcattccagatatacttttcccatggtttcttggtcagtatgcaagctggtacattataattaccgttctgtcagtagcaaagtaaagtcttgtatgtaaatgtcatttgtgtgtctttccacctaaatattttactttgaatttgctaaattggctgacttttggtattgttaataaataataatcaataattattatctctagcttaaaacaccatcatcagagaaaacatctaaacaaaagcttatttgagaataaaaatggtagtttggtttagtggaaataaccaaatgtttttttttaaatattctttcccttcacagtatgacttttatgctgtagtcacttgcaaataatattgctgaaaattaatttaaaattggtgcactgaaaagtatagtttgatttgtttttttgattttgataaggatgtttacagacttcagacaccctcaatggctcccattcctcttgtataaatgtaaactttttagactagcactaacagttttacataatctgactcaaatctattttttttttttttggctctttcttatctactgggacataatattcacattccaattgagatagcttattcaacaaccatacaaatacgtgagcttcctacctcagtatctatgactgttttcaaagatattctatgtggaataacataccatttttttctgttccttctatcaaaaattgtgccaaattttagtacaaagcccactttgtcattgatctttccccattaacctatgtcatatttgccctctctttagagtgataatgatgccatatctatagttattgaaaatattttttctacttaactgtgggttttttgaggtcaaatatcaatgtctacctcatcttaccaaatacagggcataacacttagtcatcaaccaaatattggcagaactgaactgcattaaacacaaaggtctgtcttctgagcatacagttgcaaactttaaaatagaagaaagtatttagcgattataagtaaaaactaatctagtaaatcattactgaatgacagaaatagtacaagtaataacacttctgaacaagaaagggtattatgctaaagagaaaactgaaaaaaaataagctggaactatagtgtgcagatatgatcatttcctcagagccaaattgtactttacgttaggcagaggcactggaaatggaaattgaagtgacctgggaaacaaggctctcagaccttcctttacaaagaaatgtgcaaagtagttcagcacttcttagaatagaggagactgggagcacagaacattcagaaaagaaaggaaagaatagatccctaaagctctataagctaccatcaaatgcaagataaaagaagtataaggtgatactagtgtcaagcagcacaaaacaagaacaaaaagaattgcatttgttggaggctgggctgcagaggaggtcacagaaaactggctgtgctttctgggaggaataaagagagtgaggatggagcaaatctctaagaaaaacaattgctgtgttttaattttggccacctgatgttactgtctaacagcaattagagagtcaaagctctgagatgaaagactactgcgtgcatctctaagttctgtcccttagacactagataccatagtgtaacttttatgcatcagcatccttctccgtagaatgggaacaattgcagtagttcagtgcactatttcaacaaagtaagagagtattcaaccattccacataaagcctgtattgtcaagtgcttaacaaatattgtttattattttcagtctttgaagtatgtctaagatgccacattcagggttgaataaggaaaataaatgtaaaaatatagtaacaaaataacacatgtaatgtctcagaatcccaaatccgtgaccaacttacaaatacttagagtgccattatgtattaaatacctcccattattttataattatatatgaaggaagatgtaagctattaagcactttcttcataactcggtatctttcataattggatctaatatttaactcagaagtgtgtgtgtgtggaattgtgaagggcacagtaatggtagaaagtcatggaagatgtactacttcacaattttctaaagctacctttaggatgcagtaaaggtggatttgatcattgaccttacaattcacacctgtttggagattttcccatcgctttgtgacatcaaaatacgtgtaattacaaactgaaaatcaaaaaatatgctcaaacaatatagcacctttaataagttagaggtgatgaggaaaaaggttatgctgtattctgggttagcctctcttcaactacacaccattcggttagctatttctaataactacagtgataaaagtagacaatgatatagagtaaataaaaaatattgaggcaaaattcatcactgagatagtttctatgagtgatcagcagttactactggtaatgattattcttaagacattgggtaatttgtgatctttttgtagattatgaagttaaaaaaaaactgtacacagaaaaatgaaaatgatgtgagactttccagaaattataagtttccttgtaccaaatgttgcttacatcccaccacttcattctgatttatcattgtttaatatatcattgattattctaaggcaaatagattctcagacagaatgtaatttaaaaaaaacttcaactatatattacttgagattcactctcttgaaaataattattcactttaatttaacaaacacctgccatatgatgaggactacgttaaacatgggaatgaggagatccaaatatactgaaatgggaacaaattattttaatagatacagaatgcttcttaagaagatagctacctgtgttgagaaaaatttcagtacacatacttggagtggaaattattgacttagcatgtccaccataaggatagctctgctatgctaagaatatctggaccaatttgttggttgactccagaaaaaagtagagaacagaagataaatgagtaagagatcaggtaagtggaagcccattctgtacagaatattttagtaggtcatgcttctgctccttctaaccttagaatgaggtaaatataatctgcacatacaagtgatatattgaggcccagaggccagacaatgacagccaacatctaagatgacaccaaggagcccttccttctggtgtttatgcccttatgcaatcccctcccactttggcctgtatggccaataggatacaacagaagtgatgatatgtcacttccaagattgttattttgtagcttctgccttggcattgtctctctttcatgccctctcgttacttgttctagaggaagtcaacttccatggcatgagaacactcaggcagtccatgtagatatagaggcaaagaatttgaacttccagcacacagccaacgaggacattcactgaggctgtttaccatggttggtaaagttgataacctagaacatgtatggtgtgggcagattttggggatggagatcactaacggtgctgaagtatatgtccaggtgatacagaggagaactgaaacagcactcacagatactgaagagactaagcaaatgtcagaaagaaaataaagaaaaaaagctgatggggaattgcagaaagtacaccaaatatggactagattcctacagctaaaaaactagagttgtgtccaatgtttaactctgcaggtgacggtgttcccacctcacatctagtttcagaaaggacaaagcagatacatatatgaatataatacaagaataaaatataaaagcatatacctgtacgttatatataagtacataaatgtgtacgtgcacaaataacataaataacttaaaaggtctgtctaccagaatgtaaactaatatataatgtataatatgaaataactaatgactatatagtatgaaatataactataagtccaccataataaaagtaaataatatgtaaagtagaaaaacaagtaatatgttcaccaatagatagtaacaaagttaattagtatgtgcctgttttaaataatttttgaatgaagaatgcttgaatttcataaatgaatttaattaatgctatactaacatttatttgaaaaatacatgatctggaaagatagtacttgcataatcactgtgcttagtgcttgttatgtgattttttgttgttggtaaaatgtggtgagtttaactacttttttcatatatcacagtgacatataaatgaggggtgttgctatattacatactttttttcattcaagcaatgttttatcaaaactagtatgtaaaatgggaatattttgttgagggagcacaggttgggcagtctccacagccatctactgagcaaaatactccaggccatgggtgccatccctgctgcacactcacagcaacactaccctgcccagaggtctcccagccttgagctactgcatcagtacaccacccacagacatataccacaaccaactctgactctgccaagcaaagaggaccagtgggtctccagagagctgcaggtctcctggtgaccttatctttggctctggctgcccccaagggagaagggagcacagcctgacaggtccctcattggggttaaggaaatatgggtgtggcaccagtgatttgggagtccctaaggcccatgaatgaacttaataaggggttcatctatccccggctgaccaccaacttcccaatgactgaacactgctgcaaatgtgttaaaatacaaaacaggcaggcagctatgtaaatgcctaactgctggccattgttcttaagtgctgcctactgagttgcagcctgatttacaccaccaaaaccattttttttccagcacgcttcatctgtgaaatccaatgcaggaatctaaccacaaatatatatcccgtacagatactttgccctctgaaagcatccagaaatgaagctagtcgtgtatattcaacttacaccacagtcaaactcttaagataaataaaaattatattaaaaaaaagccccatctaaacaaaagcaactgcgaaaagataagggaacagcatccttctcagatgaggaagaattagtacattaactacggcaattcaaaaagtcagcatcttcttaccttcagacaatcaccatggctccctattatattagatccacagcagctcaaccactgaaatggctgaaatgacagacatataattcagaatctgggaggcaaggaagctcaataagattcaggagaaagttgaaacccaatcaaacgaatccaggaaaacggtccaacagctgaaagatgacatagcaattttttaaaagaaccaaattgaactcctggaattgaaaatttcactacaggaattccataatttggtttgaagaattaataatggaatagaccaacctgaggaaagaatctcagatcttgaagataagtcctttgaatcagcttagtcaggcaaaaataaagaagaaagaatgtttagaaataaacaaaacctttggaaattacaggattatgtatagaaatcaaacctaagacaaactggcattcttgagagagtagtagagagattaagcaacttggaaacagtatttgaggatacagtccatacaagttttcccaatctcattagagatgccaatatgcaaattcaaaaaatacacagaacccccatgagacactatataagatggccaaacccaagatacatagtcatcggattcgccaaggtcaatgtgatagaaaaaaatattaaagacagctaaaaagaagtgtcagatcacttacaaagaaaactccttcaggctaacagtggacctctcagcaggaacattacaagccaggaaagatgggggtctatatttagcatccttaaagaagcaaaatttcaaccaagaatttcatgttcaaccagactaagttccacaagtgaagaagaaataaaattcttttcagacaaccaaacaacacataaatttgttaccactagactagtattacaagaggtccttaagggaatactaataatagaaatgaaagaacagtgcctgctatcatgaaaacacacttaagtacatttcaggcagacactataaagcaactacacaattaagtctacaaaaacaaccagctaacaccacaatgacaggatcaaaactcacagatcaacattaatcttgatggaaatgatctaaaaacctgacttgaaaagcacagaattgtaagttgaattaaaaaaaaaaaaataaggcccaaccagctattgccttcaagagacccacgtcatatgtaatgacacccacaggctgaaagaaaagaaatggagaaagacctatcatgcaactgcaaaaccaaaaagagcacaggtcgatattcttatactagataaagcacactttaaaccaaaaacagtcaaaaaggacagagcaagacattacataacaataaaatattcaattcaacaagaacacctaattatcctaaatacatatgcaatgcaacattggcactcagattcataaaacaagtacttcttggactgcagtaagatttagacagctgcacaagaatagtgggggacttcaacgttccactaacagtgctagatagatcatcaaggcagaaaactaacagaaattttggacttaaactcgacacttgacgaattgttcctaatagatatttacagaatactcaacctaacaaccgcaaagtacacagtcttttaatctgcactcagaacatactctaagatcagtcacaggcttaatgataaagcaagtctaaataaattccaaaaaatagaaattataccaaacaaacttttcagaccaaagtatgataaaaattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagacatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggcgtcgggggaggggggagggatagcactgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaagaaatcataaccaagaatatctcaaactgcacaactacatgaaaattaaaccacttgcacctgaatggctttttggtaaacaacaaaattaagggagaaattgtaaaactctttgaaattaataaaaacagaaacacaacatatcaaaatctatgtgatgcagctaaagcaggattaagaggaaatgtatagtgctaaacacctacatcaagaacttagaaatataccaaattaataatctaacatcacacctagaggaattagaaaatcaagaccaaactaatcccaaagctagcagaagaaaagaaacaacaaaaatcagagaagcactgaagaaaattgatatgcaaaaattcatagaaaagaccaacaaattcaaaagtgtatttcaaaaaataaacaagatgtatagacctctagctagataaacaaagagaaaagagataagatctaagtaaccacaattagaaaagacaaagatgacattacaacctattccacagaaatacaaaagatcctcaaaggctactatgaacacccctatccatacaaagtaggaaatccagaggacatgaatacattcctagaaacacacaacctcccaagattgaaccatgaaaaaattaaaaacctaacagaccaataacgagttccaaaattaaatcagtaataaatactctagcaacaacaaaacaaaacaaacaaacaaacaaacaaaaaacaaaaagtccaggaccagatggattcacagccaaattctaacagatgtacatagagctggtaccaatcctactgaaaccattcaaaaaaatcaagggaggatgcactattctctaattctatgaagccaacatcatcctgaaaccaaaatctcacagagacacaatatcaggacaatattcctgataagcatagacaaaacaatccttgacaaaatactagcaaactgaatccagcagcacatcaaaaagttagttcacaatgaccaaataggctttcttcctgggatgcaaggttggttcaacacatgcaaatcagtaaatgtgatttaccacataagccaaattaaaaacagaaaccatatgacctcaatagattcagaaaaagcttttgataaaatccaacatcgcttcatgaagtaaccctcagcaaactaagcattgaaggaacatagctcaaaataataagagccatctatgacaaacctatagctaatatcacaccaaatgggcaaaactgcaaccaccccccttgagaacaaggcaaagatgcccactctcaccgctgctattcaacatagtattggaagtcctagccagagaaatcaagcaagagaaaaaaataaagaggcatccaaatagaaaaagaagaagtcaaactatctttcttcgctaatgatatgattctatacctggaaaaccaggaagattcccccaaaaggcacttagaactgatgaattacttcagtgcagcttcaggatacaagataaatgcataaaattcagtggaacataacagtcaagccgagagacaaattaagaatgcaaaccaatttataatagcaatgaaaaaaaaatgcccaggaatactgctaatcaaggagataaaaaaaactctacaagtagaattacaaaacactgctgaataaaatcagagatgatacaaataaatggaaaaacattccattctcatggatagaaaaatcaatattaaaatgcccatacttcccaaagcaatttaaagattcaatggtattcctaccaaactatcaacatcatttttcacagaatttgaaaaaaaaagctattataaaattcatatggaaccaaaataaaaacctgaatggcaaaaggtattcttaagcaaacaaacaaacaaacgaaatgagctggagatatgttatcctacttcaaactggactacaagggtacaggaaccaaaccatcacaaggctaggacaaaaaccagacacactggccagtggaacagaatagaaattacatgaataaagccctgtacctacaaccatctgatcttcaggaaagtgaacaaaaataaggaatggggcaaagattccctattcaataaatactgtgaggataactggctagccatatgcagaagaatgaaagtgaatccctatctatcaccatacataaaattaacttatgacagattaatgacttaaatgaaagaactataaatacaaaattctagaagaaaatccagaacatactttcttgatatcagccttggcaaataattaatggccaagtcctcaaaactagttgcaacaaaaacaaaaattaacaagtggggcctaactaaattaaagagcttcttctcagcaagagagtttctcttgatgtgaagaagctctgacaatctgtgctcagacaatctgtgaagacaaaccatctgcagaatgggagaaaatattcagaaactatgtcatatccagaatctataaaccccaatatccagaatctataagaaatgtaaattaatcaataagcaaaaaacaaataaccccatgaaaaagtggagaaaggacatggacagccacttctcaaaagaagacatacaagcagaaaacaatcattaataaaaaaaaattgatagaccgctagcaagactaataaagaaaaaaagagagaagaatcaaatagacgcaacaaaaaatgataaaggggatatcaccaccgatcccacagaaatacaaactaccatcagagaatagtataaacacctctacgcaaataaactagaaaatctagaagaaatggataaatttctcgacacatacactctcccaagactaaaccaggaaggagttgaatctctgaatagaccaagaacaggagctgaaattgtggcaataatcaatagcttaccaacgaaaaaagtccaggaccagatggattgacagccgaattctcccagaggtacaaggaggaactggtaccattccttctgaaactattccaatcaatagaaaaaaaagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcattatacgcaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccacagccaatatcatactgaatgggcaaaaaactggaagcattccctttgaaaactggcacaagacagggatgccctctctcaccactcctattcaacatagtgttggaatttttggccagggcaattaggcaggagaaggaaataaagggcattcaattaggaaaagaggaagtcaaattgtccctttttgcagacgacatgattgtatatctagaaaaccccattgtctcagcccaaaatctccttaagctgataagcaacttcagcaaagtctcaggatacaaaatcaatgtacaaaaatcacaagcactcttatacaacaacaagagacaaacagagagccaaatcatgagtgaactcccattcacaattgcttcaaagagaataaaatacttaggaattcaacttacaagggatgtgaaggacctctccaaggagaactacaaaccactgctcaacgaaataaaagaggatacaaacaaatggaagaatattccatgctcatgggtaggaacaatcaatatcgtgaaaatggccatactgcccaaggtaatttacagattcaatgccatccccatcaagctaacaatgactttcttcacagaattggaaaaaactactttaaagttcatatggaaccaaaaaagagcccgcattgccaagtcaatcctaagccaaaagaacaaagctggaggcatcacactacctgacttcaaactatgctacaaggctacagtaaccaaaacagcatggtactggtaccaaaacagcatggtactggtaccaaaacagagatatagatcaatggaacagaacagagccctcagaaataaggccgcatatctacaactatctgatctttgacaaacctgaccaaaacaagcaatggggaaaggattccctatttaataaatggtgctgggaaaactggctagccatatgtagaaagctgaaactggatcccttccttacaccttatacaaaaatcaattcaagatggattaaagacttgaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacgagaaaaaaacaaacaactccatcaaaaagtgggcaaaggacatgaacagacacttctcaaaagaagacatttatgcatccaaaaaacacatgaaaaaatgctcaccatcactagccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaatcatcattctcagtaaactatcacaaggacaaaaaaccaaacaccgcatattgtcactcataggtgggaattgaacaatgagaaaacatggacacaggaaggggaacatcacactctggggactgttgtgaggtggggggaggggagagggatagcattgggagatatacctaatgctagatgacgagttagtgggtgcagcgcaccggcatggcacatgtatacatatgtaactaatctgcacattgtgcacatgtatcctaaaacttaaagtataataataataaataaaataaaataaaataaaaaaataaatgctcattatcactaatcagagaaatgcaaatcaaaaccacaatgagatatcatcttacaccagttagaatggcttttgttaaacagtcagaaatataacagatgttgttaaggctctggagaaaatggaacacttgtacactgttggtggggatctaacttagttcaaccaccatggagagcagtctggaaatttctcaaagaactaagagttgaactgccattcaacccagcaattccattactgggtatatacataaagaaaaaaaattgtatcaaaaagtcatatccacttgtatgttcattgcagcaccattcacaatagcaaagacatggagttaactcaggtgtccatcaacagtgggttgcataaagaaaatgtggtacatatacaccatgggacactatgcagccataaaaaaatgaaattatgtcctttgcagcaacatggatgcaactggaggccattatcctaagcaaactaacacagaagcagaaagccaaataccacattttctcacttgtaggtgggaactaatcgttgagtacacatgaaagtaaagatggaaagagacactgggggatgcaagaggggagagggaggaagtagggcaagcattcagaaactacctattaggtacaatgctcactatctgggagatggatacttttatactccaagcctcagcatcatttaataaaactttgtaataaacctgtgattgtacactctgattctaaagttgaaaaaatgaattaataaaattaacatttccaattactaaagaaaaaaataaagtaattttaaaaataaatagagaataaatgaatgtattatattgtcaacattttcacaaattatctttttaacaattcttaagaaactctttgcaatgtttaacacaattagatcagtgcagtcattataaactatttcaaaaaattctttaatactcttctctccaaaaagtaacatctgttccccatttactgcccataaaatataggctggacttagtaaaataataaataaatatttttaaggtaagatgaagaattggtgacactcaggcggacttaggagctgatcaaatttgagctgctttcattcctgccttttctatttcagtacccaggaacttgctgtattccccctgctcttaggtaggatgaatataaaaggcaacccacattgtctaaaaatagacctcagtccactttgacaaagcactctatccagcaacactctgctgccacactctcattaaaacaatggagatgtcagcatcatctatttcatttctactggagagcacaagccttcttcaatattttgacctatctccactggagaggaagaatttgatttgtaaagacatgggactagcttcgttagatattaatgaatcagctaaggagcctctatatggctgctgaaacgatctgtcagcattcccattataaatctctctctctaatggattataatgttaacaaaaaaatcatttcagaatgaaatttggcatgtggtttatacatttctgggataatactgattttttttattagccaaaattaaaaataaaattagtattaaactacagcattgtactataactcaaccaacaagaaaagtaggtaagacttgccggcccacctctggaaaaactgaaaaaatataaagtctcctcctttatcaggaaaaaaaatatgaaaataaacacaccgatttttcaaaaaattaatttttatatatattcagtatccccccacgaaaatatctacagagttaccctgtgacaatgaatattagaaggtttagattacattttaataactattcaaagacattgtaaaaattgagatttctgtttccataaaaattcatttaggaccacatcaatttcttgatgaagccacatataatttcaggcagattaaaatgaatgcttgcatgtgtttgtttgtattgttgaccctttaacaacacagttttaaactgaatgggtccatcttcttctgcctccgccacccctgaaataccaggacccacctcccctcttcttcctcctcctcagcctaaacaatgtgaagacaaagagaaagaagacttttatgatgatccacttccacttaataaattgtaaacgtattttctcttacttatagttttcttaataacattttctgttctctaccttactttattggaagaatacagaatataatatatagaacatacaaaatatgagttaatcaactgtttatgttatcagtaaggcttctagtcaatagtaacccattattaagttttgggggagtaaaaacttatacatggatttttgactgtgcatgggattggtaccattaacctctgcattgtacaagagtctccagcatgtgtgtatgtgtataaacacatatactacacgtatatatacacacacagacatgtataacagaaaaaattcaaagtatgatatgatatgctttactttacataaaatatgatggtagaaaatctggaaaatggacataatggcaaaatgaaaattattcaaaatctcatccaaattaattatattttgttgaaaccaatataaaaatacaaatatagtgtatatgtatgcatgtttataaacagttaattaagataaattgatatgttctaaaacttcaatatcaaatattctattggatttattttaacatatttggaaataaaagtatgcagatgtaatatttttagactatgaaaactgtatcatttcattttttccttatgtcttattttcttagtttcctctcagcccaaagctaaaaattaagtgaaatcatccatatatatatatatatatgtatatgcctatacagtgatctatgcacacatatatacatacatactattctatccatccatccatccatccatgcatacatacatacatatatacatacatacataaatttattcaatgaacaatttagtgatactatctaggcagaaaaacactatcctaagtggtaaggatacatggttaataagaccaataaaacccctgtcctatataaattacagtttttcagggagagagacaagtaataaataaacaaatatataaaataatttcagatgatgatatttacacttaaagtggccgctccaggaatcggttgaaattatgacctcagggaataagaatgcaggttgtgccaagaagctaaagatcataggtaagttgtattaacatgtccctagaaaataaatagtcttgaaagctagaattttctgaggtggaaattttttctaaagccctttagcttgggctatttagagttaaacttatttggctctattcaactaggtagagaaaagtcaacacaagaagccgaccgagcactgtactttgctcctttttttgtttgtttgttttgttttttccagccttggtggaatgggagaagaaaaaaaagaggtttggggagagtggagatttgagatgctgaagttttagtcgtccatccacatcttggagcaataccttgagaagttcaggaagcctttacaaatatccaatatatttggggaagctcaatagggacatgaatgtgctgctgacagagacagttgataagccaagatcttagatccagacatgtaggtggcgacttcaagtctgaaaataaatgcctgggcacagccgatggaatattctaccccgtgccaaaatgagaccattaacattgtcacagaagctaataaaggagcaaactaaaccagttacttacaggggacactataagggatctagagtattttatatggagatgaacccttttctatccctctgacatgttgtccgtgcagtgcaaagtggactgcctatatactcaaaaggcactttaaagaggaacactgggggaggagaaaatgtgaaaaacaacatatagttctttttttttattattatactttaagttttagggtacatgtgcacgttgtgctggttagttacatatgtatacatgtgccatgctggtacccaaatgactataaatcatgctgctataaagacacatgcacacgtatgtttattgcggcattattcacaatagcaaagacttgaaacaacgtataattctaaaagcctgagttacgttttaaaaatgcctttgcttattaaataacactgagttttactccactagtcaaaatttaatttttcccagccagaagaaaggtctaaaaggaagaagagttatagagatgcaaaagctacatttgctggctgggcacagcggctcatgtctgtaatcccagcactttaggatgccaaggtgtgtggatcatctgaggtcaggagttcaagaccagcctggccaatatggtaaaaccccgtctctactaaaaatagaaaaattagccaggcattgcggcaggctcctgtaatcccagccacttaagaggctcaggcaagagaattgcttgaacccgggaggcggaggttgcagtgagtcaagatcacgccactgcactccagcctgggcaacaaagggagacttcatctcaaaataaataaatacataaaaacataaaagctatatttgttttgcacatgtgaatattgtggtagcaaggtctgagcccattagaaaagtgaaagtatatagttaagggctttgatccacgttttgtttctttggagatatccaaaagtcaagagaaatacgactttctaaatccagagattttctacctcatgcccaccaccacctttcactattttcaactatgaagaagggaatctacatggctatgagacagctatacagtgtgacaaacaagccaaagaaatcggtggagttgctggtgttcttgcttctgtacttctaattcttagtagctttccgggaaagaaggcaacactcacagattgtgtatgtctattcttaatctattttacttttttcatctatgagaaataaattgacctattaataatcatttattcaactgataatttttaaagtacataagtgtatctggcatgatgctaagtgttggaacaaagacacagttcctttcttcaaaaagattacagtctagaaaatgagtacaatgaaagaaatagaacttcatctcttcaatatgattaggcagctctctgattttaaaaaataatggcatcacagtatgctatgtatcatttctcaagaagatacaaggaaagcaaatactatggaatactgattcaaggaagaggtcaaaatactgttaataattatcaattatataaataggtgctattaactgaactgttattacacatcaaatattatgttgcaaaacatacattggacaagtcaatctcaattttggctgatagtagaatcacctagggccttttaccaactgtaatgcccaggttcacctaggccaattaaactaccatctctgggggtaagaaccatgtctatgtatactttaaagctccccaagtacttctagtgtgcagccaagtttgagccctactatctcagacacattttaaataagcattttttattggatatagacatttgaaaattgggtctatatttagcttttctatatactgctagagctgaatagtagcagagagtgtgatatgtgagaacagaaatgtggtttcagaataaattaatggcatttcagtgtgcttcctgcagctggctcagaaaagcagttcattcataatagaaggacatgagaatatatgattcacattcaaatgaagcagagctctctccatattatgaccatgtagaaactgcaagtaaggagcagtattcatattactcaaacaccaacatgaatgtagatattaatttattcccattaagttatatatcccatggcagtcatgttgcaacacaagttttgtcactttttcatccaatatttttactaaaacataacatcaacaactcaagatagcaaagtttgctactaggggcataaactgggagaatctgggccagatcttcccaagaggtgtttcttgttttgtgtgtacaaaaagtttttaaaacttgatgattttatgcatgaacaacatgaacaaatcctagtttccacctttttttagactagtctgtgtccttacatgacaagagttggctttaaatgaatagcagatggtacatttaggcaaggcactgccctccagcgtgcctccgtcctctacctggtgtacaccacttactcgtactcctgcctagtccccatgactgttggaattctagacctttggtatattcattatagacccaggccatgcagccagaatgaatagattataattccagctcattattgattatctataaaactgtggacaattcaaatgaatggtctggcacaataccttgtctttttttttctttttttttttttctgagatggagtcttgctctgtcgtccaggctggagtgcggtggtgcaatcttggctccttgcaacctttgcctcccgggttcaagcaattcttctgcctcagcctccccagtagctgggattacaggcacctgccacaacacccagctaatttttgtatttttagtagagatggggtttcaccatgttggccaggctggtcttgaactcttgacatcatgatccacctgcctcggcctcccaaagtgctgggattacaggcatgagccatggcgtctggccctatccattatttttataattaaaaattgtcaggaaaaaagctacctatatgttttaaacctgcacactaaattttagaaatctagacactagaaataatttcagaaattccgaatatttatgtttaaagatattttcaaagaattatttgtaatagtgaggaacaaaaaataatataaaggtttaccaataagaaatggtgaaatacaatggcaaagacttggaaccaacccaaatgtccatcaatgatagactggattaagaaagtgtggcacatacacaccacggaatactatgcagccataaaaaaggatgagttcatgtcctttgtagggacatggatgaagctggaaaccatcattctgagcaaaccattgcagaaacagaaaatcaaacactgaatgttctcactcataggtgggaattgaacaacgagaacacatggacacggggtggggaacatcacataccggggcctttcgtggggcaggaggaggggggagggatagcattaggagatatacctaatgtaactgaccagttaatgtgcagcacaccagcacagcacatgtatacatatgtaacaaacctgtaagttgtgcacatgtaccctagaacttaaagtaaaataaaaaaaaaacttaaaaatgaaaaaaataataatctttaaaaaaaaagaaacaaaaaaaaagaaatggtgaaataaatcctgatacatcagtggcatggagtacaaggttttaattagaaaacatgatgtagtttccctcagaacatttactgtgggtagtaagataacttgtttaaaagaacagtcagtccacaaatttggagttcaataaaaattttatagtatccccaaattctcttaaaaatttcaaatttgcttttgaacacaggaaatgattactttaaaagcttagccttgtcactcagccatcaatactgcattgtatgaggtgagttgtggatataaaataagtataatatttgggtgtatgagtgtatactttctagacttttttgttaactttttttttttttttttttgagacaagagtcttgctctgttaccaggctggagtacagtggtgcgatctcggctcactgtaacatttgcctctggagttcaagcgattctcctttctcagcctcccgagtagctgggattacaggcacatgccaccatgccctgctaatttttgtatttctagacttttttgttaacttttttttttttttttttttttttgagacaagagtcttgctctgttaccaggctagagtacagtggtgcgatctcggctcactgcaacctttgcctctcgagttcaagcgattctccttcctcagcctcccgagtagctgggattacaggcacatgccaccacgccctgctaatttttgtatttttagtagagactgggttttaccatgttgaccaggctgatctcgaactcctgacctggtgatccacccacctcggcctcccaaagtgctgggattacaggagtgagccaccgtgcccaatcttttttgctaacttttaaatcttttttaaaaattaaagtttaacttacatacagaaagtttactatttttagcataaaatactgtgagttttggtaaatgcatgtagctgaacgaccaccaccacaatcaagatattaaattgtcccaaaccctcaacccacaaaattgtctctgcagctatttgttgttaagacctttcttcacctctaagcccaggaaaccactgatctgttttctgtcgctgtggttttacttcttccagaatcctacaatagctaggcttctttcatttagcataatgcatttgaaatctatgttgtgtgtatcaataatttgtactatcctatgctatggatataccacagtttattcagtcatgaactgaaggatatttaggctgttttcaatttggggcaagtatgattgaagctgctataaacacctacgtataggttttagggaatatgtttgtattttacattcataaatacctagggttgggattactggatattgtagtaagattctgttcaactgtgcaataaactgctaaactgtttccaaagggactatactattttttgcattcccacaagcaaagtatgagacttactgttggcatcatttagcataagtgttttaaaagttttagtcgttctagtaactatgtgtagctctctcatggtttcaatctgtatttgcctagtgaaaaataattttgaatatcttttttatgtggttatatattatctgtatgtttttagtttctatacaaaatattttgctcatttttagtggatgatttgtttttattattgttttgagagttcttcatatattttgattacaaatcattcatcagatatgtgattcacaaatattttctcttagttttatcgtcatattctcttaaaacgtctttgaaaaattttgcatgtatacatagtggaatattattgagccttaaagaagaaggaaatcaggccaggtgtggtggctcacgcttgtaatcccagcactttgggaggccgaggtgggcggatcacctgaggtcaggagtttgagaccagcctgaccaacatggagaaacctcacctctactaaaaatacaaaattagctgggcgtggtggcacacgcctgtaatcccagctactcaagaggctgaggcaggagaatagcttgaacctggaaggcggaggttgtggtgagccaagatcgcaccattgcactccagcctgggcaacaagagtgaactccccccctaccctcccccaaaaagaaggaaattctgacatttgtgacagcatggatgaagctggagaacattttatttactaagtgatatatgccagtcagagaaagacaaatactacatgagctcacatatctgtggaatataaaacattgaactaattgaagtagagaatagaattgcagttatcaggggctgatgggtgaggaatggggagacgttggtcaaagagtaaaagtttccattagacagaagaaataagttctggacatctattttacatcatggaaactatagttaataataatacattgtatgtatgaaagttgttgagagtagattttaaataatctcatctccaaaaatgataataagcatgtgaggtgatagatatgttaatttgatttaattatactgtaatgtgtacatacatcacaatatcacattgtaccccataaatatatacaatttttgtcattaaaaataaattaaatatttttaaaaatgtattttaaatagcagaaatttttattttgataaagaaaaatttatgattttgtgggtcttgcttttcatattgtttctaaaaattatttgcttaacccaaagattaaatgattttatctttccagacatttacactttgggcatttacttttaggtctataatctatatttatacaatttttatatattatatatatatatgttgctaatatgatgaatcacaattttttaaactttaagttcaggatacatgtgcaggtttgttatataggtgaactactgtcactgaggtttcttgtacagattattttgtcactcaactattaagcctagtattcattagttatttttcctaattctttctctcccacccttcaccctctgggaggtaacagtgtcttttgttctcctttatgtgttctcatcatttagctcccacttataaattagaacatgtggtatttggttttctgttcctgcaaatgacatgatcttgttctttttagtggctgcgtagaattccatggtatatattgtaccacattttttttagccagtctaccattgatgggcatgtaagttgattctatgtctttgatattgtgaatagtgttgcaatgaacagacacatgcatgtatttttatgatagaatgatttataatgttgagggtatacccagtaaaggagttgctgggtggaatggtagttctgttttgagaaattaccacactgctttctacaatggttgaattaatttacactccctacaacagtgtataagcacttttttactgcaacttcactagcatctgtaattttttgactttttaactatagccattctgactggtgtgagatggtatctcattgtggttttaatttgcatttcactaataatcagtgatgctgagctttttttatatggttgttggctgcatgtatgtcttcttttgaaaaatgcctgttatgttctttgcccactttttaatggggttgttttctacttgtaaatttgtttaagttctttataaatgctgtatattagacctttgtcaaatgtacaatttgaacaaaaattctgccattctgtaggttatctgtttatgaatagtttcttttgttgtgcagaagttatttagtttaattagctctcatttgtcaatttttgcattggttgcagttgcttttgatgcttacttcatgaaatctgtacccattcctaaacccagaatgttattgcctaggttgtcttccagagtttttataattttgggttttacatttaaatttttaatccatcttgaattgacttttctatatggggtccagtttcagtcttctgcatatagctagctagctatcccagtaccatttattgaatagggatccctttccccattgcttttatcagctttattgaagatcagatggctgtagcagggtggcctatttctaggatctctatactgtttcattggtctatatgcctgtttttgtaccagtaccatgctgttttgtttactgtagccctgtaacataatttgaagtcaggtagcatgctgcctctagctttgttctttttgcttaggattgtcttggttattcagcctcttttttggtcccatatgaatttactttttgtttttctaggtctgtgaagtacataattggtagtttcataataatagtattgaatctttgaattgttttgggaagtatggccattttaacaatattgatttttcctatccatgagcatagaatgtttctccatttgtttctgtcatccctgatttctttgagcagtgttttattgttctcattctagagctctttcacctacatggttagctgtaatcctaggtattttactctttttgtggcaattttgaatgagatagcattcctgatttggttctcagtttgacggttattggcatattggaatgctggtgatttttttttatgttggttttatatcatgagactttgctgaagttgtttaccagctgaaggagcttttggaacaagactatagggcttcctagatatggagtcatgttgtctgccaacaggatagtttgacttcctctcttcctatttagatgtgctttatttctttctcttgcctgtttgttctcgccaggacttccaataacatgttgaatagaagagatgagagagggactccttgtcttgtgacagttttcaaggggaatgctttaagcttttgcccattaagtacaacgttggctgtgtgtttgtcataaacgacttattattttgaggtatgtttcttcaatactacatgtttgagagtttttaacatgaagtggtgttgaattttatcaaaagcttcctctccatctattgagataagtatgtggttttgtctttagttatgtttatttgataaatcacattcattgatttgcctatattgaaccaatcttgcatcccagagataaagcctacttggttgtggtggataagcttttttaatgtgctgctggacttagtttgcaagtatatccttgaggatttttgtatcaatgttcatcaaggatggtggccttaagttgtctttttgtgttgtgtctctggcatgtttggatatcaggatgatgctggcttcatagaatgagttagggaagagtcatttctcctcaattttttttggaatagtttcagtaggaaactcttctattatgtttttccaaaaaacaactcatggattttttgctcttttgaatgtttgtgtgtgtgtgtgtgtgtgtgtgtgtgtgtgtgtgtgtgtgtgtgcctgtctcctttggttcagctctaattttggttatttcttgtcttctgccagctttggcattggtttactcttggttctctagctcttttagttgtgatgttaggttgttaatttgagattgttctaactttttaatgtgaggatttagtgctctaaatttccttcttaacactgccctagctatgtgccagagattctggtgtgttgtatcttttctctcatgagtttcaaagaacttcttgatttctcccttaattttattatttactcaaaagtcattcaggaaaagtcatttaatttctatgtaactatgaggttttcagtgatttctttagtcttgatttctaattttattgtgtgtgctgtggtccaagagagttgttatgggttcatttatttcgcatttgctgatgattgttttatatatgattgtttggtctattttagagtatatgccctgtggcaatgagaacagtgtgtattcttgttttggggtagagagttgtgtagatgtctatcagatccatttgtttcagtgctgagttcaggtcctcaatatctttgttaattttctgcctcagtgttctgtctaatactgtcagtggtgttgtgaaatctccccctattgttgcatgggagtctaagtctcttggaaagtttttaagaacttgctttatgaatctgagtgctcgtatgttgagtgcatatatatttaggatagttaggtcttctcttgaattgaaccttctaccattacctaacacccttctttgtcttttttctttgttggcttaaagtctgttttgtctgaaactaggattgcaacttctgcttttttctgttttccatttgcctggcagatttttctctatccttttattttgagactatgagtgtcactggctttgagaagggtctcttgaagaaagaataccattgcatcttggttctatacccagtttgtcactctgtgccttttgattgggggcatttagcccatctacattcaagtttagtattgatacatgtggatttgattctgtcatcatgacatcagctggctgttatgcagacattttttgggggttgctttttatagtcagtggtttgtgtacttcagtgtgtttttgtgacaattgataaaggtctttcctttccatatttagcgcttccttcaggagctcttgtaaggctggtctggtttttacaaattccttcttcatttgcttgtctaaaagggatcttatttctcctttgcttataaagctgagtttggcaagacatgaagttctggatttgaatttcttttccttaagaatgttgaatattggccttcagtctcttctggatagtagtgtctctgctgagaggtctggtgttagtctcacgggcttccctttgtaggtaactggacctttctctcttactgcctttaacattttttttcctttcattttgcccttggggaatctgataattatgtgacttggaaatgatcttcttgtgaagtatcttactgggtttctcgacatttttaaatgtaaatgttggcctttctagttaggttggggaaattctcatggatgatatccgaaaatatgttttcaagttggttccattccattatcctcatctctttcagggacaaaaatgaatcatagatttgacctccatacataacctcatgcttttcattagttttatttattattttttattcttttttctctattcttctttgactatctattttagaaagccagtcttcaagctctgagattcttcctttggcttgttctattgtgctactaataccggtgattgcattgtgaaattattgtagtatgtttttcaaccctatcaagttgtttatggttttttgtttgtttgtttgtttgtttttgacagagtctcaccctgttgcccaggctggagtgcaatggcgcgataacagctcactacaacctcctcctcctgagttcaaacaattcttctgtctcagacccccgcttaactgggattacaggtgcccccaccacacccaactaattttttgtgtttttagtagagatggggtttcaccatgttggccaggctgttctcgaactcctgacctcatgatctgcccacttcggccccctgaagttgttggggttacaggcgtgagccactgcacccagccatttatgttcttttctatactgggtattttatctgtcagctcttgtatagttttaccatgtttaatttttaaacatttaatcagccatgcattttagtgataacccccattttgtaataatgaattgctctgttaatacactgttggatttggtttgctaaaattctgttaggaatttctgttctagtaccaaaatagcagcctagaagcaagctagcttcactgccactcataggaaaccagaaacaaatacataatgctgtggttattaccatcaacatctcaggatttaaaaccagggaggaaacagttccctgggctgcagataaatagaagcattctgagcatatggtaaaagaaccaaatattcatatccacgatgcctcctccaaatttgcctgccaccaactgcatggaaaatttccccctgacttattgtctctacaccgttaaaaatgagattgagatgggcaaccagcctcctcagtacctcaggtccactggcaggatatttgtattttcctcaatccacaagaagcatcaggagtgcctaaagggcaaaatatccctaaggatatccagagacaatatggggaggtggaactgccatcctcagtcttggaaactctgctctataactctttcaaaggagaccccaagtcagagtggctgttcagcagcaccatgttgtaggaggtttgttccactggtccccctgggcatgaacacctaggaagccttctcacactaattggaaattgtctttggaatatcccccattccagacagactgtattctaattatttactagaactcaggtaaatatgggcttaaggtaccatctactctcaaaaaaggcaaaaatgtggggagaaaaaggaaaaaaagaaataataaatgaatgaaaatacaaagaaagaaagaaagaaaatcaacaggtaagttaaaaagaatctaagcaaatatagtctaattttctaagcaaatatatctaagcaaatatagtcaggaaaatattgcaaatatatctaagcaaatatagtcaggaaaaaatattgcaaatatatctaagcaaatatagtcaggaaaaaaaaagccaggcagagaagtctggaataaacaactaatcttggaagcactttaatagatgtgcatgcacaaaaaataacagcaaatagaaaaccacgacctccacagacaaagcaataaacctgtgactgaccttcacaagacagtaatatatgaactccttgataaataatttaaaatatcaattttaaggaaactcagtgatctcccagataacatagaaaaataattcagaaatttatcagataaattataagaaaaaaataatttttaaaatcaaacagaaatcttggaagtgagaaatatatttgctgagcaaaaaaaaattattagaggctcttagtaacagaatggatcaagcagaggaaataattactgagctcgaagaatggctatttgaaaatacacagctagagggaaaaaaaagattgaaaattaaggaaagtaagctaccagatatagaaaataacctcaacaggcagaatccgagaattattggtgttcaaaagggatttgagcaagaatgaggagaaggaaacttcccttcattcacaaaaacaataatacaaaacattctaaaacttggcaaaatgacaaatatctgggtacagaaaggactcaattcttccattgaaagtcatagagtggctgaatggataaagaaacaagatctaaatatttaatgccaaaaagaaacccacttcaccaataaaggcacatgtagactgaaaatgaatgggtagagaatgatattccatacaactggaaaccaaaaaaagaggaggagcagctctacttatatcagaataaaatagactattacaaacaggtatacaccaataaattggaaaacttattgaatacattcctgggcacatataatctgacaagtttgaagcatgaggatattgagaacctcaacaaaccaataacaagtaatgagattgaagtcataacaaaaaggtttcataaaagaaaagcccagaatctgttggcttcactgctgaattttacccaacctttcaagaagaatgaataccaattcttctcaaagatcatagcagaaccaagaacaaaaaccatatggttattttaatagataccaaaaaagcattcaatacaatataatattcctttatggtaaaaatcctcaaaaactggatatagaaaaaacatacctcatgaaaataaaggctatgtaagccaagcccacagctaaccattatactaaataggaaaataatgaaatcctcttttatgtctagaacaaaacaaggatactcattttcaccacttttatttaacacagtactggaagccctagccacagaaattagtcaagagaaagaaacaaagggcatccaaattgggaagaaaaactaaaattagtcttgtttgcacatgcatgatcttatacctagaaaaacctgaagacaacataaaacaaagttagaactgataaattcagtacagttggaagatacggaatcaacatccaaaaatcagtagcagttatataattcttcagttaacaatatgaaatagaaatcaataaaacaatcccatttgcagtagctacaaagaatataaaatgcctagaaatcaatttaaccaaagatataaaaatcctgtaggagaaaactacaaaatactgatgaaagaaattgaagagaacacacagaaatgaaaagatatttcatgttcatgaacttgaagaatattgttaaaatgacaatactactcaaagcagtttacaaatttaatgcaatcccaatgaaaacaccaataacattattcacacaaattttaaaatttctacactgtccatggaatcacaaaaagatcctgaatagccaaagcaatcctaaacaaaaagaacaaagcatcacactacctgacttcaaaatatactaggaagctatagtaaattgtacctgcataaaaccagacacatacatcaatggagcagaatagagagaactcagatataaacctaggcatttaccaccaattcatttttttcacaaaggtaccaagaacttacaggggaaatgacaatcttttcaatagatggttctgagaaaactggataaacataggtacaggaattaaactagaccctatctctcaccatatataacaataaaatcaaaatgatttgcaaatcttaatcgaagacttgaaaccctgaaactattataagaaaatttaaggatatgcttcagggcaatggtttgggcaaagaattttcgtgtaagaccacaaaagcaaggcattgcaagccataatagctgaatgggattatatcaagctaaaaaccttttgcacaaaaaaggaaacagtcaataaaataaagacataacttaaatgggagaaaatgtttccaaactatccatctgacaaaagattaataaccagaatatataagaagctgaaatggctcaatagcaaaaagataataatctaattgcaaaatgggcaaaagatcctaaatgacatttctcaaaagaaaacatacaaatgaccaaaagtatattttttaaaaaaatgcttaacatcactaatcatcagaaaaatgcaaatcaaaactacaatgaaatgttttaccctagttaaaatggtatttataaaaaaataaagaatattgatgctagtgaggatgtggagaaaggggaacccttgcacactattggtgcaggtacaaattagtatagccactgtggataactgtatgaaggttcctcaataaatgaaaaaatcacaactaccttaggatccagcaattccactgctgggtataaagccaagagaaaaaataatgagtaaatcaaagaaatatgtacattcctcatttactgtagcaccctttacaaaaaaaataaaaattgaatcaacctaattgcctgtcaatgtatgaatggataaaggaaatgtgatatatatacacaatgaaataatattcagccataaaaagaacaaaattctgtcatttgcagcaatattaatgaaactgtatatcattatattaagtgagataagccaagcagagcaagacatatatcacatattctcactcctatgtgggagctaaaaaaggagatcttatgaagacagacagtaaattggtgttttccaaaggccagaaagggtagagagtagaaggggttgaagaaagtttgatgaatgggtacgaactaacagttttatacgtacgtatatacacatatatacatgtatataaacatatatatacacatatatacatgtatatgtatatacatgtatatatgtgtatatatatacatatacacgtatatatatacatatacatgtacatatatatatacatatacatatatataaatatatatggagctgggggccttgatcacccctcaatattgtatagctttactttattaagctatgttacacacaaacattttttggtttttgattttgtcacatgcatattattattcttttcttctttagccagtacttcagggaaaaaatgtaagcaagatgtattacttaatgtcaacaactagattggctccaaaaggaatatataatggaaatctatatctgtatctatctactacctatctaaatgtctatctctctatatagagagaaagagaaaaacacacaaagagggggaaagaaataagaaaaggaatcatgaaataaactttaaatgtgattattttttattttttaaataacccttattctactgagtgtcattgtttttaaattttgattatcctaattaaaaaatgattttgaattatattctctaattgatcaaatatataaatttctcatggaggccagtttttactttttgctatctttttcctggaccctaaatccacccttcatttcaacttgattttaattactgtctttgaaaatgtaccacatataacttagaaatacttttgccatcatttgaaataaatgtaaacaaaaaccatcctttaactgttataacattttaaaatatttgcattagaacttattcttatgtgactatactcacttttataaagtgagagtgaatttctaagctgactagaataaatatgactcaatcaaccacaattccattaaagttgctgttatttttacatactaaaacatattttaatctcataattcatttccaaattcatgctatcagtttattttctatatatagatcaaagacaagattgaaaaccaactcagtatattttaaatggtaggcaagttagaacaacaatttttacttgagctgaccaaggtcaacagctcaaagcacaatatattctcaaagaatattcttcttagtaatcctcttcaaaaatatattgaaaatcaagtgtacctggatattgctattttcatgcaggttaatgccaaatatccaagtcatatgttcaacaataagacaaaaatctattaacattctttttgaagggtcatttagagtattaccattttcataacttgaatagtcctttttatttcatattttgccatttattttcacaatattaacataaagtaaatgtgtattgtagtctatatggcaatgaactatttttaacacacacacctagacccagaattcaaaaagatcacttggcctgaagcacaggatagaagaatatcatcactattctttcaagtgggaaatgcaatttaaaaaccaatgttcaactgatatctggatatcagtgcataaaaatacctgcactaatatttaataaccttgagggattataaaatacagaacagagaacacatataataatatcttcaggttttcatttccacaaaacctacaaatctattttagcactcaagttaaatggcttctagagggccataagattacacactttcaaaatacaaatgacaacaatttattgaatcaattaattagctatttattatttcagtaactgaattgaactgtttctagtcatgagttttccagattcactgttttttctcccattatactaagtttgccatcgatgcattacagccaatgtctttccattgagtttgtttgatgttacctgaaaaaaaaaatctccttttacaaggggcagtatggaagatctaattgagtgtgctctaggacactaacttcatattacagttttgaggatgttcatatggtgtgactaaaatacaaaagaaaattatatgtgatttgcatcgtccttataaatctagaattaattgttaagtgggcagttcataagtaaaatatcaaagatttatttgaaagttggtattcaaatagaagtacacaaaagagtatattttattcaaatatatatacacacatacatccaggtttgatgagttaacaactaatgaagctgactctagattattcctgaaggtttaaaggttttagaaatataaaggatgacagaaaatctaatgagatatgctgagcttggaaggggacatggaagtaatttgaacaagaaaaaaaaaaaaagacaatagcatacatctgattcatctgaacttagagcactagacctacactttaacctgaactatccaaaagtcattaaggataagaaaaggggaagaaaattgcctcatctttgatggcctgaatcacatgtttaattagaagatgtaggaaatacctcagaactaaagaaattctcagggcctggtgccctacagaaacaaaagcacagttcagcaatctcgatggaatagctcacagtcctaacctataggctttatttatacagctcaaaagattaccaccctgtaacaggctattatgtcttatatttgcttggaagtaacatcaagttaatctttttacatctaacatttgatttttatttgccaagagtaattttcaaagcatgtgactcatattttgtccttggtgagagtctgaagtcatgaattttaataaacatgaagccacagctaagaatcaccaaaacttgttaacttgcaggatttctaagttaaaacagaatgaaatatatgcaataaaaggtagaataacatgctgaaaaaatttaatagtgtcaaacgtagaaaaaatatttagctctgtgtagaaaataaatagcttctttgtataacaatggcattcttatatatgacaatacggctagtaaaatgttttgtttagttgccaaatagtaaaatattaatgttttaaaagactcaatgctttcaaattaagaataaatcatggccaaaatgagcattgcaataataagacctagaatagttgatgaatgaattaaaataatggaggacaaatttaaatgtttattacagagccaaacatttctgaaatatttaaaacatttatcgaagtattttctcttaaaaaaaaccatactgtaaataattacacccatctgaatataatatcatgtttatgtatttgtagaaatctgaaaattttaaaggcatgagttctgtaaaattaaagaacatttaaatatataaatacacatgtcaatatatagatctatgcagacataatctatgttttatgtaaacataacctatgtattatgtaaacatataaagctatatattaaaatacaaaagtatttatatataatacatatcatatatattatgcattatatatacatgtatgcatatttaaataatgcataatatataaatacataaacctgtgtattaaaatatatgtacatatatacatacataaacctatgttttaaaatacgtatccataatatacatctctaatagagaagatactgtttaaatttttaattttgattgttagagatacctagtaataaagggactgaaaaattgaaaaaaaaaaaaaacaaaacactcacactgtgagaaaaaaaaattgtttgaaagcctgcatctgtctaacatcctatcagcaggcatattaactgaacaaagcacttgcttttttctgatgccaatgctgatttttttttgtttgtttacttaaaacatcattttcatagatattcaaaaagaagctttggtgtctgtctagttcattaatagttttattaattcagctagtcatcaggtgcaattcatcaaccgcacaaccctttgtgttctatttttgctaaatgcttcttctctggaatttaaattatgaagaaaaagtggctgactaatgtgaatttctcaatttattcatgttcaatgaaaagctattcatcagcataaactctgctgtgagttcaaatcaaatttgaaccacctgggagtaaacaaaattgttcttcttccctagcacttggaagtggataataataacacattttcaagaaagtcaggatactaatatatttaactgaaataaaataaagatgataaggcatcaagtttttccactatatcagatgttttgcccatgcaataagagcttctgaaatattttggtagttttatttccatcattaatgctaatttcttttatatcttgtaggtatacaataatcagctattctccataccctatagcatgtgcaaattctgtaagactattattctaccaactttcctttaaaacatttgaactatttatggaattgatggttaaaacaaagtattcactttcagaattgttattaagcattcaaaatcaacattcctataaacctaaaatacagaatttatctacttgagtttacaggtgcttagacttataaaagtagaccttttttttttttcataacaaatctaaggctaacagaagcttatggagtagtatggagcctgatgtgtatttcagagagaattaagaaataatcttgtagagagtcttctctagtaatagtggagctaattctcacctatttttgagcactcatggcaatacaagattaaagctggtgctggagatttttgggctcatgcgtgcacgtctaaataaattatcagtaggttaaaaacaaaggaacagaatgaaatggtaaagtgcacattccctttcacttattcttcttgaggactcaaagatacttggattcagcatataaaaacccatatatgtattacaaagtacaggagatccacagtcctcttcaggaaagagaattccattatctatttatctattaggaaatggaatactcttttctgaactgtaatttttaggaaagtattatgcatacatatatggaatatcttattagaagtggatgtacggagttttaaaataggatgatttatgaagttttctgtttaatacttattcttagcatacttccaaagcctctgaggctatccattttgtttcccaggaagctagataaagcccaaattcaccttctcccaatatagctgtaagagttgatactgtgtgatagaagataaaggccaaattcaccttctcccaatatagctgtaagagttgatactgtgtgatagaagataaagcccaaattcaccttctccctatatagctgtaagagttcatactgtgtgatagaagagaccaaaatgtgcaaagagctacagccctgtgaggagcctgcagtgcattgcaacttgagtttcaatctgaactgtatggacagagctcattgtacctcagtgaccattatccttggaagtgagggtaggaagtgaaaggaggcaattcacgtgtttttccttgaagctatattttaagactgtgtagaacatcttgaagtttggaaacatatttgcttttgcaggtgatggcattttctaaaatattattacaaaatatatgaaaattgcattgtagttgtcacaataaatcaaacatcttacataataatgtaataaaatctagtttaacattataattttattcaattatttcatccacattgagatatttactaagtcatgaagtttatatagatcatgagatgtaaaagatctgctattactaatttgatttaaaaatcccatgttcattataataggtagtgctgcttaaaatgtctgtgtaatgatctacactattatctgcagcacaatgatgttttcacagctgctgtttgcctggaatcagccatgtcctttgtgaaaccttgcctcggcatgggctcttattcctaacatttgccttttaaaatctctatagagatctaacagaaaattcacaagaacagcatcttttgtgcttctctttctctgaaaataccaaagcagcagtgtatcttcccatatttaaaaaagaaagaaaatgttttaatctttcattttccaatataaagtttttagccaaaaaagtatttattaaaagaaaatagatctgtcactcactaattcaatgactaactacataagtttaaatttactttttctttgagtatcagacaaaagtaaaacaaactaggaatttcagttctctttctgaaaaatgaagtatatattacataatgaaatatacatatatatacacacacacggcgctagcaattaaatctaaaatgtttactttatctagaagtagggcaaacagaatttaattctttgtttgtttccctctaatatttgtcatgtcttatggactggaggagccaatccacctgtcaggagtttattgcagaaaaatggtaacttctgggaaataattcatcctaaaaattgtcagaaaccagcttggttcaatatacagatatctttcagaatggagagataatcctgaaaacagcaatgttactaataatagttaaccccttactcccatccccattaatgtattgatgtccaaatcctatgaaaggaagaaaaaacctatgaataaaagcaggccgggcgcggtggctcacgcctgtaatcccagcactttgggaggccgaggcaggcggatcacgaggtcaggagatcgagaccatcctggctaacacagtgaaaccccgtctctactgaaaatacaaaaaattagccgggcgtggtggcgggcacctgtaatcccagctacctgggaggctgaggcaggagaatggcgtgaaccccggaggcggagcttgcagtgagcagagatcgcgccactgcactccagcctgggcgaaagagcgagactctgtctcaaaaaaaaaaaaaaaaaaaagcaatgagtaggaccacatttcttgtaatgacagagaactgaggtggctgtaccttccacaaataacaattctaaagtgaaaaaattataaaataggtcaactatttaaaggtactgtaaaaaacccaatgtagagagaatccaaaggaaattctaatcttgagtgtggctttttgaccaacttctacaacttcttctatagctgcaggaaataccagaacaaaactctacatccttgccagtaaaaggtgctgtagatgagtgtttaggcagaaaatctccaaattgtatcatctataattcccagttttcaaccaaaaattagtagacatgcaaagaaataagaaagtaaaatccatgctagtatgctcaatagaaggtgattccaagtgggtcaaaatattagatttagtttataaagtctttaaagcagctataataaatatattcaaataagaaaagataaatacactcaaatgattaaggaaaaatatgttctcaatatgatactctcttatcacaaaatgcaagtgagacattcttcaactttgacatgcagcacagaaaacagaagggacttttgcatatcaagaatttcaaagaatgatagagaaactttggtacatcaaatatgccaatgcatttatcacatgcaggcagcactggacaaaacttctggaagcagtagctcagaatctgatcctgagctgctgtagggagcattattgagaatatagacaactacctctttttgcacaggcctcattcttctcaaagtggccattgaaagaactggcaaggtcccttctgatgggcatattttactgagaaagctttttatattagaggactctcaaataaaattaaattattctttgaaagaaaaaataaaatcgtgttttagaaatcattttttggccaggcgtgcaggctcacacctgtaatcccagcactttgggaggccgaggcaggcagatcacgaggtcaggagatcggctcctggctaacacggtgaaaccccgtctctactaaaaacacaaaaaattaaccaggcgtggtggcaggcgcctgtagtcccagctactctggaggctgaggcaggagaatgatgtgaacccgggaggcggagcttgcagtgagtcgagatcgcaccactgcactccagcctgggcgacagagcaagactccgtctcaaagaaaacaaaaaggaatcattttctaaacaatacagttagtcacaacctgtattattccaaatacaaatattatcatttttgacaacacagtatcttccagttgcttttctatgtttctttttgattagcaattgtatatcatcacactaatagacattatggatgggtaaacattcataacaacattttttaaatactaggactgaacactgattcaagaacacaccctcattactcttctccacccggtataattttcaccaagtccttttccttgatttcactaagatgcaatcattacttctgcagtctagcaccattacaatttggtgcttggcacatattaggcaaaccatatatatttgttgaaatacatgagacaaatgccccaaacagcaacaatgtacatttataaagccccatttactgcagaagtgaattaagtatttagagagttatatctatacctgggagatctactgttcaacttcttaaatactcattttacccattgatatggtttggctgtgtccccacccaaatctcatcctgagttgtagctctcataattcccacatgttgtgggagggacctggtggagacaatttaatcacgggggtggtttcctccatacggttcttgatatggttcctgatacgagatctgatggttttataaggagaaaccctttcgcttggctctcattctctcttgccacggacatgtaggaagttcctttcaccttctgacatgatttgaggcgtccccagccacgtagaactgtggcttaaacctctttttctttataaattactcagtctctggtatatctttatttttatttttattttttgagacagactctcgctctgtctcccagcctggagtgcagcggcgcaatctcggctcactgcgagctccgcctcccgggttcacgccattctcctgcctcagcctcctgagtagctgggaccacaggcgcccgctaccacgcccggctaatttttgtatttttagtagagacggggtttcactgtgttaaccaggatggtctcgatctcctgaccttgtgatccacccgccgtggcctcccaaagtgctgggattacaggcatgagccaccgcgcctggcctggtatatctttattagcagtgtgaaaatggattaataacccccatcatgctgtttttttccaaacccaggaatagtaggcagtagaaaggacagaatcactctattatttaggtatgaaaagacatggtgttatattttccttggtcaatatttcaaggagccaaatgataccattccagcctcataagaatttatttcaagttccaaagattggttggtaaatttatttcaatgatggagcaatgaaaatatgtttacactgaataccaaatacacatatgatggttcttaaggagtcaaaatctaaagacgaccaactgaaaaagttacttggttctagtggcagatttttgtttataggcagtggtataaattatcgtctgttttttgttagactgccagtgctaaaatctcacctgaaggacaagtcaaaatctcttgcagcctataatatatttataagctacctcttataaatgttcatctactaatatcaccaccccatatgcagagatcctgtaagaataatattgtattttgatcttattaaagacagttaacaaaatattacaattatattattaataatacaaatttattttgttaacaaatcaagtagttgaaatcttacctactgaattacttgaaagtgatattatttgaatctgttctaacatctaaccactttctatccataattctccatgtgagccactacatcatgccttgttgggacctgccattctagctccttcacatttgatgcggctggttaacctattcatagctgactcttcttcaacctcatttaatgctgaactgaattaggagaacaggagcacaaagtggctatgacagaagttgggaacgtttccaagaaagtttataatacagagagcaattgtgttttgctatctgctgattaaatccaatcacaggcctgctagtgatacccaggccacttagcattcagtgttgggttatggtatatatgtgaagaggaataaactgaaatgtatatggaatcaaagataaaccttatcagctgactagatggatgaaccttacagaggagatacccatgcatacttataaataaaaatgttaacttaaataaaactaatagtgaaaaggacaaggttctattgtcacataaatatgactggagtctcctttttcctttgtaaaagtgaagccattgattggtgagtattaattacctaacaaataattcatattacagaatagaatgtggccattttttatctctatttggaatataacattagcgtatgattacagatggcagaatcatatatcaacattttattgtgattagatacacttgtgaaggggggatttattttgaagtgttggagaatgctctttagcgtattctagtagtgttttaaaattttgttaggtataaaaactttaagatcctttgaaaagaaattagaaaacaaaatattataaataatggagtgttacaggacacttattaaattggctaaggtattatttttactattataaagtacaaaaaatgagttaaggaaagtttaagtgatttgcccgtagtgactcacagctagtaagatgtagggtcagaattcccccatagattatcacatactgttatgatctcatcaaaactgaagtcattcatgttccagaaggataatgtccccaaatttccacacattcccagattgaccaatgttgttatttacataggaatattctcctttatcttaccatttccaaataacaattggccctaaaatcttttcagaacatttttttttaacacacagaagagattttagtactttacaagaggatatctcacacctaaggataaacagaaaataacaaagactcatagggatgcatgtgcttgtgcagctgtcagtcctcattcttgaggtaaacgcctttgtgtctgatgctctcacagcacactagattgaaaggtgaatctcaggacaattacaagtaataacaagccttgagccttgtagtctcacacaaatagttaaaccttgaatgttaaattttagatagccaaggtttgacttagtgctataataatgttggtcatacttatgtactgaattttgaggaaaattctttcctaccatgtgcagaaataaatgccagccatatgtgtatgcatatacaattaagtaatctatttagaactctatgtctgagcagtaatgagcttttgtttggcatcacttactaaattaagacaatttgcctaatgtggtagaggtgagggttaaaaatttcactcccagaaatattttgaatttttggttattgctatggtttgaatgtttgtcctgctaaacctcaggttgaaatttgatcccaatgttggaggtggaatcttatgggagatgtttgggtcctgggggaggataactcatgtccttccttggaactgagtgagttctcacccaattaattccagtgatagctgactgttaaaaacagcctggaaattcatccatttctctcttgcttcctctctcaccaagtgacctctgcacaggctggctccctttcaccttccaccatgagtggaaggaaaatgaggccctcaacagaaataggggcccaatttttaacttttggagacatcagaattgtgagccaaagaaacttttaaatttataaatcacccagcttcaggtatttctttttagcaacaccaaatgtactatgccaactatcatacatcaacgaaagatttttttttcctagctttctttccaaagatttggaatttaaatttttttacattttgaagtagtctgtgtatgtatttccccaaaaaaagtgaaatcaactaatcataagtgcatatatatacatatatatgtacagatgcctacggtaatttcaacaaatgtttatagaaaaaccataaaagaggcataatttattaagaactaataataaaaaagtaaccccatagtaaattaaactctatgcttaatgttaaagttagtctactttcttttgtttcaggaattggacattgttacagcttttctcaaatacagaaatccttaatggtaatcagtaaaattagtaaaaatgaatgcttgaaattacttgagaaaatagctagcttgagattgtctattattaaatacatttcttaaaataacccattagtagtgaggattagactcatttgctaagttagtgatgaaaaatgattcttctttatttgacaataaagccttaggtattgccctttgggttaagagagataagaactactcaatggaagaagctggatcaatccaaaaattatcaggatgctgtgcctgcaatagtactgctacttactagctctcttaaatctgataaggtcacttagcctcaccaaaatttcagtctcttcccttgaaaaactaatatactactattatttattgtcagaaagaaaatatgaggattagaagtcatgttaagaaaaagcatctggcttacccatggttcttaatgaatgatagctcttattatttgagtctcatcctatcaacaagcaaatcaattatttatctaaatttaaaaacataagaaaaatggaatatacataatataacattaaatatggttaccttaagatataatgattaagaataccaaatacttttctgcagtaactatctgaacagaaagtgatggcctaagattttttatgtgttaactttgaatgtaatggaaaaccttgcaatcccttaacatacagatcataggttcattagcaaactaatgttaccctgtggtacagattgttatatttaaatattaaagtatgttgaaatattctttccatttgatttaatttctaattttcaaaaatctttctttaaagcaaatcattaaattagtcaaagtatgtggaatagtatgaccatatatagccttgacgtatgaggttgtcataagtaatgttatactcaacacagtaacacaactttgtctggaattagaaagaaaaagagaacaaaactaaaattaaaataaatctccacatggatacaataagacataaaggaaggttattcttaatagcattttccaacatctttttgtacttttggctgcaaagtagagtaacaatagacataaaactaaactgcaaatggcttgttattgttcctttgaaatgcaatgtattgtgaacaatatttgtttgggatattttcatttatttggtggaaaatggtcataaaagcaaaggttttttttctttgaggagcataaattgttacattactttaaatacttcttactcaatatagcacaatgctttgtattaaccttttaatattacatgtaaatccagtattttatttgaacatcatttatttgtacaagtaactatttttatataaattttttttcaactcaaggtttttaatgtgtttttttttccctattccaaatttggtagacgtctaaatcatcttttaggaatgtaaaaagctaggcattttaaaaacagaaaattctaggcagtttacctttcaacaatctaaaccaaatcactcagattatccataaaattgtccagaaccaatacaaggaaaaaagcaacattttgacctatgtatcagaaatcaaatcaattatcagacctgtaagtaaaccaaaagaggatccatgcaggcagagataaatcctaaatctcagggtactttgacagtcacatagtaaaagtgattggaaaaggttatcttgaacaaaggttcttttcaagcacataaatcatacaaataattatctctctgaggtgacaggggcctaggaagtgaactactttaggagtagcctccagagatcctcaaccatgtttatgagccgcacagtcatctctataaaagacaagctccagttgagtaaaccatgttaagtactacattccaaagaagaaaaactgtgaatagaaaagttaacataatgcaccattgatatggaataaacacttaatgtctagtttttttatcaataaagtgagtgggatcagtttttcttatttattcactgaagcacattcttataaaagacaaacagcaagcacagcatatttattgcatggtagctctcttatacagtgttgttgatgtttgtttcatttttttgctcatccatgtaacctacacatgttacaaccagcatgctaggtacatgggatataataagattgagtcccttcacaaatcttatacattaaaaaagaattgagaaaaataaatggaaatgaaagttgcttcacattgtgattaatattctagaggggtagtatacttggtttcatcgtggagtgcttcctgcatttaaactcagtccaaggatgagtaggaaattgccaggaaaggtgagtaaggagccaatgttgaaagagaagaatataaatgtggaagttcagggaagagaatgataaattgaagatgcctaataaatccagagtggcacagatgaagaggacaagggcaggtagaagaggtagaaaaccaaggggctataacaaatggcattgtatgctagaataatgagtttgtgcttcagaacaaaggaaagttgttaaaatgttgtaaaaaaaaaaaaaaagactgacactatgaaagttgcatattggaaagaacacactggtggcagtatagaaaacaaatggaaagataggcgggacaggaagaccagaggaaaaacagatgaattaggaggctttcttgtatttgtggtgaactatgataggggctcaaatcaggctgctgtcaacgggaatgaaattatgtgaatgaattggagatatagtttaaagggtagaattagcaggacttaataattaattgttaactctttttgaattggggtatgttcttttgaccattattctttcttctcttagctctgcctatgttctggaggggtcatatttaaatactgactcatctgtaaatttcaagtcagtagttctctttattgcacattttcaaagtggttgttatctactatccacttccttttataattaaaaaaagattatctacatcaaatataaggtaccagaaatagccaattgcaaaccaaaatgggagcagtccagagataggtggctagtaagagctaaactagaggagcactttctagttgttaattttttccttcttccacttagtgaatcattacttgcactgctttccttgtacttctcttatttaccctctagactgcattagtgagcaattatagtaaggactggttgtccaccagaatgactggaatggagagactgtaagtttctaagttgtaaaagatatttacttcccttggaatgggattggggcacaaggaaggattgtgccaatggaaagctagagttttccctaagtttccatactcacttagaggtataaaatctagggcccgggatattgtttctttccaccttccctaccaacatgtcactggaccagacagttgatattgttaaggaaataaaagatggaatcacatgaaaaaaacacaaagcttctgagggatatgagcacttcaattaatttgttttaaaagaagagaggagccaaattagaggagccaaaatttgtaggaaaggataaaaatatttgaacgccttccaggtgataaaagagaaaactggatatgaaaaatataattgaggaaatacggatttcaacagatgaacagtatagcaaaatgtacgtagaaaaagaacaaactattaagttggaagatcaaattgctggcctcctacacaatgaaatttaaaaagaaataataagtgaagagttcagatacatcaggatttctcagaattggtactattgatattctaggccatataatattgtgttgtgaggggctttcctgtgcattataggatgtttagcaacatcctggtcttactcactagatgtgaggagtacccccaagttgggacaaccaaagatgttttcagacatttacaaatgcacactgggggataaaatgtcccggttgaaactacaatatatagataagtaaaaatgtatttctatgagtcacaaaaaagtaataaatacaggtgaggaaatacaggaatggggaacaatacttttctagaattaaaaaataaatgaaatatgataaaatagttcatgaacaatcaaataagagagattaaaaataatatctaagtatgctatagataaaatgctaaatattaaaccaaaattttaatggtcataattttcaaaaagcaaaagtaggtcacctaaaatatagaatgagttagacatcattcatatcaacagcagtggatgcagcaagacactaaagtaacatttaaatattgaagaaaaagaactttgagccaggaatgcttttttcagcttaaaagaaaacaattaaatttgagctgaaagcagatgtatctggtataaaaagttatagaaagcacaaatatcaaaagtctttttgaataactcttagaagatattgccaacatagaaagcagtcaatctagaaaacttcagtaagatatggaaacaaggtgaataaagaagttagtaaatttacttttgtctaaatgaacaatagtaatgataaaatatagtcctaaatgtccagaataataatttcaagttttactaatatagtatttatatattgcttggaaataagagtattttgaggaaaaggggtcagacagggaagtaagtgcatattaaaattgttactttgggatatgataacttacatttattataggtttattgcatgcaatgcaattttcaagatgtgttacctatattcacccattcaatcctcactaaaacacaataaggtaaataaccattattattatttaatttaaaatgaagtactgaagcggagactaacttgcccagggttagtattcaacctagccagtctggctaaacagcctaccctcttcagcagtaagcctacagttgactagaagatgatactattatttaggtttagacaataactgcaaaactaagcatactattttatttagctagcaaaattaaatttgataatctagaatatttcattgaaaggaagtcttaaaaagggaaaatatgtcataaataaaaagttgaaataagatatgacaacatatgatagcaattagaataaatattagtaggctaatcagaagatagagacttacaatttttaacttattaaaacagaatcacaggttaaccttacatcatctataatacacacatacagttccaaaagatatacaatatttgaaaatttaaaacatatgtttaaaaaatatcagaaaatatttcaatcaaattatatataggatagacattttatttcacataaagggaaattcaaggcaacaggaagacctaaagcacaaagatgtttcttatacactggtaaaagaaacaatatgtccacaggataaaagccaaagttctaaaagtaaaaacagcccacatgatctgcaacttcctccctttcatcactgacctcctttcctactactcttccccttgttcagttgggttgagacacaccagctcaaataaatgtgaaaacttaaataaaatattatatttctggtggatcatttcactgatgaacactaacaaacttctcaagagagtccatctaattttccagaaatttttaagatgaaaattgcctattttaaattaatgatagtaatttaactttgataccaaaaccagataaagtacaaaaaaaaaaaaaaaaaactcatgggctaatttactttatgaactatacttaaaaatactaaaaaaatagattagcttaccaaatcaacagtatattattaaaatgtcatcataatgatgtatgatttatcccagaaatgcaaaggtgactcaacctttgattatttataaatgtaaatatttacatgtatcagtcaaaggatagaaatcacatgatcatctcatttatgcaggagaaaaatgattttatgaagttaaaaatattaatgatggaaaagaaaatcagaaaattggattagaattaaatttccataaccctataaaaataccctaaaaatccaagtaaatatcatattcaatgaataaactttagaatttattaagattaagaatagcatcaggattgtcttctaccactcctactgtgtagcacagaactgaagttcctaggtaatgctgtaagtcaagaaaaacaaatgcatcatataggcttgaaattaagagataaaataacaaatatttgttaatgaatgattatgatttttatatagacaattcaggatagtcatctaatctttagagctaaaaataggagtttgtttaccataatataattttatatgagcaattttcaaccagaaaatgtaagatatcatttgcaataaaaagagaaactacaacaaagctttttaaaaattctaacataataaaggctacgactagcgtatatggaatttcaaaactctatcagaagacataaaactactccccaaatttagagaaattctgtgttcacagttgaagtgacttgacattgtggatatctgtttttctaaattcatttatctcttagtgcaattcacttctaaacctgttttaagagacttcaccaacactaactttttttttaagagacttcacaaacactaactttttttttcagttaaagatcatcagttggtaaaacaattttgagatataagagcaaaaatagagaactgattctgtcagatactaaggtatattataaaacatagtaattaagatatcattgtacttctgcagttactatcaaatggagtagcataagtgatggcctaaaaacataatctatggcaaggtgaactgttagtaaatggtgtttgaaaattttctcattacatggaggaaaaaaaaaactgacctcatgccatatatgaaaattaacttcaaatggataaaatactaaaatgggaaagaaaaatctacattgacaacaaaaaaaatagtataagatactatgtttggaactctgagacagaaaagctttcttaaatatgactatgtatcataaatactaaaaaaaaaaaaaaaaaaaaaaaaaaggaatggctgggtgcagtggctcacgcctgtaatcccagcactttgtgaggccaaggcaggcagatcacaaggtcaggagatcgagaccatcctggctaatacggtgaaacctgtctctactaaaaatacaaaaaaaaaaaaaaatccgggtgtggtggtgtgtgcctgtagtcccagctattcgggaggctgaggcaggagaatcgcttgaactagggaggcagaggttgcagtgagctgagatcatgccatcttgttccagtctgggcagcacagtgagactctgcctcaaaaaaaaaaaaaaaaaaaagaaaagaaaaaagaaaggaatgcatttactgcatcaaaatgatagatttttaaccaaagtgcatcacagacaaaaataaatgtatggataaaagcatcagagaatatacttggaatgtctaaattatagggaattaatgactcttccacattctctggaaaataggggagatcaaattgaaaaatatgataagtataacaatcataataacaacaacagatgcagagctcttactatttatcagtaatatctctaagtgtttaacatctatttacttatttaatattattaatacaaaaattcacagagggggaaaccaaaatgacaagtaagtattttgaagatatattctaacatactaggaaataaataaatggacagtaaaacacttgatttcactttataaacagtagtttggcaaaaaatgtaaaggaagaaaatattaagttataaatagagaggcagttgggactcatgtacttcaagtgggtgtataaattagtgcaatcatcctagaaataatctggcaatactttatgacagtatgcatgtatgtatatcacccaacaattccattcctacaggctcttatgcactaaaatatgaagacagcagttaaatgacaccatgtacttgatcagaaacaggctctcaaccaaattacttggctcatttaatgtatttttctatatattggcttctaatcttggctaagttatttaatctcttgctgtctacattttaaaaaggtaagtggggataataatgattttaataagaataagaataatgctattttcttgttagagttgttatggattttaactacgacaacttcttagatcagatcctagcacatagtaaagtgttcaattttttaaaggaagtgtttgccatttttttaaagaaacaatacacattttatcatccatgaatggagaggagatatactaaatatattagaatgggtacctcagaaaaacagaggactatgattgggaacaaggcaggagaaaagaagacaataataataagagttgtattgcatggatggatgatgactgtttcatgaactaggattatgatcaatttatatttataatcctttgcgcaaaggaagtgcttaaggaatgtatatctctgaaggactacagtgttgagtaactgcagagactgttaatgttttttaaatgtgttcatgtaactattgtttaagatcaaataactagatcagcatgaggaattatttaaaagagacagagagaatatgagaagaagaaatgctgttgcaggtgtttgatttatttaatttctttcttttttttcaccttttctcaaggacttggatctagacagcatctaaggctggaatttaaaaagtaaaggaaaagaggagagatgaaaaatgaaaaagtaagtgaaggggacaaagagaggacacaagaaacaattgtaaagttacttttttcagataaaataaaacgtcaaagaaaaagctccaagaaaatcaaagcctttttagtgatgaataaactagtaggcaaacaatgaaatgccaatgcatattaaaaagtaaagacagaaccacaaaggagagataactattataattgtgttctgattgaatgctcataaggaaatagaatcattttcccctcacatacaataatgttgagaatcttcaagcattttaaattcatacattaaaattttaacacatctggtcacatgcacgtatacatctcttagatctaaaggtatttttccactatttaaggaaagaatcataaggtaggataggaataattccaaaacctttcaataatgagatgatgcactggtttcaataaaaaagaaattttaggccgggtgcagtgggtcttgcctgttaacccagtattttgggaggccgaggtgggcagattacttgatgtcaggggttcgagaccagcctggccaacatggcgaaaccacatctctaccaaaaatagaaaaattagccagacgtggtggcatgcgcctgtaatcccagctgctcgggaggctgaggcatgagaatcacttgaacccgggaggcagaggttgcaatgagccaagatggcaccacggcactccagcctggaaaacagagcgaggctccattaaaaaatataaataaataaataaataataaattttagaattcaataacctagacactaaaactctgagacaagaattagggtacatggatctgtgaatccccagccctagcacaatgcatagaatatagtatgtgtttggtaaacgtttgttatactttgatagcaattcgttatttaaataaaggttttggtgaatagtggaattatgcccacctctttccctggtaagaaccatcatactcttagttccttcccccagtttctttgctgctttcacctctcttcttctggtttataaaataattaatatgtgggggcagaataagcaatatctcttgagtcagtcaaagtgataaatgcgaggtttcctgaggatcaaataagagaaggcatgtaaaacccttggtgtcctgtttgacatagagaaaactctgtaattggcagtgagtttttttattcctttttacacatcacacctgaagggcaggaagacttaaagcacatgtaataaaggtctataaccacagcagtgtttgtgaaagtgaaaatcattgccacattcataaccttttgtgtaaaaaatcagacactctatttcccaagtcaaggagattaatgcagtataaacaaacaacatcatgaaagtgtaaaaatatatatttaaaaaaaatctaccagctcttttgtaacactattatcagaacagcattaaagatgatctcactgttaatctttacagaatttgaaactcttttctatatgaggtcccagctgtttgtgaactctgatttactaagatttactacatttaatgagagtacaaaagcgggttttcaactaccaggatatatttgaggccaagagaagaaaataaaagccactgagcatgtgaagcaataatttcgatgatactttccaatttcgaatgatgcataaacttccattacaatgagaaatttgctgtttgctttgagaagtcttgtcactactcttgaagaaaagggagaaagaaaattagcatttatatctttcctcctttgtggtaaactgtattctaggcacttcacatatattaattaactcagttaatcctcacataatccttagggaatggctgttatctgcgttttacaaacaccccagggagaattggtaacttgtctaatgttatacggctaatatgtgcaagacaacggttagaacacaggctaatttgactctaagacctgtgctttttaaatgtcagttatcttctgtttatatctgtattgcagattataattaatgtgttaacatacattcactgtagaaccagcggttttttttttccctgttgttgttacttgtggaatctacatatgagggttgtgacctaacttgtttcctgggaagcatcataacattctatcataatatgatgcaggagtagataataaaacctgccatgtctatttcttgtggagagggcaagtgtttaataaaaagccttcagcataaataatgagaggttccagagtgatttctagcagagccttttgtttgtcaacatttgaacattattctccaaaataatggctcaggtttgagaggtagtattgacaatttcacttgtataccagaacatgcacagtggtagaagataattatgctagaaataaacaatattttttttttttattgagggcagtatgaaagtagaggactcatcctcaacaaacttttgatacaatccagactattggatcaacgtttttgattggaacttggaaaagttaaatataattaaactcaacctgagagtcaattattctcccacagttgacctatatgcaacgtagcatcaatattatctgcataatttgtaaatttaaatttatatgatcaatcttttgcttttaatttattgttgtatagattaaatattttgcaatcttgtttacttgggaccaattttctcatttgatttcagttcttaaatgactaaaatataaagtaagaaaaaagcattttatcacattaatgcaacacttgcaatttgatttaacaatatgatagatgaaagcatgaggctattataacacaatgcatttatcatctttacgaatcctcccctaaacagaattaacactgaaccatttccagtgaggtttctaaaatgactagccttgccaagataggtttttggctcataaataacatagtagaaaaaaataaaatcactgaatgctataaaaatgcagtatcgggaattactaaagtgtgaaacattaagtacactactcaaaatggcattctcaaatgtataaattatttatctgtatgacagagcctagactactgtcacaagatacagaaaactgagttttcagattattttaacatctggggaagactactgaaaaacaaaaaaaactctaagatactagcatccatattaaataactccacaattaggaaacctattgacttcatgttgttgatatatttagaaacccccatgattaatgttcttgagagcagtaacagtcctattactcactcatcataccaggagagaaaaggaattttgctttaatatttacagagcataacaggagagaaaaggtattttgctttttaagaaatcaacataagaaaaattctaacatgttttattcaatttatacaactttcttcttgctaataatccataaatgctcttttaaaaacttcttaatttgattgcctgattttttatatctttcatggttaaaatgctgtgttttttttaacctttctgtctcttacagcatgcaacacagcatcgtgtgtgaaataggatgaatagatgaatcagctctctcaccctttttaaaactagaatatagcacagcatttgacttacatgcagtttaccaaaaactgagaggtagccaatatcatctacattgcctagatatatttaggatcctgacttttattatattaggagcttccaaattatcatcatttaggcatttgcacaaagacctctcaacaaaaatttactttacagtttgctggagtttagtgattctttctttggaatcccaactggtcccatctatttactgagagctttgaacttggcctttcgaattccttccagttctaacttgcagtgagtatctgtaaggttactaacaccatatttctaaaataaagacagtaggtacatcgctctccaatactgaaacttttctcccttcagccgtgaaggaaaatctgccctggggggcggaaccaggtgcaacggaggttttctgctttagaaagatgctcctctgctttcatgggttattctgccacatctgtagaaataactatttgtagctgaccccaggacttcatcacctctcactagaattgtggcaaaggtcccccacctggtctaacctagctctcctattcatactttacaatctggctagaattatctttcctaaatgtagtttggagtttggtcactttattccacttgtcaaaaattggcagttttcagttttctctttgtttatggaatccatattaaattatttagtttgacattgagaagtctctacaattgaggtccaatgcatctttctggcaacactttaatacaccatttcttctcatgttttaatatctctgctaacattatttaacattatttcgaaaacccatggtatttcatgctaaagtcatttcatttatgcggtttgtcccaatgagtaatgctattcacccttttcctgccaattctacttattttcattcattttatggatatgcattcagtaagtcaaatatcctagatgacactgtaattgattaattggaaattagtattaaagtataactcatgaaagcatggtaatggcatgccttaatactctgtttaatcttaaataatatataaattattaggagtgagaaattacttgtaaagtaatctgaatgaaaattccttcatcagtttttgaattccacttgaatcctttatagttgtctttcctagacttaatttataacatcttagaaacttgttaactttttttgactttccaaatcattcaacttagtcttcttggaaataactagctttttcaatatttttttttcattttgtataacacttagataaatagtatcttttttttttttacaaataaaactgtcattctcaactctaggaatggcaagatattttggaaagcatgtatctcaataggcactagtagaagtcatgggtgtgcatgagcattcacatgtcattggcactgcatggtaggttttatttagagaatgaagacataagattcaccagaagcaaataggttgattaatttgtatactacaatgtaccaggtactgtgactacaaaagacactatgagtacaacaattgtatcagttatttatgaggcaaaactaacaaccccacaacttggagcttaacacaataattgtatgattctgggggttgggaatttaactggctttgcctggggtcactcagtctgctgtaaccatttgaaggctcaactgtggctaggtagtcttacatgtagggtattccagtttccattactttttttttttctgtcctgactgagaaatagaaagtgtcttcgccaactctcttacctgtccaggcagcacatctgatgtccattgtgaggatgtgctgcagcctccctctgtatgtaagttctatgaataaatgctttggactggtcgccctggagtttagtgcttctttctttggaatcctaactggtcccatctaggaaaggtctggggaatttcactgtgggaattgccctgctgccacttttagggtgactccagctgctggctgcaggaggaaacatgttctcataaacatatgtggagttggtgctggctgagttccatacgcatgggtctttcatcctcaaggaagctagcccagaattccttacacggggctatcagagtagaaagagttgggattaaatgtgataacaccactaaaggcccaaccttatcatctctgctgcattttataagttaaattaagtcacaaatccagctcagattcaatgggatggagaatatattccacccttggaagagagctattataatatcacttttaaaaggaagtgtgcatgcgaggaatttgtagcatgttttgcaatgttccacaacatgcagcaggacaaacaggaatcctgccctcacagaaagcagtaatgaagaaaggcaagcaaagaaacaacggctgtaaaaaaaaatattttaaaagggcaattacaaggcactataagaaaatacagaagtatatcactaaattttctgagaaatcaaaacattctttctagaaaaatcatatataaaccaagactcaaagaaggagtaggagttagtttggcaaggaatgagggaatgggagagagagttttctgaattaaaggtacagcagggtatgcataaaggcctggaaacaaaacagagcacggaagagaaagcaagaggatgttcactgcaaggaggatcagaaaatggaggtaagagataaaaagaggacaccagaatccaaagaccaacgacattctgttaaagagttgagctctgagaattaggagaagctgccaacagattagaaaagtcaaagtggggccaggcgcggtgggtcacgcccgtaatcccagcattttgggaggctgaggggggtggatcacctgaggtcaggagttcgagatcagcctgaccaatatggtgaaacctcgtctctactaaaaatacaaaaattagcagggtgtggtgcagtggtcctgaatcccagctacttgggtggctgagacaggacaattgcttgaaccaggaggtggaggttgcagtgaattgagatccaagatcatgcaatcatgacactgcactccagcactgcagcctgggcgtcagagactctatctccagaaaaaaaaaaaaaaaaaaaaaaaaaaaaaaaaaacaaaaagtcaaagtgggccaggcgctgtggcttatgcctgtaatcccagtactttgtgaggccgaggcaggtggatcacctgaggtcaggagttcaagactagcctggccaacatggcgaaaccccatctctactaaaaatacaaaaactacccatgtgtgatggtgggcgcctgtaattccaactgctcgggaggctgaggcaggataattgcttgaacctggaaggcagaaagtacagtaagccaagatcatgccattgcactccagcctgggcaacaagagcaaaactctgtctcaaaaaaaaaaaaaaaaaaaaaaaaagtcaaagtggtgttcagatcagcattttagaaaaacaactcaagatgcagttgtacaacgtgaggtttatgagtctagcaacaaaataagtaggctgctgaagtaatacacagggtatggggtttacctgtggccagcagcctctctaagtaaatgtgaatctaactaaggcaccagttaactattgttactgggaataagaaaaagcaataaaatagtatgatatccctttatttagtcaatgtaagacaagttgccagaggagattggaccacttcactaataattggcctctcaactttttggatgccagtaattacaaaataaataaataaataaataaaaatcaggactcaagactgttaataacatcaggctgaaaatttatgtgacactttttcataagatatgctcatttgaataagaaagaaatgatgttttactcatttggagaattaacacaaaaagttaggggtaaattaaaatataatttttacctctgagaaatatattaatatcagtgaatcaatttccttaaaaacaaaaaatatatattctattttatttttctttcttataaaaccaatttataaaactaatacaaatgacagacattgctttaagtattaattactgctacagctactactaataatatagaaattaaagggttcctggagaggctaatgctattttatgcatttacaaattgaaagaaggaattgtaagggtaattgagctcaggagaagggaaaaaatgcctgcaatttccagtcttctatatattcctgcaacacattccaaactttagttttctaaaaatggaaaaccatcccacacacaaactaagtttttagatatccctatactttgtttgtattgctctctttcccccaaatgtccatcaaaatatacttgatcagagggttgcttagtgaccctctcgttccacttcctctgataatctttctatgatttccccaggctctcagtgacttcctcagtgttctcatagtattttttaaatgtacaattgcagtagcagtagtaggaagcatttatgacattgttcttagctatttgcttatttttcttttcttctctatatgacttcgtcaaaactacttagatgttttcttttcattagtttctagtagaaatatcaaagtataagttcccaagactcactgaacggtgtgtctgcaaagctgatgatggtggttagcaaatcacaggtactggttgaattattagaaattgttttgttggtaatcaaatgaatacttgaagaaagatggatgaaacaactaagagtaggaccttagccaaggcctgtgatacatattttatcataactgaaccttttgtgaattccagaagaaactttgtgaaaagtatcaagagtaatgacccttaggttgaatgagctgctgccatttttgtttttaaataggcagatacctacagcactgtgaaaggaagtgaagatttttggagtgtcactgaataaacggagctcacttaattgcctgagatgttatgtaaaaactctgtagttgtttcatatggctgctgtaagaaaattgccacacacttggtagcttaatacaacagaaatttattctttcacagttctggaggccagaacccaaatgagtatcactgggtagaagtcaaagtattggcaaggtcacgatccaggaaaaaaaaaaaaaaaaaaaaaaaaagctgttacattttatcactacattccttcctttaaaaaatcttatagacacagaccaacaacttagtggtttcaataggaggacagtgatggtacttagatcaaaatgttttctgcactattcaaatgactgtgctctcaaattgggtaagatttacataggaagaccagagacattgaacctggtcttttatatccctcactagcttccaaatcctaaccttgctctcagattatgaaaacacatgcttggaaaggaatagctcaactagagagagataaccactttctatggatctcagtagacaaaaataagcttagcctgaaaccaatgttaatgaggatttcagaatcacaagagcaaaacggtacaatagggacgtgtgagtctacacttatgattctaagaaggataacagcctaaagcttcctaagcagggagacatctaccttatttcccaagagctctatgaattgagttccaaaatcatcatgaaaatccttttctagtatttaagtattttcccttttccttgtataaaatccaaatttcccttattacagtataggccaattttgtttcttcttcagcaggtatgttcagccaaaaatagctttgtcaatttccagatttttcaatttcccattccctcctttatcaacccccttccccgttaaatgatctctggtctttagagactctattattgtcattttatctttttttttcctttttaaacttttatgtagtttatgtaaggttttacataagttacatttccaggttcttttcctgaaaatttttactttatttatgactttttaaacttgacctggggaaaaaaattctactcagacatcccacctagactgtgtttaaaacctaaagcctctgtgtgcggttgggctgggatgaaggagatagagtaggatctagtaaagaagtacagacttgcagattacccatgagaggtcgagagttaaataaagtactagcatgggaacagagtaattgtcaaaaggcaaacaaatgtaaaagcgggggtgggagggaaccaacacctttgagtattggcagtattttgtgaacggatacaggaatgagggttgttcccagttttaaaatgtcaagatacagtgtttctgaatgcattcaaaaagattcttttcaggatgccaataacctgttacagaatttctttgtaagattctattagcacttcttcttgtagcaaaggttctcctattttgggtaacacgtatggtatctggaaagagttttaggaaagcaattgaatatttcagatacaaaaagtaatatatctttaaactactttaaataataaataacttggcactcatatgggcactgacgaagaaaaaatgcaaaattttaaaaattaaattaaggaaacatagaatcacatgctttgttagatgctccgaaacacgttccattataactgttaaagtgatcaactattgctgtgctcaaagttagaacaaagaacaataaactgaaaattctcccgttcacctatttatgttcacctctttctccaaagtacttctaaaataaatgataacacccaaatacgtactcagtattcaaagcaacgttcagccaaaatacaattttggaggaataaaatcagtcaccaatgtaatttttcaatacttagcttatcattgatgcctcttcccatcgtgcttctcactttatcctctttattctggactgtcccttatcagaatttaccctagttactctcattttagaaaatatcaaatacattaatccacaggaagcaaattaactaccatttgctgagcatcatatagctattcatatatatatatatatatatatatatatagagagagagagagagagagagagagagagagagagagagagagagagagagagctattcacattcatattttgtaattggcagaatggctgttagagattatataattataaagtgagaattgtttattgatcaggaatctgaggttgaaagatgttaaattctttgcaagatcatacaaccgttatatgtttgaattactcctattctggttcagtctgttaacacatgaacctacctcatacccacttcagccatatcacatatgctaatagaagcactataaattatttctcctatgtaaaactaaatctaaaaatacttcccacacaattacatacattggttacaatgttcaaagaacgtgaacattaaagagaatatgaaaatatttttctatatcttaataatttttctagttccattgattacaacagctgacatttattaaaggcttacagtatttcaaacactcttctatactttttaaggatcatttcctttcacagccacaactctaatgagatgttatattagttagacttaagtttggcagtgactgacagaagaaaaaaataacaaggattttcatttaatttttttttttttttttgagacagagtcttgttcaggctggagttcagtggtatggtcccggctcactgtaacctctgcctcctgggttcaagcaattctcctgcctcagccttccaagtagctggcactacaggcacccgtgaccatacccggctatttttttttttttttttttttttgtatttttagtagagacagggtttcactatgttggccaggctggtcttgacctttcaacaagcatttgtaacaggatgaataaaaacggaagggaatattgtacaatgccaggcatgagccttaacatctctatgtctcactttcctcatttggaaaaggaaggtaatgattgagcctacatatttagagactgcagttagtttttctcaaaatcctttgccctcttctgttttgttagagaccccaattttagatggttaaatggcctttcataatcaagattgcatttcctagcctgtttgctgttacctgtccatgtgactgttttctggccaatgagatgtgagaaatatcatgtaccagtttctgggagccaaggtctttcacatcagactattctcagaccacctacccagatatttacttaaaagggaaataggccagacgccgtggctcacgcctgtgatcccaggtcaactttagtataaggtataatttatccctctgtcatccaaccatctatttcttacctgcaccaaaaataattcaaggttatttgcaaagatagatatggtaccaaataagataaaaaaataaataaagcagtaaagaagccatggggaagggtggaggagatgaagcctgaaataatttaattatcaaattaagctagattccatacaagattctagtcacaaataaaaagagacaaacttgatgtatctaccaacacggatgaattacaaaacactatgttaagtaaaagtagccagacatgaaaaaactataacttgtatgattccatttgtactactttgttgaaaaggcaaatcagtgataaaaatgaaatcagtggtttccaaggactggactggaagtggaggagggggattgactatagaaaggcaagaaagaactctacgggggatgaaaatatttcataactagattgtggtagttctttctatacacttatagaaatatgagactatatacacttatcaaaaatcattgaactttaatgcatggactttattgtacataaataatggtttaataatatgacataaagtacaatatcttgctacactgtttagctgaggatcaccatttctctctgagttttgtaaacccagtgtaaagattgacatacaatcagttacaagatctttgatgtcactaataagaggacctcactcataacattttcacttgaataataaatttgtcaatatatgtaaagtgctttgaaaacatctggcacaaattaagtgccagaagtattagttcccactaccatgactcttaaattacattcttaggtcacctgaacatccgtcgaaagacaaaatgttatgtaacacccctctgcatagactctgggtactcttttaatgccttatcatttcctataagaaaagacagcaaatgctaattcattatagtaaggtgacaaattagtattaaaattgtactatatttaaaggaattgccttcaagggaaaattcatatgaaaaaagtgagaataattcaaccctacagtctgaatataatacatcatggtaggcatagttacctcagggttaaaatatacataaaacaaacaaacatagtgcagtggactgaatgtttgcatacccccagaatttacatgtcagcatcctaacctgtaaagtgatagtgttcagaagtggggctcttaggaagtgattaggccacatgggcacctccactatgaataggactagtgtttttataaatgaaaagcattttcacttgcccttctgctaagtgaggttacagtgaagaagatggtcctctatgaacaaagaagatggccctcatcggaacctgaccatgctggcacgctgatctcagattttcaggccccagaactctgagaaataaatttctgttctttataagccccctagtttatgctgttttgttataggcaccttaatgaactaagatgcacaggagtagaaataaaactgtgtcgtgttgccaaacagtcaagagtttgaagttgaaagactgccactctgcacccccaccccaccactcccttttggctctagcctgacctttcctcttttgatgcattctgtttatgataacttacttttactttggataagacagagaatctaattataaatttagtcaatgagaaaactgggtaggaattaaactgagtttaaaatatgacagcagccatgtataccgaggatgtgaatggattccaacagaatagaaatgtgagatcattccctttaatagaattgctttcctttctcttacaagacattaaaaactttgcttggacaatgcaacaggaggcattactccctatataattttatcatatttttcctcttagcaaattcatgctttacttattacagggaactatatctctgtaagaaataagaggtacgttttgactgtctttacattgaacaaatcagccctttgaaagggtcagtggtcttatataacacagttaggcacagagagatacaagaatcaaagaatgtatttcaccagtaggtagtgttagaagcttcaggaaaagcagagtcctgaatgctgataggggaaggctgagatatgcagtttatagagaagaatttttattcagagtcctggtaggccatgggagggatgggtctgtaaggcagttatagaggagaaagagaacagagaagtaagtagagcaagaacaagcactcagatctgtaagcaaagacccaaaaatagctttcagataaggttgatggcatctcagaatgttaatgaaatataacttaatacttctatgaagtataagccatgcttcctacttgaaaatttttttaaacattgaaattattttcaacctagagataatttaatcttttaaaattgtttcttctattcatatagtttttaaaagcttctctattaaatagaagaataaatctttcttctaatacatatctaacactaaaattagtactttcatattgtatatataatgatacccattgttttccttaaaaagagaaatagttggaaggatgaacctcatgcaaattaaagctataagaagaactaacaacaagaatgaatctcacagaaatgcatcactatatagttgaggggaaagaataggtacagtatgataatttctagtgtagcaacactgacaggtcagagtatatgctgtgaaaaacaggagtagtggtcaggcatgaatgatagtgcctgaaaggaagatggagttaggcagcatcttacaaccattggccaagtatgagcagcagtaacaaatggagtacagtaatagaagctgaaagttgtaatgattgcctgaagaggcgggtcaaaaaaagattcacaggacatttgatgcctgaaggcattagcattatgggcataattggaaaaaatgagaagcaggatccattacaggactgttagaggcaaggacaaaggtaacattgaaaggataaaatgaaatttcatttttactgatggtggttaatcaaaaccttggaagcagataaacaactgaaaaggtttacttaatatcatacctattctgcagcagattaataagcctttttagttctccaagatagaaaaatgaatccattattcccagtgataatttattttatcatatgtttctttacaaaattggcttaaatattaccgttgtaaatgtatgagatgagatttatatttaattgctcattgtatacaagttgacaataaaaagacacatgttaaagaggcttaggggtcacttttttcagaattgtccttttaaactttgaatggttcaaattttgctaagtgatgttcacagagttatgagaagacaatcccttatgttggcataagatacctacacagaattttctttttcctaattctttccaaattctttttttttttcttcaggctttcaaatcctctttcatggtatagaagagagatcacattctggcacttcttaggagtggatgcagtactcacaatatgctctattcgaactgattcttatttattttataatgtatatttcctcgtatatttgttaaaaaacaatatatggtctaaggcattctatttcttaccgtaattacttagtgtatagttagttctttctaatatatgacaattctcactgagaaatcagattttgactattcgtactcctacaaatgacctacgtataatgataggagaaacttgtccacaatcagtattaacagatcaatgtttatgggaagtttgacagtactcacatgatacctgcccacctctgttctttattctgtcgtgaaaactttaggcatcaggcactcttgctttatcttctaatcaaaacagagaccaggaattagaaacagtgagaaccccctgtgtttcaagaaatgggtgagggctctgtacaggtcatcttatatatttctcttaatcacctaggaagttaaatattatattattctcatttctcagatgtggataatataatatttattacttaagaatagataccacatagcttcccttaagacacaaaaccaggaaggagcaaatctgaatttccaacccacccaagtctgattccaaagcccggatccaccagatcattttgcacattggttcatgtttttgatctcctatctttccaacaaaactataaacattgatatcattaaagtaaaaagatggaggcaataccaacataactaccacttaacacaagtacatgggcactcgcgcgcacacacgcacacacacacacacacacacacatccttcatactgaggaaataacaaatatatttcaaagattattttaagttagaattaaaatacaattatttatcctagcatactaaggttttttactgtttttcttctatacagatgtgtaaaaattttatatcatgtaatattagtgatcaacacattttgtgacgtgcaatatgtacttctgaacccttgaaagactcatgctttcttttacctccctcttgtttcagtaattcacctctttgacataatgctaattaacaaagagaccaagaaaaattgtctttctaagtatctatccatctattttttaaatctgtttcccatagactgataagctgactggtataacatatagatcagtggttttcaactgggaaatttttttccacccagggcaaatttggtaatatgtgcagactttttttattgtcacaactatggaggagagaaggaagatgctattgacagttaatagaggccaggaatgctgctaaacattaaacaaggcataagacagtccccaagaagaaagaattatctaggccaaaatattaatagtgcagttgaaaaacgaaatgctagatgtttacatcatttaagaaagagaagaccatatgactgactacctttcatggctatccagttacattacaacaaaggaaacacattaacagagtttctcaaggaggcaaataaacagaatcacaaagacatattctcaaggggagttattgcagaaaggacttagaagtaaacagttacaatcatgcagaggaaggggatgaaaaacatttgcagaatgttatagctaagatgctacttatttgttcaatttattggtagaattttacctgaggaaaaatataaacataaattgatgtcaattgaaagcatctagcatatttgcaaaggatggttgtaaaatactaagaagaaccaggaaactaagtaaacttcctttttaatttttggtaaataaaaacaagtttgcatttattaatcatgagtcattggcacctagaaataaaagacacagcttatatactcacacagctaactggatagagagggagaaatcacaattattctaaagcataatgaataattatatccaatgatcatagccttggagttacaaaatgtttggagttataaaaatggtacggaaaatggcacatctgactcttgcttggaaaagacagtgcaatggtgaaagaaaacaatacatactccaatgcttctgtgaaggaaaccatttcaacatggaacattttgaatgaacatagtataaaaagccataaaggtgtgaaacattgatttagaaaatctgataagataaagtcacttaaaagaaatatgtacaaatgtgttagttatggcattagttataatgataaaaaggtggttttcaaaatttgaaaaaaatctatccaaatgtaaattggcatacttaaagtccttcaacattggcaaatgtttaaagcatagatcttgctagatgaataaaacaagttacaaatgattttataatataatgtcattttaggataaagtgtaatgtgctatgtatgcataggagtatatttaattgtcatctttttaaaggctgaataatattccattaaataagtgtgcatatatatgtgtgtgtgtgcatgtgtgtgtgtatatgaattttctttatctgttttatttcttgatagacaattattttgcttccatatcttaggtattgtgaataatgcaaggtgctggatatgttaattagcttgattgaatcattcaacaaagcaaacatatatgtaagcatcacattgtatcccatgaatgtatgcgattatgatttgtcaaccataaataacattttaagaacaaatacattgaaaatacatcaaaatctgatttttgaaataagaaatcttaacagttgttaaatttgagaggtacaattttcagtaaacttttttttttccagtgtgtttttctacgttctccaagttttctacacagatcaggccacgtctgaattattgttttcaattatttggcaacatgttttccaatatattttgaacagttgatcattcagatgaaagaaataagaacagtgagaaaactgtatgtgttttcaaatagaggctgtttaggctgagaaagagaagctcaatgaagtaaatggtagctgccctcaaatttctacagtgcttttatattcaaaggaatttagtaaaatatatgctgctcttgagaacaaaaccttagcctccaaaagagagcttacataaagagagtttgggcttattacaaaaataacattctaataatacagtcatagcatcctcagatttcttggaaagcaggagcccccccacaaccaggagtttcaaacagaggctactgaccttctgcctgtcatgttattgaacagattccagcttttggtgggaattgcatcgagataaccttagtctaaggtgcttttcccacttccaaatgctgttgtaagtacagggctggcattagaaaggatactaaataaaatgaaaaaaaaaaactttgcatctttttatttagctgtcatgattgtttgcatttcttttttcaacatgtgcatttcttcaaattatcctatgtttcatgatttaaatagtcatttaggaagttaaaagggctgacttgaggggtgcttcaaatgccatagcacctggatgcctacttataaaaattatatggatatatatatatatatatatatatatatgcaccagtgaatagttaatatgtgttaattatatgtcaatgtatgatgcagtttgatctttcacaagtggcctaacctaaaacttaaaagagatagaaggagcttgatctccatcctcctcgctgctctctgccaatgtgaggatacaaggaaaagatggccaaagtattaggtgctaaccaggaagcaggcccttaccagacactgaatctgtgggtaccttgatcttggaccacctaacctccagaactatgagaaataatttctgtcatttaagccacccagacaacggtattctgttatagaaatttaaactaaggtatatagcatagatacagacagagataaagattatagttagatatacgtgtacttctcttgatgtatcagagtggagggacactgtggatttcaatccaagtgagttcctgagaaatcagttcctgtttactgtcttctccctctctctcttttttttttttttttttaatgtgaattgtgagtttctggaaggaagtattcatgtgttattggtttttacctgacggcttggtggctagcacacaggaagcactcaataaatcattggtgtataaattgaaagttgcttaaaattaactagttttcctggagttcagaagaaaataaacctagccctagttaacaccagctgttagaggtattttatactacagtttgtcagctttggctaccccccaggacatttggtaggtttggcaaagtatcattgatgaaaaggccacacccacattttgaagcagaaacttgaatgttgagggtaaggcatctatattttaaaagatttatcagtaattctggtaattttgtggttttacaatgacttctgttcatagccatctgctcacagacaaggggctagataagctctatggatccaggattccatcatttattccactattccaagaaataaagatccttaattgggacaattctgcttctccctactaagaattatctttagtgcatgcacatacctaaaatggaaaaaaattgcttttgtgtatgcctgtgacagatacacaaccattctgtattacaaacttctcagtcgagtctggtaataacatataattaaaataaatgagttcatcttaagttattagatcacaccatgattttcctaacctataaattataaagattagagaaaacaaatttgcaagggcaaagttgaagctaaatcctatcatcatttctatccctgcctcaattttgttaggatttgatggcagaatctgtgaatcagatgcatgttttccctcccccactccccaatagtgaaaaaagaaaatagcttctaatttttgttttccaatctaccagcttgtgccattgctgctaaatctctggctttctaggtgctctcctggtaacctctccatgctttaattttgaaggcattgacctctatgagatttgaatgttcttccttgcctttcccaattactccatttttcagtgtgtacagcaagctgtcagatttcctcctccacgtgaaaatctctttgggtttgcttgcttctatgtgttctgaaaaaaaacaactcagttttggtcaactctgtctcagagtatctgttccacaccatgacagtttataatactagagaatagctttactgattttgaaaaatcctctaaatacataaaaggccagatgtttccacactaagttttatcactcccatctgatggggaaggacctcattcatggctgtttccagtgaatggaatttccgtcatctagttggctagcattaaatatttgttgaacaagcagataaattgagatgatagtttgggtacaataaatacaaagaacatatcatttgttctgatttataaatttagactcaattttttcaagcttagtaatgtgtataactatgacaaaggcagtattgatgttgatataaaaaatatgactggtcaaaactctcttactagaggaagatttgattggaaaaagtgtctgcaatctgagaataaagcgtatattcagcaaaattaatatctaatacatgtaattttatcagaaaatacattttaaaattagaagcaatctctagttgtcaaatctgtaaacaatttttagaacccaaagtaacaaatacatccaggtacacaacaagtctaggacttgtctctaaaattattacttactaaggctatagtctgtgaagtgccaaatcaaatataattcctttattctatgattttttataaggaacatttgagtacaaattaatactttgaatgctataattctatttttaacaagctctgcaaaactttgcattattttgagaagctttgtacttgttttaaagtggctgccagccatatgccttatctatgtatatgtgtatttatttataaattctcaggagaattaactacaagttttatcaagtttataatatgttagtattgaatttttctcatctttcttgtaggatttatctttaaagttttatttcagaattttttttcaactgcaaaaaatacaacaaaaactttaaatttatgtaacataaatgaacagaaaatttgaaaaggtgagatatattaatttaataaagttgtgaaagattcctttttgtggccacaattcttcttcttctttattttattttattttattttattttattttattttattttactctattttcctgagacagagtcttactctgttgcccaggctggagtgcagtggcctgatcttggctcactgcaacctccacctcccagattcaagtgattctcctgccacagcctctgaagtagctgagattacaggtgtaagccaccacaccagcctaattttttatgtgtttagtaaagacagtgtttccctatgttgttcaggctggtcttgaactccagacctcaaatgatccgcctgccttggccccaaagtgctgggattacaggcatgagccaccatgcccggcctgcttcatcagcctaaataatagcaatacagtcattggtaattgatttgaaataatatatatctagaattttaaagtaattcaactattttataataattttaaatgaaatgtgatactataactttaaaaatagggttaactgcattattcactttgggttcaatttttcatttattgcaaagatgttgattgaatggcatgtgccttttctatcttaagcactgggaaagcaaagacgaatcagatacagccctgctcacaatgagcttttaatctagtagaggagtctgatatgtaaatcaacaattccaataatagctttatgtaaaaaaaaaaaaaagtattagaaactcagaggtatcagggagggcatcacagagcgcgtgaagctttaattgtatctcaaaaaaaaaaaaaattaggagtttgcaagtagataagaccagaacagcattcttgtaaggagaaatagcacgcatgaaatcaaaaggaatgaaataccacagcatgtctgggaaactcaaagaggcttagtttttatgaaagccaagtagtagtaaagggtgctgtggatgtatgtaaatgctaaaccataaagggttagtgccatatctcataccaaagaatctctgctttcttttccgagggcactaggtagtcatctggagtaatcaagcaaagccaactccctcccaatagacatacatttgataaaaccccactactgacattatatatcaggctattgaaacagtcctcatgagagtcaacccaattagaataggaagaaaagaattaagactatctgtttttgatggtaataactttgaaaaactactggatgtatcagataaggaaagtgaaatacaggaacagttctaaatattcttattggaagccatggagaattatatctcaactaaggtggagacaaggaaaaagttttgtaaagcaaagataataacctcggttttaaatatagtttgaattatatttgtgatatctagatggtgttatccattcacagtttggtatatataggtcctgatcatagcagaaagttaaagaatggacacacagacttataaatcattagtagctacatagattttgaaaaagtaacaggaatagaaaaattggtgagactgagtgtaactcagactagaaaccaagaaaacacataccaataaatactggagcatatcatcacaatgtaaaaattatcagatttgcatattgttcagttatgaacaacattataaaaattcattttgtaaaactgaggtcaaatgtatacagagggaaataatgcaccaaacttaagtatatgagctgatgagttttattgtattcatcatctatctatatctctatatgtgtataattatcacttcaaacaagatatagaatatacccagcatcccaaacagttcttttatgctccttcctggacaaagaccacttcttttcctcactccataagaaattacacatctaatttttcccactttagatttgttttcttttcttgaacttttacagttatagataatgcatttttttgtctgatctctttaattcagcataacatttttgagctttatggttttgtatatatcaacagttaattctttctctgcatttatgttcatgagagacattggtctgtaatttcattttcttctaatgttatttatcaggtattaattggtattagggttatgctggcatcataaaaataactagaaagggttcactctttccccactattttctaaaaatattttgtgtagaactggtattaattctttctaaaatatataatgcactaataaaaatattattatgtaactaaatagtaattgtattctaatgaaaatattagccccattaaaacactacttgactcagaatgtatgtttgtagttttttaaatattctattacaaattaatattttgataaagagcaagaaacttgtcatttatatcttgttctctttcatagtgttacaaaaattatatatatatttaataattctcaaccccttgaataattgtgtaaaagtgagtataaatgtcaaaaaaaatcctggaagtaggaaacactattaaaaagtgttatatcttctcgtatggaagcaaaacaacaacaacaacagaaaaaaaataaaaactaatttttaaaaaggaaaaaagtaatttacctatgttgctacatttagcagtgcatcaattcccacacattcagagttgtttccttggagaagctttgtattattaacattttccccactagacctgcacatacacaacataaatagagcatcagaagttgtcgatcataaacctaaatatagctctaggctgtcaagtttctggttcccaggagtaacaacaacaaaacctatgtaatgaggactttgctgttaaagtcttctctgggaaacacttgtgttacctcgtaatttatcataaactctatttgatattctgcatctggtagtgaggtataagactgaaaccgcggcggggcgcggtggctcaggcccgtaatcccagcactttgggtggccgaggagggcggatcacgaggtcaggagatcgacgccatcctggctaacacggtgaaaccccgtctctactaaaaatacaaaaaattagccgggcgtggtggcgggcgcctgtagtcccagctactcgggaggctgaggcaggagaagggcgtgaacccgggaggcggagcttgcagtgaacggagatcgcgccactgcactccagcctgggcgacagagcgagactgcgtctcaaaaaataaaaagactaaaaccgcttgaacaggaacagaaactctgaacacataaaatgcaactaaattcactgcagttttatccagaagttatttcatcttttaatttctacaactctaaatccttgggagtctgctcccccattttgttttaacaaacatgccctgaatttttgtcaatataagctgtttgggaaggaatagaaaagagaaaatatccatttattgctagaaataagtagaaaaacaggaatataaaattaagccactatcttgagtaaatataaaaatgaaacagatgcttattaattaagtgtgggcaggtagatgacaaggcaccgaggcatattgcaccagctgtgaagaatttagacagcttttatcctaccggaccatttattcattacgtaacagacaccttaaggagtagaaaaggtgacaaaacaaaatgatataaagagctaagagttcagttttctaaactttgaacactacttggtttggttttatctgcttttctaaggaataatctggcttccatgtttaagttttatgaatgctgcagttcgtgattttttttccactggaaactgtgtgactacaatattatttatgaaattgtattgcatacaatatgccaagaagatagacagcactgctttaagtatagaatcaacttttccaaggagtccataatagcaaggatttggaaagaagtaaaatatctaggcagagaaaaacccatgaaaacacaaatccactaatccatggtttatagcaaatctatataacagtaaatttttgaaaatgaaaaataaaatttaaatggcttcttataagacactctgatgaccaatcaatctcattttttaaattatacttctgctcagattagtggcaatcgaatttcttcatttagaacatttgataatgggccattagggaagggaagtccaatcaattcaaacttgtttccctcctcccagccccccactgccccttgctcccatgttctcgcatagaactggattccagtaacattgacagttgatccttagtccctaaggttttttttaagttgttataacttttctacctgactttattttttatactatatgattttctttggattttattgtgcattggtacacagggcctttgatctcgtatttttcaatattctacttatctcaaaaggaaaaataaaaaacagacaaaagtcctttaaagacaatgaacaaaaatacataatgcagagatggaattagaactaaatgagaaaaaacattttctacatcaaaaaagggaaattttaaaaaatgatctacaagtttattccttccatatatgagaacattaaaggccagaaataatgtaaatctggtgcttttgttttgattaggacaaataagtacaatatttctagaaaacaatgtaacaatcagtaccaagaatcaatgtaacattcagatcttcagtttattatattctcttcctgtaaatttatactaaagaaataattttaaaaggtgaaaaagtttatttctgaaaacatgtagtaaaaaataaggaaaactattcatttctacaaattaaaaaaatttcaactgaattaccaattcatgtgacctttatgccagctattaaaatacaattgtgaaaaatataaagtaccatgtgcaacttacattattgagattcaccaattacatttaagagagtaatacccatttgtgaattccatctctatatattgcttcttaaagccatacagaggagagaaaaaaatgtcagagagctcagacaaaagtgagaagatggagagataatagtatgaaaacacaattgaggcattttcataggtatccagaaaatatggaaacaattaccaattatccatggatcaataactaaggtagcatcttgtagacactgcattgaccacttagaagacaacaccaatattttgtagctcttggggtatgggaaagaatgccaaggagggggggcttcttgcacatttgtcatcaatttccactagttataagtcctcaataaagtgactcatgtcatgatatgaggatatttagaaactctcaatgttaacatgtaatctgtatatatacatatatatacacacatatgtttatatatgtatatgtttatatatatttccatatacataatacaagaagttgtttgattttatatatataaaatgcttatatatatttaaaatgtttatatataatgtttatatatataaaatcaaaaaacttcatatatatatatatatatatatatatgtatgtatgtatgtatgtataatcaaaccacttcttactctgcttgaacagctgtgatgtttctttccaggtttgcaagttcagagctgatgctaaacaaagtaagtcattccataaaattcacctatacacaatggcaaacagataaatgagaaaaagggtacacatttttgtgtaaataaataaatgacaaaataaacttgaaaaacacagtatatgatttttaaattactgtatgaaacaattaccttaatatttaatatatcttgggaaaaagggggagattggtaaaaataaaaaatgaaaacagctgatgctttggggtaagcaattaatttctttatttcctttagttttattgtaatgccatctgtggacgaaatagaagttcatagcaacagaaataaaagccattgatttaagtgcctgaagagcactttgaaaggaaaaaactagaattctaaaacaaggaaaaataatgcatcttcaagggcaaatgcgtctgaagacaaatctatgaaaaatttcaggtatgacttgggctaaactagtgtttcaaagataattgtctaaattctgaatatttagatggtcaccttgcactaatctgggagctgtagttcttgagtagaggaccatggatgaagctgtgaggcataacatgatcacatcagcatgtgtcactcaataaatgtactgaatggtaaatgcccaccagatcttctgctgctccatctctgccaacagaggtgctccggaacacagcagaggaactcgttaaagatacaatgagccctaaatagaaattacataatgtcttttgccccaacatggatggaattgtggctactaccttaagggaaacaactcaggaactgaaggtcaaaaaccatatattcttacttagaagtgagagctaaacagtgtgcaaacatggacatagagcacagaataataggcattgggaaatcggaagagtaagaagaagagaggggggtgagggatgagaaattacttaacaggtacaatgtacattattcaggtgatggttgcactaaaagcccagactttaccactatgcaatatgctcatgtaacaaaactgcacttgtactccttaaatgtatacaacattttttaaaacaagatacagcaggtcaattttgtccatacgattgaatgttggataaaatttgagtagatgttgtttaggaagactaaatatgacttggagaacagtaaccagtggaatgacctttccaattctatctagcagacattgttcaatttacactataccattctctcagtgacaacttcagaggttttctcacagccctgacactcacttaatatgaccataagccgtaaatcaagtagccttcttagatgaatataaacataatgtttgtgcaagcaaaagaaagagtaggatggaagaaggagaccataaaaaatggaactcatagaaattgatatcaaggcatcttaatttatcatttggtagcagctaagcataaacgtgtagctaaaagtcttatataataagtaaattatgaagaaaagaatgctgttagaccaaaagagcagaatatgtatgttccatatgattaagtcagtttgaagacaatattaaagatgaaatttcaattgattgcattattcattttcatagtgagtcctttattccaacaggagtgttttacactgatcataataagaatgacatcctatagtttaaaagctccaaatatttactcaaaagcatagttagatatattatcattcagtatctgtgtaaaaataagtatttgtcatccctaatcattctctggatgtgtgatttaatcttttccccataaaccaggtcaccattgagagcctctgttcaaaaaattttacaatcttgttactgtattgtcaagaggaagacagtgatttcacagctgaacttgctggagtcctacaaggtttcacccacagaatcaaggagcctacttttgtaacctactctttctttcccacaaggcttgagtgattgcacgtctgagactattaaggaattccggcagatgtgcatgacagtgctatttatctcagacagttctttcagaaatgcaatgaagttattactagaattttgcacaacgtaaccttaatctaccattttctaatagttacccttgtatcattgtttggcttttaaaaagctattaaatgtataacaaaaaatataggttaaagctacacaagttttcaagtgttgataaacctttggcaccatagagatgtaagtttattgtatcatgaaaaatgtacttttatttttaacaaaacagttttcttttcacttctacttcatttttttaacaatacagatttgtttttacttatatttctgtattgtattcactagatggcagagtaagcaagtcaaaacattataaaatagagttataacaatctactcctgaaatcctgagagaataaggattgttgtggcccaggataatcagggaatgtttcagagaggaagcaaactttgtgtacaagtggcatgtgtcctttccagaccaaggcttataagaagcatctctgcctccttcatgttctgtctttcactatctgtcaggtggatgcagaggacttcaggtcctaagagatggaataaccaagaatggggaagtttggatcacacatctgaggaaatccacctgctaagagagcaagatatagtatttcattacgttaaaccactaaagtgttggaggttattcactaaaccagtttgcatatttctaacaaaaatgcttaatgctgattttctttatttcatttgaaaagaatatatgtttatttccccttattttagatgttacattatttattgaagtaagatctgccttggaataatgagtcctggacaaaacaaataacacttttgttgttaccaaaatacaagggtgtaacttctctttccatatacataagacttcctatattatcacccttagttttcttattcatttataatttatgaaatacttactgagattatacaagcttcagaacctgttttcattcctgtcttgatggttaagatttacagcatattgctgggaagaaaaaattctggctgctggatccctccttccctatttcaatccctttaaccccacaattatctatcaacagctgtaaaggcatatcttcatcaaatccttcaataagcccctcatatatgtaaaagaaggacattttacacgtgaattcttatgtttaaatttgaaggaattttactagtatgctttgctttaatttttacatcacatgcaatcattctatttaaatgtggaaattatactgttaaaggctagaaaaatatggaaattcccatctacaagtatcagtgacaaccactaccttcttcatttgcaattaattctttttgtttgtttgtttgtttgtttttgagacagactttcactcttgtcgcccaggctggagtataatgatgttgtgttggctcactgcaacctctacctcctgggttcaagtgattctcctgcctctgcctccagagtagctgggattaccaagcccaactatttttttttttttttttttgcattttaatatagatggggtttcaccatgttggccaggttgatctcgaacttctgacctcagatgatccacctgcctcagcctcccaaagtgctaagaatacacacccgagctattgcacccagccaactattaattcttactggaaattttgcttgcatatagggaaattggctgtaggtgttgctgtataaaaacatgtttatcacctaacacaaggcctgcctctatgcaatccttcagtccagcattttatgaagaatcacaattcagatagagatgccagaatgcaaaatttctgtgcaaagattttctccattatcctttttgtattggtctctttgccaacatgtagctaatatattaaactgagtcttttactcttgggacaagactggtctgggtgctctcacattgtacatgaatgggccctgaatcctctaaggggattcatacatcttggttattttactctaggaatgtctgttgaagcttgagttttggacatctctggggaaatggacaagtgctgaatgagatatttcggacaggtggaatcttacattggacaatgaagtagaagctgattccatactctagtcttaaaatgtatcctgtgctcttcccaaaatgttatcttgcctccaagcacaatcttttctttctcaaaattttaagatactattatcgacaaaaattatgaaacagatgagaaaataaggtaccataaataaaagtcagaaaaataaaacattaaggagtcagacctacacagactgaagatattcaatgaaacaagaggctctaagaattgactgatggatttggagaaaaaaaaaagcaaagctcttctaggaataaagaatataattaaatgataaactgaatgaatgggttaaacaatatattagacattttacaaaagaagaaacaaagataggtactaaaatatgaagagctattcagtattcttagatatcaggggaatgtaaatttaacctcgtgagacacattttaatatgtatcaggcctacataattttgtagtcaggcaacattaagttaattaatacagaacaataagtgatcctccaacataccagtgagaatgaaaactgtcaacttgggaaaataatttgatattatctagttatttgctacatggacacaccatattacccaggaatgaaacacctggatatatgccagaggggagttttgcatatgcatatcaataaatatgtgagaatgttcaaaatagtgttatttgtaacaaacactggaaacaatccagttgtctgtcaaaactggaattattaattaaattgaggtatacttgtttaatacaatgtatatcaacatccttaaaattaaaaagtataatttgaagtaaaaagaaaattaaataaaaacatatattatgatgctatttataagattcaaaaacaaaatagaggctggggatgctgctagacaacatataaatcagaggacagaccttcacaccacgttttaggcctgaatatcaatagtggcaagactgagaaactttttctaaggaaaagtgagagcataattaataccaattttaggaaaaattttaaaatatggaattagcattattgattttccctttagatttttccttttactaacactgtctttatttaaaatgttgatatctttttcattattgatttctaagttgatttgaattattttaacatactgcattaaaatattatttattctgattcctgaggtttttggcacccccttaaggtttggggcctgagagtgagcctccctggcctcactgcagtttcagtcttagagaaggagtgcaggtagaaggacggaaggggttagagagcttcaaaaatattgatattctatttcttaatctagggtatagatacaggtgggggttcactttattatttttattaaactatccatatagcttatatacagtctttatatacaccattaaaactaaaatgaatttaaaagatcaattaactatggttaacttatatgctctaaatttatattttgtatcaactattagacatctgctgtctattattaaatagtatacacatatcacctatgatttttgtttgggtcaatattaagagaatactaaaaatgcatacaatgatgtttctcctataaatccacaaatgttatagatgcttataaaacttattctaacacctaacttacctctgttcacaatagagctctcttgaattttttgatagtgttggaagtatacggaataaattcacttcaactgtggtttatttcctgaatcccgaaaagcagtgatttgacatgcaagtgcaacacttctatctctttctaattcaatagcaaaattctgcaatgattctgttcgttagagggataggagtctttcatatattcaatttctgtcttccatggggatgttcactctagtggtagctttctgttcattcctccactagtcaaaaaatgaaaatccagaacatattcattatatggttatttcctttttattgttattggcctgcaactataatcctgcaattaggacaataatgattacaatacagtgtagaaaattgtattctcatttacttgactcttctgttccttatttcaattaagtgctcaagtggcattgaaactagcttcccactagattttactttgctttacctcaaatttctaaagaagttgtatttacttgtgaaacatgtttaaatgatttagatttaagttatactttgttattggcacatctagtatcagcattacattttattggcctcttccaggccaacacagacacgcaggtacaaacacatacaaacacacacactacacaaagattagcctctgagacctgaaagaaaattagaaacccaactcagcctccccctcctccatatctcaaagcaagttaatgagtggtttgtactcccaaagctgagatcttgaaagagggatgtgaacagaaggcaagtatatttctgttaaccttttctcagcatagtacacatttaaaattgatcacagcattctttctatttagccatgaaaggagtatcaaaatattctactgtaggaggccaccaccagtatatctcagttagtacttgagatgagcttaatgccttctctgtccaagaggaaaaaatgaaatttaattcaactaaaccatctaaagctccttgtcagagtaaggtcacatcatcatagtagtcatgatgtaagaaattcaactacatgtatataataatggcctatcatgtgcccaggccattgggagttaaccaacatagatctccatttaggaaggagatgcaaggagaataatgattgtggaaaaacctatgcttaagaaagtggagcagcttaaggagctttcaagatgctccattggcccttagaatgttatttagcaggcaacgggtttgaaaacctgactcttcccatagaagcttatgtttaaaggcctatgacatgacacacacaaaacctgtggtaatcttttttcggggtaggggggttaattctatttttctgttaatataacataaatttagtgattgaggtgacacatttattaagtagattctattctggccagaaactattagatttttattagtaaagaagaaaaacagagagccactgcttttggaaacagcctttgcataggcttctggatgttctttcttacgaatagcgtcttagtaaaggcagacttaaaaatacaaataatgtaacagatattaaaaacaagcaagcacacaaacaaatgaaaaatccaaacagtaaactaagttttctctgtatctatctcacctgtacctacattttcttaatttttaccacccaagaggtttgaaagaaattgttcagttacctttaattttaaaatatagtttttagaataaaatattttaaagtgcaatatgtatcttatgggggcagcattacttttgtcacttcaaaatttttagcctttagtattttaattaggcagtgaatttgataaaccttactcaacataaatgtcacgttctagtggtttttatgagcaaagtcacctacttacctttacctctaagagatacagtgtatacgaccttggattggagtgaattagaaattagaataagaaaagataccataatatgtagtctgaatccatttacaaaataattggagagtatactccattaatagacataaagaaatgtctggtataaagttcaccaaatgcactggatatttataaatagggagccttggtcttggtgatttataacattctacgtgttgttactatgttgcttgaattgttcataattgtcatatatttattataaaaacagttaaggttattattatgaaacaaaataaaatgttcatagaacacaagtcttgaagttaaacaatatggtaagaatactgcatatgacatatttaactatatacagagagaaaattaaaagtaagaagaaaaaattgttactgcattttgtttacccactaacattgagctaaaaacaaaccgaggcaccacttgaaagttaaaaacccaaattcaaagctgtgccacaagctgtaactacttaatcaaagatatatccaaaaaataataaattagaaaggactgacgggggatctgatagacatcttcatttatctctcaggtgtaagaaaacctatatatatattctccaaaagaacactccaataaatcaaaccctcaatagcatgtaaaggtttatagttaaggtaattgaaggaaagaggtatttcaaaccatttatccaaattttgctgcaaattctctaagcattagattatgaattcttataagtaaatactgctccacacctgctcttacagaaattttccttgggaatgagtctgtcaagattctttttccagcctgagatttgggagttaatttctattcatgctgaaatcactggcattaattgggtttacccccttctgatttacgagcaaaggaatgtaatttaaattctaggagggatgagaggcccatttgtgtagagttaactccttcagggtaaaaagttggggggaaaggtcccagtaatttggatagcaaagcttttgataaaggtttccttaaattggttccggatttcctattaatcaaataaattttttaaaaaatttattttttaaactttaatcttctagtttttccatacataaaaatcactagtaatatcaaatctctttttaactagtaagaacttaatatccttaccacattgtttaaatatgttgctaaattgactttaaaaattatatttcactacccttgttttactattttgtggctgttagccacacagaagtaacaaaataatgaacaaagccagaaagattcatttcataaatacaaaaatgaataacttgaatgtagcaaaagagctacattgttatatacaatctggataggagtatgatctatgatttctataatttaataaaatgaagaaattaaaaatataaaaatcaaaattataacaagaaggtttacacacacagaataactggttggaaaataattttacatattttatacctattaacgtgtttatcttaaatagtatctcaatttacataaaaagactagcattaaaattttttttagtatcacttttaaggtcattttcatttataaatgtagtgaataataaattgcagtataacacaaaagaatattaacataatctgtttttaaaatgatgaaaaattactaatatttatacttactatgttgcaggcactattattagtcttacttatgttaattatacgagctttcactgcaaccctagaaactatttggtgaaattatgcccatttcatagattcagaaactgagaaccaaatactttaaactactcacgtaactttacatagtagttggtggaaccaaaaagaatacccaggcaagtatatctctagagtccagttcttttccattgtgctatactcatgaaagttaaatggtgaaaacattttgcatcaaatgattaataaatcacaagctgtcattacaaatttaaaaagttaattgacagctgtcctgttacaattatttttaaatttatattaaaataatacatcttgcacctgcctaagagacataaaatatcctaaaacttcataggagcaagaatggtgcattgtaaaaagtatacgtttttatattattataagatatatattgcatatgctatcattcataatatctattatatgtgtttgtatatatgcacatgctattatctgatatgagttttccttttgctaaacttataaattttataaatggcattaaatttatgcaattttgaagtatgagactcaggcttgggaaatagaagagaagagagaaagctaaagggcacaaggaagaaatggacaaaaaataaataaataaaacaaagaaataaatatattaagaaataaaaacgaaatggtacacagaaggtcactgtgaacagcaggaagaatcccccgaggaagaaaagttttactagtggtttgagatgctgttttcttttcctccatacagtttcaagcctatgttatcagagagtccatgctcactgggaaaagaagttggtgaaatatttccctatcaatgtcttcctataaagaacataaacatggaaggttgaaaagtattttccctttgttattgtctccagtcgttggtgtgcagaaataaattacagaatttgggtactgaacgggagctcagatacaaacatattcatgctcacgtgcgcgtgcacacacacatatacgcaaacacagacacacacctctgcatactcgatatcatttttatatgatatggaaaaaattagactaaaaatctaaaaaacatggattctagaactatcctttttcctaagggattttttaagcttccaactttcatttgtattgtcaataaaaatgtatatattgaacacaacagtttttaaggttctctgcagttgtgaaatagtaatataaaatttattatttatccgctattccttagagtccctgagccaataggaatgcatttatttttatgaatacattaaaaataatactacatacaatgtctttatattagagttgagggatttctcccttctggtgtgtataaatagatgtatttttaagaagcattaagtacatccacaattttttaccaatgttgtttctcacttttacaaagcaatgtatagcaactaaattattaaactagtgttcatggctaaaaaactgttttttttttccatttcacttcttacctgctatatcattataatacaagcacttgtgaaagcaaacattgagtagtagaccataaatgctttgtattatcttgatctaaaaatggtatttttacaattattaaacttgaaacaaatcttataacaaacacaattagataggctaacaacattgctcttcaacagaacaaacttgttacttatatcagaaatagaaaactgtgagaaaaaaaatgccagctaaactttcaggttacagaagtgtaaattacccatgatcacaatgtataaaatcacagtttgcaaaattgtctagttttctcttattactgaaactgaaagttttcagaattgaatagatgaaaatatatttgtataaaattatttttaactcagactttttcctctcatctgtgacaacttttcctgctatgagagttcatatttcatgcaagaatagtcttacatagaggtatttactacagttgtttgttctgttcatctgttgcttttttaggaaaatacaataaccataaatctgtgtaaaagagaaaataaatagaaattggccactgtttctaaaacaaaaacaaataaaacaatactttgggtcaactttacctcagttatctaaacacccttaatagcatcctatgtctttattgtcagttctcatttttaattccaacaaagctggctgtcaagccatattatgcagtgacttaatatgagtggacatttgaaaacatcttacaatgtagaatatatttttcctactcactattacgtatcatccttaccaatattgtataaatatccttaacttgttctggagtagcccaaggaacagaaatcgtaaatgctcatagaggtaaaccatcagtggctcatcgaggtaaatacagacatgagtttaaaaagccatggtcaaatgactatgcaattcctaatgggtattgttcttcagtatatgaaaataggtagtaattttgtgatctgaaatgacaataaaacaatttcagaaagaaagaaaaggaaggaaacttactccatcccactagattcttattaaccaaagctctggaaaatctcaaagaaagataaaaatgtgttgtgtttctctatttgtgtttggtggagggcagtggtagtggggtcagaagaggtgttgaggttctataccaagccagagggaaagaagtgaaagacagagaatgaagagtaaaaattagcaacaattttagaaaataaagaggcttattttcttaatattgttcatcctctcttttcattgtttctgctctattcaattactttgtttctttttgttttgttccttcttttcctcatgcattttcctaatgtgtctcttctcttgctagtctctttcccctccttccccttctcttaccctctcccccttctccccttcctcttcctccttttcttacttctgtttcttctgtaccttttaccctattttccattgcctttgtccattttatgcccatgtcctggcactaaactaagactagattgaaagtcagaacctcctggtttgcttaagtagttattaaagtagttaacccagcaggacgtggtggctcacacctgtaatctcagcagtttgggattctgaggcgggcagatcacttgaggccaggagttaggaccagcctggccaatgtggcaaaaccctgtctttactaaaaataggagaagtatctgggtgtggtgatgtgggcctgtcatcccagctactcaagaagctgaggtgagagaattgtttgaacttgggagacggaggttgcattgagccaagatcacaatcatgccactgcactccagcttgggtgacagaatgagattctgtctcaaataataataataataataataataataataataataataataaagtagagtagttaaaccactgtattccattaaaacaaacaataaaacctctgggtaacagaagcaaaagaaaattgtaatttatttctaataatagcttccatatacacaaaacatgcttttgcaaatcctggaaaagtgctataagaaaaaaataaacaacttaatctatacacactattcttcatcacagtaaatgcatacttgtttagactttccaatggctttatgtaggccaaaaacttcttactgcagagttctatataatatagcatatgattacgttgatttgaaaattatttcaggttaaataatatattctaaaataaaacaacaataagtgacaaatcttcatataatattaagtctatgaagataatttcagttgcctcttgagaataataacaccaatacaaatattaagaaggataatcatagaatccattctgtttgttgaatgcttacattatgtaaaccactatataaattatcttatttaaaataagatagtatataccttaataacatctaccatatgaggtatatattacacatgcgcagattagtcaaataaagagtttataaaatgtgcacaaatttgtatggattagaattatgtcagattaattctagaacttactattgtctattcttttcttattatatttaagttttagggtacatgagcacaatgtgcaggttagttacatatgcatacatgtgccatctctattcttaaatggtagaaaaaatgttaatttttaaaactctttacagtagtgcttatttaaattatcgtatgatttttctctacttaaacacttaaggtattgttgaaattctgccatgcctatccttttgtgatattttaaaatctgaagtcatttaaccattttttaagtataatattgatagtttcttgttagaaaaaaataatgtgccattgacccttgaacatcatgagtttgaaatgcgctggtccactgacacacacattttcttccactttcacttccactgagacaggaagaccaactctcctcttcctcctccgccttagccaactcagtatgaacacaatgaggatgaagacctttatgatgatccacctctacttaacagctagtaaatacattttctattccttatgattttcttaataacattttcttttctctggtgtaacttattgtaagaatacagtacataatacaaattacatacaacatatgtgttaattaactgtttatgttatcagtaaggctttcagtcaaaagtaggctgttaatagttaagcttttggggagccaaaagttatacatagatttctgactgtgtgagggtcagcacttctaacctccacattgttcagaggtcagctgtgtggctataacattaatctatagctccatgtcataaaactttaacttaaaatttatatttttattatcaaaagagatgaatacagtcttatataaatgaattttagtagtttatagtaaaaagatattttattttaaaaaatagaataatatttagatcttatggttactataatcacaaatgttaagtatattcataaagcaaaacaaactactttatacaagtctgaagtgctatacaccgtaatttgtttcctaagtttaatgtatgtagccttcttaagcaagataaaagagctgatattaacagtccgcttattttactttcagagacattaaactaatgacaagttagctcgtgtttttaatgtaagatcatagagggtgatatgaggatgaaaagttggcactgcttttattggctagacaatggatcatgagaaaatgaaatattaccatgaacagaagctgctgtggtgtgctgcctgcttatttggttggttgtgctgagacttgattcaactccttgcttttctcttttgcaaaagtgttggaatatgccagtctaggaacaagaaaagtctactcttattcattaactgtcgtattcatactgtggatacatgcctcaactgcaagagcattacttaaaaattaaatgaatcccataaataatgctatttccttttgaagaactaatgttcatggttctcaatgagaatgtgttaaggtgtattggaataagacatctttatccatcaacatagatcaatctaatttagccaatgagagcaaacaagtaaagaaatggggcttgagaagaataacaactttattgagaacttattttaccttatgccagaccttatgctatgtccagtacatgtatcttatttaagtcctactgcagtttaaggtttgcataatttccattcaaggcctgctacataatgtatagattccagagcaaaattaagacataggatcccagctggaatgcacaagtcaatatccattgtccagtggtcagccgccccaatgcatgatggatggatgatccccccaaaattgtacctcctgttgggatgcacttagtacctggataagggtgggtaagaggcttctgccaactcacctactgaatgtacagtgtggctaccagccaatggattagatggccacagctttgctctgttccaaaacactgtggagctcatgtccatgcctccttgccctgtgaccatgagagtggagaacagcaatggaatatagtcctccctccagtttcctctccaggtggagggtgacaacagccacagaaaggtacagagaaaaagaggctgagtatgagggaggcagctgagaaactctcctagatccagagacagagaggctgcatgaggtgaagcagtgcaggaatgaggctccaagcactcaaaatatactccatttccccaaaagctcaacttgctaaacaagaatttaaagataaaaccaatatggatttcaagatgcgaaccaaaccgcattaaatctcaagtactaagctctggatcctatgtaaccatactgttcacttgcccatgaagctagcccttttcccattttacaaatgataacattgcccaaagtctgtttgtcagcatgagataaaatctgtgtgtatgtgttgtagggactcatcagggaacagggatagatcaatagtttaaactctaacttatgttttttccactacgtctaattgcctgtatatatttaccactcattaaattaatggaaaatgttttataatatactccttatttttcaactatttggggggtaaatatagaattagaacaagaaatagatacaaggaatataatgtttttgtagaggactgatgaaatataaacgacgttggcaaaattatcaaaactctgccccatcaacaaataggtgatgacaacatctatacataatttcatgttctcaacctcaatattgactatcacacgaaaaattaatagaaaaagttataaaatggaagctaatattgtagcttgtcaaagctgcaggtatttttcacgtggccatgatttgttcagacttgtttactattactgtcatctccggtctagtgtgagaggatgtgaaattgcatgttgaaaattactctatagaaaaatggtatgggaagtcatgaattataacttctacaaagccattaaaataatgaaaagtcaagaatgaagttggattaaaaatatgttgtaagggattacaaaaatacacaaatcaatggtcaggtgttcttcagagaagcgtggcagaaataatttaaataacttctattacctaattcaacataaaaatattactctttcgcgtgaaaactttacagtctctctgtggttcagctatccaaggtttggctcaaaaatcacttcccttaactgcattgcccgtttgtctctacttccaggctagataaggtgatcctcctcaatgatgccttgagtcctgggtgcatttttcatccatccttagaaagtgatgctgtaattgtttataatgttctgttacttctgattctcagcgacttcaggaaaaacagagacctatgtattttgtttatttgcttgcttgtttgttttgtatcatctgtgtttatcagtgtgtccagaaaatagaaaacattccttcaacactgaatgaatgagagagtgaatgagagaatgggcctatgttttctacctgaggccagagttattatttgctttgtccggccctacttggctgaggactcgcaagacatttccctacacatcgtcaaatcttcataatctctaactactcaaaactctttccagtcattcagaaaggcctagaaatttttcttgttaatataactacagaaaggctaaagtaaaaattctggctgtaatataggtggtcatttgttacacattttaggcccattatgattaaaagagattttggatacctcaaaatttagctacttaaaactttaaaaaaagagagagaaaatatccaaagttctagatacttcatttccaataaaatcttggaacacaactcgtttagaaggaagggaagagatatgtgcctctatagaaatgactgtacaagtaatgggcttatttccaacattgaacctcaaggaagctttcctgttaatgtttgaatagtttgttttcacattttgtttgcttaagtcaactagaaaaggcacttttaagattgagaaggtgtggtcccacatccacaggatatttctgtatattaaacacttagcattagccagccttcaggttaatattgattgttatctggataatattggacattagcctattgcttgtcatagaactctaagaactataattagctctaaccataaagcatgtgttaggtagaaaatgacttttcgaatataagaaaatccactggagctacccctagagcacagtaaatatttgccatcagctacctattcctcatgattcttgtaaaggtatatttttttcacctgctctatctgtatttctttatgattaaaagagggtaatttttaaaaaaagtaaaagtaaataaagctattgatagaatatattatatgtataaattacatatatgttatataatatataacatcatttcatatatgtataaatatgtgatataaaattatatattatttatatgtaactttatatagatataaaagtttatctctgcttatagatatttccaaattaaaatgctgctagctttatgttaacctcagaatattttcaaactgtaattgcaaaatagtgtctactatgggagtgtaaaaacactaaataaggcattgcttcttaattcctcagttgttgacatttcagaagcactaagatcaaagcctgatgttttgccggtatatgagatcaacaacaaccagttgtaagcaatgactgtgatataagacatttatgcagccaaaagacacatgacaaaatgctcatcatcactggccatcagagaaatgcaaatcaaaaccacaatgagatactatctcacaccaattagaatggcgatcattaaaaaatcaggaaacaacaggtgctggagaggatgtggagaaataggaacacttttacactgttggcgggactgtaaactagttcaatcattgtggaagtcactgtggcaattcctcagggatctagaactagcaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacataaacaccacggaatactatgcagccacaaaaaatgatgagttcatgtcctttgtagggacatggatgaagctggaagctatcagtctcagcacactatcacaaggacaaaaaaccaaacaccgcatgttctcactcataggtgggaattgaacaatgagaacacatggacatagattggggaacatcacactccggggatggttgtggggtggggggaggtgggagggatagcatcaggagatatacctaatgctaaatgacgagttaatgggtgcagcacaccaacatagcacacgtatacatatgtaacaaacctgcacgttatgcacatgtaccctaaaacttaaagtataataataaaaaaagataaaaacaaaacaagaaaaaaagaaataagacaaagatcctttttaattccacttcacaagcttatattaaagaacaattattacatgtataattaatacactcgtatatattttgggatggcaaactgttgtgggcatgtgtagcacatttcaattctcaagttaggctcttgatattaatacctttcatgtataagctggtgcattagtcagagacctcatggataatacttttaaggtgaggatagtcagtatattcagcatcagctgaatgtcaaagactgccagtcaatcatcaaaagataggagaaaaggttggaacaaatccctcccttgcagtccttggaaggaatcaatcctaccaacatcttcatctttcacttccagattccaggactcagacaatacattgcgttgtgttaagccattcgatttatgggactttgttgtggaagctgtaacaaactaatataatgtgtatccttgatatctccctgatcttcttagtcttttcttaccaaaacagctatctatctctctatgtatctatctatgtatctatgtatctatgtatctatctatctatctatctatctatctatctatctatctgtctatctacctatccatctattatctatgtatctatctatcaagcactgagatcagggaaatgtatttgtggttccttggaccctgagatttatacctgttttccttctgcctaatatgccctaaacactaagtgaagccacttagtcatttcagctttgaaacccaaattaaaattttgtggttgttcttaaagtttcatccaagttttttgcttgttcatctttgcttttgcttttgagttaaggcacaggatataaaactatgttcattatgtgtaccaacctataacagaaggtttcagttctctaccattgttacttatatgcatttatttacttaagttgttacttatttgcatcggttgtggaaggagcactgtccagcccagagtgcttctagcgtttaaagtttgttttacatatttatgctaataactctaggctatcacgtacattggtagattattgagaatcttatctacttgaagttcctttgggtctgtaagatgcttatgaggaggacttggggctgctagtcatctacctgacaaaataacctcctggactggtcaaaaggaagacacagaagcttgcctgaaatggaaaagcttcaaaagccaaatctggtaagtcttagggattcctataaagataaattataaaccagaagtaacagttgactccaattaagcgttcaagttttaatcaagtgtgacatacaaatgtatgctttcatgtatgatgaagatggaagaatatatgaaataatgaaaaagagaaaggaggcaaagaaacaaaactgatagcacatggaatagagagaggctgtgaggggggaaaacactcagagaacaaagaaaaaaaaaatggaagggtttgcaggaagggataatataggtcacttaagtggaaaaaaagtgcaattacctaaaaaccagtcaagctaagtataaaaggacaaactatcatcactctggtggtaaatttatggaaattattgtatagtctctgctgattaattggtgagttcttggacagaagaatatttgggatgggggtggagatggaggtggggtagggaggaggtggtgcacatacacatgcatgcgtgaacctgtgtgttacttcctctctgtacccttaacacttaggcaatttgcctggcaaatagtaagtgcttaataaatgcttgttgaatgagtgatttttggctagccatttacatttattaactttgtgataatttgaaaattattgaaagaaatgttctgctgtggtttggatatggtttgtccccaccaaagctcatgtttaaatgtgattcccaatgtggtggtattgggaagcagggccctgtggaggtatttggcagcaccctgtagaggtggatctctcatgaatatcttagtgacattctcttggtagtgaattatcttgcactctcccaagactgtattagttctcttgggaatgaattagagagagagagagagagagagagagagagagagtgtgtgtgtgtgtgtgtgtgtgtgtgtgtgtgtgtgtgaggtgcactctggctgttataaagcgaggttcctcctcctgtctggtccctcttcccgtgtgtctgcttcccctttgaccttctatcatattttgccctagcaccaaagccctcaccagaagctgaggagatgacagtgccatgccccttgaacttcccagcctgcaggaccttgagctaaatacaccttttttcctttataagtttctccggttcaggtattctgttacagccacacaaaacagactatgacaggttcttaatgagataactgaaatgatccactaatccagaaattatactctcctctaaaacattagtaaaaaaagaatatgacagtagggtttggatgaagtcaaatatctggatgtttcccacttccctttgagtttcctagaaacagagctcttgagatacctaaggaaagtctggcactggagtaaaggaagagtacaacaaagcatcacttctactaaatcgatttgtatcatattcaggccctgcaggtttgcaaaatgtgcttccagcagatggcgttttgcatagataataaagatgtttgcatctccagagtcttgtaattaccttaagaattaggagaaggaaaatagaaaagaagaggggtaaattccttctgcttcccctccttttaagctccattatcataatctgtatcccatttcaattttcatcactctcagaagaatacaacaaactgatagggaatgagagtagtctggattgaaaagacaatttaattgctctgctgaaaaagaaactcaactcacacaaaacagggccaaccttttccatttgatcttacagctcaaatgtcaactatgccatacgttttatgtgacttgaaagaacaaaaatggaaacaaagattttaaacattccattcttcctcactatcattttatccactgaaaaagggaaaaaccctcactggcattcaacaaacttaaaacaagcatcaggaatgtgtcaaggtcgccacaaactacagtagcatatgtgaagctccttgactgtatttagtgaaatttgttgatggtgttgtgtattaaattactgaaacctttcagaattctggcttgcaaagcacatggaaaataaatagtgtggctactgttggtgcattcatttgcatatcaatgaagataattctgctagtttcatagaaatgatagtgactaaggtctaagaaggaaagtgaggggcttggatgtacacagaggttgctaaaattcttcctgcttgcatgccaacatttcaaataattttcccagtaagataagctagatccttcattgttttgtgttctctgagacagcattatggaagcctgaatagggctaaagaggcggatgttttgaattctcatccaacaatttttttcataaaaaataattctctgccaaaatttcaaagtccaacagcttgagatctctgtctcttttcctttttagtttcatccatttgaaaaaaaatcagattaaataaaatatgaacattttatttcaagaaagccaagttatgagcaataccaagaaatgaacagatttttttcattatattttacttgccaattgcaatcatgctacttgtaaaatctacagttcagtatatagacattattagttctgtcaaaaatgtgaaggaacattgggaaagcttaagctaacttttcagataatgaaagataaattttcatattcagcttgggaattcgtataacagacaacataacgcctggactatttttaaatatctaaatatttaagaagaccatgatttgaatcaatatatcatagcaaaaatgagtagccctagtaagaggactcaggggcaaatcaaaagttttacctttaattggaatcactgacatagtgcccatgtgcattcttctaatttccctttattcttaataaccacccagaatgaaagcaagatgatcacgcctgtaatcccagcacttttggaggccgaggcgggtggttcaccttaggtcaggaattcgagaccagcctggccaacatggtgaaaccctgtgtctactaataatacaaaaaattagccaagcatgatggcatacacctgtaatcacagctactcaggaggctgatgcaggagaattgcttgaacccgggaggcagagagctccatctcaaaaattaattaattaataaataattaataaaaaataaataaaatatgaagatccccttcaatcttaaaataaccatcttacaaaatcatgtttttaaatagacctattaagaagactaacagagatctgcggaacacatattttgtaaattgatggcttttactggccctaaaacacccaaaagttaatattgtttttccttaacatacatatttccctaaactatcgcatgacatataattctattttagttcattaactagagaattaaacccttagaggataggaaatgtttacctgtatacctaaaattggtatatggaattatcaaagcagtaagaaatttaacaaccaaaaatataaaacaaggaacaattaagaattattcaagaaattcgagtaaagaaatgaaaacttctggaaatgcattgctaaatttcaaagctataaaagttgttaaataatactttaaaaagtgtttaacttatttaaataaataagtgatcaaactctttaattttgcttctaatatcaagatgaggttcggtagagaatgaagtgaatcctgtttatctcacaacaataataagagccaaactgaaatatattttacttaccacaacagatttctaaatatacttcgggagattaacttactactgaactgagtctgcaattcttcttatatattacccttaatacatgtttctaatttatgaaacaagattataatagttatagttagatcattaaaatattttagtgcaacatacaattattatgtgtgtgtttatatataaggatatatatatataaacacttagccttaatcattacacaatattagaagcttatctttcgtattaagatcatcaatcattttaattttctagacagcccttactttttaccctttctacaccctctattttgttttaacaattaacttacttcaatggtagaatgtttaaatattgtgaatgttaatttaatcaattacacattattagtgaaggatttagctaaacggattacatttttaagaagtctctgaatttccataaccttattttagcaatgccatataaaagacaatgatacacccagtgtgaaatcatgtaggtatgccaaaatgtaccaggacttcttaaaaacaatcatcactgtgttccatttactaaggaaaattccctcgtcgcgcatcagaaagactcaggacgctaaagagtatagctagctgctcatgtcagaaagggtggaaccaggaaggctatggtatcccacttaaccattagccagcacatattgtggacagatttaaattagaagacacttggtgatatcacttaagcctatttctggactcctgcaggaaaacaaatgctggcacaaaagaaaactgccaaacaccagctggtctggtagtcaacatttatgagctcttggcatttcataatgtgtcttacatgtgagaaaatccattgtcattaaactcttttatccattcgtgatctcactttatagattatgtaagaaaacatcccagcaagtggacacatgcttaagtatctaatgagcgattaaaatgaaattttaaaatgaaaatgacctacaataggaccacttaaaacataacttgggcaattctagtattagtagactgtctcgcatgtcttctttgtgtgagacataacctttggggtgtgaattattttagtgcattccagaacctcagggtctatagttattctcaaatacagtggttctgggaactagcctgcttggaactgggcgaggaaagctgtgatgtaatgtggatttacactagaaaacaggataattttctgacccttgaaaatgaccttaaagtcatttttcaaaaagggccttttcaaaactctagggttttttactataactaatttcacgtcctaacctctgactgtccgagacacagatatacctgcactctacagagaattctagccaggaagctaagtcattgccaaggccatttaagagactgaattggctcaagtttgatacagatttaattggcaaatggatctgaatttattctggttcttgttctgtcttttgagcctgttaagtcatttagaccagggaaagattctggcgtactaagaatgtttagaaaaggctcctatcttgacagttaggcttaaaatggatgacttctgacaggaatgcttggaagataatcattcacttctttccatcaattccatgttatcccaagggtttgttcaacagatggacataatttgcatacttgactaccgcagttttcttaattgcattttcccagcacattctattatatttgcagtattagatttcccttataatttcactttgaaaaatatacacaatatataataagttattatattttctatatggtggatcattctgcaaaacctaacacctggaaactgtaggcatttaggatatattgaaaatctattaccacactctaagctcaactatgacatctctcaaacttatttaatacctctattttgaaataagccttcatgttttagttcaaaatacttcacaatatatttgtatgttaggatattgcataatccagtaactatgtacaatattttaatattttaaggttaatttttgtttataactgaccattaacctgtaaaaaatacttacaccattaagtattaaaaatattattctttggtgggggggctgaaaagatgaataggtgactcacagataatttttagagcagtgagaatattctgtatgatacaataatgttaatacatgtcattatacatttgtccaaatccacacaaagtacaataccaagagtcaaccctaatgtaaactatggtatttggatgatcatgatgtattgatgcatcagctatgacaaatatgccgctctggtgggggatgttgataatgggtgaggctatgcatgggttggtgtaggaagtattgggaatctttgtaccatcctctcaattttgatgtgaatttaaaggtgctccaaaaagaaaaaaatagtctcaaaaaaggccacaattatttttaaacatagaactccagactgctgtttaccatttttatttttaatgttatatcattgttatgctgaattaatatctttattcttcatgataagtgtgcatttttcaagtctggtagttcttcattaaccctagggaagttcctgaaattgtcactgaaaatttcttaagggatacataccaatagggagaaggaagactgttgacaatttattcagcaacatttactgcttatttgtttaaaaatttaagcaagccttctaattaagatttctcactactcaaaagacacatgacatgaacaaaaattctccaaatgtttaattgctttaagtactatagtgcctaaggccaacatctctttccttgaccctcctcttcctaggtctgcaaatctgtttcagcatctcatttctgcccctgacatggaacatgttaaatgaaaaacaaaatccagaagatagtgaagagaaataacactgtcattaaggggaacatgatgcaacatagcatcaccatcattatgagtatagtgtccatgttggaccagatttcatcatgcaaattagcacctattacaaagacttccaaatagataaaatcttatattagaagtgatatttctgaagagcttctgagagttcaacatattttttaacaaatgatttgatttttaaaatatattcaaaagtaggcatttgcaacattgttacctattaattgcagctacagggccgagttcccatttgcttttttttttaaaaatcctttctctgattctcaagtgaaaacaacgaaatagagccattttgtattacttcacatgagagaaagagttgttttaatgttagtgtgaaagctgaccatacaaattggggtcattttgtcatacctgctctaaaggacaggaagaaaaagcactcagggcacataacgttgcttcaataatgtaattctctccaagtctggctgctgaaactgcctgttgtaacctgaaaccaatctaatagctactgagacaacctactaggactctaagactagtttcccccaccaccatctcttaccaatcagaacttgccagttcctgaaaaactttactagtgctactgaattttctttcagaacaatatgtaacatttctccatgttatcaaacttccaaccttctccttgttctttggacataccaaagatcatccagcctgtgtatacgctccagaatgcaattcttgcttccaaaataaaacacttaaaatttaaagatttgtctctatattttgatgttgactttagctatcgaaagcatatacttttccttaaatgtatacaatttcatcaggattcccaaagaggctaattaacctatattcatgggattaatatgcagatatgaaaatcctatctaaaaattgtagacaataatatatagcaaactatgttatgcctagaaataatattctccaagctaattttgttaattatgagttttgaagaaacaaaagttgggataattgaataatgtttaaggtgaaatggaatttttatttaaacttttgttctggtgactgttcacagaagcagtactacttcctaggggagattttgaaaacctgggaggcagtatgttttgtttgtcagatcgatttatgacaacatgggaattttagcaggtaaggtcaggacagtcctgcacatcgaagaaggcttccatgtccaatatggttttgaatatcctattgggcaacaaggggaaaaagaatctgtttggagtaatctgagtcttaatcctaatcctgttttacataaaacacaaaggattctgatacattttaagttatagactaagtttccataaagcaatctctatctaaatttaaaaaagattaatcttagagagactttcctttaaatcaatagttgttttccatcaggcaaagtcacattacctccataggaatactgctgatgatgtttgatagaattatacaatgaatgtgactaaaatggtataataaatgtgataaagtaaatctgtatttatagctgactcattaaagacattctatgtataggtgcaaaaaaagcatatgattacttcattaggtcttcatagtaagatttcccaagcaagcattaataaaataaaagaaatttaactatttcattgtaaattactcaccctttatttctgcttttcattttaagtgggggatttgtactaatagggttgaacttacacttcatttccaggtagtgaaagggaatttgcaaaatatatgttaaaataaaatgcatcaagtctaatagggttgataacagctgtgatagcagaataataataatgaacgttttattatgcatatcattgctgagagcttagtggtgtgacactataggaaatatgataactactgaatccagaaaaaaatgacaataatgataatgttatgaatatgtggagtctcacaaaatgataacgcaatctgaaggcctaagaagcagcctcagaagcagtttctctctgatcttctcccgccctcctgcctcttgcccctcagtctcccctgaggtaagccatacaatctcttttccccaaggttggtctagaaccctttttccccaaagccagctgtaaaacctaaaaatattactctaacctctctccacctcttcctgagtcacgattggccattaagagattaagaccttcattccagagggtcctaccccatactgaggagggaaaagtgtcgcacagagggatcaagaaacatctaaacagacaggccttgctgagttgtcccacccaatctattagcattagattatatactttttgtataatcgtatttctatgtggtggttcatataacctaaataaaatatacttcatataacctaaataaaaatatacttcatataacctaaataaaaacagatcgttttctctgtacctttgattcttccttctgaaggctcccatgctatgtaaaactatcaaatacacttgctatgcctttatcttgttaacctgtcttttgataaaggggtttcagccatgacccttatgatagagaggaaagggaacttccctttttcactcctagagaaacagaaggtccagggcagaaaggtgaggaaaaacgccttaagtacaggaaaagagaatgaaagctgggactgaggaatgcatcataaaagatcacatttatactatgatgtaaagtgggtaagaaatcagcttctttatcttacaggaaaagtaaaccacagacctatatcactcatgaacatagatataaacttagtaacacaattttaagaagtgtataaaaatatataaaacaatatgtacagaaggataatacaaaatgacaaaatgttaattttttaaattgattattaatgcctaataaagatataataggtcaataacccctaacaaataacagctaaaatgataaatctgcatgaagaaaatatggattaaatcctagtggcatttaatttgttaatggtctcttagacaggatttttgaatcatgaactacaaaattaaattagaatccatcaaaattaaaataattagactttttcaaaacctaaaccttttgctcattaaaagatacattacttcaattcaatatacaaattaggagaaggcatttgtaaaacacatacaacaaaggcctcatatattacaatttgaaagaaagatataaataccagagtagaaaaaaaaaaatgacaaaagatttgaacagacatttcaccaaaaatatctatatggattacaaataagctcataaaaagatgctcaacatcattaactattaaagaaattcaaaattaaaccatgatgagatactactctgtactgattacatttgttaaaattaaaataactgattatatcaagtgttagtgaggatacagaggaactggaactgtcatatgctactagtgggaatgtaaaatggtgcagaaattttgtaaaatatttcaacagttttacaaaaatttaaaaatgcacttatcatatgacccaatcatttcattcctagagatttacccacaagaaacgaaagaatgtgtccattcaaagacttgtaaataaacgttcatagaagctttgtctgtaatagccaagaactgacaagagtagacggccttcaacaagtcaatggaaaaccaaattatagtatagccatgcaatgaactactacttcacaacaaaaagtaacaaactattgataaatataacaacacgggtaattcaaataatgataactactgaaagaaaaatacaaagcacattgcatgatttcaatcatataaaattctattaagtgcaactactttacagtgagaaaaagtagatcggtgtttttcctgaaaaccagggttggtggaggaacggttattataaaggggcaccaagaaacttttggggatgatggatctgtttattattttcatgtgggtataatttcataaataaatacatatgtcaaacatatccaactgtacactttaaatagggacaatttattgtgttgtcaatgatactgcaataaagctgtaaagttgatattctatgaaggtaagttgttaagaagtcagctatttaaaataactaacggcacataaaaccaaagctatatttcttatttacaaatggactgaccttgttaaaagttaatttaaacaacacgctgttttcatgtcagcactggagtaaaaggctaaagaaactcagacaagaggaaaaaggtgccatgaattaaagactatatgacctgtgaagaggaaaacctgaaaacaaaagactataaaaggtatgtgatcaatttagcataaatattttctgtaccattagctttctaactgcattttttccagaaccctatgactggctgcactggaataagggcaagagacaggatcattttcagttctctaaactgtttgcaataacataatttctgctttttctttgttttatttctttaagctcccatataaatttcatctgagcaaataactttaggctgaaatgttgaagccacttcactgcagtaggccaaaagagagattagaatagggcagcgccaaaactcattttaaacacatttttgtataatcactcagctctcataatagatttggatactatgattcatatgaattagatcacaggtaccaacgttcagtgttcaggcaacagaaatatgtaagtccctactgtgtaccaggctttctgctagatccagggatagagtgatatgttgctttacttgagtgttagaggcaggcattgaatacatttttttttttttgcatttttgactaacatggtgtatcttcagtgccatgtaaaatcaatcagcttaagggcttacttaattaaaaaaaaatctccgtctagggcttagattagatcaataggtttttatttttatttttctttctagtggtggaggaaacagcacaattttccactaattaagtgagccaatggctgattattttacaaccttgctacttctttctgggtgtgaccaagaaatttgatgtaacgtatcattgttccagcagaaaatgaaaattgctggagtttgagagaaaaaggaagggaagagagggagggagggagggagagagagagagagagccaaagacaaagatatggttatgtttcaaaaatgaaaagttttaacagttcatacacatttctggttttgtaactgcctctaaactataactttgatttacacagcctgaggcaatttagttccattgtccctttgcactttatggacaatttaactgatccctgtcaaaaatccaaggatattcactcttgaggagggagttattcagagacttcattactgtcttgcttatttctatctgaagttgctgctttgagactaaatttccttttattatgaaaactgaatggttcccacatttatatgctatcttttgtaagcatttggccacagctaaagtggctattgcttttgagacctgtttaattttcttttcatattaaatgttaatgttttatgtttatcactttgtctaccttgtgtattgcaaaatttcttgctggttgtggaggtttaatcataagatcattttattagtcaaaacttacatttctataacactacagatttatatttatggtttgagtcgtcatcaatgtccttccacctatacaattgcataggtcctcttaactgatttccaatcaacattctatattctatttcctgtaagatccacccttcacactgctaccacaattttcttctgaaatcccattgggatacttaaaaaaagagatatgtatattttcttcattgttggagatatacatagtaacaatagtaactacaaacacctggtatataatcctactcacaatcttgctccaacctctaattactatcttgctccaacctctaattcaagcctcctatttcaccagtcatatttacaagtcatccaacctttgaacctttatcctcccaaacctaaagacatatatgtattcatattttatgtcctggattaatcatttttttttctgtccagaatcaggtccctgcaccgaactgctagatttacatcaaagtttgatcatttgttgtataacactaggtaaattaacctcttaacagcttgttcatctctaaagtaggatcataattatgctttctcacaggtttgggaggattaaatgtaatatacgtaaagtgcatagaatgagactatagagagcctacaatcactgtttactactaatcactttttttttcattgtagtaatctaatggtatcccactcaaactttgagctctggattaaaatcaacctgcctgtgaatcactacttggcctcccttacagtgttagtcattgtattcttttacatcaaacatacatcttcattatctcttcattgtgctctaatatttgtttcaatgcatcctcattaaattgtaatctccccaaaagcagagatattgatttatgcagtctgcctctcttgtgcccaccacaatgcactgtacatggtagatggttgataaaggtctgttagaccctggctgctgaatgcatctttacaagtatgttgatatgtgtggcatgaggtccaactgaccacatttctgtggacactgaagagatacaggtagagagatctgagtttatagtcaaaacaaatttcattttttacaacaaaagtagtttattaggttaagcaggaggaaaaaaattcctcttgaattttggatatgagccagggaatcatcctaccattcctaagatgaaaataaaacattatttcataccagttcaaatctcatagagcccctcttgaaaatataatggcccatatggaaaaaaattggctaaaggaactgaagttcaaacaatatttaaaacagggagagaagtaggtttgcaccttctttaatggaacagtgattttagaatgcatgcccttcttatcagggctctacttttaaagcatgctgttttctagctgcttctatattgacttttctaagcccaaggcataatcttttggactccagacatgagtctacttgagagcttattacacaatttattttgattatcagtatactggaaaactcttctcattttcccatttcttaatcattaataataaaaatgaaacaataatgaaagcattttagaacattcacacaatgtatctaatttctcaaacagaaatattatttctaatgatgacataaagtttgacattttacatattattgacagacattttaccctaaacatagtgaaaaatgaaattaaatttcatcatcactcagctgagcaaaatgtagattccaacataccctggaccagttttcctccaaggatagattagtcatatgttatagaaacctgtgtaaagcagagacagcattaaatataatcaacatatattcctttacatacagagtaacctgaggttataaggtaaagccatatagtgcgtaggtaatctgataatcaaagtattgaataattaagagtatttaatcacaccattttatctatgatttccaaaataaaattatactagtattttcaacaaaatgactccgtacacaatgcatacctatctgttcaattaatactcactgatggcctactatgtacaaaatgtgcaaggtggccccacaagcactacatgataaatattggtgcactcgctcttttcattcattagacaatgcacactttgaaagacaaagaagtgacttgcttcttgtgtgttgttaatacaggtatgttagatgtatgaataaattaatgagtgaataatgaaatgaataaacaaactatgaaaaaagaaactgtccttctactgaaggcatttaatctatgtgtatatgtgtgtgtattgggacagggggaagacagatgtggcagggagagagattgataaagtaggtgaggcaatatatgaagggtgcaagctaagtaagctcaaataaggaagagatagtatcaagtaagggattttcttaaagcttcaagaatgaggtggcatgtgagatattttgaagaattaaattttgacacatactataagccaaatcagtgatagaacactttctatccaaaagcaagaattgaacatgaaataagttaaaccacattaggaaataaaaatttcctattttgtatttcctttggcctcccaagaatgtttttttcttctcctgctttttaaaccctctagcaatcacatacttcacaataatggttaaaagaataatccaactcttaaatacagctatgcaactactagatataaaagctttggaaatgtatttaagtttttaaagtatgagtctctgtattcataaagtgaaacattagtaccaactcgattggctatttttgttttgttttgttttgagatggagtttcgctcttgttgccccggctggagtgcaatagctcggtcttggctcactgcaacctccacctctcagattcaagtaattctcctgcctcagcctcccaagtaggtgggattacaggtgcccaccatcatgcccagataatttttgtatttgtagtagagatgggttttcaccatgttggccagtctgctctccaactcttgacctcaggtgatccatcccccttggggtaccaaagtcctgggggtgcggtgtgagccaccgcacctggccaagatacatgttttaaaatagttctaattcctgcagagttcaaataaacaactacttagggcaggaagattgttagatgatgatgcctatgacgacagtgatgaagaaagaaaaggaaacctaagtacactttttgaggttttagtttgtgcctggtactctttacgtatttttaaaataatccttaaagcaaaatttccaaagcttatgtatctagtagttgcatacctgtatttaactactcgagaggctgaggcaggagaatcgcttgaacctgggaggctgaggttgcagtgagccgagatcacaccattgcactccagtctgggcaacaagagcaaaactctgtctcaataaataaataaataaacaataaatataaaataaataaataataaaacaaataaaataaaatgtcttaaggcagttaatactggtagatttactgtgagcacaaactaaatactcactaactttgtttaaaaatacagaattgctatagggtcaaagagaaaaaatcttcacatgcataaaatgtaaggcaactttactagaaaatcaaacctttttaatctttgactacaaggtgttacacaaagtaaaactagtttgattagtcataattgttaatagttcatattaatgagaaacctacatacctagagagacaatagtatctcaaattcccatgcctaaatggtacttccaaagtcagacttcatgacattgcaacttgaacttaatcaaaaatgattaagatccatgtttcagaaaatagaaggaaagctatgtgcattttcctcctagaggtattaaaataagaagatccctattaaagctttattaattacgtaaaaaattaatccctaaacaataagttagagacaaaatgtagttttatacagtaacttttaaacatgttttagtggggtttttattttcataatttacacacacattaccatattctctaaatactttatgatccaacactttataaattcagcgttatttccagttatagttgctgtcacatttgtgtcatttccacagatatttccccctgaatgtcccaacattatttttgcacttaatgttggtttatgggattgtagaaataaaagaaaattcatacatctcactgtttttcatgtttatttgcttttcattttggctgacttccctgggagccagaggagagaaagaagtggcaagggagataagaggattatgtccctgatggtagagaaagaaagaaagaagacaaataaatacaacgaggtggcaatgggaagtaacgcagtgatatggtttgtctctgtgtccccacccaaacctcatcttgtagctcccataattcctatgtgttatgggagggacccagtgatagacgattgaattatgggggcaggtttttcccatgctgttctcatgatagtgaataggtctcacaagacctgatggctttaaaatgggaggtgccctgtgcaagccctctctcttgcctgctgccatgtgaaatgtgcctttcactttctgccatgattaggagacctccccagccatgtggaactgtaagtccaataaacctctttctttcttaaattgcccattctcaggtatgtctttatcagcagcgtggaaacggactaatacatacagagtggaggcaagcagtaagggttaaagtgtcaagaggaggctctcagtcaacgttttttggggtgatcctaagaaatttgtaaacaattatgcctcatacttaagaacatacataaaaattacgaattattaccattctacaacctctaagttaggaagttttggcagcacttattgaagaaaaacttggaaaagaaacttagggaatgggcgaaaatgagctattcaccaaaacaagaaatgttacttttccaacatggatcgtgttaaacattagttctacagaatgtcaaagggtacatatagcaaaaaaaaaaaaaaataaaaaaaataaagcgagaaaccaaaatgatagattatctgaccaaattaatttggagattgtaggttaagcaaaataaaagtttccgtaccagacaaattatgagaaccatgaaaaagagagtcattctaaatgtccatcatgaggttgcttgagagatgtgagttctttagaatacacttttggacgtgccttctttaaactaatggcatgctcttctctcatgaggtgagaaattgtttggaagagtttgggtagctcaaaaatcttgtgtcatccactgggaataaaaagatgactaaaatatgacccctgtacataagcttcttatgcacagaggtgatattttatcttttttttagcaatattgatactagatttccactcaaatgcagttttatagtctgttatagggaattcatatttacctaaggggtcagtaatacgtagtagcctagaagtttgatcccctaaatcagacagtgaaggcctactgcttctctgctccttcaatttcaagcaaagatgtttcttctgcagatcttatatatcttaagtcagcaaatttgacctgcatttcaaaatcttcaacaccaggtaagtgactaaaagtgattttgagacatctatgcttttatctcccatcctatacttgcactgggaaggagatagaaaaaaaaggttacagccattaatcactaaagacaagatccagtgattgttcaccttgtgaaaagtaaacttagttctcttttgtgttgtggtcagcatgctctccataacataaaaagacatcattgtacttgatttttttccatgagtaacaggtatgttagttctcagcgtctcttcttgtttcaagatctataggaaccacgagaaagagtttaaattttgacccggtaatagccaagatcggacctcaaaatgtcccttccttgaagctggtttgataccattaggcaaaagcacactgcctgagtaattactctgtctgacaggagcaaaggatggtcactggccaactataagttaggtaaagaaacttatctgaaattttatttatgacacagatttagaaatcatttcttttaaaattttattgcattttttccaacacattttcctattggtttgtcttatgagaagcactaatgttaaggaatttctttcttgttcctacaattagacaatatattaattttcctaccataaatgcagttgtcttgcattttaaggtctggtaacaaatatcatacagagctacctatgaattcaagtacatttaggtgacggcatcacagtctatagatggcagggcctgcaataagctagaaaatgactgctacatttgaaaaaaataaaataaataaataaagcgcttaaatattttcctctaaacacaattagagacacatgcatacatctgccaattaataaaaatgttgattttgatgttaatgtacaaaaatcaccacacctaaatctgtcataaatttgtctaaaatgaatattaagatgggacctcagctttcattctagttactgtacttttcatattctatttaaatcaaagtacttagtatgtattatctgaggattatgatacctttagcacagcataaagtgaacatttattgttttaaagcattaactttaggaggcgggaaatgaagaatctgataaaagtgactataaaaaagtaaaaaagcaagtgacttccttcaagattcagtttagggtaatgaaatatatgccatgtatgttctctgaccctttactcatctatataaccaaattttaaattaaccacaataattttataagacagctgaacagtttctacacttttgaactcctgccaagacaagatgtactggaaccaaatttcgcaatgtcagaaagcctagaaagtctttataaagcttagattaacatcagatcaaatttggactcttaaaaggggcttggctattttcaagcttttcccaaaatgatatttagcaagagacaagcaataatccctctttaagcttaatctcagatttaaaatcctttgatcaatcaacaaacacttattgaacacaaaatattttagttacacaggagaaaataaaatctaagtcaaaggaaaaaatagataattttttatcacttcaattctggaactataggctatatgttggttcacttccccaagtatatgctccaagaagcacaaaggttcagggaagaaactgtttatatgttttactatatatataaaataatatgtggaataagatatatgcataagtatacatatttatatgtgtataatcatatgtaaataggtataaatatatataattatgaggtaaaaatgtttgtatactggcatccacatcttttctaaaaaatatttgattataaaacaatatgccataccaaaattcagtgctacaaaagtttttcatttgtcagaaatgtaattgtttatgttatcatttgtaatacctaccaactaattgaattagagggctacataggggtctttgaacaagatgaagtttagtattgtccatatagcaatatcaaattacttaaaattaacagaaaaacaaaacatcctattaattaaataacatgttcaattgattaaataacatgctcaaaacagtctattttggacaacccttatgtgaccagcactatgctaggcactttcatgtgaacattataaattagccttcacaatcacactaaaagtccactatcactattcaaatttttagacatgaatctctacctttcacagataaaaattaagtaaatcaaggtcatatggctaaatagtaggtcctctaaaataagagactaaactctttccattcttttttttttttaatttttttcctagtgagtaggattatcagatcgaggttaagagttgggctctgtatcttcatttcgagttatgtgatttacaacaagttgcttagctctgttttctaatcttcacaatggataatacaataaaatccacattatatgaatgagcttgtgtaatgtgaatgacagtacctgtataataaatcacacagaacatcacagagcacatggcaaccacccaataaaagttagctaatattactacaagttcactctgtgatccttagtgagtcactttgaacagattatagtttcctaatatggccttagcagtagtccacttgctcatatcgcaatgtgaccttgcaacttctccataatatgatctcttatttgtggaatctgaaaaagttgaactcatagaaatagtagaatgatggttaccagaggctgagagggtgggttagggaaaggggaaatgttggtttcagggttagaatttctggtgatccattgcagagtaaggtggctataattaataataatgtattgtatatttcaaagtttctaaaagagtagtttgtaaacatacgcaccacaaaaaatagtaagtgtgtgaattgatgggtatgttaattagcctgatttgctcattctaccaatgtatacatgtattcaaacatcattttgtaccccacagatatatacaattactatttgtcaattaagaataaaaataattttttaaactaaaaaagagagagagagagaacctatgtcttctttctttgaagctgcatgaaactttgtgacagcctcaatcaatacagcacgatggacatgaaatggtgtgttctgcaaagttagatcacaaaatgcaatagtgtctgtgtgccactccttcatctccatctctatctcttcttgctgttggaatccagtcaccatgctgtgagtaatcacaggccacaagtagaggttatgtgtacactttcaagccaacaactccagataggcttccagccagctgccatcatcaactgccaagctaaagcctttgaagtaacaccagcctcctccattgtctcccccattttcatgagaaaccctgagggaaagccaccgagcccaacccagtcactcccagagtaataagagatattattattctgatattatatattatgtattaatgatattatatattaatgagtgatcagtattgttttaagaaactgtttggggatgatttgttacatagcgatagataaattagcataatcaccaagatttctttttcattattttttacttaaaaaagccaaattaaatatatttcagaattagtttgatttacaaatacatacacagtcacagagccgaagtgtattttttttcttttttgagacaaacactcactctgtcgcccaggctggagtacagtggcatgatctcgactcactgcaacctccgcctcccgggttcaagagatttttctgcctcagcctcccgagtagctgggattacaggtgtgcgccaccacacccggctcatttttatatttttagtagagatgaggtttcaacatattggccagagtggtctcaaactcttgacctcaggtgatccgtctgccttggcctcccaaatgctgggattagaggtatgagccactgtgcctggccacgtattttattttattttttctaaatgaatagaccttttaaggatacagagcttcacagttaaatttgatgattaaaaaaatttctgatatgtagaaataaagggggtgacccatcactactctgatgtctggcatacgattatgaacaaaagtgacaaatatgtatcttaagggactgtgggtcttcacagaatggaatccttcttcctaaggccaagagaagagtatttccatcagtaattgccatagtaccagcaattttatgctcttcctcttatggggccagctgaagaaagttctgactcttttaataaagaagacaaggcatgcagtagctaaattgcccagaaactttgatggtaaacatccactcagcggctcagctgctcaggaatatgtaaccaaacaactcttttaacgcataaaactaaaagccaattctcctccaattaaaacatagtacatgtctgaattcaagatgctaattataattgagtttcatcgctcagctttatttataagggctggaggctttcaactgtttcaagaaaaatctgttggacgaaggaagaaaaatctctcagagtggcatttgcttgggtagtatcagcccattctataaagagaagtttactgcattaaatacattgatgaaaaaaatgattttttaaaatatagagctatatgtatattgcaataggcaaactctaattttcacagggaatgaaatgcttttattcattggctatatggaactgtagttcttcatcaggaaagaagcccatgataactctgtgaagtagaatgatgtagaatatcactcttgccagcaatgcagcttttttaaaaagaaaaatatccaaaaacaaaattttaaataagattaaacaaccctaattctatagcaatacatatgtaattatgttgaaaataataacacatttccccgtaatcttaaagaaagcacgttttctgagcaaattttgcaaaaggagctatctagctaatcatcatactgtccgcagagaacaagtcaactcataatcacatactttctcttcctccagttttaaatttttgtttatttaccttttatcatttataagtggatatttattgtaagttggcaaatcatctgtgggtgcatgcatataaaagtaagtaactgaatgtataagttatttaaaatccaaaagtaataactgtaaggctttgatttaccaagattgcttaatagtgttttggatttttcccctggtaataaacaatatgaattacataataaaatatatttgtttaatatttgggccaactttttattattcacagtgcatgtcctagtttgtcaaataggcaagactttatctattttttcttgttgccaggctgatggccatctcggtgtgcatgatgtaacatcttcagtagatggcaaaggaataaagcataaaaacgatttagccccatcagctatttagaggaaggctgtgctcagtgacaatcgagatgactgaagacttttaattatctttgcagtcctcacattacaaatagagtaaaagattcccaaaaggaaggggatccttttgactgccagatgtgggaaggaaagaatgagattagaggatatccttctaaacacataccctgacatgattttctgtcctgctcaggggtcacaaagactcaaatgtggacagaatttctataagctatgcttatcatctgtatttactctggcgggtgcctgtctcccaggagactcatgataagcagcaataattgcagtgtcttgtagacaaaaggatcaaatctctgttctctgatgacttttaagaaatccaaatatatattacaattttttcacttgcttcttatgtgctgtataaaatctcttgctttttgaaatcctggtagcttcaatatatgtttagaaaacatggctttgtagatatgatgcaaagaaaaggaagaggacaataacaacaacaattagcaagaatgtttaatttgccaagtatagtacagagtgttttacatctggctctgctaacctcaaagagttgctctttcacatgaggtgatttaaaatagggtcaagtgttgcttaaggagggggatacattctgagaaatgcattattaggcaatttattctctatgtgaacatcatagagtgcttttacacaaacctagacggtacagcctactacacacctaggctatacagtatagcctacctattgctccgaggctacaaacctgtatagcatgttaatactgaatgccataagcaattataacacaatagtaagtgtttgtgcatctaaacatatttaaacacagaaaaggtacaatataaatacagtataaaagataaaagtgatacacctgcataaggcacttagcatgaatggaggctataggactggaagttgatctaggtgagaggtgcgcgaatataaaggcctaggacattacactactatagattttataaacactgtatgcttaggctacagaaaatgtatacaaaaatatttttatttcttcaataataaacttagcttactataactttttgactttataaacttttaagttttttaaactttttagtttttagattagcactaagcttaaaacataaacacattgtgcagctgtacaaaaatttctttttaaatatccttattctatacagtttaagaattttttagtcattattactattatttacttttaaaactgttttgaaaaactaagacacaaacacacatcgtagcctagaccagggattcataacccccaggcccggactggtactgctctagtacctgtccttggcgtgttaggaaccaggttgcacagaaggaggtgagcagcaggtgagcgagcactactgcctgagctccacctcctgtcagttcagcagcagcattagattatcacaggagtgcaaacactactgtaaactgcatatgtgaggagtctaggtgtgtgctctttataagaatttaatgcctgatgatctgtggtggaacagtttcatcctgaaaccaacccaccctctcccattgccctcagtttgtggaaaaattgtattccacaaaaccagtccctggtgccaaaaaggttgggggctgctggcctagacctctacagggtcagtatcatcaatatctttgtcttccatctccacatcttgtcccactggaaggtcttcgggggtaataacacacatgcagctgtcactttgataacaatgcctttctctggaataactcctgagggacctgcttgaattacagctttttttttttttaataagtaggagtacactctaacataataaaaatacagtatactatataaaaagtgatggaaaattttagctccattataatcttatgggaccattggggtatatgtggtccatcactgagtgaaacgtcattatgtggcacttaactgtaattttgtcaagtggttttttattatttcctttgagctatccttgccttacactttgtgtcaatgatttgagaaattcaactaatcagttatcagataactgaccaagtctccgtcccattaaagtcttaagtgactgcctttgccactaacgtgtaggataaaattttatctgttctacctgcttctctaggctcagtattcatcatgtgtcttttgaaaatggcaggtttcctcctgccacatcatctttgcacatggtgtttcccctgcaaggaattctagccctatcccacccacttcttataaatactctatttacttaactcctgttggttcttcacatcttagttccatcacttcctctaccattctttcttcataatgttcaaattatgataaatatcccattatatactctatatatcaatacatttcaggccatggagcacatatatctgattgaattttggttagaatctgtttcctcctcaagactgaaggctccctaagtacagacaaaaaatgttaatttttcttcactgagttgagtggctggcataatgctcagtaaatgttaataagataagaagataaattaatgactgaagaacttaacatatactggttttagacacgtttttgcttctcaattaactgcctgtgatacaaggagaaaaggttgcctatatctggtcctaaacaatttgcctatatctgctccacagcataacattactttgcttgctccactcaaatctttatgtaattatgtacttgacctctaactggagaggaggtactggtagagaaaggctcccaggggctatggcaaaccaggggcatccttctgagcaaaattgctaggcaaagagtcaaaatcaccatcagagagaaaaattcatagccaggaggtaaacagtatgcatcatatccaattgattaggcaagcacagaaataaaagagtaatgataagaatatcacagaatattacaaagggtacaatttgggctgacttcctaaatcaaaatgatttatatggtgccatatacatttcatcctttgcttcctctctgttagaatagctgtaatatctgagaggagagacatctgaccccacctggaccagtcaggcgctcaacccactaaccacctcaactggtctatgcatgggcatagaccaacgtaggccaagctgaatcctcctctgaaaatttaaaaactcagaataaggtaaatgggctaaataatacaaggccaactaaaatgttaagatgctaatggtcatatgcattcatcatattagaaaaactaaaataaaacaaaataacaccctttctgtggcagaaaataatgaaacaagcattcatagagagaagaaagcgggtgtgtgttatgtgcaaaaacaaaataaaggaagggaaggagaaggtaggtggcaggggcaggaagcttgtggggagaagggggcaggaaggtggtggagagaaagtgagtcagtcggtagatttcaattttccttaattctagccatccttcagccaattccactcctggtcttccaaagattggatgtattatcccaacagatatcctttctcgtctaaactagttgtagttgggttaagagagtacagaaagactgggtagaattcaaacattaattgaggtagtgattcagaactcaggtttgacacatttctgcttaggcagccctctacttccccgtgcatggtcatgggagctgagggcttttgggagggtgaaaaatgttgcattaatgtggtctcaccaggttgcaccatgagaagggatgaaggtagaatattataacataagagaacagaggaacataggcttataagaggctatcttgccataatatctcggagtgctgactactaataatgtgtttagatcataatgaaacttgattaaatttatgtaagcaattgaggtatttttacatgtacactttcatttagcaattcttgtaaaaatcaatgaaaagtaataattttatccacaatagtggcaagccaacaatcatctgaatactcactgctgtatctttatctgtacctacatcttttttggtattgcctatagaaataccaaatttgtatggagtatacatataggcactagagtgtggtttcaggtttcagtcaggtatcgttttgtatctctctctctttctctctctttctttcaaatcctaaggaaaaacaagtggttaaaaattcagagtaggggaaacaactgaatacactatcgtttttattttttatacttaatttataattcaatacaaccatttactgtatggtggagaatggatttgtgcaaataaaatatgataaattcaactttaaaacagtattgttgaacttatttgtttataattttaaaggtatctgtttctgttgttgttgttgtttgtttcttttgttttgttttgttttttgttttttttgtttttgagacggagtctcactctgtcgcccaggctggagtgcagtggcgccatctcagctcactgcaagctccacctcccgggttcacactattcttctgcctcagcctccggagtagctgggaatacaggtgcctgccaccacgcccggctaattttttttgtatttttagtagagaaggggtttcaccgtgttagtcaggatggtctctatctcctgacctcgtgatcagcccgcctcggcctcccaaagtgctgggattacaggcgtgagccaccgcgcccggccggtatctgtttcttatgtgtagtgattgacgttctttttcttcctcaccaatatgtggtcatcatttgattgctgacttccccttcatatggaagccagggataatgacattgcttatacaaaggccccaaaggcctctactcctattcttgaccctctagacttaagaaatcctccaaataggagtcgctgctgttttacacctttaggatcagcccaagacagttcctgacgcaatatgaaccaagtggaaaaagtgtcagtggtgatgatttttttttcaatcgattaattcacacagtttttctataattttcctttaaactgtcatcattttggcctagttaataaaaagtgggtatcaactttagttcctcaacaaatactcctgtttattgaattataaaacagtccagaagctcagcttttgtagcataggccctgatgatctgcctggttcctgttagctccgttttgcacacactcaggtcttgatttccaaagtcccaggcagagaatctactgtgtgacgtcacacttttgaagatggcctcctgcatgaactccctctgtcatactgaccccaccagagtggatatgcacaagcatcaggcccgtttcaaccacactccctttcacagtggagctgagttcatctcaggttctgagacagtccacaccactctctgcctccggctagtcctttgtggtggttgtatctgcaggcctcattttgaagctccctactacactaaaacaatcttaggatatatttatactaaaaaaaattgtttatctgaaatcaacatttaaccatgttccctgtggtattatgtgttaaatgtggaaaccgtaaatgtgactagactgtttcttagaccctatatcatccccagggaagtcatgtccagaatgtgggtcagtaccaaatacacagaaccccttgggcagtttcagaaccttacccggcccaagaaaacacagagatataatgttaaatttcacagtcttgtcctaattatatccttttatcagtaactcacactcaagttttacagaagacttttgtgtactccaggtctcagttttttttgtcaacagatacagagtttcccataggtaatctcaaaagggtcttccaagtcaacattttacgcattccaactaagatgtatttctccctcaaacctcagcatttctgaatagaaaacttgattttatcttgtgatcctaaatccttagatcccatatttccatgtcctcaagaattgagctccttaagaatgtctaaatctgtagtcatgcagtagtgtggtagtgaatgtcactacagggtgatacttatcctgatgacatgagaatattctacattcctcaagtttttttgacagagaaagagcatgcaagttcccattaacataattaacaaaagggagattgtacttacacttgtaaatttccttttagggcaacattgttctgcacatgattacaagtccctactaatagccttgtttgtcccttgccagcagtttagaatagaaactaaaaatttaagcgtgattttcttgctgctctttctaattcttgtatagtcaagggaattatattatttagggcatatatacatgtgtgtgtgtatatatatatgtgtgtatatatatgtatatatatgtgtatatatgtatatatgtgtgtatatatattatatatgtgtatatatattatatatgtgtatatatattatatatatgtgtgtatatatatatatatagagagagagtcacttttctgaataaactacaagcctttgttatttaaatgaaactaacttttaaagactggatccaaaagatcaaaacaacttggagaaaacaaaacaaaacaaaaacctagaggatcatagaaactagacacctgctatcaaatgaatcttagaattcacgtgacacatgctttttcaaatggaaaaaaaagaaatgctctatgtcatttgaaataatatatgagttaagtgtaatatctcaatgactggcattgctaatgttatgaacatttgaaattgagctaccctggtggagttcaattgaaattaggacattaaaatcagacatagatacagacaaagaaagatacattataactttgtaaaagtaaaacaatataaatgctcagtaaaataatgagaacaaagtcaaagaatgttgtgtgtgtgtatatatacatatgtatagagagagttggcatttaatttgatccaatctaagcttctaagaaagactgtactagtatatttatatagtcttcagagaaaacaatgatgcagtataatttctagtgtttaaaaatccaaatcagttaatctaaaataattatgctaataacatggtttaacagagtaagaaacgaatggaatcattccttgaactcagctctcttataaaaagtgataatggcataaggcaatagtaaatatataggagcaagaaaactgaattttttctataccaggtatcaaagtagatgggaagccttaaggtatactagtctgctgggaataaagaaacaagcttcaccttctagaatacagtaaatttggcagccactcttagattgttttgaggagaaatatatagattcagggaattaatatgtccaacaaataatgtctcccctagaatatttgattgccccacaatcaaagagagaagataatcaaaggccgaagatgctacttaatatgaccaggtcacctattacatgcatattaaaccatttaattgacaaatgaagctgtaaggattaagactgaaattatttaaaaatcagtggtctaaaaaggtgaaattaaaagaaaaattaaaaaaaaattaatttgtgcttttcaagaaatggtgaaaatgttaaagaataaacaatattttgaaaaagggactacaaactataaaataggataattacactaatgctatttaccatttttgagcatatattttagtttgatactatcacaataccttacagagtgcatctcatttactcatcaggcatgtttatgaggtagactctgtcatcggtatgtgacaggggagaaatatgttcagaagatttgagccatttgttcaaaatcacctaagaaatagtgaagccatgaataaaactgaggtctgaaatccaagttcatgttgttaactactatcctataccatccatgtaggatacataattgttcactgatgataagctcaagtgtattgacaaatagcaaaaacagagacattggtactgcaaagcagaagattctggatcaaatacaggcttagatgctgaccagctatatgagcatgaataagtcactttacctctctgggacttatttttcttattggtaaaattaggaagccaaaggtgatagattttcacagtgagagtccacagttttttcatgcctccctgtatccacacatttgcacagaccctttgcacactgatgcttgatgtgtgatatggtttggctgtctcctcaccaaatctcatcttgaattgtagctcccataattcccacatgttgtgggagggacctgaggggagataattgaataaagggggcagtttcccacatactgttctcgtggtagtgaatacatctcaagagatctgatggttttaaaaggggtttcccctttcacttggctctcatgatctcttgcctgccaccatgtaaggtgtgcctttcaccttccaccattattgtgaggcctccccagccatgtggaactgtgagtccatgaaacctatttttctttataaattactcagtctcaggtatgtctttatcagcagcatagcaacaaaccaatacagtaaattggtaccagtagaatagggtgttgctgtaaagttacctgaaaatgtggaactgactttggaactgagtaacaggcagaggttgaaacagtttggaaggctcagaagaagacaggagtatgtgggaaagtttggaacttcctagagacttggagggctcagaagacaggaaaatgtggcgaagtttggaatttcctagagacttgttggatggctttgaccaaaatcctgatagtgatatcaaaaatgaggtccaggctaaggtggtctcagatggagatgaggaacttgttgggaactggagtaaaggtcactcttgctaggcaaaaagactggtgacattttgtccctgccctagagatctgtggaattttgaacttgagagagatgatttaaggtatctggcggaagaaatttctaggcaacaaagtgttcaagaggaagcaaaaaataagagtttggaaaatttgcagcctgacaatgcaatagacaagcaaaatccattttctggggagaaattcaagcgtgctgcagaaatttgcagaatttgcataaataacaaggagcccaatgttaatcaccaagacaatggtgaaaacgtccctagggcatgtcagagacctttgcagcagcccctcttatcacaggcctggaggcataggaggaaaaatggtttcgtaggccaggccagggaccctcctgctgtttgctgcctagggacttggtgttctgcatctcaaaggctccatccatggcgaaaatgggccaaggtacagctcagggcatggcttcagagggtgcaagccccaaggcttggcagcttccacagggtgctgagcctgcgagtgcacagaagtcaagaattgaggtttgggaacttccgcctagttttcagaggatatatgggaacacctggaagtccaggcagaagtttgcttcaggagtggagtcctcatggagaacctctgctaggacagtgtggaagggaaatgtggggttgaagcccccacatagagtccccactggggcgctgcctagtggagctgtaagaagagggctgccatcatccagaccccagaattgtagatccattgacagcttgcaccatgttcctggaaaggtcacagacactcaatggcagtccacaaaggcagccaggagaggggctgtaccctgcacagccacagggttggagctgcccaagaccatgggaacccacctcttgcatcagcattacttggatgtgagacatggagtcaaaggagatcattttggagctttaagatttgactgccctgctggattttggacttgcatggggcctttagtccctttgttttggccattctctcccatttggaacagctgtatttacccaatgcctgtacccccattgtatctaggaagtagctaacttgcttttgattttacagcctcataggccaaagggacttgccttgtttcagatgagactttggactgttgagttaatgccgaaattagttaagactttcgggatctcttgggaagccatgattaattttgaaatctgaggacacgagatttgggagggaccaggggcggaatgatatggttttgctgtgttcccacccaagtctcatcttgaattatagctcccataatccccacgtgttgtgggagggacccagggggagataattgaatcatgggggcagttcccccatactgttctcatggtagtgaataagtctcatgagatctgatggttttataaggggtttcccctttcacatagctttcattctctcttgcctgacaccatgtttgacatggccttcaccttccaccatgactgtgaggccttcccagtcatggggaactgagtccatgaggcctatttttctttataaattactcagtctggggtatgtctttgtcagcagcacgaaaacagactaatacagtatgacaccgtgactccctttagtcaatgagaaaatagcaaatatgatacaatcagaggcttgaaaacttcctgcctcctggagcttactctcccttgctgcttttggaagtcctacaacagcatctatttgaataagtctgggctagcctgtacaaaacatatgactcagtcttcctgaccacatcagctaacagccagtaacaaccatcagacataaaaatgaggccctctatgacaaacaaacttggcccacccgccagctgaccgtagccacatgagtgagtccaggaaaagccattatagaataactgctctgctgagttgaatcctaactgctgacagaattatgagctaacaaatgcttgttgttttaagccagggatgcaaaaacttactctgtaaagggccagatagtaaacattttaagctctgtgggccatgtggtctctatcacaactactcaactctgtcattgtagcacaaaggcagccacagacaacaagtaaataaatgagcaaggctgtgttccaataaaatgtcatttacaaaaacaggcagcaaaaataaataaggaaacaaataggcagcatccggacctgatccataggcaacagtttgctgacacttgttttaagccagtaaggtctgggagtgtttgttatatatcaaaacctaactgatactttgatcaagatgagcttattaaaattctgtcattagaagttgcattataagtgaaatcagcattacagtaatctagtttatgtcccgcaaaaatataaagctttcatcactgaatagaataagaaatgcttgcatttctccaaatttattttcaatgcaagtgatcatgtaaaactttgaatatattactaaacttatattaactagaaaaaatataaatataactaaaacttcacgcaatacctttttcatggccctatggagacccacaccatcacacatgcacacatgtgcttacacatgtggacagacacacacatacacacacacagacccaagttagaacacaatttttaaaagcactagttaagtgtgccttaaaatgcattacagttgctaagcaaaattataaaccaagcaatgtaaggagtgttaagaattaaaatagcccttgaaaatgaaaaaaaaaattgcaagtatcttagtatgtgtattattatttaatacaaatttttaaatgtagcccttcataagatatgccagatgtaaatgtagttctaatatgtaagaaggaagagaaagcaataagagaatggatgaggctaaggaacatggtagctctaaagacctggatgtcactggaagctgaatgagactaattttgattcaaatatgtcacttataatttatgcagaatatatcttgaaagaaatccggttaatgttattaactaatggtattatttttactgtaaaattgcactgataacatcaagtgtatttgtgcggcatggggtatggaaagtggataggagagaatgtaaagagaatacttagcaaggactacaatttgaattgagcttgagaggaaactatagtttcaggaaaagcgagaatagcactgcattgcaggctaattttagaaaaaaaaaatctataacctagataagttactgttgcaacccacctaggttaaaaaatttagcgtgtaaagcccattaagaacattctggaagttgtcaaactattgtcagaaaacttcatgaagaaaccagggaataatttctgcctttaaaagtagtcagggggttgggcatggtggctcacatctgtaatcccagcactttgggaggccgaggcgggcgaatcaccaggtcaggagttcgagaccagcctggctaacatggtgaaaccccgtctctactaaaaacacaaaaaaaattaactgggagtggtagcggtcccctgtaatgcagttactcgggaggctgaggcaggagagtcgcctgaactcggggggcagaggttgcagtgagccgacatcacactactgcactccagcccgggcgacagagtgagactccgtctcaaaaaaaaaaaaaaaaaggaaaaaacaaaaaagtagtcagggatggagcagatggagttacaccaacacttttggaagtaggttgaatgatgtaaataaaaaatagatatacaaattataggcacttagtatctcaggaacactagcgtcttgacactaagtgttaagaacaaatttatataggaagcaactatggtttaagcaatgaaaaaaatgtacgttaatgtattattagagtcgtggtttatgaataaaaagatgaattcataatttttttaatggttaagtttttcagtcactgatagcaaatgattgacacctactagcaagatatgagaaagaaagaaaattcttgcccaaggcatttcttggttaagaattaccttacattttaagaataactagagtttatttttggactggaatataaattggtacaatgtttcttaaaacattttggcatgtcttaccaggagtcttaaatgcttatgcatttgatcagactctcttcataatagtaaatataaatgttatgcacaaaaatgttcattaaagtcttatttttttaattgataacaacaggaagaccaacaataagaaaatgctgtatacatttaataaactatctggccattaaaattttggaatagtttctatgctctgagaaacttattattaggtgaatacagtaaaagtgaaataaaaatcacacatatctaatgatcttgtttatgtaaaagatttacttgtagagaaaattttgtcaaaatttatgctaaaaaaatatgctaaaaaaatagtgattaacagccaggtgtggtagctcatccctataatcccagtactttgggatgctgtggcagaattgttggaggctaggagttcaagaccaacctaagcaacatagcaaacccccatctccatctttttttttttttttttttaaataattggctgagtgtggtagtgtgcttgtttagtcttagctactcaggaggctgatgctggagaatcgcttgaacccaggagttgcaggctgcagtaagctacgatcatgccactgcacaccagcctgggcagcagagcaagactctgttgctataaataataataataataataataataacgataataataataatagtggttataacagaggggcagcattttttatttgttatttttaaatgttctaaatttgtaactatgtattatactaatagttttcttagggatttaaatatatagtttcagagaatacgattcctttgacctcaaaaactctaaagtgctccttagtttggcattcaaggctaacaatctgttaccaagtaacttttgatccttctgacactcttcctttccacctaacacagatagattgatctttctatttcatcataagtttgtatttctccagttcagggcttttgctgagttccatttgtacaaaacacctcatctgttactcacattgtctccttcctgtttttaaatcccctttctagtactatatcctctcatcccagaatccctatttaaccacaatgttgaacaactctctcaacggctaccgtctgttttatgctaccttttcaacgctaagtgatagaaacaaacttaaactggcctttacaaaaggggtgaagagggttggctaaatatattcgcccatctagggcagggattttcagtctcagcaacattggcattatttgttgtcctgtgcgttgtagaatgcctggcagtatccctggcctctagccatcgaatgtcagtagcgccctccagtgtcacaatcaaaaatatctccagccactgccaaatatcccctgggacaaaatctctagctgagaaccactgctttaagaggaaactaaaagttcacatgctcaaaccttttgctcctccatccaaaagattttcactccacaagcttactgctgccagccccataccttgaacataccagattaaacactccaggaaaaaaaatgcattgtttaaaataacaactcttgtaagaagtctaatgcaatttctaattgccctaactatgaattaatctatttgatccacgtaagaggacaagcaagggcttgtgtatgtgtatatgctacaatggtgctacatacttagctgataatgagataaacatgtggttcctattgagtaatatttttgtttgtttgtatgtatgcatgtatatatgtgcatgtgtaagttttaaacagtaagaagtgtcaacaaatatacatatttgccctgttctgagggttgctttcatcattatacaaccacctgaggaaagaaaaccctttgatttctaagaaaagagagggtgctctactgttgcttacacttttttctctgcctagtaagactgtaagctgcttaaaggcaagcaatgtgtttttaacattggtgaaggtgggtaccttccagagtgctgtcttgtagaaagttcaagatatagtcctttattaactgtaactttaaaaattacaacataacttactggaactttttaagtcaccgagaataaaatgttctcataatttgtgttttacaaaaatatctacaattctataaaaatcttctgaaaaaagaaaaattatgttctgtaaaacataattctaaaaagtaaacttcaaaaaaattaaaaactgctttaatacttttattaatttttttccttagtaaacgttaaatttgacatctaaacccaagtatgtataatatgacagaaattataagattcaaatagggaaatacagaataaaatactaaatgtaagcttcttgagaggaggaaatacatgttacaatggcgctacataattagctgataatgagattaaaagttgagtcctgttcagtagtatttttgtttgtatgcatgtatatatgtgcatgtgtaagttttaaacagtaagaagtgtcaacaagtatacataaacttatggaaatataattacatacatatatttttaaaatctttaattcatcttccttaatcaaattattaaaaaagattattatatcataaatgttttttaagaatggtagcaatagtttttttgaaaataaaagtttattatgctgatatagcattcatattacaacatatttgtaaaataggatgttataaggcaatgcatctctagttaagggcaatagtctcaagttaagaaaatataatttcaagttgaatttcaaagagtttgaaagcaaactaatgagacttgttgtatatatttttgcttcctataattttacaaagcaatttttatctgtcagagagggctgtgccagatattgagaaagcctaatttgaataagatgttaaatgcagaactgccatacaaaaatcaaaataaaaacctgacttccataccagattttttgatcttcaactccttggaaaacacttcaggctcaataatgacaattaaatttaaatggaagttttcttcagcataaaaaattgtggtattggatgcatgtggagtatatcttgacttgaatgcattatttctttcaaatatacaactagaatatagactattttctgatcctataagaaatgatctgaaatatacattgtacagtttttcctaacattatgtaaattctttgtcataatattttattttacttatttttttatgtttcttttgtagtctggagtgcagtggtgcaatcatagctcactgcagtcttgaactcctgagctcaagtgattctccttcctcagcctcccaggactagaagagtgccccaccatgtgcagctaatagaaaagaaaaaaatgtagagatagggtcttgctatgttgcccaggttggtcttgaacttctggcctcaagtgatcttttgtttcggcctcccaaagtactgaaattacagacctgaaccatggtgcctggcctggacctaacattttaatagataatactaagtgtagagataaaaagtgagccatattttcccatacttgcatttaaaatattttaatatttactattttaaattccttaaaatgttattttataaataattgatatgtttttggaacagaagacaatctatgtacatttgcatttttaggtgttacaaatactatttaacaccagcagatacatcaaatctactgcttatttttgagtaattaaaatttaaagagtaactcagagtctctttatgacttctaagaatctaatggttcaaagaacattgaacttcacaaaaattgcaatgaaaaaatattcttaattatctcaagtgttttcttataaattaataagcatcactaaccaatactgataaattcaattgtttcttttcttttcttttctttttttttttgagacggaatcttgctctgtcgcccagaccagagtgcggtggaataatctcggctcactgcaacctccgcctcccaggttcaagcaatcctcctgcctcagcctcctgagtagctggcattatcggcgtctgccaccacacccggctaatttttgtgtttttagtagagatgaggtttcaccatgttggccaggctggtctcgaactcctgacctcaggtgatccacccacctcggcctcccaaatttctgggattacaggtgtgagacactgcacctggccctcaattgtttcttatatcattggaattcttctttgatttttttttaaattttatttgtctgtatgtgaattctcttccagtctattttctaagcattgttcagtaacaacttcatgaagatgaaatttttgtaccatatcattcatccatttaaaatatgaattttgttatattcacagagttttgaaattatagaacattttcatcccttagaaagaaaccccatactctttaacagtcactcatcatttccccctaatcccttcccagcagtagccaatcataaacgtgctttctctatgtatctctctatatctactggcctattttggatatttcacataaacgaaatcatataatatgtggtctcctttgtgactggcttctttcgcttaacataatgttttcaagatacattcatcttgtaacatgtatcagcacttcgctttttattgccaataatattccattttatagacaaaatattttatttttacatttatgtgttgatggatatttgagttatttctactttttgactactgtaaagagtgcatctgtgaacatttacgtacaaattttggggtggacatatgtgttcatttttcttggatatataaccaggcatggattgctttgttttttgaaaacaggataactcactgttaaacacatagttcttgtatcctattttcttcatgtaattttcattcccttaatagctgataaaaaacctatatattttgttaagagacagcactatgtttcatgcctgtgaaatttgtaaaacataatttaatatgacaattttctctttccatttcacaaatccccctagtgtttgaactcacataagtaatagtttatccactattttcatttgagaacctgtttagggagtcagtaaattaagctgtattcaacttgacatttttctataaacagaaatgtttgcctttttaaaattctaatatatggttaagagaactgagagaataccacacatgtgtgaatttttgaagacttttatcttaacttttaataaatgtctttcttctgtggggtgagcaattgaaatgttgtccatcagtattctgtctcaattcagtagagatgaaaaatgcctgatgtcactgtcaaacatagaaagatttgatgagcaaacccacaggaaaaattggcttttcccagaaatgctctgatgattggcacaatgtgtatgcagctgttttcctctaatttccagttctgatattcagagaagaacttaccttttgcagatgatgtacctgtaatgtgacaatacataatcccacaagggaatatcactaaggatttatgatacacatgagagcttggaaatgcccttttagaccaaatatagttctagcatctgtgtccctctttggctcctcagtttatagatctctgatttcatattgccacaccatggggtacatattagattgtaaatattaattgagtaaataaatgaaggaatattgtgaagaatatatttttccaagcctataagaaaattgttttaataccataatagaaatagggtctttttcagtggccaactacattagatatggtatattagagttagataaaaatttaaagaaagaaaaaagtagtcaagtaccaactaatgtttaacctgactgaagtccaagccaaaaattctgaggcagtagaaatgcatttattttgttaaaaatatcttagggtgattcctaagtgtatatcagaatttctccaaggacatatgcaatccacagtacagaaattgatagaaatagagaatgacttctttattcaaagaaccactaagaagggaatggtgcactaagctgtcagaaaaatacttctgatttctggtgtgtagtcaagtttgtataatcagtattaaatgtcacagtgtagactatggttatcaggtagtagcataccataaaggttaaaacacaatggccttgcttatatcttgatgtactttattgagataatagagcatttttggagctacaaatatttatttaacaatacactgtgcttctttttgaaaacaaaagtttttagctaactcagtgtaacaatagctatgtaatgtagtttttaaaatcctcatgctttgtgtcacaagatggacatactacttctgtttgtatcctcctaacagaatttcattcttgagaaattcatttaatggctgtgggtttctgtttcttcaggtgtaaatgaaagctctgcccaccagttaacctccaaagttctgtccaactctgatatttaatgctcccattacagggaaaacatggaacaaaattagacggcaggtaagccatatgaaaactggatcatttcagacagaaatccaatttgaactgtttattaataacttttgtatgtgacattggggagaaatgaaaacagattgacttgctaggaattccttctgaggacaagggttatagctaacaagtgactgaatcctttggcagttggacactaaccagaagtgctatgacaacaggaggctgtctctaaatatagtgcctcaaaaacgacattctccaaatagtttcctgcaaccattagtgcatataaattcttcgagttaaaaaaggagaatttggtttgcgctagtatgatctaaattgatatttaaattagaagacaagtatggctttggccaaaatgcagacaattttaaaaagacaccaaatgtcctgaatattgggcttgcattcaccacctttcacaaactttgtctttagatattgctcatagttacaaatgtctagtagcttaaggaataatggaacttaattttctttttcattcctcctattgtgtggtgagttttgaaataaagaaaagctattccatttaaatattttaaaataacttagaagctacatttacatttttctgtaactccatttattttctgacacctctccttctaaaatcccttttgtccttaggacattcaggatctagacagcagcaatggaaatgtgccctcaggaataatgacggtggaatagatggtatgggtgtattgtagtgactagggatggagccacaaagcattgaacagttctacctagaaaatttacatatatcatgtaactaggtattgcatacatatttctgagtttatggtacagttaagtaaaagggcttggaaatcagggcactagttttcacatttcaatagggctgctatgtatgtttgtgcaaactcttgtcttcacaaggatagcacatctaaaaggacactgtattacagtgattatagattcccaaattacagcaaaaccttcctgtaggtggcagcgaagtatcttttttctttttacaaaaaaactttaaattctgataatttttctgaaagaagtttcttaagtaaaggaaacttgttcttttcttatttataaaaagataccatatggggtagagaggtccagcatctgagatgtgctattttcaagatctaaacctttagatagtttaacttctttgaaacttaatttcagccttggtcaataagtaaataaattgagagggatgagagagagaaaaagagagagagagaattgatgtacttataaatttatttgaagattaaatcatactacctacacacatttagtactccataactggtattataatcaggtgttgatcatagatagtgttatatttagtatcattttggggaaatgaagggaagttcgattccattattgggatagactaccaaaaaaggggccagtatccattccctctctttcaaggtcaaatagaggtagaaattgctagaaactaggttaagttcacctgtcccagaattgcaggagagaattcttagaagcatttaactaaatggtcacgttaacaaatcagagagatgcagcatagaggcaggaaatggtggagccaaaagtgaagcatgcctcagaaatacatttgtgatgccccaagtggagaaaaatccctgagggacatgaaatgaaagaagagaaactcaaaatcaatatggcacaaggggtttgagagccagtgtaacttgggataattctgaatgagtgactcatttcctctttcaggctacagtgttaaatacatttataagcatttgacaaattttcaggtatcttgtccctttcagttggaccttagtgaccctgtactaatgtttagcacaggattgctggagacacctaatcttctgagaaagtttttacaacaatgccatctggacagatagtaaccatagaaaatgaatattacaaaacagtcatttcaaaaaataatttttgtagaggatctcaggttaaacatatgaacaggccttaatccagccattgctttcatttgcatatttagttttatttgggaaatgtcacatgttcagctcattaacaaatgcatgacacagctacacaatcctgcacattccttcctttctttgatgcccctattatttgcccccaaggacaatgcaagagaaaagtagccaatttgctcattaaaagagaactcagttgaaaatgacaactaatttcagccatttgagaaatgactggatctcagtatgtatagtatcttggtaaatcaagacaaagccattaaaattattgtataaaattaatttgagcaacaagtctttagacaaattcattgcattagcctctaggtacttctataatctaatatcgaaagtcatagtagataaagatatgagttttaaagcctataaaattcactcttgtatatcatacacctacctaattgattaaaagatacatatattgcacctggcatatgcctagaaagtaaattattcttatggctggcaataataggactaatcatgtcagaacagaaggccaggtagtagagaaagtaaagtactcttattgttaaaaaattataggtctaatacttttagaggtgagaaaagccaacccaaattagagttgttggccagatcaccatgactttctctgctcttctttgagtacacaaactatacaaagtttggtacaatcagaatctaaatgtaatgcgagaacatatcagtgggatatggtaaagaataatccaattattttgccctggatacctccctcatggcatgtccaaaggccaggcatagaaggagagtgagagaaaggaagtagcagagggctacccctccaccaggtggcaaagacccctgattcatcatgtttatagcctagttatagctgatctggaggttaatgtctcatgcagtatcatctttaagtcttataaacttgatcttttggtttagtaaaaaaacaacataaacataaaacataaacataaacatacaacataaacataaacataaaacataaacataaaaaaaaaacaacaaaccctgagttgagttataaacaaactgaacaatatataccatctggtgcctttatcccaaatccattttccttacttatttttccaaaataatcttccatcaaaatttggaattttagaagaacaaaaacgacaatgatccagggccagccctgactctcggcaccactagtttagttgtgtaacttaaataaatttctttgcttctctatgtacaagtttcctcatttgtagatgggaataatcatagagcctaacatatgatctaagtttaagataagcatataaactgattagctgagtgtctgatatagaaaattcaataaatactggctaatgtcatgattgtattcgagggttaactttcctgattcttgtataactactgctatctgagttctatccctacagtaaagaaatcctcatgattcaattaatatatgctcttttgtgatatttctgtactctatgtagatcttacctcaagtgtcaaagaatcacctacatagtggagttacatgaaaactaaatccttccccaaggagattctgaggagattctggcaactggcccacaggctgagtgcattagggatactttaaaagagtgctttgaggccgggctcggtggctcatgcctgtaatctcagcactttgggagggtgaggcgggcggatcatgaggtcgggagatcgagaccatcgtggctaacgagggagaaaaccctgtctctactaaaaatacaaaaaattggccgggtgtggtggcggacgcctgtagtcccagctactcgggaggctgaggcaggagaatggcgtgaacttgggaggtggagcgaagagccgagatagcgccactgcactccagcctgggcgacagagcgagactctgtctcaaaaaacaaaacaaaacaaaagggtgctttgatcaacttgtggcctctaggaacaaatatgaagaaagttattaaaaaataatgtttgagaaaataattataacatacttttcatcttccagattttgtttcattagtatagggtagacatatgatagtctatgcctgtccttaataagaaaatacaggcttccacagctttctgggagactgctgtacaaacaaagtggttcaggaggtcctggaggtgagcttgaggtcagtagagggagaggctcagatttgctgcattgcctccctccaaaatcagacaacttctggcttcatctaatttgcacatagtaataagattctaagtaagattccactgcagaacaggaaagaaagaactcatgtgtgtgcctatgtgtgtgtgtgttgctgctccaaaaagttctatctcctgatctaggttttacattttcctcacttagaatataaacacaacaccataaattttcaaatcacattaaactttactactgattcgaagataatgatttttatgccaatccgtaagtttgaatatatataaacttacatcttatcttcatgtgtggtaaaaggttttttttttgttttgttttgttttgtttttcagatggagtctcgctctgttgcccaggctggagtgcagtagcgcgatctcggctcactgcaagctccgtctccttggttcaagccattctcctgcctcagcctcccgagtagctgggactacaggcacacaccaccacgccaggctaattttttgtatttttagtagagacggggcttcaccgtgttagccaggatgatctcgatctcctggcctcgtgatctgcccgccttggcctcccaaagtgctgggctcacaggcctgagccaccgcgcctggccccatgtatggtaaaagtttttaacggaactctgcctcaatcctcacttctctttggataatcaatcataattcttactgttctccaattcatccctccactcttgtcagtagtaagaacatattaacaagtgtagttcaagggcatatgatcatccacatatagcagagcttaactgaaaaaatattgaatgtagaaaatgaggaaaaaatcagatatcaccttcattaaaacagacatgctttttaattacgttagacataacagtttggtgatttaggaaacagaacagaaatgcatgaccctttaggccctagacctgctactagctcataagacttggtcaactgtaatagtcattcatccctgaatgatttcttggtctttcttctttacctactgtaatctttcttcctactagatctgcatgttcacagtatcacttttatcatttcactgataaaactttcggaatactatttaaactcctttgctggaggttggtcatttatatcttactcaagctactttcacgtgtctactcaaccttcattatgtgttcaaaactatttattaggtacctaggtactatatgctagacactatgctagcttatgagcatacagtgcaaaacagaaaaaaaaaaaaaagcctttcctctgagcgacagttaaaatgtcaagctttcagaacactataagggatctaagtggcgtagtcactaagtgtgggtaatctgccatgagtagtcctgaattgatactttcatcattaataccagtgcccttttctagaaatatttgttatcctcatttatataaattcttatcttttaactagtaagaattccaccctattcacagtcctcgtactgacatatagttcatcctaaatcttcagtttttaaaatcctggatctcagtcccttatgatgctatggtaatactatgagaatgatactacattctgtacttaatataatttttattgttaaatatatgtttagtacaataaaccattatatatacataactgctgaaagattcaaataaatcaggagatctagcttgaaaagcctagattttttttgattgtttttgtttaccattgtctccagtagaagtttccttccaaaattacctaaggagttttaacaataaagagtaatgtagttaaatttactagtaatcaattacctgaggttgaaatttttctagattctcagaaacacagttgacaggatgagaagtagatgaagtaggagaaaaatatttaaatacataaacaccacacacacacacacacacacacacacacatgtgagacatatattctaagatgcctaaaagcatagaccatctccaccaaattcagaatgattagagtaataaagatgagttcagaataattaaacaatataaataaatgtttgtgattctcaaagtctattgtgtgtaagaaacacacgaagatcctgttactgggctccactcccagagtctctgattcagtaagtctaggataaaacctcaaatttgcatatttttttgagacaggctcttactctgtcacataggctggagtgctgtggcacaatcagatcatatagcttgctgctgccccaacctcctagattcaagtgttcccccatctcagcctcctgagtagctaggactacaggcatgcaccacaacacatggcaatttttttttttttattttctgtagagatgaggttccactttgttgtccaggctggtcttgaactcctgggctcaagctgtcctctctcctaggcctcccaaggtgctaagattacaagtgtgagccacatgcaccaggccaaatttgaatttttaaaaagttcccaggtgtgctaatgccagtggttcaggaatcacatttgagaaccactggtctagaaagaaacaaattctatatgtaaaccagcacattcatctagcagttttgcttcatttatgatactctaattttcccaagcaaatctgtaaactccttgaagtcttcgtatctccaagaacagcaatctctccttacactaagtgaatattctaatgagtaaataacaaatgaaaagaaacatctgaaaatgagtaaaaacaagtcaacaataatgattaaagttttccagggacttaaataaatatttgagtgggaaatggtggttagtttagatgttaactctaagcataatgtagataccaaaaattatttttcagttgtatcatttgctacatattgaaatcatgatatttagaaaaataaggctggctctcacctttcacagttaatggatgagatgaggtgaaaggcagccagcattctattcatgctttgctttatggaaatgtccaaatctcacctaatatccaaaagctacagttgctcttgtgaagccagaaagtggctgagaagagaatggagtctcaaactatggttcatttaagactaggcattttaatttttttactttgctacttaaacaaaaagttggatgtaatcccaattgaattttagactccatagatgtgcaaaatttagactgagctagtaatagaccatacatatgtaacaagttctgctattttatactaaaattgttgaatcctttgtaatactctgaagtaaaatgactatcatatgaaaactcatcctcattaaattttgaaaaaacctgtttaacacgtactgaaggtcaggactacaattttaaaaatgactcgaaaggttttttaagtgaacatcttgaaattttctagaacaaggattagcattctattgcatttatcatgtaatacaaactattttagaactattttatcatctgaaattcctgagcttatctttcatgattataaaattccaaaaatattgggggcctaagtagttaaaataataaaaaaaaaaaaggtgcaaagtaagcctttgatgaaagcctgtaggaatcagctaattttccaatagataattttaggcttatgaagaaatgctagatgaaacaatgaaagcagtcatggaaagatcatgactttctactctggtagaactgggtttgaatccagactctgccacctaatagctccatgatatagagaatttacttaatatcctttgctctctaaaatgggaatgataacaataaccttataggattaggcagtaacttaattgacatagcacagtgtctgactcataacggatatggaaatgctttttgagaatgaatgttaattgttcaatacagaactttgtatgtggactatgactaaaataggtttgtctgaaaagaaacaaggatactttttcactccagataagtcacttagacaagataagccttcagtcttctaatctataaaatgtcgaggttgagttagatgatttcccagggtacttattttattattctattatattctaaactgctgctctaagaaatttccaatttaaatgatattaagattatgtagcagataaattaccctaatgttagctatgaaatatctgaaggctgtggctctcaaccctggctgtacattagaatcaactgagcagctttaaaaaatactcacatcccccaacttacatagaatattaaagaagtacagctttcacactgattttttttaagttgcatggtgattctgattgtagttaggatttagaaccatcagcttcaaagacagccataaatatgccagctgtaagagaagttaagatcagaagtagcaagaatcccattctgtttcccaggcaaagcataccctgatacacgtgtacctcaaagaaaccttccttgaagtccctcaccaaaactctattctctcatttctatctgtctatcacatagcaccttcaaactcaatttgttcataatcaaattcattttttcattaatatctgttcttttgcatgattttcatttctgttaagaaaacctccattttccaatttttcaagttctattattctccagcttgaaatttaagactttctcttctaccataattcctcaaaacctgcctgcatatgtacacacacacacacacacacacaaacacaactactcaaccaattaatttatattttacatttaaaattatttttctggtaaagcttcctctgaatttcccaaaactaggacacatgtcctgatgtatgtgcttatagctcctggtcctttcatccataagaaatatgaattcagtgttaggtttatttctatgatctattgtttaacatatatcttcaccattagaatgtgaagtccataaaggcaaagacaatgtttttgctatttatccctagaaataagacgaggtcctcaacacgataagaattcaataaatatttgttgagtaagttaactaaagattaaattgtctctttgttattgttatttgcacttatttagttattggtaagtctgagcatcttttattatgtctattggtcttgtgcatttcttctgcgaattagtttcactatggtataatcatccagactcattcaagtccagtaatctattcatcagtaaacagagatcaggtctccattgatataggtgaaattctaactgtctctttggtatcaaaatttacagttcatcatcaagaactgccatataggataaaaactttcatctgattgacctaatatctttaggtttgtgtattttctgaagtaaagtcctttcaatccttatgctttgcaacactacagaattttatgtgtgcagatcttttagttatctgccattctgaaactggttagggtcagtgtgactagaattcacaagtcctatatgttgcaccatgaggaaattgggtctggttctagggcacaggatggactcctattccagttccttctctcatggtttgtgagaccctggcaagctcttagtcttttttctgctcttatttcttaattgaaaaagaaataatttagactagatgcactctctgctcggcttatctctgacattctgtgattattagaattacttacaatttattgttgagattggatttttcctacaaattctgtggagttaggtgtcctagtcttgcatgtacatgtgcacatatttggcactccagcctgtgtgacagagaccccatctcaaaataaaaacattaaaaaattaacaaaaaaataaaaatctctgatgcaaatggttcttagccttaaatattcaggaaaggtgcataagattaaacactattgaagccaatagtattcatatactcaaactactataaaagtttgtttttaatgttaggatcaacctataaacaaaaactgatgtctcaagcatagtagaaaaaccatgtatgtgcatatgatataaaattatcaaagttggaaaatgcttttatttgggaaacattctatcttttttctgtaagagatcacttaatagttttctattgctgtagaaaattactacaaacttagcagcttaaaataatactatgttattatctcatagttcttgtgggtcagaaatataggcatggcttagttggtttctttgttcaggttctcaaaaggcttcaaccaagtgttggctaggcttagtctcttatgaggctcagggtcttccaagctcatttggttgtcaccaggattcatttccttgcagttgtacaactcatgaaaccttgattctgcaaggccaggaggagagagagagagagagcatctgctgcttctagtctcttctctttggaatccttttaaggattccccctgataaggtcacttaaggagacagggaatgtaaggaattgagattcatcttagaattctgcatagcacattcacacatagtctataacataatctgaatgagtcttctatatcagcacttcattttggacactattccaaatggtatgaatgtttaattttaactgctattttgaacattttatgaaagttatgaatatttaattttaactgcttactggaactaaaaatttacttttaattggtctaataactgtaataaatatttttatcagttattaactctaagaatctcttgaaacttagggtcctaagttaaaatgtaaaataacccagtcctccaatatacctgcttttatcacttgcatacgatactgtaagaatacactttttgtaaaacttagcaaagagactacttgttttcacgtgagaaaataaaagtgcagaaagaatatctacaaaacgactgcattttttatttatttttcttttatgttatgaactttaaaaagcattttgtcggggttcagaacatcaaaatgttgcatattcccaagtgcaatttcattctttgtggcaaaacacccataagtaatattttaacatgtgtctaaagttaattattcttatagaaacattacatgatttttaaaaagcacacacagcctttgaagcaaggctgcttgggttgaaccccagtgccatcactaaccagttacatgacactggacatgtttcatattattttggggtctcatctttttttttttttttttttttttgaaacagagtctcgctctgtcgcccaggctggagggcggtggtgccatctaggctcactgcaagctccgcctcccaggttcacgccattctcctgcctcagcctcccgagtagctgggattacaggcgcctgccaccatgcctggctaactttttgtatttttagtagagaccggtttcaccgtgttagccaggatggtttcgatctcctgacctcgcgatccgcccgcctcggcctcccaaagtgctgggatacaggcgtgagctactgtgcccggccggggtctcatttttcttagcaataaagtaagccataataggtaccagactcaataggattatgtagaagattaactttttagttatatttgtttctatacactgagaaagggcctaatagttagcattaataagggtatatatgtgtatgtatatgcatgtatgtttgtgttaaatatatatttatgtatttttaaatccatacataacaattatgcctttcaattctagacttgtccttttgtatgcatgtaccaaataaggaaatcagtaactagctattaaagcacaaagacaaaaataatagcaatattgctttaaaaaatatctgatgtcccagcctgtgcaacatagcaaaaccccgtctctacaaaaaaattcaaaaattagccaggcatagtgatatgtgcctgcagcgacagttactcaggaagttgaggcaggaggattgcttgagcccagaaggcagagattgcagtgagccataattgtgtcatggcactccagcctgtgtgacagagtgagacctcattagaaaataaatacatttaaaaaaattaaaaattaaaaaaaaattaaatctctgatgcaaaaggttcttagccttaaatctgcaggaaagggtgcataagattaaacactattgaagccaatggtatttatatactcaaactactataaatgtttttttgtttgtttgcttgcttttgagacagagtattgcactctctcccgggctggagtgcagtggcaggatcttggctcactgcagcctctgcctcccatgttcaagcaattctccttgctacagcatcccaagtagctggtattacaggcgcccaagaccaagcccgactaatttttttgtatttttactagagacggggtttcactatgttggccaggctggtcttgaactcctgacctcatgatccacccgcctcagcctcccaaagtgctgagattacaggcataacccaccgtgcacagcctacatgtttgttgttaatgttggtatcaacccatacacaaaaactgatgtcttaagcatggtagagaaactagaatgtaaggttagcgaacttgaaaatgcaaaagtaaagttagagctagtaggaaacagctcagcaaataagaaagagaagatagaaaacattgccaataaaaaagatgttttactcaggcgactaacttactggtgaagccaaggagctcattaattatacaaaaaagatggtttctatagtttagactattaaaattccacttttggaccaaaggtaaaaattgacaagggtagcgtcacaattagcatgtggagtgtttgtgctaactgtgatacttttagataaagatttctcaagatctaggcagacagaggcctgggacctgtagctgggtgagtagggccaaaccggcttaaaaccactagcgtatgcaacaggatgcctctacatagcaaaaacctgtacactcatagcaaaaatgaaatgtcttatagcatgtcatattcttcctgcattcagtccccgcatggagactgtttctggttaaatgaccccatgcaccctatgaatctgagtgccatgaaaagtatctacataatgatgccgccattgctactgcatgtatcctaaaaccaggcctctcccctgggagagtagcaaggtgtcaggtggtgccatgagaaatgcaataacacaagctcaaccaggaagcctcatagttccaggtggagtctgttctctcttctactgggcaggattttcttgcttatcctttctgtttaggcttcaggttctgccatattgctatgcactctctctcccacctttgatctcctttcctttcttctttaatacattaactagcaactatcccaatttagaagcattccttaggcaggaaagaaattattgtccaatcgttccagagcgattcttcagccaaaatgaccaacatagtgttttgccagacagagggggttttctctcctaagagacattctgactccaacccctaatttttatttctcctatacatatgttgcatgatttatgttttaagaagtttgaataacttgcaaagcctcaaattcaataatgactagagcaatcctagtcttaagattgggagatgaatatgaatcaattaagaattcaaaaattttttctaaaatactttaaaaattttgaccacaaacctttgttggaagacttggaaacacagaatcaactgcagaaaaaattgggggtggggggtgggtgagggtggggatggtggttaattttgtcttaatcctcttaagaatggaaaaactttaaaaaattaacttaaagcttccataaccaccaagaaaagcaaaatttgttcatattatccagttaaaacgatcatagatttttttaaaaattccatttgttgtacctaattctttgatcaccagctggatcattaatttaaaaacaattataccattgcccattctcaaatataagatgataaacatcagtttattaacttaatgacccaagtaaagaaacaatacaacttagcttttgttttcagaaatgcagaagtagaactcacttataggtcaagtatagcatgaaagaacaaaaatctgcaatatctaaaagtccactacaaataaaatatgatgcacgcaaatgcaggatcctctagaggccaggaaagaacagcaggagaatttgcttaagacatgcagttcttatcctatctaattaaagaattagaagaaaaatgaagcaccgcagtaatgacatgcttttggtatttaaaagcatctctggcatgaaagctttatctctgcctcatttactttacaaattctaaaatatagacatggcaagagcccagattagaattggaaaattaaaaactttttttctgctttttgaagggtttatttcagagatgctaaaattggattatatgaaaatatagcataaattagagaggagtctaaccttgctatcatctgtacttaaaaaaactgactatataatcggcatcaataaggcactcagttgggagtataagatgtagaataaccaagacaaagctccctaacttactccaaattaagatggagagttttttttttttttatttctttttgtttctcttttatattctctggaaaaccaaaggccagtttcaaatttaatgaaaagccttccaggatgggatgagtataagagtctatgctataaagttgaaaggctctagaaatgaggtaggttatacaaagtttgggtagatttattcacaaccttcttatttatggacttattcatatactatgtattattttatgtatttattaacaggatctatgtgtcatttcccccaatttaagaaagcaaggcagcaacttttacacttttgtttcttatgtgtttttcagtgaacatctactgagtgtaaactacagagcaagctccagctgaggtgttggagatgtgcaggggagcacagaggaaaaccctgcttaggttgatgtgactgcctaacatcaaagacaatactgaggcaaaggaggtcccccaaacacctacaatcactatgacgagaaatttgtcttgaaatctgaaagatgagtgaaaataacctggtaggttgcttcccctaccgccccgccatttgtgctaatattccaactggtctttaattaggaaaaagaagagaaaaagaaaaagaaaatgacttctaatatcggaaggttctttattcaacacagcactctaggacattgtaaacaaagggctaaataggaaatcttgccatataatttggcactaaacatttattcaacatgtattttaaagtacttgttatgcatatgaggtttaaaatatagtaaggtacataggatatgtatacaagaaattgtaataaagaatagaataaaatgtatggaaagagaggtacagatagaatcttaagcagtgttcagagaaaaacagatcccttatgtgcagctgctgaggagcggtagggtaaaaagggttatagttaaattttcatatattcatttgtttcagtgaaatttaaaagttggcattttggtcaatttggatttttcctaaatgcttatcatgaattaaaataacaaagaaaatctgacaggatgaccataatacattactgaaattttaatactcaaatcattatccaggagcttccccaaaggtgtgtaaaaataactacattaaatggtgattgtgagtgggtggttgctgctatccacaaactgcatatcagaaggtacccaaaatactgttcatttattcaatagtagtcaatgtatttcttccctcagtactcttctatcctgttccctttgtatgacaggctgattattatttcccagaactgttgacaaagacaatcttaagctgcttcttttactctttttcatactgcaacgatctaaaggaggcattgatgcacatgtaaacccataaatcaggttccgactgaagaaaaagaatgtcagacatttgctttcaggattatggtactacatgagaaagctgtagttgtatcacagtgcagcttaattctggaaagcttctcttttactttcctccatatgtttaaaaattacagattccaatgacatacattataatatatgcatagagtaagaaattaaggaattatattattgactcctgcaataggttaattttccttacattatttttatttttggttttaattaaggagagcaaaggagatgtgttatttaaaaatgcatttatagctgacatgcattatgtttaggagacaaaaagacaacagaagcattctccagataataaagtataataaataagtgtcaaggtcatgaagtgtcattgttatttgggaggaattattgttaattagcatcataattaaataaaaatatttcaacaaaggaagtacacatgcaaaatcctacagatactgttgaatataaaataaaccctcttgatctagaaatgctaggctaaagctagagaactgtttgttgtttagctaatattgacccatctaacagtctgaccttcctttttttaaaaacaaattccattgtttagagaatctacacttttttttttttttttgctccttactggtaatttctttaagaatgagcatatagtgagattcctcttgagatatgaagaaaaacttcctaaggggcttctgagaaaggtttcttcagtgataaatagagactcacagacagatggggccttttctcttccactgaacactagagtctccctgggtttcctaaaaagagcagccatcatgcagtcaccaggagtggcagctgaggacaaagtcaaccagatgcagaggcaaagtagaaagaatatgtagtagatggaatgatggtctcaaaacatggtcaacatcctaatccttgacatcctaatccttgaatgtttgaatgttgccttatagggcaaaagaaacttttcagagatgattaagggaagatattgagatgggaagatgagcggagattatttgggtggaccctacatataatcacaagtgtttttaataaacagtggagcaaaggtagattttaccatagagaggagaatttaatgtgatagaagcagagagagagacttgaagatgctacactgctggctttgaaaatggaggaagaggccctaagccaagaaacgcaggtctagattctgggaacagaaaaggaaccaaattctcctctacagtctcagaagggaaagcagccctgaagataccttcacttcacacagtgaaacttatttcagacttctggactccaggactgtacaaaaataattttgtgctgttttaaggtattaggtttgtggaaatttgttgcagaagccagaggaaactaatggagacgtaaagaaaatttgaaagagccactgaattaatgcaccttggagccactcatttatagtactgataagtgcaccggggaattatctgagtggcagtgatggctgttttctacagtaaagatctggttaatgggtttacatttttgctgaagttactggaccttctaaatttccatgcactaagtagccttagagtaagctctccattattttaagtaattttggtccctatattatgaaaagttctaaggcgttaatcctaacccaggaaaaatgtaaatcattcatcgtaattttattataattaatcctgaaagctatcctcataaaagacagcacattttcaattgcccaagtaaaagatactgaggagacatgttgaatctatttttctctcacacttcacctataatctgtcagcacatccttcagctccgccttcaatgtctctgaaatcagactacttgtctctcccctttcttaatgccactatcctagtccaaaccaccttatagtgttagccttcagctgttcttcctgacatcacccttataaaaatatatacaatggatcatgttattctgctcaaaaccttccaataccttctcatttctcttggaataaaagcaaaagtctcaaaaattgtctacaaagatcatatgatctgtacagcctagatatcagagtgaagaagacacaagctaagttcagaagactgacccaaaatagcccacagaaaacatgtaacataagagaggaaccaactgttatttttgggcaatcttagggttggttgctacccaacaaaatctagtgaaatcaaatgaaatatgtcaaaaacatcccttttttgttcttttttttaaccacctgaaatcatacactaattaatttatttaactttccggcactctcctgatgaatgactgtaggatttttctgtttttttttccactattttattaagcccccaacacataaaatacagtttcttccatttaatgttactgaatgaggaacacttaatgagtgttataatgtgtgtatataaattaatgttacattagttagtaagttacataaaagaataagtcactacaaataatggccaatactacccacttttgtattccagatgatcgtttacagtaaaatgttcattcaatatttgttgaatgaataatttctcataaactggacatataaagcaaagaataggaacactgtgaaggaagttttattgatgtcactttaaatattataatttcagtagtataaccaggatcatgcagataatggctaatacagaatttcattcttgaaatctctggccttgaattctttatttactgcttccacatcaaaattaagtacacaactagaaagttcaagaaaaaatattggggttttcctgaaagaggtatagaaaaaaaattggaaaaatctgtacttcattatcttgtaaataatgattctttttccttagactaatatgcagttttttctctgtatatcaatttaaaaacagacacacacattagaaatggacattgtttcaagttatacagaattaacaatgttttagaggaggagatccagcatttgatattatttactgtagattcttcagaaacaaacaaacaaacaaaaaggctaaaaaagtaaaacacgtaggatattaaatcatgttagaaaaactttattcacacttgctccatcattaagtttaggatactccttgggagtttatacagtctaacagtaagataaaaggaagtactccattataaagtgggcagtaactttatgaatcccctttctccccatgatggcaaaagcttaaattatacatccattttccaaagtttgggaaaattcactgttaagttatactccttggggatgttttgagatgtaattctagccttcattggtggaaagaacagccacttgtctccagagtgactgctgatgacttttgcaaagacaccaaggtgagacatggagttagataggtcttactactgatttgttgaaatgttcttaagaacagcaaggaataaatattgtgggcaaaatgttttctgcatttcttactgtggttgctcagtaatatgccttctgcaaacccacaatttaaatgtgtgacagattttcactgattttccattacttatggcatattctgtaataaacattgagcatgacaagtgtccaggaatctacaaagttctatcgacattattgcaaaatatatgaaacatttggctgaattggtgtcttgattggaaattggcaatatctcatttttatattggttgtttcagtaaacactgcccaaaaacctttttcccccaatttcccaagtttattgataaagagtaagagagataccagccaggctaaacctcaaatgagttgataatgttcagtggttctgagtacaatgagatgttcatctattgaaaatacaggaagaaaaaaattccattaagataaaatatctaatttggaaaaggcaaaaagatggggaaaagagtcacattattgggtggttacaagctaaagcataaaaaccattaaaaacaattattttatgtggtgctttccacaatttggacaatgactgtaaatcaagtcaactcaaaagccttatttttttcccagaaaacatttgcatttttaactgaaaacagtcaaactcctaaaaaatgactgatgtatccatttgttttgattttatgcatacatttctctggacattttcttatctcattagaaaattctaaatatttatagttggaaaagacctcagagactgtttaatctaacctctactttacagagataagcaaataggctcagaatttctaagaggtaaattatgtagctagaatgtatcagaaattaggtggattgtaatttctgtcctttcacttcaggccagtgctattttctcttcactttaccaactatctttgatatctgtaacctaaatgacaaattaaatgtttatttactgatactaaatggagtagcaataatggaaaataggttttggaacgccacgtttgtttattgtatggtttgacatccatttgttttccttaagaataaatataatatcaatttaccatagtaagttcttctagtcagatggatttttctcaatacagttatggtgatttaatacgacatactgataaaagaggaaaacttaatcgttgaacatctttacaaaaacagttttggtctttaatcattgttgaaaatctctaaaggatattgtatacatggattgccttaatgtctatttttgctttactttagcacacacacaccctttaatgttttgtgctatgtgctcctttttcctaaaaacaaagaccatcaaacaattctggatattttaagatttcggttaacaccaattaaagacataaaattagtttcattgctaaaagagcaagagccataacacctaagcttcagtttcacccaaactataggtgattttcaaatttattaaaacctgaggtgattgcttttagcacatggagaaattaccaagaatatcaactaccatcattgttagagaagtagttgttcaagtatttgtgataagccaaaaacaacaaaactaaatcagtcccagctccaccagtttgagtaagacctgctttctcttaggttctccgattactcccttctctgtgattacacagcattcacatacttttattaaatatcttatttgtttacatcactctctgtttccttagtatggtaggcagaatggtccttcaatatatccatattctatttcctgggtcttgtaaatatgctactttacatggcaaaaggaattcttcagatgtaattaaagtatgaactttatgatattgacatcatcctacgttacccttacccgggtgggtccaatctattcacatgagccttgaaagcagagaactttccctggctggagcagaagagatgtggcagaagaagtcaaatttgaattgtgtgtggggctttctgtacctttgctactttgaagatggaagggagagcaattaacggcttcctcagatctcagactaactgtccacattgaccaagagaataatcttcattttctcagtgtaaggttccttacagacagtgattctaaaggacagacagaaccacatggcaacataattacacaagtacacaactatttatcaccactaaacatgaaccacagatgggagaaagcacaagattatgcccataaagatgattcaaagtatacacaatcagctaatttaatattagataaagtattttctattcaattgcattcttgttctgtgtaaaaataacgtctggattctttaaatttctatttactgcattaagtaatattgaaaccaacccaatagtcacataagtagttcttttggataaaaatagaaattgacccttctggtatcaaagcctgaaacttatattcgttttatctgagttccttcttcaggaaaggacccccctcacccagccatgcctctcaaaaagcatccaagaactgagactcaccagatcactcacttagacatctcattttgtttccttaccccaacctaatttgtattttctaacacatggttaaatttcttctctgctatataaacccctaactcgagtcagttatggatctggagttgagactgatctcccatatccttggctgcagcacccgattaaagccttctttcttgtcaatactctactccttgcctcagtcattggctgtctgtgcagtgagctgcaagacctagattgaaccatcagtgtttcaataacaatgtcattggcacaggaagggacacctcaggtatctgggagtgagatataagtagctcagcctctgcacaatcctcagtttactgtagtgaaattccaggcatggttttcactgtcattgcttctgaggtagcaaaaataaatataatgacgattgacctctcttagattgtttcttttttcttaaggttttgttgaccacttcaggttctcctgaattcactagatttattgattttatttctgtaattaaggttacaatatttcccattcttcattagaaaagaagagtttgacaatgcccatccacttcaaacagtgctactcatactttttgattgataagcccctaataacacagtatggtaaatctgagtttccagggaacatagagcacaaatggagaaagtctgcatcagaaattttatatatatatatatataaaatatatatatatttttattatactttaatttctagggtacatgtgcaccatgtgcaggtttgttacatatgtatacatgtgccatgttgtgtgctgcaactgcatgagaaaactgaattttatttttaatttaatttgtggcaccatctataacattatttttttaagtatttgaatcatataaataaaaataaattacaagaaactgtaccattttgtccttcaattttgtatatccctttgcacaccaagtgtgggaggcatagacttagactatcttctttcacttgcctcatgattctaagaaaaagcagaggttaggcaaacatactctgtttggcctgggtttttcttccagcaagtatttcttccagtagggaaagtgaattcccagggtgagcctgagtaacagtgatgcttagagtttagagatggcacatctctgtaatgagttgtgtttttttttttttccctaaaaatatgcaagttgctggtgtacactctaggataaaataatgtgtgaatacagaaatgaatcaataatcactcaatttacaaatcatattcatatggagtaatgtgactaattcttggctctgtactaaaagtaaaactatgagtttcaactctagctctttaattacagctactggaaaatgacaggaattttggtacagtaagtatctgcttgaatgtttacttcggattatgtcagctctagtccaaccacttgcaaacatttcagacatagaaataaggcatttccaaggcacccttcatattaaaaagctctgctactatggtggctatttcctatggcatttctaaagcaacacgtctaaggaatatgggcatttctacctgtaatgatccaaaatatcagacagaaaaagatggttcccaagagtaacaaaatatatgcaaaacatagaaattggcagtccaaggttatcctttaatttggaggcgcttgcattaaagagaaaaacataaaataataaaaacatatatcatgaattttctttttcatcactactaaatcaaacaacaatcttctttattttctgcaatagttcttaataggtttttaccctggcagggaatgtaactgcttgttccctaaaatagaaatcaggttgcctcgcctgaaaagttaaaattaggaatgcattacaggttccaataataatatattgtaaaagatccattactcaacaaaggaacctatttgccaaattagagttccattggttccaattatagtacgatatgatccttgccaagccatgcattcaatttccaataacgataaaagaatatgttagagttaagttcaaagagaattcttgcagactgaattttaaaatgcatcttttcattctgctgatgcacactcatttgtttaatacttttcacttaattgccatcattctcagacaaaaatatttagtttttgttatcacacaataaataaaatgtgaagatatagacaaaatacaaggtagacccatttcccatgattgtgatgccttctttcaaagaaatgaaaatttacatatatacatatataatatatacacaggtatgtatatatttagcacagtctgaaagacataccatatctaacaaatataataataattattattgtcactgaaaggcattctctactagttccatgacatttaatttctaacttgctttataaggctttgtatatttaagcactgaaaatagagaccagctgtttcttgaaggcactgagatatttttaattatattttgcccatctagttcattgattagaaagtacctagaaactttctcaatgcttagtttcttcatccgtaaactaagctgaaatagaagctacctcactgtcactacattattaagctaattaatgaatacatgcattgccattgtagagtgtctgataatgtagtaaatgttcaattaagtgttggtcactaacttttctgggattactattttacatttgtaaatgtaatatacatttatattttttaatattcacattttaaaatctatttttacatagtaatttcacactcaatattgggtagaactactattatcatcatcaacaatggataatcattgagaacttattaactgcagaatattttggactattgtctatttttctaacttatgagttataattgtcagaaatctgtaatgtgtgtgctttcaatgccagaatgaatatgacaaagaacttccctggaaggcaagggactgagatgttaatttcagctaccctataaactagctgcatgattatgaaaaagatgttaacatctgtagaatttataatccttagatgtaaatggagaccttgaatgtgcagatctttctagaaatgtgtgtaggaggtttttgtcaggtcaaggtccttataagggaagaatactcacttcctgaaggtaaattttacattataattgctaagcagaccttacattggccaaggcagtgctctctcaccctgtagaccatcaaccccattaggcaattcatcagaagattggtaggcctggagtcactacaggtcataacagctggtttttatagctggaagcagatacatttagaactgataatacagtcaagcaaactaaatatttgcatatgaatggtaaggcaaatactcgtggaaatagtttgtatctttacattgctataatttatctctatcactgatgctttttcccattaaatatattaatgcataaagtaactcacaatcaaatattgccagcccagtgtcattgctctcatatagaaaacttggtgtactaatctgactcactatgtattcattttataatatatctctgaaaggccaatcttatattcattgcactaataaatcctatacattgttaaaaatctctaaaataattcccattttaaaagtttacaattctaaatgttaccattccatcctgatagtctgtatcaacagctgattaattgtttgataaacataagtagtaagaaaacaacaacaacaaaaaagtaaaattcacgtagtatagtttatagttaaaattctaatgggaagatttgctggcaagatggccgaatagggacagctccggtcttcacaacccgcagaacaggagattccctctggtgcctatgccaccagggccctgggtttcaagcagaaaactgggcagccatttgggcagacactgagctagctgcaggagtttagttttcataccccagtggcacctggaatgccagcaagacagaaccattccctcccctggaaagggggctgaagccagagacacaagtggtctggctctgtgggtcccccctccaccacccggagcccagcaagctaagatcctggcttgaaattctcactgccagcacagaagtctgaggttgacctgggacactcaagcttggtgagggaaggggcgtctgccattgctgaggcttgagtaagtggttttaccctcacagtgtaaacaaagccaccaggaagtttgaaatgggctgagcctactgcagctcagcaaggctgctgcagccagactgcctctctagattcctcctctctaggcagggtatctctgaaaaaaaggcagcagcccaggtgagggacttatagataagacccccatctccctgagaccgagcacctgggggaaggggcggctgtgggtgcagcttcagcagacttaaacattcctgcctgatagctctgaagagagccatggctctcccagcacagtgttcgagctctgataagggtcagactgcctcctcaagtggatcattgacccccatgtatcctgactggaagacatctcccagtaggggctgacagacacctcatacaggaaagctctggctggcgtctggcaattgcccctctgggatgaagcttccagaggaaggaacaggaagcaatctttgctgttctgcagtctctgctggtgatacccaggcaaagagggactggagtggacctccagcaaactccagcagacctacagcagaggggggtgactgttaggaggaaaactaacaaacagaaaggaagagcatcaacatcaacaaaagggacgtccactcagagaccccatccgaaggtcaccaacatcaaagaccaaaggtagataaatccacaaagatggggagaaaccagcacaaaaaggctgaaaactccaaaaaccagaactcttcttctcctacaagagattacagctcctcaccagcaagggaacaaaactggacggagaatgaatttgatgaattgacagaagtaagcctcagaaggtgggtaataacaaactcctccgagctaaagaggcatgttctaacccttcgcaaggaagctaagaactttgacaaaaggttagacaaattgctaactagaataaccagtatagagaagaacataaataaactgatagagctgaaaaacacagcacaagaactttgtgaagcatacacaagtatcaatagccaaactgatcaaggggaaaaaaaggatatcagagattgaagatcaacttaatgaaataaagcgagaagacaagatcagagaaaaaggaatgaaaagaaatgaacaaagactccaggaaatatgggactatgtgaaaagaccaaatctacatttgattggtgtacctgaaagtgatgaggagaaagtaaacaagttggaaaacactcttcagggtattatccaggaaaacttcaccaacgtagcaagacaggccaacattcaaattcaggaaatacagagaacaccacaaagatactccttgagaagagcaaccccaagacacataatcgtcagattcaccaaggttgaaatgaaggaaaaaatgttaagggcagccagagggaaagcttgggttacccacaaagggaagcccatcaaactaacagcggatctcttggcagaaaccctacaagccagaagagagtgggggccaatattcaacattcttaaagaattttcaacccagaatttcttatccagccaaacaaagcttcataagtgaaggagaaataaaatcctttataggcaagcaaatgctgagagattttgtcaccaccaggcttgccttacaagagctcctgaaggaagcactaaacatggaagggaacaactggtaccagccactgcaaaaacataccaaattgtaaagaccatcgacactatgaagaaactacatcaactaatgggcaaaataaccagctagaatcataaagacaggatcaaattcacacataacaatattaaccgtaaatgtaaatgggctatgccccaatttaaagacacagactggcaaactggataaagagtcaactcccattggtgtgctgtattcgggagacccatctcacgtgcaaagacacacatatgctcaaaatagagggatggagaaatatttaccaagcaaatagaaagcaaaaatagcacgggttacaatcgtagtctctgataaaacagactttaaaacaacaaagatcaaaagagacaaagaagggcattacataatggtaaagggatcaatgcaacaagaagagctaactgtcccaaatatatatgcacccaatacaggagcacccagattcacgaaaccatttcttagatacctgcaaagagacttagacgcccacacaataatagtgggaaactgtaacaccccactgtcaatattagacagatcaagacagaaaattaacaaggatattcaagacttaaactcagctctgaaccaagtggacctaatagacatcaatagaactctccaccccaaatcaacagaatatacattcttctcagcaccacatcacacttattctaaaattaaccacataagtggaagtaaaacactcctcagggaatgcaaaacaatagcaatcataacaaacagtctctcagaccacagtgcaatcaagttagaactcaggattaataaactcactcaaaactgcacaactacatataagctgaacaatgtgctcctgaatgactactgagtaaacaatgaaattaagacagaaataaagatgttatttgaaaccaatgagaacaaagtcacgatgtaccagaatctctgggacacatttaaagcagtgtttaggggaaatttatagcactaaatacccacaggagaaagcagaaaacatctaaattcgataccctaacatcacaattaaaagaacgagtgaagcaagagcaaacaaattcaaaagctagcagaagacaagaaataactaagatcagagcagaactgaaggagatagaaacacaaaaaaaaaccttcaaaaaataaattaatccaggagctgttttttataaaagatcaacaaaatagatagaccactagacagactaataaagaagaaaagagagaaggatcaaatagatgcaataaaaaataataaaggggatatcaccactgatcctacagtaatacaaactaccatcagagaatactataatcatctgtaggcaaataaactagaaaatctagaagaaatggataaattcatggacacatacaccctcccaagactaaaccaagaagaagtccaatctctgaatagaccaatacaaagttctgaaattgaggcagttattaatagtctaccaaccaaaaaatgtccaggaccagatggattcacagccaaattctaccagaggttcaaagaggagctggtacctttctttctgaaactattccaagcaacaaaaaaagatggaatcctccctaacttattttatgaggccagcatcatcctgatgctgaaacccggaagagacacaacaaaaaaagataatttcaggctaatatccctgatgaacattgatgcaaaaatccttaataaaatactggcaaagtgattccagcagcacatcaaaacgctcatccaccacaatcaaggtggcttcatccctgggatgcaaggctggttcaacatatgcaaatcaatatatgtaatccatcacataaacagaaccaatgacaaaaaacacatgattatctcaataaatgcagaaaaggcttccaacaaaattcaacagcccttcatgcaaaaactctcaatacgctaggtactgacggaatgtatctcaaaatagtaagagctatttatgacaaacccacagtcaatatcatacagaatggggaaaaaccagaagcatttcctttgaaaaccggcacaagacaaggatgccctctctctccactcctattcaacatagtattggaagttctggccggtgaatcaggcaggagaaagaaataaacagtattcaaatgggaagagaggaagtcaaattgtctctgtttgcagatgacatgattgtatatttaggaaaccccatcgtctcagccctatatctccttaagctgataagcaacttcagcaaagtctcaggatacaaaaccaatgtgcaaaaatcacaaggatccctatatacaaataatagacagagattcaaatcatgagtgaactcccattcacaatttttacaaagagaaaaaaatacctaggaatctaacttacaaggtatgtgaaaaacctcttcaaggagacctataagccactgctcaagcaaataagagaggacacaaacaattggaaaaacattccattcttatagataggaagaatcaattcatgaaaatggccatactgcccaaagtaatttatagattcaatgctatttccgtcaagctaccattgactttcttcacagaattggaaaaaaactactttaaagttcatatggaaccaaaaaagatcctgcattgccgagacaatcctaagcaaagagaacaaagctggaggcatcacactacctgacttcaaactatactacaaggctacatcaaaacagcatggtactagtaccaaaacagatatatacacccatggaacagaacagagacttcagaaataacaccacacatctacaaccatctgatctttgacaaacctgacaaaaacaagcaatggggaaaggattccctatttaataaatggtgttgggaaaactgaataggcatatgcagaaaaaactgaaactggatcccttgcttacaccttatagcaaaattaactcaagatggattaaagacttaaacgtaagacctaaaaccataaaaaccctagaagaaaacctaggcaataccattcaggacataggcatgggcaaagacttcatgactaaaacaccaaaagcaatggcaaaaaaaaaaaaaaaaaaaagccaaaattgacaaatgggatctgattaaactaaagagcttctgcacagcaaaagaaactatcatcagagtgaacaggcaacctacagaatgggagaaaattttggcagtctatccatctgacaaagggctaatatccagaatctacaaagagcttaaacaaatttaaaagaaagaaaacaaacaaccccatcaaaaagtgggtgaaggatatgaacacacacttctgaaaagaagacatttatgcagccaacaaacataagaaaagaagctcatcatcactggtcattagagaaatacaaatcaaaactacaatgagataccttctcacttcagttacaatggcaataattaaaaagtcaggaaacaacagatgccggagaggatgtggagaaataggaacacttttacactgttggtgggagtttaaattagtacaaccattgtggaagagagtgtggcgattcctcaaggatctagaactagaaataccatttgacccagcaatcccactactgggtatatacccaaaggattataaattattctactataaagacatatacacatatatgtttattgcagtgctgttcctagtagcaaagacttggaatcaacccaaatgcccatcaatgatagactggataaagaaaatgtggcacatatacaccagggaatcctatgcatccacaaaaaaggacgagttcatgtcctttgcagggacatggatgaagctggaaaccatcattttcagcaaacgaacacaaaaacagaaaaccaaacaccgcatgttcccactcataagtgggagttgaacaatgagaacacatggacacagggaggggaacatcacatgctggggcctgtcgtggggtggggggggctaggggagggatagcattaggagaaacacctaatgtagattgcgggttgattggtgttgcaaaccaccatggcatgtgtatacctatgtaacaaacctgcatgttctgcacatgtaccccaaaacttaaagtataataataataacaataataaaattctaatgggaaaaatggctagtaaactttctaaatagttctcattatttttcctgtcaccacacagagcaaagtttttcaaatatgcgatacaatatatagaaactaaggtaataatgagagtttaacctaatcaatcgagtttaagttccccaagcagtttctcaataaaagttagtaataattaaaattaagagcctttaattgcccagttttccataagtatatgtgttgctctttatatccaaccagagtctcaaaattctatgttgtcttgaattcacttgcttcaagtatcaacagctcctcattgagctaatttgtgatacaatgtgtgtattctaaatgaactcagctgtactgtttctgtgagttctagtattatctcattggcatcctaattataaatctgctattattcatttttctcttatcaaactatgtttatacaaaaataataaaaccctacggtagaaacacaagcaattcattttgtattgattcatactatttgaaagtgtttatggggtacatgtgatattttgttagatgcatagaatatgtaataatcaagtctggatatttaggatatctgtcactttgaacatttatcatttatatttgttggaaacatttccagttctttattctatctaatttgaaacatataatgcattgttgttaactatagttaccctactttattataaacatgagcacttattccttctatcgaaatgtatgtttttaccaattaaataacctgttttcatccaccaccaaacatctccacacacacaaatccttcccgggatgtaactatcatgctacctccatgaaataaacatttttagctctcacatatgagtaagaacatatgacatctgtctttctgtgcctggcttatttcacttaacataatgacccacatttccatccatgttgctataaatgacaggactgtgttctttcttatggctgaatagtattccatcatgttttctttatccattcattcattgatgggtacttaggttgatttcatagctttactattgtaaatagagctacaatatacatggaggtgaagatatctctttaatatatggctttcttttccttcagtagtgggattgctgcatcatatggtagttctatttttagttattgtttgagaaatatccatactgttttccataatggatgtactaatttacattctcaccaacagtgtataacagttcccttaaatactggatgtaaaagatacatccttgccagcatctcttattttttgtcctttgataatagccattctaactggggtagaatgatatatcattgtggtttgggttggcatttttttaatgtttggtgatgctaaacgcttttttcatttaattttgtgccatttgtatgtcttattttgaaaaatatctattcatatcatttgccctgtttttattgggattatttgatttttgttgttgaattgtttgagttccttgtattctggatcttagttccttacaggatgaatagtttgcaaatattttttctcattcaacaggttgtctcttcactttcttgattttttttcccttgctgtgcagagtttttagtttaatatagttttatttgtctatttttgtttatattgcctgtacttttcaggtgttagccataaaatctttgcctacatcaatgtcctgaagtgtttttcctgttttcttatagtagttttgtaatttcacctcttgcatttaagaccttaatctattttgagttgacttttgtatatagtgagagatagcatctggcttcattattctgcatatggatgtccaatgttcccagcatcatttattaaagagaatgtcattttcctaatatatattctcagtatctttgctaaaaatatttggctataaatacataaatttaattcttggttatattttccattccattagtctatgtgtctgtttttacaccaacaccatgctgtcttgtttactgtagctttgtagtatattttgaagttaaatagtgtgatgtcgccagctttgttctttgtgttcaagattgctttggctatttggggtcttttgtggtttcataaaaatttaaagattttattctatttctgtgaataataccattagtattttgatacagtttgcattgaatatttgcattattttgggaggtatagtcatgttaacaatattacattgtctgattcattatcatgggatgtcttttcatttgtaatctttccaatttctttgattactggtatgcagttttccttgcagaggtttttcacctcctcaagcagttcgtttctatcattctttttatagctgcattatatttcactgcacagaaatatcagaattgtgttaaccggttttgtctgtcactgggcggttagactgcttccaactgtttactattataaaaatgttgcaataaatatccttatgattaaaattattacatacttgtgtgaatatattatggggcaaaatcctaaaagtggaattgttgggtctaagatatatactttattttgatatataaagccaaatttttctcagtgtattttatcacctcactctcctatcaagagtatatatgggtactagttttaacaaatcctaagcaactcagcatccttttcaaatgtactcagagatgacggatttcatctccatattgatccttcaaacttctaaacaattgaagagaactaaggatgaaaaaatatgtccttttaatttttccacttactttctttctccttttcttattttcttcttcacttaaaaaatggcttattaatttcataaatactattcctttgaaacccaactgatttctttcttccttttgtttttttgttttgttgtgttgtgttttttgaagacagagtctcactctgttgcctaggctgaagtgtaatggcacaatctcgactcacttcaacctccccttcccgggttcaatcgattctcctgcctcagcctcctgagtagctcggactacaggcatgcaccaccacatccagctatttcttttttttttttttgtatttttagtagagaaggggtttcaccatgttggtcaggctggtttcaaactcctgacctcaaatgatctgcccacctcagcctaccaaagtgctgggattaaaggcatgaaccaccacacctggcgccaactaatttctttctgacaacagtttcttcatctttttcacaatcaacactatcctctctttatattttataaatatagatatatacatatgtgtctgctacgataaatttgacgtcaatttaaacaaaaaaattagaactatttttaaacgaagaaactttaagaagggcacaattttgcaggctacgcagtatttgacaacatttttggacaacatttgtgttagcaccttatcacttggtatcactgattctgtcacttttcttttgttccaaaatgtgcagcatgtcataaaacttttaatgaaataatatgttcagagtttattactttttgagataactggagatcccctgaggtatcatacaatcaaagctgggaactcttcctcacaattggtaaaatggtgttttattaaccaattactctctttttggacacacgaacaagaagcctttatggagacttaaaatcatgtaagaatagtgtaaagcaataaaatccatgtccaactcttctcatttgtttcagggacaaactgaagattctaaaaatggtatgaggagaaatgtatgtagcatttaagagaaaagccagtaaaagaaaaagattgttcattaatgtacatagcaaaagaaatatcaaggcaaaatataccttctcttgccccctgccaactgatacaaaaatggaaaacatgatttcagaagtacagaggcttatcaaaagaaaaaaaattcaacgttatcattattagtcatgcctattttaataaagaagcacaaaatctagtcaagttcaatataaacctcatgcagataaatggaaggtttaggaaagaggttgatgaggaatgtaatgtttctgtgacaaaagaaagggaagaaacatattcactgagagttagaaaaaaaaatgtaattttaaagggaaaggaataatggaaatttggatctttcccaggttcttggggaaagtgtttacacgaatcccaatggacattaaagcttttggctgaaactctattgtctccttttgttgataagcctttggtatatgtatgcattcctgaatagacacacttacgtgtaacactgtcttctaataacagacagctgtagtgaaattttgacaagtctgaatagttgttaaacgcaaaaggctgcaaagatgatttttttcattaatatgttgttactctgggcagaggacagctgagtccaaaagaactttgagaacaagctgcttgttccagtaacctgctgtacctatgcattcaaactttctttgccacagaagaagcatgtgtggtaaatgggaaccaatttgattgcaaacttcatttggccagtttcctataaatgtggatgcaagatccaactttgcatattcaaattgggaatatttatataccgattttttttttactttttattttacttatgctttacatgtggtatgcaatcagcagtcttcccttcctttttctctagtactagggaaaaaacctaggaaggtgctggttttacttatactgtcttaactttgtctttcttaatattgctaacccataggagaaaaatttagtcttcacaatgcctttttctaaacttaaagttaacctttatactgatcaagaaaagaactaaggaagcttataattatatgtaccagaatgactaaaaaatgtgaaaatctaaacaaaaatgcaatctcttctgagaatctaagacataagtattagttttggcttcgctactcattttgccaaataatcttcaaagaatcctcatcttattttgaaattcagttctctcatctacaaaatcaagataaatataattgcactctctgcttcattgggatatttgtatgctcattctatcctgcatttacacatttatttagcaactatttattgtgtacctactatgtgttgggcaccaagctgttgtgagaaccaaatgaaaattaaagcacataaagctacctttaaaacagaaaagttagcatattttttcaggttattgatagtagtggcattgtattattccttgtataatcagactcaactctaggaattataagatcaatttacaatacaaagataactaggttagccataatgtgctttccatcctcactgttaaccacacgcggtaattctgatgacataaaatgctttttcaggtgagcttggtgtgagatcgaattgtcaggactgcccattgggagagatgtcatagagctttatttaccactttttttttctctctctcttccctggcctccaacattcacagacacatctggttctgccagttaattgcttgtgtttctcacacagtgaccaataaggtctcatctcacctcattgttattattcacctttgagagttgtggctacttaaaaaaataaaaacaaccagagtccagtgagatggaatatagtcagtagtcagacatgatttggtactgtcatttgatgagagaatctttgaatgcctattatgagattttatgttataactgatttttcattacatactccagtgccaacattggaataaaaaggtaaagtaaattatttctgcatattggggctatccactcttcctcatccatttgaggctattttgtaaagaacattgatttcttaaaatattgattttgtttttgataaagtaagcacatacacaattaaatagtattttagtactgtaggaatatggaagtattgattactactaacatgaagtagaatatatagacgccttttagttttgttggattagaaacggattttcaataggaaaactctaataaggtattttataaaaacctatcataagaagttttaaaatttataaactcttgcttaaagaaaagatttgcctgcatcctttacctgatatgaaaataaatgaatggtaacattcttatcatctatgtttgtgtaactgaatagcatatattatctatctctaaaacataagtgctttatatataaaagcatgacaaacatataaacagaaaagagagtaagacaataaaaatgatgctaaagtagcaagtcacccaaaaaacaatctaaggaaatccaaaggtaccatttcactgaccttggaaagagaaattttgttgtatttgtgctaaagttcaggagcaaatgtgaaagtttgaaatgtaattttatgaaatataaaatttcttgtcatctagattactttttgtgaagaacgaacacattcttggtaactataattacatacagagtaaaacaaacccatcctttagtctgtcaatggtcctgacactatgaaaacatagtggttgaagataaccagacacaaccttgattatcaataatgattggatatatgtcctctccattcttcctctctccgcaggctttactgttagcaatctccataggcaaaacctttctgaagaccagattggaacagaaatttgaaaagaaatgctgaaaggagcctacataagagcataacttccaccatttgacaattcagtccaggaaaccatcccgataattcctgataattacacacagcttgacagtgttaacttggactctttctcttatgcactattcatataggttgctgtagctcataattatatatttgaagaaaagagagagtatacaaacctaaaaataaacaatatgtacaaagacagcagacatggtcagagacaggtacagattacacacacacacacacacacaaatttttaaaaagtccctaatactccttattttgttcattttcacttcacagtgctactagaatagttttcccaagacaaaactatcaattatcataggatttcaaaatttaaaatcctgcatatagctcttaatcaacttgaagataaagtagctatttctcagcaagggatgtaaagccatctatgtgtggctcccaggttggaatctggcataaactccacctaaatctacatgtatagccattaagtctactgccagttcccaggaccagccacttggatgcatttgcatctgcttccgatgtgtttttactgaatttcactgtgtgttgaattcagtcaccattcaaaatttagctaaactaacaccgcctgttagaggccttccataatacctttcccttactatgcagagagagatgtataaatgatgcatgggccattacgataggtgccatagagaggtatagggaaagaggtaaggaaaagtctcacggttcagactagacagatcatttatcaccctagtgctttctgttcaacttcatggaggtagtggtctttaagctgtggagatttaataaatggacgtgatgatacaggagtggtaacagaagcttataagtgagagatagtttaaaataattttttcattagcctaataaatgtgaattttaatcttcaggtagagaagatattcagaatgttacgaagcaggaaagaaacagtcagttattctgtagaaatattaatatggtagatacatacaaaatgcatttgtatgggaaaggatattctggaagtgtgaagaacagattgaaaattattatgataggacaggagaaaaagcctccaaccaggacaaggttggaataaaaagggtgaaatttccaaatattttagaaacagaatcaaaggatttgtcacttttttacaggtgaaggatgagatttaagaagtgagaagatgactttgggattttgaatcttgatgaaaagaaatatagcaggaacaagtaaacaaataagaatcaggaactcctgagtaggcagtggacgatgagtttagatttgtcatagaaaatttgagtttatgttggcacatcatattagaagggactgtgaggcaattggaaatgcattcctgaagtttgggagagagctcaaggctgaaatacatatttgatagtagttttcattgtgtcagtgagaaattataaataggttatagattagatagagataatagatgatacagataaataaataatcatgagtatacatcatgacacaagccaaggggggaaacttgcaagagtacaacagtgatcaacactatccactagccactattgatagactattttgaatgaatggttgaggcaggattagaagttatgtcttcaaattccaagttttctcttttgacattattatacagccaagtatcacactcatcctttcagaattgcaggttttctctggtatttgagtgcttggtcataagtttcttcagggctgtgggacaagataatatagatttgtacctcctaactctacttccttgccatttaagtgcatctgggaatgatgtgagaggtagtggatagaaaagatttacaaacatatatagagaaaagaaagagaaatagcaagttgacattaaaatgtatgcacatgtagttcattttcatgattagaaaatatataattatgattcattttttatatgagagatctagcatgaatggcttgattattatgcttgtgtcacttttatcatttgagctttcagtttcatctctaaaatgtttgtttttaaaataaggtcaatcacagattgcatgatttgggaagccagctgtaaggtatgcctacctataaaatatgagatatatctaaatcatcagcagaataaatgtagtttattttgtaaacttcaggacctaatatcataaatgtcttaactttattacatctatcagtatacttacctcttctgaaattggaatgtctatatgaaactataggtttcatatatgaaacaattaaacaattagattattaattgggggttacttttaaatttattatatgcaatatgacagtaactcaaaaccaaatttctggaacttttaaacaatgtgtttgcattgtatttctatgcatgttttagagtgtctcaattttactatcataaatgtttaacattaattcatccttaatatgtctcctaagatacgacaaataatttgtgtgggttaaagtaaaacataccttgctccattagccctttacagttccgcagggcacagcaataggccccatggaactattgagaagaattaaccttcctttggcagcctctaccaattttgcactcaagctggttgatccccagagagtggctcatttgttagttggtggcttatgccatttatagtagtatattttaagaaatgagtctttctcatgaaagtttcatgctgcatcaatttcataatgattttctctaggtttatcataaaacttggaatcgcttttggatccagattagccactgtggaattcataagaaaataagagatagtttaagacacaaagtgagctgaacatagtattttgggttttaaatttataatggtgttgtaatatatatatatatgatgctaaggtaatttatgtgtatgtgtctatatatatatatatacatatatacacatacatatgtatatatgtatatctatgtatatatacatagatatacatatatatagacacacacacatatatgataaagacgactgtgcactattatacaaaatataagaaaagtatactattcccaataatttaataatttagcatattgtcctctactataaatgtaaaggtcctttgacatttggaaaatgcaaccttagttatagtaacagaagacaccgcaattactttcccaacaacctaatacttgaagggcaaatgagagaaaaaccccaactcagaatagtccttgcatgagtgggttatgtattatgattcacattataatagattaaataatattggataaataacagaaaacaaaaagaaaagccaaaggaatatacttggtctatatttgcatttttgaattgtgaatgatttcatttggtctttttccagaaaattcactatggttttatgttcaaagccagctttatagtgaatcaacacaattctcaaaatgttaaattagaagatttttaatgtaccttttctgacatatccatacatttttccacatatagtactaacagcaactgctatcagatattagtaagagattattctaatctaaaaaagattttttagattaagattttagcattgcagccagaatgctttcaatcttggcttggtaaatacagattcaacaacagcaaagtaatttcccaagtgaataagaagctaacaatttacactgtaggctgagtgttttaactatagattttaaacctgatcccaattgctttttaaggagtctctaaatattaaaaaaaattaaaaacaaaacaaaaaacaaaacatgcatgcattcacaaagcaagcaattctattttctgtacagagatccctattagtttgctaatacattgtttagaaaatgtaattccgtacacagtgggtttatttcccttgtgacactggctattgagcctaacattttgagcaatatagaaacactaatgcaaaaacctagcctatataaagcattttgtcatgtacaggtaaaccataacaaaaatataattgggggctagtgttttttgcctgtattacctatctaatttaattagttaattagatttttatgctatcatttgaaagtagatttgaataagtttctcctttttaatgataatgtgaaaccatgcagattatgttactaaaatatttcaattttacttttgttcataggccaaactttcattagcacatttaggtaaaattttcttttgtcaaacaaatttggcagttttgaatacttatatggagcaaaaaaaggaaagtataatgcctggaaactagagtcagaagaagagagtataaagtaataagataacacagcaagtttaaaagaatatgcagttgatcttcaactgcaactaaactttactggaaggtggaccccatgttgctaaatcttttaatgtttttgagagaagatttttaaaaatctattgttttttataagcaatcttaatttttaaatgttgcaacctattcatataaatttaaaattaataaacagattttttaaagcaaacacaaataaaaaaattactttcattgtcgaaatcatttggccccaatgtggtctataagctggccatgtataacgtctgactattctacttacactagaaaatttacctttggctcacatgtgatacatatgtataatgatgatttttaatacttgatagttaaggtatcctaaattccagcttcacttctctaattttcacaatagatatgacatttgaataactactaaaacctatttttgcatgtcctgtttttttatctaaaatttaactatttagtcattttacatatgtctgtctactacttgttctgttgctacgttttttcccctagtaaatgaaatcaaacttacaaactttggctaatattttgacagaatagatatctacttataagtcatgactattgcaatatggaggcttgctcttcctgcattccttctgtttacatccatgaagattttacgtgactgcctttggttaagtcaaccccagtggtacaataataaaatagataatttttctcacataacaagaagtcagaagatgggcatcagcatctgctcagaaaattaccaggggtctaggctagatcaagtgtcctcttgtgtatctttgattcttaactttaatccttatgaccataatatagttacttcacctccaggtgtggaatcagggtaacaggaagtaaaacagaggacatattaaagggcctcaggttcccgtcaggccttacccgtgcctcttagtcagcaaagtaattgctttcccaggacccgtattctgtgtatgttccctcacttctcaccacctggaactgggttataggattactgctagctacattggagtccacagaagggagttcgtttatatttatttatttatttaattttttgagacagggtctcactctatcacccaggctggagtgcagtggcacgatcttggctcactgcatcctctgccccctagctcaggtgatcctcccacttaagtttccagagtagttggggctaggggtggttgccaccacatccagccatatttgtctttaatgggaacactgctggctcaaatcagattaaatttggtagttaaggtattatgtagtagcagagaatgtttccttgtcaggcattgagcaacatctgcctagtatggtgattctactcataagtctgaaaatagggctaagaactaccagaagacttctgagagctatcagccaggaaacaaaaacatgttgttgctgctgctgcttttccctctccttcttcccctctttctccccttccatcttttatggaatcatgtgaccaactcttaagaaatcattcattatagaaaaatagaaataaatgtggcaacgcacactgtgtctattggcaagacaccaccagcataagctacttattatatgatgattcaaaaggatgggcaggggacagtgactaccttagctgtaatgcattattaatcagtctctgaaactgtaattactttctgattctgtctcttcaagcttgcaaacaactgcacttaacagtcttctcctctgcagatgacttagtgctcatttcatactgtggtttacagtcagttattgcattagatttcatatctgagattcactcaactaataagtacatctgaaattcaaaatatgtgcaaggcattatctactatatggatgacagcttctgtgggtgctctctagaacctcattttacaagctcaattaccaaactaattttaaaaatctctggatcatattttttgtaaggggaaacaaggaagtgatgtaaagatatcatctctttctttcaattagtttttgttaaagagagtcacaccttaacataaaattcattttcaccacatttttttaaataacggaatggatatacaggattgaaaatgaatgatgatgaatgcagttagaagtataactactcatctagtgtttgtaaaacctatgcttttacattcttattgatattaataaagactaatttatagcaataaagagtacttaaagagagatcacgagagacagctaaatatgtacaaaaactctgttacaacataggatgtcaggctaggggtttagctaaaatgcttggtagtaacatgttttcacttcctaccataagttaattcatattatcatcaacctactcagttcaaacagtgccaacctaaaaaatatatttttcagtgaattatttctaaacaccaaatgtcatttctcatggaaattctaataaaatgcctaaaatgcattatctgacattttagtggatcagtaagtagcttgccaattgaaattctaaaatctttacatgttatagatttcagctttctgttctaaactcttgactttttaaagaataatttacatctctatgcaactatttaacaagggatgtctaaacatcaatttcaattataaataatgattccagttacacatgtacattgcattatgaagaacctagcaattgagcagttctgcacttaatattgataaataatgtctcagacttgcttaagtcagcaatgcctacagctgaggggaaaaaaagctgactacataagcttgaatattttccctgttttaatcacactaacctttattaatatatggattgataatttagcaaatcttggccaggtttcctcctaaaaaggtagaataaagcatcattattttttagtcaactgctttgtcatgtgcttggtaggcaccttttgcaaaaacgaatgtatcttctgatattgcaacatctctttcatcagtataaaaatttaggttattattacccaaagaattcaatcctataacccaaaatataaccctgcaatatgagaggtctcatattttaatgacatcattaaaattcaactaatgctattgttttctctttatcagttcttagaaactactactgagaccattgatttgaggctccttccattcattcattgatttttgtttgtttgtttgctttgagacagggtctcactctgtcaccaggctggagtacagtggcatgatcttggctcactgcaacctctgccttctgggctcaagtgatcctcccatcttagcctcccgagtagctgggattacaaatgtgtgcaacaatgcccagtaaatttttgtggtttttgtagaaacagggtttttccatgttgccgaggctggtctcgaactcctgggctcaagcaatccgaccttggcctcctaaagtgctgagattacagatgtgagccactacgcctagcccattgattctttcatgaaatgtgtgtagagtattggctaaaatttacacactgggtggaaaacaagatagcctccattctcatgcagctttagtaatgcgacatactttacattaataatgatttcagcaacactaataattatttaagcaatcatttataatgataataactactccaaaggggaaaaaaaacaatgagaactgctgtaagagagtgtctgatacactcctaacagaaactgcagagttagcactgcagtcagagaaaacatctctgaggaaataatattgaagctgcaatatgaagagtgagaagggcattgattggtcaaatgaagggttgaggaaagaattgtaaatgcaaaatgagtagtaggtgcaacaaacagaaaacagaattataaagaagaaactgaggggaccaaagaaacagagaagcttaatatggtttggaagataagataaacaagattaggttggaaaaataacaagacaaagtggaatgtggttgattgtctgagtatagatttcatttcaaatcagagcaatgaaacgattttgaaggggttttaaaagcgggggtggaatggatagcaacataaataatctttaagtattaaaacaaaatcaactcttttatttgtttattaaaaatttaaaagaaacaatggtgggatgatatttatgtaggtcacatttatgtttgaaactgccacccaagtagattaatatatagaattaagaaacagctgattagaatggctgactcctatgaaattcaaatgatcattgcaaaaacattactgaatatcatgggtaaatgtttcagtttttttcggaagaggaattcgcattactctcttaagcattttaactttgaaatgaatgtgtcaaaaaagccaggaaggaagatttattagttagagatgcatattaatgtaactgaaatcttaaatataatggcagaaatggtagtatggtgaagagtatgtcccaggatttcaaaataaattcaaatcaaaagacggagtgaggaaaatttatgctctgaaccatccgcatgagggttattacattagtgtttctaacaagctcaaaccaaacccccattaaatatttgatcagcttgtgaaagaccagcatgtactcttcacaaccatgaatatgaacatcttgcagtcagtttaatgcatgacagacccataaaaaagattatacatgataaaatggtgcagtgttggcacatcttaactgcataaaaaaataaaagtgaaggaaaccacaaaacaacaaatgcaagctaaagctagtacacaataagctatgttaggaagacacaattgcaggctgagtcaggaggttacatgctagccccaaatctgactatttcacacaggaactaaggatttttctgttgtcttgggacaatatgtcaaacctataatatacagtgattttaggatactcgagcctagcttatatatttgcatctacaactgaactttaataaagaaatgccaaatcaattttctccctcaaaccttaatatataagtttgctattatacttgtcacttccatttgtggtaattttctttgggttaaaatatttagaaataaattaaaaagcaaaaatatattcaaaaagaggggagatggcaattatcacatcaaccaatttgcacattggtaccaattggttttgtatctgagagttcacttagcagagagacagcaagaaatagtacattttaaaggactaaaataaacacatttggacctgggaaaggtgaagaaatccaagtgccaacatgtcatcagggagggactcctcatctgggaacaggaaggaagatgttgatctgtgttacctagggaagtgttctgaataaaaccaattctaatgtatgggaatgttcaggaataaaagtaactatggggaagatacagattctattaaaattagcattacaacaaaattatttgattcataattttacctaacaagctattgaagaaactattgcttctacttctaaacaatctatttcaaaatacatttaaagaggaaaaatgaacattttaactattcagttaaaacctaaatatacatcaattctttctattttctttctctttttctttctctctttcttttctttttctttctttcttcttccctcccctcccctccccttcccttctctcccctcccctcccctccccttcccttctctcccctcccctcccctcccctctcctcccctcccctcccctcccattcccttcctctttttcagatggggtctcactccattggaatgcagtggtgtgattttgcctcacagcaatctcagcctcctgggctctaacaattctcccatctcagccatccaagtagcttggactgcaggtgcaatccactatgcctggctaattttgtttatttatttatgtatttattagagacaaggtctcactgtgtttctcagactggtctcaaactcctgggctcaagagatcctcctgcctcggcctcccaaagtaactgcaactctttctacatctgggcaaagatggaggggcatcaatggagagaaaggagagtccactgaatgactgaatttggcaatttaatattgataataaatgtcatctgtttaatatgcagttgctatttagttctaatcttaaactttgtctgctgaaagacgatttatgcatactttcctgtctggagattttaaatattgggatataatatattaataagtgtattatttattccacattgtatcaaaaagaagagataacctccaagtttacaagtgatcagaacagctactcagaaaatgattttaagacaagctattgagggacagaatagaagagcacttgttctctaaggaaaaaaaattctgagaattaacttgtgagaatttttaagagaaattaaaaataaattggataattgccttccattgaattaagttagcagaacctggaaacatttaaaattggttgctatattgattcatgtctttctttaaataaagcaaaccctttgtaaattataatgtctctcctctcactctcctgtaattataaagtatgagaacactgaggattgattggctcttctctaaagagagggactatagctttcacaatggacttgatcaatatgcaaccccttataagaataaattccaattattagatgctttgatagcccaccccttctcttagaccaacctttaaacaaatagtatcaatgcagatattaataataccttataatatctccttggtagtagcttgaatgaagatttttaacacacagggtttagaaaattttattcattattgatgcagaaataattgatggcaagtcggtatgacttcatagcaagaatgaaattcaaagacaagttatatggccaacaagtagatggataatattgttagtatcaatgttattaaaaggatatgcatagtagttgcctgagacatctgtctctccactgattccagagttgattgagctgatccgactgtgaagtcagatggcactccttcaatggcttcatatgcgttccaagatccctatatttcaccaaatgcagcgcattttctgatagaatctgctgtgatctagggtattcctattgatcaccccgccttcaaagaaacactcagtctttttgtataaccattattagattttgaaaacataacctctattccaagcttttgaaatactctatcaataatgatacctcacttactgtaagatttgctatcagaaatctctacatgttctcaaagttttggaactaatttaacaatcaaatgtataagtcaacaaagcaaatcaaaatttcaaattttaccaacacacataccatcttaatcaatatataatgtactttcctatactttatttaaatgagggccataatacattttttaagttgttattgttaaacaacatgatatttccctagtatatgttaaagttggtactcaggtccaggtggctctaggtttcacctcctccccaatctactactcagtgtaaaatggagacaagtattctagaagagtgtttatcaaaccttaagttccaacaaatagtttgggggtcttgttaaaaggcagattctgtttcagtaagtgtgaggtgggcctaagactctgaattcctgacaagcacacaggaaatgctgctactattgttatgctggccacatgttgagatacaaggcctagttatacagtaggcaattttaaaaacgttttaatgttctactgaggcagcacttaaatccccattctggccatatctctttttgttttttggggaagatgaattctgagcaaatacacactactacaaactatttttaatattacatgcaattttaaccctactgtctttataaacaattaacactaagttaggtttactctcttaattacaaggaaagagaaagtaataatgaggaattgcaaactgctaaacaatatctctgatttatttttaagtttgctgattttttcatactttaaaagctttattataaggaaataaaagagaagtcatgaggcattaaaaatgtttaattgtttgaacataccaaacaatagctacacctttcaaaacaaccaaactgcaggctgattaaatttgtttaacctgtaagatacatatcatattcaataattagttaattgatgcctgatttttcaaaataatgactaaaggaagaattttgcctgggttaaaaattgattttggatagagtacagatgtatagtaacaattttgtaaaagaataaggataatttttcattagtttaactgacaaaagtgaatacaaaatttacaccccactgtaataatttttttatgtaacaaacagaaactgctttcagatcattttgttttcacattgagaaatatatctgagcaagtatctaaaaagatatgtttgtccaaaccgagattttgatccactgattaattgtaaggtagatatatattttcttttttatataaatatattcacttctgctaagctaaaaaccaaacaaaactaaaaaacaatctaccatatttgattggacaattttcaaaaaaattttagttttaataagaaaagctagcagctagactgggcaatttttgtgttctttaataaaaggctgtcacataattcaggtaaaatgctaatgtccaaaaaagagttcctctaaactgacgtggtcattttagtaatctgactatacacagaaggctatgtgtattatatttttaagccattactttgatattctttgtgtgaatacattgatttattaactaaacaaagtttaaagtaccttatagtacagaattttgatagaaaaataatagaaattagttagatattatgaaatatgctaatgagccaaagccaaaaagttgaatatttatttgtttgttgttgttgttgttaaatctctggtccattatagataaattgtttttacacccattttttactttcaaattgcttcacattttggttttattgaatattaattatgaaaataatatttgaaaatatcaaaaattattgcttttacatttttgaaaatgtgaagcatgaagaaaagcatctataaaacctactctcagaaaatgcctctttcatccattttatataaacatttttgtgtttttgtatattataatatttctaaatagaaaaaggggctctctaccggtttgtttgtttttttaccttttaaaatgtactttgacaattttctatttatgatcatgagatatcaataagacaagctctttaaggcaatgtgcattctttgaacctaaaatttatttggaatacaatagaactatgagaacaaaaacttcagtgaacactttgataggaaacatctgcacatctgacaatctatgttcaaacgatcttgtaatttttttgtggttgtttaatttgtttgataaattaactgattctctactagacaattaagaggcactgaagacattaaacatgcacatatatcatgtacattacatatataaatatattacagatatatatgtgtgtgcatttgtgcacatatatgtgtgtgtatatatatatatatatatatatatatgatagcatactattctgtaaatcttgcagttcagcaggaaatgaaaaagaaaacaatcaattttatttagagctaatacgaaccctaaataaaatacttactctcatggcagttgatttatctaatagaaacgaccagatcatttatcatttgttgggctaacataagtatttgagataaattgatcataaaatgtatgtgtttccacatactattatctatcacttcccaataattgctaattaaaggaattattgtaaggtctcacgtgtgtgtgtaccagaaagatttaataaaaataactaccaatttttcaccaatctctagaatattctatattatatcattgggtttggaaaccgtttcctggagaaacataacaaaatctagagctcttgcataaattaaatatatattaaaacatttcttagacaagtttgaaggaaaagaaatgcatttcagtggcaaaacctcagatttacaagaagtgctatttgaaactattttttttccactttccaaacctcctgaggaagaaagtacaaaaaagtgaatactcattttccagtcatttacatcaggacaagaatttctagaactcaaaccaatgccaaactttttgagaaggtctcctgtcagggctgtctggtagttccagggctcctgaagaacccaggtctattctttgatacctatttgaaagaacaagatttgggtccttgcagctgtacattgcagtaacaatttctggagtttttattataaaaattatcctgtctgtaggttgggatataaaataaagagataatacttatatatttcatgttgtaagcttcctgcccctgtagatgagcttccatctttaaagcaaaacaacactaaacaaacaaaaaaacttttgactcagttggccctatacagatcagaaaaaaatttagaaatcctaaggaaggttgagaaccattctttttatcagtgatttaaatatactgtaatacactcttagtagctcagagacacagattaagttttttattttcttatttttcttattttcttagtagctcagagacacatattaagttttttattttcttatttttcatgatcatgtgtattgaattacacccggtacttgaaaatgcatttgcacaggagactgtaaaactggtaggggggtttctggggtgctcttgccttaaaaagtaagagcagctttttatggtttttcaagatttgagagtatagaaatcattttttaaaatgtgcattgcacacccctacaaacttctctttgcccataggaacttgttagcaacttaaacaaacacatggagaaacaaagtcactttatctccagaaatcgattcaacatagctattttaaagagttttcccgagactttgaatgacttgctggaggtaaacattaaaaatgttatgcaccaagagaaaatatttgattatacgttacataagttcaggccttcagatgggaatgaattcatctctatgcagcaaaagaataatttcttaattaatggtagaaatagaggaaacatgaagacagaagtccaactcattggaactttagaatcagaaagtaattccttttggttttatggcatcttgctcacttccaactctgataggacaaaatgtcatttcgatggaagatctctgactagcccagttctttcgcacctttgttaacatggcctgagattgtttctaccttctccagatatggctacactgtgcaaaatatatactgtatcagctcttcagtgtcagaatcttgctttttgatgataaaactgatctttattttactaatctcactactattttccaaataatgaatttggaacaccagcttaatacattggaaattatagttgtttttctgttgaatatgagagttgcctatgaagtgtggttttatctttcccatatattctttttaatattccaaaatattcaatgataaggtcttaacttatcattgtgcaatttatatcatttgacaataaatcgcaaacacactggttgctttttgtttgcctgtgttaccttttgttttatttgtcattgccctctttgccatttgggcaatacatgacttatttcaagaaagcgaactgggaattaaaatatattttttaatgtgcatgttctaagggatttaagagtagtaatactattttaaaataaaatttaaaaagttattgtatgttttcagctgcttatttgtcatgtcattggatagcatgtaaaatcatgaagtctgttcatgaatattttttctacttgcacttctgataggtaatcaaatggtctgtctgtctctcttggcttttgattagaaacaacttaatcagtacatcgcatgcttaatgtcttgtggttaagccattttatacaaatacctgtttttaaaaagatacaagtatacttttcttatataaaggttggaaaaatagaacgtgtgaaataatgacacctataatcttacaacatgcacacaactttactgacttactacagtgatattctttcacaatattgagttcatgctacatatgccattttgtatgctttttctatttaatgtgatattgtatacatgtttctaccatttaaaattgcataaccattttgatgcgcatggcatagtctgtcatgtataaaaaattacttaagttgctactgaagattcacattttctacatttctttatattttaaataatacagaaaaatcttttatagatatttgaaatgtaaaatcactggattaggaataaaagttggactctagtagacatctatagaactatattcctgtacttttttttctgaaaattgtgctttttttatttcatctatgtttctgaggaggtaactgtcaatttgtataacaagaacttgccctctgtcacaggaaacttaaatacttttctaagacattttaactgggactatgagattgaccttactctgctctgtgtggttgtactttgtaaatcccaatagctaatgatggtgtattccaacatctggattgagtgtacagaggaaccatgtctgctgttagaggaaaaataataaaacagatatacaaagagtagcagtaacaaagagcagagaataaaggcaagttgcaaattctcacggagaccaattcctgggcagatttgcactcctgactgtgggttattataagataatgtaggaatcttctatgtttattacaatcttcccccaacacattttttgttcctttttccatatttggtttctaaaacttcaaaagcttataatcaaagggtatcaatattttaaagtttcttgatgcatactgcctgtgctatattttattgcatcaccttaactaaactggaactacattttccataaattcattccctaaatggtttgaagtaagatttggccacaagagatatttgcacacgattttgtaagtagagaagtggtagtaatgtttactctccaaaggtggatgtagggtgttaggctcaggagcagcttgcatgcatccctggcctactgctgacttaatataggcagagggcagcaaaaagccatgtaaccccttaagctcctttgattctccttctcatacttctcaaatttgcatcaagtgcatgtgtggctcactggtaaagttagccaacttctcttgcaggtcatctataccatcaatattggtggtggtgagaaacatacaagaattccagtttatctttatgggtcccagttcatccttgtggatttcagttttgtccttgttctcctctacttcacaatcattcttccttcctaatggttcagctgacttacagcaatgtcactctcaacaccagatgcagatgccttctgcaaactactccatcaactctcacaattccataagatctaagccctataataaatgccatagtttgtatcatcatagtgatcttgcttctcaccaaatactgcctaacgcagatactggtttgaaagaggagtgctactgcaataaaaacagcatggtttggagcagcaaaaccatctggccatggctttggacccctgcagtacgaggaagctaaaagggcattgagaagactattaatagaagcttgtctagcttgaaggaggctgtcagtgcagactgaagagaagccagcaattaagccttccatctgaaagcccagacactgtggagcagaggcaaaccatttccccattccctgtctgaattccctgattcacagtttttttgtgttttaactagtcttgaagtggttagttaaatagtaagagatggttcataaagaatttggtgctgaaagtggagcagtcagagttgcatctgctttcctgctcttgtgttatacactatgcttctagaatcctgtgggcttagaggaaattccccatttttgcttgttagtccaaattgagtttttaaaacttgccaccaaaaagactcccaacctattagaaacaaactgtttgaaattttgtcatgcagattgatatctaaaaatttactgtgtccttacttatttttatgcaattttagatgaaaaaatacctcttagataaaaactcatgatcactttcagttggcatttttgtataaatttaaataagttattttgttcaataaggtatgtggtcattcattaaatcatctaggaaatatttactgagttatctcaatgttcagggtaggggattaagcaaggagaaggatatatcgaatcacagtttttctgagtagttaatcacacactagcagcaataagacatgcaaacagaaactaacacatttccttgattctataatgcatttattttttacatttaaattgttttaaaatcagggcacatcatatactgatggatgcatttcatgtgaaagtgttgcttcttttcccttgaaaatttgctattaaatcaacaatggcttctaatcatccagaatgtcttaggagaaagaaactataatattgcagaagttaatataccataaataccatgagagatgtcaggagtcttaaaatgtttcaccagctgagataatataagaagactatgaagaatttcaacagggtttcgaagaggagagcaaagaggcttgacattcagcaaggatctcctgcccatatataaatgaactttcttctaatcctcaaaacagctttcagcagtaggaattatcttcacttccctgatcatacaactgaggttcagattagtgagcagagaaaaaaacatctttgactttcgaacccatatgtctctaaattgaagtgtacactctttttagaaaataatattgagggaattcacatagtatgacatactacatgcagcatataacgtgtactacctacaccccatgttctaaatcctatatgtaaaataaaactcagtaggtactaatactaacctcactttatgaatgagaaaaccgagacctgaaaaaataaagtaagtttttcaaggtcacacaattaataaacaacagagctgcattctgaactcttgcagtccggtgaaagagtctgtctttttaaccactgtgtcatgagcctctcaggacagtttaagcaaaacgctttgtcccgaatctctaagcacctgattaaaagatgcagccccctaacttttgatttccctttccaagctctactgatcaccttttaacatacaattgtaatatttattatgtatataacgtaatgtttgttgctaccgccttcaagtaaactcctcaaagaaagatattttttaatctgctttgatcatggatgtatcttaacagcttgaatcacgcctgacacaaggtaggacttcaataggtatttgctgaataaataagtgattgatttctgtaaaatacgaagtgaggatattcagtgagtgaacagtaagtggagagaaacagaggcatggaagtaagagttgtgttctgagactccgattagtgcagtttgcctaaggcgtcaggtgggagcagaaaattcagtaagcagatctccctgaaaggggggttgaagtcacccaggaacaaccacaggagcctttggtccctcgcgttttgtttatagcttgttcagcactagacactggaaaggagggcaggaagacatcaaagtagctgtaccgttcatattattttcttcctttggcagctattttctctatttcctgctgacactacaatttcagcgatttaatgatacaattgtttctgaaaacgacacagaaacagataccctcagccatttaattggctgccctgaagaagtggaatctgctgttttctaatttcatttttgaggggtttgagaatatggaaaggctagaagaaagacaatatttacttccatttaaaaaggtaaaatcttagcaaggaattttaaactcagcccagttaattaaggtctgctatttccatggcatacaccaggatatctacgaagagtttatttgattcttgcaaagatattactaaaactaaagaagcacagtgctgttagaaaagtcttatttcttctcctgtacattttaggttttgtctacctaggtctctaggattgttgtggaattagctcctgcatctatgcacttgactgagacttgctaccttctcaatatttgaactaataaattaaatacaagaacatttatactttctgttgttgaagaaaatttccctcattctgcaaaatgttacagaaataacattaaagttgacccaagttttcctcatttttcttcttaacataaaaaatgaaatactaaatttctaaacaggcaagtatatatagtggaaagaatatggttagtatataaaatattatgatatcaatgaccaggtgctgaagctaagtattgtgtataaagtaagtatacacaatatactaaagataggggaaggcctgaaaataattcttcaacttagttaacaaagaagactctgaaaaaaggttataagataataggcaaatatacctatatgttatatcaaatgttaaaaggtgacttttctttatcacattgatagaataaatcagaaaataacataataataccaatagatccagaaaaaggatttgacaaaatccaacttccactcatgataaaatctctcagtaaacgaggaatagaagggagcttcctcaacttggtaaaaaatatctatcccaccccccaccaccaaaaaatataacatactgaaaacatcacattggtgagaagctcgaggctttctttctaagatcaggaataaagcaacaatattccctctcaatattcatttcaaacaatatactggaaatcatagataatattacgagaaaaggaaatcaatttactttgtttgagaaggaagaaataaaaccgtctttgcttgcggatgacaagatcacctatgcagaaaatccagaacaacaacaacaacaaaaatctcatggaactaatcagccgttatagcaaggattcagcacacaaggtcaacaaagaaaagtcacttttcctttgattgacagtgataagtcaatcactgtcttaaccaccagcaattaacaagtggaatttgaaactaaaaatacaatattatttacattagtgcccaagaaaatgaaatactttggcataaatctaacaaaatatgtatgtgatatacatgatacacactatgaaactctgatgaaagaaattaaaaatctaagtaaatggagaaatattccatgttcaagaacaagaagactcaatgtcaacataacagttcttcccaaattaatctaaatatgtaatgcaatcccaatcaaaaccccagccagttatattttggatattgacaaactgattgttaagctaacatgtagaagcaaaaacccagaatagccaagccaatatagaaggagaagaacaaagtccaggactgacactacctgacctcaagacttaatataaagccacagtactcaagactgtgtggtactggcaaaataacagataaaaagatcaatggaacagaaagagcacctagaaacagactcacataaacatagtcaactgatctttcacaaagaaacaattgcaaagcaatggataaaagatcacctttccaacaaatggtgcctggtacaaatagacattactatgcaaaaataaatgaaaaaatgaatctactcacaaatcttgcacccttaacaaaagttaactcaaaacatatcacagacccaagtgtaaaagccaaaactatgaaactcttacaagatatcatagaagaaaatgtagatgatcttgggtttgatgatgacattagatagaacaacaaaggcatgatccatgaaataaataaatgataaactggaattcgttaaaataaaaaattccagctgaaaaaagacactgtcaagagaatgaaaagacaagccagtgactgtaagaaaatatttgtaaaagagatatctgacaaaggaatgttatctaaaatatacaaagaaaaacaaaaactaaacaataagaaacaaacaacttcattaaaaaatgggccaaagacattaacaggcatttcaccaaagaatatatacacacggcaaataagcatgtgaaaagatgctcaccatgtcatcagggaaaagcaacttaaaacaacatagagatatcagtacgtacttattagaatggccaaaatccagaatactgaaaacactaaatgctgtcaaggatgtggaacaacaggaacactcattcattgctggtgggagtgcaaatggcacatccagtttggaagagagtttggcagtttcttacaaaactaaacagatttttgccacctaatccagcaattgtgctccttggtatttaccccacggagctgaaaacttatgttcacacagaaaaacttcatacagatgtttctagcagctttattgatatggtatgcttctaattaataaatgtgaatactaaaataagtgaaagacttaagtctttttttaaaagtgaatactaaaataagtgaaagaatactaaataagtgaaagacttacctgagattcagaaaggctgaatctcagaatttgggtggaagagaattagtaagcagaaggagaataccagttttgtgtggctcctaaagtgactaccggaaggaaacgagcatgaggattatgggtgggagttttttgtgggccagaaaatggttcacataattttgcctattttgcatttgccagaattcagtcacaaataaaaaataatatgaaaagagccaggattagcaagcatagaataaatcagaaaataacataataataccaatagatccagaaaaaggatttgacaaaatccaacttccactcatgataaaatctccagtagccaagaatattaggtctaggtaatatttatgtctgtcctagatggttggaaggttgaaaataaaaagaatgaataaaaaaaatcgaggaggggagacaaaaaagtcgacaaataacaatcggcagaaactataaagagctatatctaaaacaaaatactaaggggacacagggactagggtattagaccagtaatgaaatctggaaaatactactagaactagactgtgaaggaaaactggagctttggaagttggatttagggactaaagtcattctctatagacagagatgaaatggttccagatgtgcaatgaagaaataaatagcccaggaaattctgaatggagaatatccattcaaggtcgtagtcaaggagccatctgacaaactagacaaggtgagttagtttgcgactgcagcaacttcagcaaatactggcatctacacaaccttgcttatttaatttctaaaaaaacaaacaaaaaagacaacaaaaactttccttttcaactttatagttctaaaatcgagtggcccaattttggtttattaaatgtgtggaaaatattgtattaaattactttaaatcacttttgcaaacaccatttatgaaacagaattttccccctcattattatatatgtacacattttataataaattccaaataaaatgttaaagggtgagtatacatgtatatatagatacaagatacagatatgctattcaacgtagcacactttgctcttcctgatttataccaaatggatttagatatagtttcaaagaatcatatctatctctccacttttcatgcatctgaataggaaatttatgtgaacaaaacagagatagtatagtttaataggtcctaaagaaatgcataacattttaacatatggaggttgtgctctaacaaactttaatacaaaacaatattttgtatattcactcatgcatttttttcctttgcaatttgggaatttaaaaaaaccaacagttttatatgtaattaaaacaatgcttaagtcataaaactcttttgtaatactcaaaactaaatcttatttatacttatgtgtcaggaactttacctgcattaacttaattaacacttagagccagtctatgaggtagacatttttacaggtgcgggaactgaggctcagaaacatttgaaaacttcttcaagattatacaaatagcaaatggtggaacccacaattttacccgtataacatttttttcagaatccatgcttttgatctccttgccaagctgtttcccatattatatcttttatgttaaaatacgttttcagcaattgcattttcttaacactttcctaatataaaattttttttaaatttatcttgttgggaaaaacgcaaactttttcactcatttctccatatcaggtattaaagagtcatgaagtaagtttattcatatcatatgagcttcattctattttgagtccaaagaccaactgaaaatgcataaaaagattatatatggaataccactgggtcttgctagcagtatcaaagttatgttaggaaacagtgctgagaaaccatgttcattgccagttctcagcacaattggctaccaggagtcatgtatagtaagtgctatagctcagtgcctgcacagcctcaccttttctgctaatgagtaacattctagcaagcagaggactgattcctgagacagttgcctgaaatttaatgctcgatttctatccataccaatataactttcaactgatagtccttccacacgcagacaaatgaaactgacaaaagacctgtcagttacaagccaataatgcatttcaacaaataattttttgtgtgcccagcacatactgtgggtattcagtgttcatcccaaaaccccacaaggttggcctattttgacttttatcacatctatagataaaggtgtagtgttatctttctttcccaccccaaactgtactcatctttttattgcaaatacctggctaaaggaaatgtcaaaccttatatatagaatttacttgaataggtcctacgtcaaagtgctgctttcttagaagctcaaaactgttaatatgtattgacttagcaaaaagaactctaatggcaaaggcattgcttttgagagagatagcccatgtttggaacaggagaaaaaaaatacatatttttctctaagaaagtgaggagagattcaatatagaatggataagcttagcagatatatagcttataggataaatgaatataaattaaatagagtacattgctaaagaggacctggggtcataaatataatgtagacaaaaaaaaaaattccaacacagaagaaagattcatggatataaattcaactgagcaagaacaaagtaaattgttcagagttcagctgtcattacttgcaagatcatagacaataagcagcagagtatccaggtggtattgtttagctttattagtggatacatgtaagtcctggaagaaggtttgtaaaatgaggagagtcctgaagattaaaaaggaatcctcattaggagagaagttgatattggtcatctaacattagggcagaaaattttcagaccactttcttctataagtgttacaaccatgcagttgacattttaggaactaaatcagtcttaatttgcataaaggctttttcattgttgttcttttgttatacaatcaaaatgctttagcataacacaccttcttcctgtttgttttgctcttcaagagaaaagtaagcatcccttacttttccttcccttcatctgaagtgcaaatttaaggtaaacaggaatcttcaaagcacaaaaagcattttcactctgaaagacttcttatcttggaagaaatgagattccaggataataaaaagctatcatgatatctattctctcccttacttgacagggattttcaagatggatcggcaagatagaaagggaatttattcattctaccaatacttatgaagaaaagggcatttgggatgaaaatggatattgggacctcctcaaagttgctatagaaacccgggtgattacagctaatggtgtggggagaagtcctgttatctttaagagattaacaggaaaccttggtctcattattttttcactccccacattgctctgatgatagcaatgtacagattagaaccaacaaacaacaataataacaaaacaacaccttcaatatctccttgtttataaagtaaaaatataattttgaaaattgagcttcaaaagcttccatcaacaaatcccactccaaccttctgaaataacaccttattcttcataactatattctttgatttagcatatgccatattgacaatatatccctatttatttccaccttcaggtttctgttcatactctcctctctaaagaaaatgattttatataactccacataaatacatctcatccaaaaaaatgctaattacttgttcaataattatttcatactacaagagttaaagtagcctctgtcttctaaatgctcattccacattatctggacaagttctcaatgtctacctgtgatacggttatgtacatttgttgtcaatgtttttccccatgtttacaaatatcattatatgtaatgttctcatagcgaccagttttcaaagaattgctagctgggagtcaatagcaaaagcataccaatctttacagcatatacagggtcaacccaagtggatctgtcacgatttagttttctcttagcaccttgaactatgcactgtatcacacagctggctatatcacaccagtgtgagattatatactatttgtattggtctctttttgttttttgtttttggtttaagtacaaaattgtatgatgccaaaggtgaacatcttcaaagtcagaaatattcagaattaaaaactagctcagatattaaatagccctacatatttggataaactaccaaccatcctagagccttaatttctttctacaacagaaataaaaccatttttcttacaatatttttgtgaggattaaataagatgattcacattaagaatctaggacatggaaagtcctcaaatggatgccaacatctcatgagcaatactgtcagaagattccataattcactttgaagatttctccaaagtgtatagcaagactaaatccaggtggcacaccattagtgcactgaccatatgtgatttaagcagggataagaacatggtttcatgttttaaatattatttctcaaatgagaagctattattatgcaatggatagaattcagtttcttattatctatttctagttcacagatattacttactagttgtgtgactttgagacaggtcctttacttccttgattcttcacttcttcacctgcaaaaatgaggacattgggctagatccattattttacattaatttttaaaagtattggtttcttcattctgtgaataaaattgtatggaagtacaaaaactgaaagcattaaaagcagagttgttctgaataatacaaggagaaaatctaggacctccaactttcggtattgatttgtccatggttaacagcagattcatgaaaaattgtaacacttaatcagttactaaggcttactcagaaagtacatacaagaaatgccaaacgctaggccactatagtcacagaatattacctaaagaaaaatagcctttgaagctccaagaattgtgctgagtacattgtctaattagctgaaaattataaagtgaaattatacaactttaatgattgaataaagaaaaaaatgtggctcataaaagataatatagcaaacaaattagagtgatcagacattaatgttttgcgtttcaaagataatattgggtgcaaaattcatatggatgagttatgtcttcacactttcaatattgttaagcatgtgtcaagatggccacagtattgtagaatggtcagtatgcaaaaattatgcaagaaatcatgtaagaaatgaaacatgtggctttagagttgatagatggttttaacattgtaacattatagttctgggctatttacaaaacctctctaaactgctgcttatctgtaaaatgaaaatagcaatttggtcttcttttcatttgtttgttattattaaaggatatttgatatagaaagcaccagctgatattgagttcctaagtaatattaattcttttttcccctctccttttatgtagttccatatgtattgttaatattactcagcatagagtgttaagcaatcttagcaactcaactttttaatggtatctttcacagtggtttctagctttctaaccttttgaagctgttaaaataaagtcaaataatgatactgctgtggcttaagtgtatgctaggatcaataaattgtggttcttggaataaattgcaattaaagggatagcacttgattgcttgacagtaggtagtctttttggcccaaagaaacttgagtatcaatctgattcataagctaattagtatggacttcactttcatttcactggaagatcatcagatcgtattgactcctgtccacatcatgagtgcgcccttgatactggcctgtgtcacttataggtaacaaatcctcttcacttgtttactttgcttattcaagattatagtaagcatttttaatcaaatagaatatagaagaaatttaacatgtttgtaaataagcactctaatagctctaaaaacttcaatactattgcctgcctttttacatttctatacatttaggataaaacatgtcttaattcagatatgataaatgtatcaacattgtaaagaacgatgactgttactgaatctttgtagcaatagaaaaatttatataacaactaattatacactagaaaacacaacaggatcgatatttcatggtaaattatttgaattaatctaaaaataaagagtcaaagtattgtcctcaaatgtataaatacacttacttagagtatattattttattgttcttaattttccgcaccttctattccatgtggtgttttatatgtaataaattccagcatatacctgtataactattgaatgaatataagccattcagagactaaagcaaagtaagttaagcaatcccttggactgtaaattccattaagataaataatgtgcttgtgtgttttcttcctctatattatctacttaccagcatatgtccatccagagattaaataaatgttttgaatgaacaaactaaaaaggttggatttctgaaaatgactgtttaaatataaagtatcttctccatttaaatagcctgacctccatacctcttgtttgttacacactttttattttttatactttaagttctagggtacatgtgcacaacgtgcagttttgatacctaggtacacatgtgccatgttggtttgttgcacacatcaattcctcatttacattaggtatttctcctaatgctatccctcccccagcccccgaccccctgacaggccctgttgtgtgatgttcctcaccctgtgtccaggtgatctccttattcacttcccacctatgagtgagaacgtgcgatgtttggttttctgttcctgtgttagtttgctgagaatgatggtttccagcttcatccatgtccctgcaaaggacatgaactcatccttttttatggctgcattatattccatggtgtatatgtgccaaattttcttaatccagtctgtcattgatggacattctggttggttccaagtctttgctgttgtgaatagtgctgcaatatacatatatgtgcatgtgtctttatagtagcatgatttataatcctttgggtatatacccagtaacgggattgctgggtcaaatggtatttcttgttctaggtccttgaggaatcgccacaatgtcttccacatgattgaactaatttacagtcccaccaacagtgaaaaagtgtttctatttctccacaacatctccagcatctgttgtttcctgactttttagtgattgccattctaactggagtaagatgttatctcactgtggttttcatttgcatttctctgatggccagtgatgatgagcattattttcatgtgtctgttggctgcataaatgtcttcttttgagaagtgtctgttcatatcctttgcccactttttgatggggttgtttgtttttttcttgtaaatttgtttgagctcttcgttttcttgtaaatttgtttgagctcttcgtagattctggatattagctctttgtcagatgggtggattgcaaaatttttctcccattctgtaggttgcctgttcattctgatggtagtttttttttttttttttttttttttttttgctgtgcagaagctctttagtttaattagatcccatttgtctattttggcttttgttgccattgcttttggtgttttagacatgaagtccttgcccatgcctatgtcctgaatggtattgcctaggttttcttctagggtttttatggttttaggtcttacatttaagtctttaatccatcttgaattaatttttgtataaggtgtaaggaagggatccagtttcatctttctacatatggctagccagttttcccagcaccatttattgaatagagaatcctttctccatttcttgtttttgtcaggtttgtcatacatcagatggttgtagatgtgtggtgttatttctgaggcctctgttctgttccattggtctatatgtctgttttggtaccagcaccatgctgttttggttactgtagtcttgtagtatagcttgaagtcaggtagcatgatgcctccagctttgtttctttttgcttaggattgtcttggcaatgtaggctcttttttggtttcatacaaactttaaagtagtttttttccaattctgtgaagaaagtctttggtagcttgatgaggatggcattgaatctataaattaccttgggtagtatggccattttcacgatattgattcttcctatccatgagcatggaatgttcttccatttgtttgtgccctcttttatttcattgagcagtggtttgtagttctcattggtccttcacatccctggtaagttggatacctaggtattttattcactttgtagcaattctgaatgggagttcacgcatgatttggttctctgtttgtctgttattggagttatacactttttcaaaaagcaaaccaaaatcagaatcaaataaataattttctcatgccttgctttctctgttgtctcatatttatgttattcattttagatgctattataaatctaaaatcatataaatctcctattatactataataatgtaattttatctttctgagcattaaatcctttctccccatcatagaatggaaacttggtgaagactatggctaaaaaagacttatctttttggtatgctgatgaattccaatcacccaccattgcatctgattcattgcaagtggtcaatatttactgggcaaattcaaaattatcaaaattcaaaataatcaaaattataaattttaaataatatttcagacaacctcaatttacacatggaaatatattttcataaatttatagtgaacattttttctttttttaaattttgttattatactttaagttctgggatatatggcaggtttgttacataggtatacacatgccatcgtggtttgctgcacccatcaacctgtcatctacattagatatttctcctaatcctatccctcccctagccccccaccccccacatgccccagtgtgtgaggttcctctccacctgcccatttgttctcattgttctactcccacttatgagtgagaacatgcggtgtttggttttctgttcttatgttagtttgctgagaatgatggtttctagcttcatccatgtccctgcaaaggacatgaactcatcctttttgtggctacacagtattccacggtgtatatgtgccacattttctttttccagtctatcattgatggacatttgtgttggttccaagtctttgctattgtgaacagtgttgcaaaacacatacgtgtgcatatgtctttatagtagaatgatttgtaatcctttgggtataatcccagtaatgggattgctgagtcaaatggtatttctggttctggatccttgaacaatcgccacatgtcttccacatgcttgaagtaatttacactcccaccaacagtgtaaaagcattcctatttctccacatcctctccagcatctgttgtttcctgactttttaatgatcgccattctaactgatgtgagatggtatttcattgcggttttgatttgcagtcctctaataaccaatatcaatcatttaacctctttcatatatgacaacacagaaaatatatggaatttaagcaattatattgaaacacaatttaaaacagtacaagcagtgatagtatttgaaattaataggattctaagctcaaaatgcttaagtaaatgtttccatgtaaaaattggtagaagtctatgaaaagaattagaagcaaaacatattccctagctcttaatgtcatccaaaacaagaacctgtgttccttgaaagcaaaatatatgtcttattgaccttgttatgtccaggaatgaacatgacacctggttcattttgaggcttcaattcatgttttaaatgccttaataaatgaatcaatcaactaggaggttcagaatgtttaggaattgaaaattgacacataaagtatgaggaggacaaaataaagactgaaaaattatataagaatatatgatacagtaatttaataatttaatatcaaaaaactattcatgtgctatagtttcataagattatgttttattctaaactgcaagtgatattagaattccagaaaatataaagtatgtttgcataggtagattttttaaacattcatgatgaggcattatctttttccattctaaggtcagtgacctcagattcgagttgtagataatatttgacagcatcttttccccatgcctgtaaactgatctggtaatgagagaggatatcttgttttcctgtacttgtgttacatttactgaagtgaatgggtggaaaagtttgcacaggtgtgggtctgaaagcaagaggtaatgtaatttcacagaacatgtgatttgtcataggccttacagcaagggtcatagctctgagtaatcttagatctatccatctgtctaattatcaatttgttagaaatcttgcaataaagaattatagttttatgagctgcataattatgatgtcattacaataaaccaaatgtttaaatacttttatctttcaggtggccacatgctagaccatgggaaaaaaaataaaaattatcttttctgtccttactataaggcacacctcccctcctaactccctgaaatttcactctcatcagcccagatctccaccacacacccagttgtctttctctactcttcttttctcattcctctctttacacttcattgtctgccactgttattcaatggggctagtccagaactagtcctgcctctatgagcatattttgtttttcctccatgtatttttcctctcaaattatttctttgtaaataaaatttttgttgatgcataatagatgtacatagtttcaggtatatgtgataatttaattcactagcatactttgtatgatttgtaaagatggaatgtccatcatcttagctatttgtcttttttttttttttttttgagatggagttttgctcttattgcccaggctggagtgcaacggcacaatctcggctcactgcaacctctgccccctgggttcaagcaattctcctgcctcagcctcccaagtagctgggattacaggtgtctgccactacacccggctaatttttacatttttagtagagacggggtttctccatgttggtcaggctagtctcgaattcccaacctcaggtgaccacccacctcagcctcccaaagtgctgagattacaggcgtgagtcactgcacccggccagctatttgtctttatgctggaaacattctaattattatttgctagctattttgaaatgtacaataggctgtgagcagtggctcacgcctgtaatccaagcactttgggaggccgaggcaggaggatcatctgaggtcaggagtttgagaccagcctggccaacatagggaaaacctatctctactaaaaatacaaaaattagcccagcgtggtgcatgtgcctggagtccctgctattcaggaggctgaggcagggagaatcgcttgaacccaggaggtggtggctgcagtgacccgagatcatgccactgcactccagcctgggaagcagagcaagacttcgtctaaaaaaacaaaatgtacaatagattcttgtgaactatagtcacactatttatctatcaagcactaaatcttattttatgtcaaaccttatatttgtacccattaatcaacttctcttcctctctccttcccagttatccttcctggcttacgtaggattactttttttaaggcaatgttaggattggtcagagcttctaactataaactctaaaatatccattcacctatgccaatgatctactttctcaatatgaaatgttgttatctaagtttctaagagtgctgtttaattttaggtaaaatgaatgttagaaaacagcatttagagggacaaaaacaaccaaaatgatttaaaacagggttgacaagcatatgctgcaagcggtaaaacactgccccttacgtggtgcacatcaacactcagtcaaaactccttccctctaagcaaggatgcagcctctgaattcttctgagtaatattcccttggtcagataaagcataaaacttgtcttctctgtattaaaaatgtaccttttagtatatgctattgaaaaatgaaaaaaagtttacctcccctgtttgcatataacatttgttacgttatttcattttaaaaatcttgtaaagtttttctaataatgtgagtaaaacgctattacggaacttcgatatatgtgtgaaaggaaaataaatattgggaccttaaactcactaagctaaaaggaaaagtccagctgggaacttggtcacgcaagcctgcctgctattttgatccctaaataagatggctacaaagatgaaaagctatatacctccctaacattttgcccacaagtaaactccttgtgtgccccaagatttttaccttcaagcttatctgtcaaagttcaccatggcagtgtaattgatcaacctatcaattatctttgcaggtacaggggacataggacagaactcagagtcatccctctgcacacctgaaacaaatgcatatctgattgtttcctctgccttattgtctatgttatattatataaaaattcagactcactgagcaggacgaagccattaatattctcccctactgcaatctcacatgataactgtgtatttctcaacatcctgtcctttcccctttaaatttgaagccctcaaaatcatctttggggaaagtcatagacctgtctccagtggggtggggggtggggggcatccttaactttggcaaataaacctcctaaaatgagacctgcctggatcattttccttgattgacatatgcacacaaacacgcacacaaacacacattcatacatattttctagctgtaattactgcccctgcagataaattattccagttaacattgtggcctatgttcccatctgtcatacctaaataaacaagttactaaataggaaatatgcacagacacatacacaaaaatgcatatacataaacctctctatttgatgtcctgtggatttgtttccatgtccctcagtattttttagagtgtcatttgaataggtctttaagttaaaattaattttgactgtgtgaatacatgaaaaaaagtataaaaaggtcattttcatttcataatatctgttgaatttaggcttaatttaaaaataatcattaaaaataaaaacaaattttaaaaatcacctttggtaggctgaataattgcatcacaaagaagtccacatgataattctaagtacccatgaatatcttacaggtgcatgccaccatccccagctaattttttgtatttttaatagagacagggtttcaccatattggccaggtaggtctcgaactcctgacctcaggtggtcggcccacctcgtcccccaaagtgctgggattacaggcatgagccactgtgcccagccgggatcctttttgttttaaataattgaaagagaaacagcaatgcctatcaaggcagctggattggtcaaattaccttggaggacaatataagttcacagactagaaaagtctatgtgacactattgattagacaatacttcactaattaatatagacccatttcattggtgtgcagagtatacatgtttttttttcttctcagcaccctggattatatcttaagaaagatgcagcatagaggccttatcagtttttaaatgtttcaggcattaattagcaaagactctctttttgttgtcaaaatatagtcaagggaactataagaagaaactttaaagaccaagtcaatttatcttgtaaatagtcattctaaacaattctgttatctaaatattacctttattttacatgatatttatttgatataatatactttagggtggctcacttaatctttccagatttcattttacttattattaatagtatacaattattttataaaatcaaaaaaaattaagcatttactttgagtctctctgctaagctttttacatatattttgtcatttaatcctcattacaatatacaaaacatattgtcattatttctattttacagatgatgaaacagaggtgccaaaagataagtaattttctaagatcaggatcttggttagtggtcaaatgggccatctgccaaaacagtctatactgtattacactgtatataaaaagataataaaggcttctgcacaacctctcaaaacaataattaggattaaattcatccatgcattgatttctacattccatcataaagctaatggtcatcgtgcacttagaatgtgctcaccaaatattgagcgtggtgggatacagctatgaacaaagagacaggtgtttggccttatggagtttacaggataggtggaaagacatcgtaattccttagagtcataaaatggtgatgatataaaaaagaaagtacagtgagctatgataatagcagagaagagatgggtataatactgaagaaaggagccaaaggtcagttttagggagatggcatttgagctaagatacacaaaaggaggttcactaggaagataccaaaaagagaagtcatgatacataaagtcactttataaagtgttaaagaattgtaaaatttgaggcattaagcattaaaagagagttgtgacaaatgtgttgaagaaaaatatgcttgcaaactcagttgtaaatttttttttaatcatctactatcgtggattatctaaattactgtcgccctccatttatgtggataatgagttgactaagtattgaacatgtttaaaatagctgaaccctgtcttttcctggctccacacattgcctatcatatggtcgacactaaccaatctgtttcttttactgcccaattacactttgatagtgattaagagtcacatacacacatcttctttgtagaaaagggaatggatttgttcaaatgggacctcttactcaccattaagaaaatatattgtattggagtcatgaagtgattactgactgctaaatagccacgttggagtcaatcatagctggaacccttagcttttagctgtgggaaacagaggatcaaaagctataatttatccaagaaataatactgggcaatcagaggttagtacctctcatattttaattctaacttttttttttttttaatgacagagagggttcctaaaatcttttatcacatttgcactagaaaaaaaaatgtaaactttttctctgtttcttaatttcctaagctttttgaggaatgaaaatttgaaaacgcaggaaaatgtagaggcctagaacataatagacacattcatttcccaaatgatggtactttgatagtgaaaggggatgggtcacaaatggagatgggcatagatgtgttagcaaacctccttaggaaaatgtgccctaaaaacagaccgagttttgagtcagtattagctatgtatgccaattaactgtggaggcattgataggtaaatcctatttcattaagcttcattttgagaaccacaagtggtggaaagagaactgaataaagtggcttcttattcaccaatctctggactctgcttgtagttctaaagcaaatcatatttatctcattaacctttggcaggcagttcattttcacctcatttttgaaactaaattgagttttcttcactggatttttaagaaatcactgtactaaaatcaaaatacataaaattactttatcctgttttaatatcaatggattattttaattatacaaacactcctgctgatctgggtccttgtttcatcgctagaagtacttgactcaatattagtacatcacttcaattgggcagattcttatactcgattgaatgttttgaccattctcattcctattcttcttccatcctctctaacacattttgtttgactaaggctgaattaacatgatttattgctattcaagtagaaattttacatcacctttgcagacagagcagttgaggtcttgcatatgaaacacacaattgtcttacatgtaaggtcaaagtaatgaaatatagatcagaaggagaaatagctatatatgcataagcatgtttatttataattccaagagcataggtaattgaatgtattgcttgttcaagcattttgaggtgttggatacaagcctttcttactatctattactatttgattattcaatgatgaagtggttatatttctattgctctatatactcactataatatttaaatctgttgtgtaaatgactaaaggtaagtacaatctgcaaaataggctaaaatcttttttatgcaggattttatctagagaaatcctcattaactctcacctctctgcccctctttaagcataatactgattcctaaatgctgcaatacctttaggtggttttttaatcataaaataaatattaacttatattcaacagtttttggttgagtgaaatactcatgaaattgataagccacagagggtatgtatgtgaggcaaggtatatatggtaatttgccttttaacaagtcccttaaaattaccagaaaatcaaattttcaaacaacttaccagctagtttacctgaattcaaaatagaataatcttctttaaaataatcatctctatatactcggctaaatcacaactttatatttgaatttatttctcccttaaaattaggatttcagaggtgaagttgtggtcatattaatggtgttgaggtagtcctaatgttcttacaaaaaacacatcctctgtgaaaaacttacaataatggtcctaggataagaatggaaccactaaggacaaaatctaatgcttttccttttcctggcatttgactatttcagagtttgtttattccacttcctaacagcacttttcagtcatcaatattaattgaatactttgttcacatcattataataagaactattttaattctaatatattctgttctcaagaatacaacatttcttaccactcctgccaacctctgcatgggagaagagaggatttggaggtatagagaggatgagtaaaaattttcagcagaagagttacaagtttttaatatagagtctcttaaagactgcaaataagattagagagtcaaaataatcttacactgtttaaaaatcaagactatccctcacaaaatgagagcaagctctttaaaatgaatttaaagtttttaacaaccgtacaccaaaatataatttaaaccctattcattaactttaaactcatgtccaaaaaaaaggcgttggaataatttattagaaaatatggcttggtaaaattttttccatgttgctttggaaaactaccacaaaacacaaccaataactattaaaattaaataagtcattaggaatctccaaaggaattcacccataaaaaaatcaattgagtaaattttttacttattaaataactgaagcataagaaagacataaagaataatatagtgaacttccatgcactcaaaacctagtttaaatatggaatattatcaataaaatttaaatccactgtattgcacttccaaaatacattatcctcctaccctctcaagtactagccatttaatcggtaattgcaattttcatgctcttcctacatatacaaatatccctaaacaatagataacattgtccagcatattttaatacaactgggatcatccattatgaatgcttttgcaatttgcttagctttacctttgcagaatccatttaatgataaacatttgttgctatacatcttctatttatcttttatctctatgtatatcaaatattgatagacatttcagcaaaatacatttaggattttctaatttctgactgttaaaaggctaagagaatcaatcaactttaggttcaaattcccaaattccaatcttgtcctcttcatcacttttatgaatgaagcctcttggtttccggtttttaataaatgtgcacaagacagtcacatttgattcctacctcatcgtagtatttgcccctagagattttccttaagttctttgactctcaaatatgcttttacaagaatgtttattgtattttacttagcaattttatcttctattcagtttgtattaagaacttgttttaaaataccttatctgtcatattactagaaggattatatgaggacactgatgaaacatgaggctactgctagggtgacgttatatcttcatttcttttgtcacttccatcttcatgtcattttttactgtggcatgggaaatgcatctgacagttctaatggagagaaggaaagacatgagaaggatgtgtgccgtacgtgctttgtgtgtctagtacatatcataattttgcatgtgctcatggtactttcctctgacttcagcatgtgtcccattgtccttgatgaaaatatgctaaaatcaatttttacattgtatttgctaaatagatgtatacttcctcatgcaaggcttataaatgtattatttctcttaaataaattattcagaaaataaatttcttagaattgtaaatcattatatatttctactttggcaaattttattctggcaaaatagctcagttattttgagctagatgtaaaattctacaaaattttgacatttacttcaaagtttttttcatataatttaagttattaagaaacgtatgaggcaaaatatgtatcttggtatttaatagagcattgtgtgaaatttgtcttcttgggatattagcaagcaagcaaaactcaaaatgctatttttggtcaactaaatttgggaactactcaaggtactcagacttcccaggttcaatactttgctaatgtgaactgttatatttttaaaacatattgcaccatggaatgttttgttaacaattgagagcttatagaacttctgttctatagacgacactttagaaaatactgctatatttcttttcttttttttttttttttgagacggagtctcactcttattgcctagactggagtgcaacggcacgatctcagctcaatgcaacctccgcctcctgggttcaagcgattctccttcctcagcctccagagtagctgggattacaggcatgcacgaccatgtccggctaattttgtatttttagtagagacggggtttcaccatgttggtcagggtgatcttgaactcccgacctcaggtgatccgcccacctcggcctcccaaagcgctgggattacaggcgtgagccaccgcggccggccgctgctatatttcaatcctttaaatatatacttaaaacatagagtatgaaagaaacactatgatatactactcattttaactagtatgcgaatttgagatgttaaaatctaggtaaatattgtcagtagaaatttaatgattgtgtctactaagttaaaatctaaagtcgtattagagagtacactgagatgtacactgggaatgatatggacttaaaatattaatatctattaagcgaatatattaacataacattccaaatttttagttcatttgatttccatttttggttgtcagggttttgagggagctttaaataaaagagaaaattgccttttttttttttcaggtatttgttttgtttgtatcaaccaagctctgaactgcctggccacaggctagtgtggcttcctaaaagcctattcatacacttcagaaatattagcaacaagaagtaaagtggtgaagacagtgcctcaaggagattatttatctatcaggaattgtctgttccatgctgcccatgccaaaggtcaatctgatgactttaccatgaagggatacataagactcactgaatagatatttctctcaaattggtttgttctatatactcaaaatgatatttgaaaatgctgtccagtgatatttgaataattgttctgtagggttgtatacttttaaaatttacacaaatttcacttattctgtcattgttaaataaaactatataggcacttaatattcccattatgcagaaaggaagactcagaaaaaggatacataactacagttgcagagatgaacataatgcgtttttaccttaaatcttattttttcctaaattgtgagtagtggttttccaaacattatggctcatgtattcataaaaatgttttttttcttttttctttttttttgagacagagtctcactctgtcgccacgttgtagtgcagtggcactatttcagcttacagaaacctctgtctcccaagttcaaggggttctcctgcctcagccttctgagtagctgggattacagctgcctgccaccatgcccggctaatttttgtttttttagtagagacgggggtttcaccatgttggtcaggatggtctcaaactcctgacctcaggtgatccacccacctcggcctcccaaagtgctgggattacaagtgtgagccaccacgcccggcccataagaacagttttaaaaagaatataggcaccaccaatatttgtgtactattcactttcacttataaatgatgtaaatatactactaaattatattagtgtttatgtctttaaaacaaagcagaaaacactccaaaaaataagaaaagaagaactagcaaatataacagaaacataaatcctcatctatttctcctagaccccctagatcattttatgtactgaagcactgtacaccaggtatttttgagaacactgcttaagggtgtgtttatattagatttttctgtgtttgatttgatttaaccatcacaaaactacatttttgagcactctttactagaaaaaactattttcacttggattcgttccttgataataattggcactattattcagaatgaattctagtgttcaatgccttgatttcaggacttggcttttacttgatgcatgtcaaacagcaaactatttaacctctgttcagtgccagtaaaatggaataagattagcatttacatggtggagttgtgaataataaatcagctaatacgtatgcaaagtgcttagagcagaacttggcacatagtaaatgctgaaaacatactggtttaatattagcattattatatccttttgtgctggtaggaaagtttagatatttttgtttctttaaagtgaaaacaagtttgttagagaattaaagaaacaaaagaatggctactccataggcagagcagctggagatgcttttcaaataatttaaaaacaacgactatgcataaagtgccggaataggcactaagtatatgcaatgatgtgaataattttccctgacattaaaatgccttgtgatcaaaacccatgaggtcactggggactttttggtactgtattaaagaaaaagaattatataaacagaaatcagatggctattccaagctaaagaaatattccaagctaaagcaatattgaccaaattgataaaatagcaataatgatatatctccaggtactccatagtcaaaagcactaactactgtgctcaatacttggatgagacaacctcatcagaagactaatatttaaaatgcaagaaagctacatatctgatagaggacaaaaccctgatctgattatctaaggtatcatattatcatatttatccacaaatatgtacatatattatgtatctatgaaaaatagcatggtgagataatgagattctacataatgaattaacagtgttttgtcttcatcaaaagataatacttttgtccagaaattcttcaaatacagaactaagcatctttaatcatgctaattagcataaatttaatgcatggtgaacctatttgggaataaagatagcaaataaataatgtgtaagttttattaattattctgaattttacatcttatagggtattataatttcattgatcaatgaagcaatctttgttttaacatctaattacaaatattagacagtatatttactttagtttggcaccctagtatttatgaaacttttttattaaatagctgcaatgtcaatgaattaaatttgaaagatttatgtctcttagcatcacattcaaaatagcaaactgtctgaaaaatttagagttagaaaaagatatcctgtgtttaatttgattattatattctactattagctcagtatacaccatcttaagaaaagtacacatatatatataaagtttttaatctgaaatattatactgtaacataattgcattttgtgcccaacagaattgcttgttcatttgatagaaaattaatatcattaaaataagtccactaaaatcatatattttgagcttcactaagtaatgcatattgtattatgttgtatattgttttctgtataattatttagtaaacatgtgtatcttccatggttgctggttggtatactgtagtatgcaaaggtcatttgtaaactcatactttgccatagaattcacatctttgttttaatattactattgaaatgtgactggctaagttgttttttccttgcctatgtgtgtatatatattacaagtctaatacctaatgtcacaatgtggaacaacggtaccaatgcaaaaggatttttttcaaaaatttggaaattcttagttttatttatatcatgagatctattgttaacattataatattcattgttcagccatcctttctacataaattaaaataatgggaagatgtaggtgcaaagattgtgggtgaacatggtgtatgtatgtgtgcatttaatttttttaagcaaagtaatacatatatgattataagccatgtagtaaagaagagcttataattaaaacagttacatctcttctcttctttattcccccagttttactccccagttgtaaatattattacatctttaagttgtttcttctgttaatttccttcccaactcttggtaataagtaaatattttaaataaggcccaaaagcattttgtcacttttaaatctcaaaaaatgctaacattaaaatgtacctaagcttttcagtaacaagaagattttggcacaaattattaatctcttttctttatttctgaaagcaaggaagaaaagcagtattaactggcagtgtaatgggttgaacataaatctcgaaaatatctgttttataattaaaaataattgtgtgtgctgcagcgaactaagttctgcagtgtaattaaacctatttaacatacattaactctataagtaatttgcataaattattctgcttaacaattttagtgtacactaggggatactgtgatttttatcaatgcattctattcactgaatggataatgatatggttttaaaagttgagatgtaattataacccccatagaagctccaaatcaagagtgttacaggctgttggaataatttgccaaattacagggagaattgtatatgttgttttgaaagctgcatttgaatcttttatacaaatttttggccaatgtcagctacagatttacatttttctcaatgttccttttcagatctattagttcacgttaggcttttattaagagaaattgcattatgcatagagttctatataactattgtcataatttgtcctactgaaaaacgcagatactgaattttatgtgatacatagtaatataataaaactagaggctggaaatttgagttcttactcttgatttggacactatcaggccagtcactcagagcaagttggattatcaatcctggcttcagtttctttgcctatgcaacacaatgttattggactttaataaaaatttagaaagggtattttaagtacatcacaaaactcatcacaattagttttatatgctgctccatttattttactatatcagacaatgtcatgccattgctagccattctgcagggcatgtcattgtctagaaaaaagactttaatccacataacatgtcacattttcttttgttccctctatcattctccttctcttccactttgcaaaggcaaagtattggaaaggacatagagttgtcagagagtgtgagaaagaagtcacgacatggcatgcaccagcttttctcttgtcccaagcagccaagaaaatattacagaccagaagttttctaatatttttttgaatccctttagattcataaaaattattgatgaccccccaaaagctttatttagcacggtttttaatctaatgatatttactgtattaaatattaaaatgaagatctttgaaaacatttacattttgttaactgataaaagcaatctcattaaagggtcctgtaaaatttgtcattaaggccaggcgcggtggctcacgcctgtaatcccagcactttgggaggccaagacgggcagatcgcgaggtcaggagatcgaggccatcctggctaacacgatgaaaccccgtctctactaaaaatacaaaaaattagccgggcgtggtgccgggcgcctgtagtcccagctactcgggaggctgaggcaggagaatggcgtgaacacgggaggcggagcttgtagtgagccgagatggagccactgcactccagcctgggcgacagcgagactctgtctcaaaaacaaaacaaacaaataaacaaaaaattgtcattaagaccccttattttgaaagtcaaaaagtattgagaagattggcattgtttgacattaaaatttctatattgtatggcttaacagaagacaggtagattcttccatctgctttcaatctgttgtggtatctcatgtcatggagcttcttgaaatcttcactgtatactcataagagaaaagagtgaaaaatgcaaataaccccctggtgttatcgaaatagtttgatgtcacagattttcagaaagggttttgttctcagaccacagtttgtgaaccaccgatgtagacaagggtacaggggtaagttacaaaatgctgtgctttgagtagcagagtggacagttgggtgtggggcaggaaaaaaaggggctgaaaggccaatccctgaccacaagtagcatgtatacagttgtgtctactatacacccgaaataagcattcaaaatgcacagagaatcagtaaagaatctgaattaattgatacccatttctacttggaaaagaaacaaaattctatgtcaaaatctctattaggaacacttactattatatgatcgttcattaacttttaccattcctgttaggtattgaatagtattatactatttaaaagaataagagtcaccacttttactaaaactcatgataaggaaccaaggtaagcaagaattaaatacctgctcatataccaataaactatactgaggaagcagagattaaggagaaagagcatggagacatgagcaaggctcagagcaaattagatgggcacacatatttcttctatgcagagaacaaaagaaaaagttatctctgattatgcaaaaatgaaggaaatgtatcatggttaagatgtcagcattttcatgttcatgttttcagtccaggacagaatctggagaatggggtcttctccatcaacatctagtcagcaactgccacagcttaactaatgagatgcttcaggatccactggtggctgatttcataagaaaatttgtacataagccaaagcttgagctaatcgctcaacaatcatactcagaaaagagaaacgtactagtgaaatgtttatttcactaccataacagtaacaatttctcacacttacatggagcttattatatgtcaggcattgccctgtgaactttgtgtatttcggccccattgatcttcacaacaatcctctgacagagaaatttttttttttttttttttcagatgagagaattgaggaaaagagcttttaaacccaggcagtctggctccagtatatcaaaaggaactgagcaatgactgaatctgggcaaagctatacaacaaaagaatatgtagaaggttttctaaaaattcaatgtctagagaagtctacttcttgaaattcttactcttacacacgaattttctctacctctctcagagcacaatcgagtgataacagctggagtaaaataactttgtcagcccggcgtggtggctcacgcctggaatcccagcactttgggaggccgaggctggcagatcacgaggtcaggagatcgagaccagcctggccaacatgatgaaaccccgtctctattaaaaatataaaaattagccaggcatggtgtcacgtgcctgtaatcccagctacttaggaggctgaggcagaagaatcgcttgaacccgggaggtggaggtggcagtgagccgacatcgtgccactgcactccagcttgggcgacagagtgagacttcatctcaaaataaataaaaaaataaataaataactttgcctagtctcttcaccactgtatctttagaacccagaacaatgactagtatagaacaggcttttaataaatatttttggaatagaagtctgctatttataatgtaagtttatatcagaaattcagtgaagtacagctggaaagtgaggttctttgtttagttttgattctccagcaactctattatctatctgttgctaatctctagattttctgatttattttttctcaaattttaatatttatacaacaaattgtgaatcttgttaaaatgcagattatgatttggaggttcttgaatgaggcctgaagttccacatttttaagaagttcccaggtgaggtcaaggctattggtccaaggacaactctttgagtatcaaagtcttaaaagtaaataatagatatgactttcagctttaagtaaatcaaaatcacttacaagttataataagaaatagtaaataagccctctgtgcatcaagatttctttacacacttcccttcttattttcactgtcgccattattttaggacaaactgaaaagtgacatttctcactgctactggaattgtcacatgtgatgttaaattcttcaagctccacttggggacatggtgcaatgatttgtctggatatttccaactgtaaatgttttctctatgaccttttctatggattaaacacaaatcaacacatatttaaccatttgaaaaggcaagatatcttacagttaaaattagaatggaaaaatgcaaaatcatccacgtcaacatttttttggattcattcatgattccaggatttcaatagataaccattgtccaaataaaccaataaaatgtgaccccttatgggtttttttgcaatgaaaaggtcaggcttgattccattcatttcacacatgtagatagatgctatggaaaattttaaagaaagtaatcagtatttatttagcaaatactgttacgatatttaattgcttctggacactattctaagtattataggaattttttttgcttcccaggcataacttcccaatcaatatgtactattattattgcctccacattttcgggttttttttttttttttttttttttttgagatggagtcttgctctgttgcccaggctggagtgcagtgacgtgatctcggctcactacaagctccccctcccgggttcatgccattctcctacctcagcctccggagtagctgggactacaggcgcccgccaccatgcccggataattttttttgtatttttagtagagatagggtttcaccgcgttagccaggatggtctcgatctcctgacctcgtgatccgcctgtcttggcctcccaaagtgctgggattacaggcatgagccaccactcccagtctattacctccacgttttaggtgacaaagccaaagcactgcaaagttaaatatgtcacccaagctatagcatctatttgatgggctaatcaaggactctggcttcagcatctgtactctaacagccctgacttcaccactatacaatctatgcacgtaacaaaattacacttgtaacccatatatttatacaaattttaaaaatctgtactcctaactgctgtactccaggctgcttctctttatgcatttcttagaaaaatatatttgaaattttcaaagagttgaaatattctatccaactatatctttaacctcaagaatcagacttcctccagcaacttacatgtcacagattgaatatcaacaaataattaagatatagaacaatcaggcctacaaaattgccagggaagtggggcatggtctttcttctccatcatatcccctgggttcacattaattttcactgagcatattctgctataataagctaatctattatctctattaccatacgatatctatattttcgtagctcactaaaatttcagaattacatttccaattgtgcattagacatccccacttaacgctgtacaatggtaagagaaagtaaacatatcaatctcctacaaagatgttctttgtcgaaataagccaataagcgctgtgctgaatgatattaccacctgctcattaattaggaatctcagagacatcttaacaattctctctttttttctttattacatcaaagtgtaccaaccaatattaattttacctcaggcgagactacattagctgaaggactcatcatctcttctttggactattgtggtacctcctgactttctcatggctcccagttctccaattattctttgatactctcctcagacaggctttttaaaaccacatacagtctttccacttgcaggttaaaaaatgttaagttgtccactctgcttatagatttaagcccaaactacttagtaaggcatacaaggacattgctaacgtaacccctgactatgtttccagccacagtcccaactatttctcttcccaagtagctacatcagcttctcacttcaacaaaccatgccctttaaaatcttcttagcacacactttttctgttctgtctagaatattcctgtccatattttcagcttgacagtttttatttattcttcaagatgattctttatacttgaagtattttcctatttcctcaagtagaatgtactttatcactgactttctatcgtactttaaatgtattttctgagacactccagattatcgacttctagcaggcaagggattctctcatagtttttagaacataagaggagctcagtcaacatttactgaataaataaataaaaacaaaccattaggtttaaccaatggttttctattttctacttcataacttttgatattgaaataatagttcaatagttaatactacaaataatattaattataataaataatagggcattttatctcccacattgctatgtcaataatttctccgatttggatggaaaatatttgtagaaagcacagcaatgagagtaaattatattaatagtttcataaatccccaaaatatcctctactctgtttccatagtcatgcctttccagaggggagaataaactaaacagtcaaatgcagaatggtgtaggctgttgactgccaagagaaaggaaaagccattcatgttgagttcaacatagatttcattatcaggaatgtgctaaaaaacactgtcactgctgtggtcccaatgtaggtggtttgtctgacatgtgggaggctcatctttggttgaaacatgctgtagtgctgctgatatatggctctgcgatgtatgcttccctatgccatctgtaaatacaggtggttcctgctttatgccatgatctctttctggaaacccaactggagagaaaacaatagcaaacattattttctgtacattcacataaactgctatgtatacagaatacggaaggctcataaaggtgagaaagtttgcagttatcattttgacctctagatggtgatgctgctctggtttgacatttgcactataactcacattgctggagttgcactagattgttgttcccaggacagccaaaaactgtggaatgagcacactataccagacaaagtggatcttgagataagcaaaatatagagatgtaaagcagtgaattgttatacttaagactaaatagaacttttactgatgtatgtagactcacaacataaaattgtcatatttgttatttttgctatttttataattataatcatgggaattctaattgtgaaatacatctgaaagtagatgagtgatgtaatgaacctccatttgctcacaactcagcttaagcaattatcaagacacaacctatcttgttcatatttattgccacgtacttgctccatgttttgatgccacatacatacgtgcactaaaaaaactcataattctccttggcaaaactgactttgtgaaaacattttacttgaaatcactctttgaagagaagactatgagtatagactattaatttttgaaaagaacaccaggataatgattaggaagaaggaagtttcttggctttatttcatgacctgggtggtgaatacatgggtgggtttgctttgctgtaattcacctagacttataacttgtgtacttttctgtatacatagtttattttcacaaaagaaaaaagaaacagacaaacataaaaaaaaaaaaaaaggacctgtgccttatatatcctgtcctcttgatagatacaggtttacaatgtagagtagctattccttattgaaaaatggaatcacttagagtaatgacaaaaatgtatttaacttgcaagttaagagagaaattaaggagaaaattcaattgtgccaaagccttccactgtctttcttacctaaagggtaacgaagaaatccttggtgtttaccttaagaaaccctcttaagagctcaagtcatcttgacctttctttaaatggaagatataataatcataaaaggaagagttctgcccacttccttgcctacctctttacctactgtgttaccgtttgagccaaccactgccactgggttggtttgcagctttgtggggatacaaggaacacaaatacttgagtaaaataatgttgaaagtttcacgtcctggaagcccaatggggaaataaataacaagccaaaagcaaaataaaagtgcaatgattgtaaaagtaaaaagaattaaaggagataagtcaatatgaataaaagtgaaaaatgagaaggcggggagaagagagtatgtaagaagctgttctcacttgccacagatgcctttctttactactcctttgattcttctctcctctaagctcttagagtgttcaaagtgttattttatgtcaagaaaggcaaaatgggatacagacagtatctactctaaattcagacaatgcttgattggaacttgtaggaaagtactttacctccttgtgttttagctcccatagctataaaaaagggttaagaaaatctgctttacatgtatatttcacttattagagacaaaatatatcagcacattgttggtgatcaatgagtaacagccattactgttattattaattactatcatttttatgtttgttgtattatctaacttatatctaatagtattagaaataagctagggctatagcaggtgttttcaaccatagacaagcataatttgagtgtaagcagagacagccttaggggctatatgtgctgcctttgacacatattggtaagttgtctttaaaatatgtaagacaaaaatgatgagttttcctctttatatgttgttttcagtagtgtatgttactgatattcactaattttacaatttacttagaaaaaaagagagtaaatgtaatacaaaaagaagttatctaactcatagatagaagacctacaatgtcttctaaagatatctaatgaaagacttagaaatggattttctttgctagagacagtgatgacaccttacttgtccttctatttttgttctaagttcacctactgaaatgaaatagtacatgatggatagtaaataatacctctcacccttctcaggaatacattcaatgcaatgggttttgtttaaatcgataaattagaggtgtttatttgaaagcaatgtcattaaagtaatagagttttaatgcaggatacagaaatattagaaagaatacagaacattgtaattgagtaattttaggaaatttctgtccttttaaaggtaggctgtgattactagatattaatctcacttatgggaaggaactaaaaagacttatgatcaagtctagcataatcttttcttaaacatatgatgatgttaatattacaaaactcagcctgggcataattagacctattttggaatgctaatggaaagacatatggcaaatcatgatacaaaaatttactgattcatagaaggacctttcatcaacatttttacctaactaaattagtgattttcttgagcttaaaaagatgaagtagccagaggatatgattaagcagcaaaacacacaggacagagctattttacccattttaatggcttcagtcatatctgttctggggaatatgtgttttttttaattatgtttgataaaattaagcaaaacaaaaacacagtgccaagtgtctcaacttaggcatgcaccatggttaaaaaaattgtgctaaatttgaagtcaaaagatgtatagactagttcttgtttctccatttactagctaataaaacttatgcaaattatttttcctcttagggtccatttatttaatgataaaataaggagtttagaccttggcaaatactttctaaaattcttagcagttttaacagttcaagatgccattatcctttattttctattcaattagcacattgcatctattttcccaaaagatcaaacatgaaatggcaggtgtgcttcaattctcatagccaggcatctagtgttcttgtcctggtggtgtggtggtaatggcggggacagagtggagacagtagtgagagaacaaagaaagtaggtgagacagctgagtgtatccatacgaacagccacaattgtaatagcaagtacctaaacacaactttgaaagccaagtgttttctagtatgtataagaatgaggctagtggaaatgaaaccagatgatttttaaagaaataccctaaaaggaaaaaattcctcttctaactatcagcccatttaatttggttcttctaagtaataattgctgactgctgcctagtcgccccattctctttttctatacactgaatatttcaccagactgacggcttctggatcagacagtaagtcttgaaagctaatcttcaatactttccaaaagaatagcattaagtgagctacacagcacattagaattttttaatgaataaaaaatacctatctctcggttaagttttaagaaagcataaatagcatgtcatattaaatagaaacatagtgtcaaaaaaagaacaataatgagaacaagtagtgagcttgtgcttaattatatgcgaggcattgtcctaatactatacatatattatttcatcaaactgtcatagccatattatgatgcaggcactattattatcccttttctacagatgttgaaactgggacagagaaagatccagtacattgaatgaggtcttacagctcacaatggaacaaagactgaaacaagagacttgaaccatcacttatttgatggtttgcttatcagtaggacgttgttaagtcacatatttgagaacattatttattttcacagttcttatgttgaaaagcctcacttatctttttcttctcattaaaaatgtagtgaatgtaatcagtgaaaggaagtattagaacgcatgttcacaagcaagccacttaactgtgctttactaaaattttcaggtgaagagtgactgcattaatttaattttcagcggaagacactaacgctgtgaaatattttcctttcttggggctattctatttttagtgtaagaattctctgacatagtacaatacttactgtttcatgtcaacctgaaaatcaaacggttctatactaaacttctacatgtttggccttgggaaacatttatgtagaattttgaaatacattgaaattgaattaatcaaatcaaaaattaaatgaaaatacattttgaattgaagtctttctatgaaatttctgcagacagaatattttactcatctaaatatatttagaaatcttcaaaaatataccatgcttaatatttcataattaagaagctagaattttttcttaaatattaaaaaattctacctacatgcatccctttttaaagtagtctgaaaagtcagtttgatggtcccatttcctacctaatgctgtctttgataaaagatctcttctctcctgagatcacagatgcagacatataatgagtttctctgtgatcaataatcctcacccctggtctgagtgagtgttcagaggagttaaacatgtgatctttgcctgaagtatttctgtttgatggaattggcagaaaatatgcctcttttcaaaatgattttaatatttttctcagaataaaataggtaaatttaaaatttaaagttataatgaaaagcattagtttccctatccaaccaaatttgtgcttctcagtgatcatatttttcaacactttcagcttttttctattattatatatctccatttttctaaattataggcttatgctcttattgtaaaattttgaatgttagatattgtccactgaagacaatatgaatgatatatatttaaataccttacagtctctcatccacacatacttgctgtcttccatgcaaccaatatagtatagtgacataaccagttgctaccgagggtttatgctactatcgttggctatataactgagttgaactgcatattagtattatgtttattttcttgtacaactttttcctcactgtttcgctctatttttacatcttacttttcaaattaatattgtcacaaaccttttgataccatttaaaatgatatctggtattagctaccagagcactttgtcctcctgctccaaactgaacaagttatttatctgtctgttgagtcctcttcagaattccagttatcattatcttggaaacttcttctcttttctcctgtaatgaatattcaattcccttaacccaactctccctcttgtcacactactccattttggtggagatcatctcagaacatcttcctgacaaatatacacatgaagtaaatgtgcacatttggaaatatagcataaaggaaattgatcatttacatgattagaaagttggctgagcatataaatttagtatagaaaccattttcttggaatattttgggagcatatggtgtatgtctcagaattacatacctactgccttgtacctctcactgttgctggtaaaacagctgattgcattttgattctcattcctgttatgtgatctactttaactcttgggtcatggaaatgacccaactacttcttagttgaaagatgtgatgctaatggctaacagctatttatcaaccacatgcacagtggggagtagggcacagacaaaggagtttggaatccagtaatggtaggagaaaatggggccaacacaaagtcagagcaagtgctgaaaatagaaagaaagaaggagaaagagaataatttttaaaacagactttagtacaatacagttttcttttcattttgaaattcattaataactgctttattacaatgacctcccttcctctcctttagatttccacgtatacttagtagtaatatgaaattatatgataaattattcatatcaatgccctctgttttgttgtttgcattatttgacaggttttgagtaggttgtaaaagtgccacatgcctttgtgtttctgattagtattccttttgttcctggaagtttttgcttagatatttttgtcatgtaattcaggactttggatagtcaatgacacatatctggattgtagctcataccacttgttagtaaaagagtgccgccttgttcctgtttgccttgaattcttaccttaaattttactttgtctgccattaacacttttcatacccatgacattttctattacctttgcattgctgcctttccttttactctaaacttttacatattccattacgtcctagagcctccatcagtgcctggctcatggtgagtacatagtgagtatgttacaaaatggataacttgtaagttcagtcgcttcatgagtttgcaattaactagcgttcttgttaatgtttatatgcacaaaatctcattacaaagtgtgactagcttttaggcctaaaggtagaaccaaaagtatgcaaaatatttgtttttatacattattattattattattaattattattattgagatgtagtcttgctctatcacccaggttggagtgcagtggtgcgatcttggcttccgagttcaagcaattctcctgcctcaacctcctgagtagcttgggttatagtcacccaccaccatgcccagctaatttttgtatttttagtagagacagggtttcaccatgccaaccagactggtctcaaactcctgacctcaagtgatccgccagccttggcctcccaaagtgctaggattacagcttgagtcactgtgcccggcctgtctttatacttaaaaaaaaaaaaaaaattgatgaagtttacaaaaattcaacataaagcataatatatctaatgggttaaaagtgaggttaatctattcagactgtgagtaaaaccaataaaagtaatcaactttatagagtcaaataaaaaatttcattgcatgaattgatctgaatttagcctctactgaaaacctatttatgttttcaagtaactttccttgttctctatacttggacagttcttggaatctaacattcagattattttgtatttgaatacaacttaactttcagtatatgagctttgttggcctcacttatatatttactcatcattaattgaatcatcaccttgtgaaacagcatacaagtgtttgaaataagtagctagaactggacactggatcattagttaagctaatgcccttcaataactgtgtgaagtcaaaggaaaatagaaaattgtgtctcttattgcaggaacctgagccttttccccagctataggcaccttgatgatctttgcctcaatttctcttttttcactctttctctttccaatatctgttcttcttacctttcttgagacataccacctttacgccttgccatatttctcagtttgtgtaaaaatcagaagatttgtcaataccaaacccatgtttcaacatgtcaacaattagctggagcttagcagctgctgactcctgaagccaaaaactacactcttcattttaccatattttattccctatccacttcatttatttacattatcatcatgttcctttaggttgttgagttcacatcaatcacaggcatatctacctggttggtgtttggtcagatcatcccccgaaatatctgtttatatcaacattttcaggccttaatttagtacaaatactatgcatgcctctttagctgtgagatagataaagtagttatgtataagttatgtataagtaggaatccttaggaaagcccttttgagggtcctctttgcaaataccaacatagttattagttattaaaaaatttccctttctggtcatcaaaatgactcttgaattagttgatgctataggccttaatgcataaacaagtagaggcaattgtgtcaaaatacagaagtttgaatttgcaggcaggtgcaatgtaagaattataattgtatttgatttaagtgatagtgcattatctaggggttaaatgtgcatataaatatttggctgctcttgataaacaacataactagtccagttggctcttcccttgatactctttcagggaaaggctaatgcaaaaagacaagcactctggtccgtgcttgttcttttccacccgccagaacttgcccacggaataactgtctctttcctgatcataggagccacactcagatgcctcaggaacccacagatcatcagattaatatatgaattggaattgaattggagaacctaatcctgcctacgtttagtgtcctctcccttcattttaaaagaagtgggaggtggtaatatgaagcgtgatgcagttttccacacatttgctagctccatgttctctatgattggaaaggacccacttgattagaaaaaaatgaacctcttctaattcataagtaaaatatacttcttctgtaatcagttaattttggtggggggcggtatatatgactacttgaaaacagtactgatgtaatttgtgacctctcactaaacagtcattaaaaatttcaaatttgaaaattcaccctatgctcaataatttggaactgcagtgaaacattgggttacagcagcatgggatatttatttcatataattgtattgaactatggaaacatagaaaaactagataaaaacatctttgaattattgttaactacaggtttatagaactgggttgcttatattaaaataggttctttatgtaaattggctggatcaataagcaaggttcaaagaatctgaaaaaaatagacaatttactttttctacatggcaacatagatattttcagaccacttcttactggggcaagtaactaaatttctaagtagaggcttgtacttgcattatcatgttgcttgaccaaggtgatttgtatgcttaaaattatatacagaatgctttgggggataattctatgcatgcagaactggatctattttaaaactataagtctgatccttttatttctttttactgtctacgttattatgtgcatttctggttcaatttcccaagttacaaggtaccttcatgtcctctgaatttaataaccatgagactacctaattgtcatttcagcctctttatagcaagtgaggagaagatatctgaaatgtatttttaaatattctttaatcagacatgcgatgaatcccaaagcaaaaccatgttagtatgttctatctttgctaatcagattcccttggaaataacaaaaagaatagttcagtaatttaaaaactggcacattattgctttaataggaattgtgaatattttatcaccataatccccaatgaataattctgctttgttactttccctttgaggagaagagtacttgaagttatgatatgtggtgatagaatatctggaaaacctttgagattttttaccaagtgactctgaaaatcttgggtattctcttcagaataagagatagtgttcacaatgtggagcaattatttgtcaaatttttctaaatattgagattagcttatcgtgccctattttgaatttgcatttatcctttcatttgtttcaaatctgttgcatattaactagctttcttttaagtctctaggatttcttcattaacatagtatctttgccttttgttataatgtcatacactcttattcacacgatatttttatcaaagatattttactgacttgcctattctgtgtaagggactatggctgataaagtgttgttcatctcatatttaatgtgcttccctgcatttttcagaatactttgtaattaggtaaaggttataagactagttactactgatgtgtgatgagccaaaatgaatgaagtcatttcttatcaggtattattaattgctgatatgctacctgtttttttttctgtttcctgctgcattaccttggaaactttggatctgaacagtgcagctactgtggactatcctgttcaataaagaaacagttatgtacagcataagaaaactagagcaaaggaaaaattatagaacaaatatggttatttaagaaataatattaatatattaaatgcatgccttgatattctgcttgccttctagaggggcctcaaaattcattctaaatttgtaagtagtaaaaatgtataaaaaggaaacataattcgttacttgctttataaaaataaccagttgattggaggaaagcaattattactggaattaagacaggcagaaaatcatccccctatctcatagacagggtatcatgatctaaacgaacctatttattcttcaatgctatttaaatacagagccatgtaattttgcagtcagagaagataattctaaaatttatttggttatataaatcctcaaagcacatgactctttaggttatgtttttattttttaattgtattttttgtgggtacataggaagtgtatacttatgaggtacatgagatgttttgatacagatatgcaatgtgtaatagtcgcatcatgtaaaatagagtacgtaacccttcaagcatttatcctttgtgttataaacaatccaattatagtcttttagtgacttttaaatgtacaattaaattgttattgactatagtcaccctgtagtgctatcaaatactaggtcttattcattatttttattttatttgtacccattaaccatcccccccttccacccaccctctattaccctttccagccgctggtaaccatccttctactatccatggctgtaagttcaattattttcgtttttagatcccacaaataagtgagaaatgtgatgtttgtctttctgtgcctggcttatttcacttagcataatgatctccaattccatccatgttgttgcaaatgacaggatctcattctttttatggatgaatagcactccattatgtataagtaccacattttcttttattattattattattatactttaagttctagggtacacgagcacaatatgcagttttgttacatatgtatacatgtgccatgttggtgtgttgcacccattaactcgtcatttatattaggtatatctcctaatgctatccctcccctctccccccaccccacaacaggccccggtgtgtgatgttccccttcctgtgtccaagtgttctcattgttcaattcccacctatgagtgagaacaggcgatgtttgttttttttgtccttgcaatagtttgctgagaatggtggtttccagcttcacccatgtccctacaaaggacatgaactcatcattttttatggctgcatagtattccatggtgtatatatgccaagaatggcgatcattaaaaagtcagggaacaacaggtgctggagaggatatggagaaataggaacacttttatactgttggtgggactgtaaactggttcaaccattgtggaagtaccacattttctttatccattcatctactgatgggcacttaggttgttttcaattttggctactgtgaacagtgctgcaacaaacatggaagtgcagagatctcattgatacactgatttcatttcttttgggtgtatatgtgggagtaggattgttggatcatacggtagctctatttttagttttttgaggaccctccaaattgttctccatagtggtcgtattaatttacatccctgctaacagcatatgagggttcccttttctccacatcctctccagcatttgttattacagcctgtcttttggatataagcattttaaatggagagagatgatgtattattgcagttttgatttgcatttctctgatgatcaatgatggtgaacaccttttcatatgcctgcttcttaaatgttctggttatttatctcttgtctgatgagcaggttgaaaatatagtttccagttctgtgggttgtctctttactttgttaatggtctcctcggctgcacagaagcttttaacttaatgtgatcccttctgtccatttttgcttaggttatctgggcttgtagggtattgctcaaaaaattttgcccagatcaatgttctggaagttttccacaatgtttaattgtagtagttttatagtttgaggtcttaagtttaagtctttaatccattttgatttctgtatagggtgagagatagtagacccctatctctagtttcattcttctgcatgtgaatacccagttttccaagaatcatttattgaagagactgtctttcccctcagtatgttattggaacctatatcaaaaatgagttcaccataggtatatggacttgtttctgggttctctattttgttccattggtctatgtgtctgtttttattccagtgccatgctgttttggttagtatagctgtgtattataatttgaagtcaggtaatgtgaatcccctggttttgtaccttttgcatagaatagttttggctattctgtgtcttttgtggttccatataaattgcagaattttattttctatttctgtgaagaatgtcattggtattttaatagggattgtattgaatctgtagatgactttgggtagtacggacattttaataatattgattcttccagttcatgaacatggaatagctctccattttttggtgtcctcttcaatttctttccttgatgttttatagttttcattatagagatctttcacttctttggttaagttaattccaaagtatttaattttatttctggtattgtaaatggcattcctttttaaatttcttttttcagatcagtcactgttggcatagagaaatgctactgattttttttaattttactattattatactttaagttttagggtacatgtgcacaatcctgcaaatttaaaggatttgtttgttagttctaatagttttttttgtgtgtgtgtgtgtgtgtagtcattaggtttttccaaatataagatcatatcatctacaaacaaggataattctacttcttcctttccaatttagatgaactttatttctttttcttgtctgattgctctagctgggagttcctgtattatgttgagtaacaatggtaaaagttagcatccttgttgcattccagatcttagaggaaaggcttacaaaatggataattcctgaggttcatttaggtcagaatttatttttacttattccatatgaatttttcaacatcatgcaaatactccaacatttaaatatactatattactagcatgaaattctactgtaagtatttaaagaaatacatttttatgtctagtcatttgtattctgttaaaaagtataacagttcaaaaagaatatttccttaaaaagtataagtaaaaatttctgcattagtttgatggttgtgccttaaaacctttatgtctttctaacttatttatgatcaaaaatattagagaaacataatgtagtttgaactatgtggtacatttctcacaaatgtgtgtagagattaccaaatatctgagtgttgttatagataatatattttgtctgattcttttttagttaatgtattttatttctatttatatactcaaaatcttggtagaaaatctaagactattcattgttgtttatattttcttttttatctttagagatgaggtcttactctgttgcccaggctagcaggctagaatgcggtggcacaagcattactcacagcaagctggaaatgctggcctcaagcgatcctcctgcctcagtcatcagagtggctgagaatacaggcaggagccactcaacaatttctttctttcttttgataaagctattttgccaatttgatttctaattaacgttcaaagagaaccaaaaagaaacacatagagatgttgcatttcttgaaagcataatatcaaaaaggaaaacgctgtctttcctaaaacgctttgctatgcaaacttaaaatttcatggatgttctttggaaatcaatgacccatgagagcaaaccatgtacaatgcattatgggtcaatacaaatcttaagaataaaatatgagagtaagatggttttgaacatgattttcaattgcatttgtatcttttgaatttttaggaatgatatatttagcttctttgcatcagaaaggtttatttagcaggcctctaaaaacgaaacacatatcatagtacccttcactaatcagcaaaatgtgtctttactaccacatgactgaaacaaaaagtgccatcatgtgtcccacagtttttattcaaaaggaaagtactgtttaccaatttaccttaggcattttataaaattgaggcattagtggagtattctgaagtccacggaacaaaatccactagtaattgtgaaaaacgtttgtaaattgaaatatgaacataaccatagaaaaattatttctgcagcccttgtcatcccagctcaaataaatatcacaacaatttccatttttttcctagtttgatacctagatattctgtgccatgtatatttgagttcaattgtgattagtcgattatgctatgatcagaatagttttatcatctttaccagtttgaaaaatgcacttcacacattgaaaatagtttttcacaggtatatttcacacttagttactccaaagagaattgacatatggtagtgatatttaaaaatccacaggctgcttagaatggagagagattagtaggacgctcaactcagtaatcatagactattaattcaactaaaatataaaataattaaaatataagaccaaaaaaaaaagacaaaaagtaacccaaaccctgtattattttttaaatgctcccaactatacatcatggacgattactcactatctttttcttttttattattttctgaccacacatcgcctttacaaattttatcttttctttagttgtgaagtagttttctacttaaactgccaccatttcttaagtattttagttgcctaggaaacatacaaaggttttgctgcaatagcaggtattcatttaaccaccaaattccctctgtaagccagattcatcatttctatattgcagaagccttcagcggagcacttgactgcagccaactggcttgttagcatatcatgctttcaatagagtgaaatgggtcaaacagattttcagagatctttaagcacagaattatggtcctcccaaaatgattcagagtatcatttccttgacattcatggtcccacagaccaagcatctattttgtttctgttagtctaacctgttatctggctacaaaagcacacattagcactggagagggatcactttattctctctcttttcaaaggacataactctttcaggaaactaggatgtagtttaccacatacaaagttatctacagattttttggctctgtgtgacttttatatattatatttgtgtagcactagtgtggaggaaaataatattatgtcatacataatggcttattataactgctaggtatttcaccagtggcattattggaggataacttaatctctgtagctctcagttttcccaatgtaaaaagtgataatagtaatatctaaacccaaagtttattgtaatatatttaatttatataaaattatctcttttgtttcttataacagagaatagttctaccatcttcccagttcacaagtaagaaaactgaacctttcttacatcttacttcttattcttcaaatccagtaagtcgtctaatgtctgcaattcactgtcattgctatttccaaaactggtacttatttggtattaaagtctgaggttggactgttttaattctcaacaatgatgccaaactgatctttctaatacgtaatagctgactctgtcatttaatttcagtaactccacatgaaacttcagatttctaatataggcatttaaagcctttctttttcaaactcttgtttgtattcttcttcttatgagttgacaaataaacacatatcagtctagcttattgaattatttctagttatctttatattgtatgctttacttttcactccagtgcctctgcattgtaattgtttacctggaacttctggattctagaactgacttgccattagccatttttatttccacaacagaaacattacctcgtctatgaagaattattgaaatacaatctgaattgagtattcctgcttttatgttgtagaataggataaaatagagattatgacaggttcactatcatatacccatgtctactgtcccatatgacatatattgaacaatgtttgcttaaaataaagttcttaatcagcataccagtatatatcacaggatgaggtttcatattaaacagaattcatacaagtatgcctgatatagttaatgaaacaggaaaccctaagatatctatttttatccactaatttgcatgagtaaaataaatataacggcatttgtcaaggaagatggtccctgcacaaaatgcaaagcacaaatgataataatggggctatttttaaattttttatataaaagcttctgatagaatcttccttaataccatggtgtggaagtgtggtgtagagtgaggagagagaccgtccctttagttctccaagggacaatgagcttctgaatgagttggaaagtgacactgatatttggattactactgttaatataatcacattggtattcatgggctagtgatgccttaagtcattgttcatatttttaaatagtcatacaaagaagggacatggaaacatattgtgaacatattcacttagcttgtctttatatttttaccttaaaatgatagaaaccatgaacttacaggtattggctgttaggcattattcacaatttaaataccttctgttcagttattacaaacattcttatcagataaaatgtaactgttttcaaacactagttaaacatcaaggaccactatactctttaataaccaagcaattttaggttaaaaagagaatgcctttaattaaaatcacctttaatagataatgctctatgctcaggccctaatgttctcatttcagttatgacacatttcaaaggatgggactatatgtcatgcttcctttgctcctttcttctgcaataaatgcatggaactaatgtggttgataaggcttatgttttacttcaaatggaaaggagtaagtttttggaagacaattcagttgacatcttcagctgttcttattttaactcacttttctttttttaatttcaggttgaaaatggatgacaccttatcagatcatcaaagcacagtattaccagagttatagtgttgaatgtgtttcatctgcaccatttctaagtaataattcatcacaaatgacaagatagaatctctagcaataagattttgggtcatcgtcatcctatagacttcaaaagaaacacaggcactcaaacgtctgactctaatcataagttagcataataggaacgatggcaatagaagagtatgtttagctgatatcatttggaaatgggaacatgagcacgtgattacagcgtaagcaaaagaaacaatttatctatcttaagaatattaaccataggtttaatctaccaaggagttttgaaaatatcatttcaaaatcattaaagagggcaggcacatgaagacagagaggagaaggatggttaccaaagactgagaagggtagtgcagggactgaggaggaggtggggatggttaatgggtacaaaaaaaaaaaaaaatagaaaaagacctagtatttgatggcacagcagggtgactatagtcaataataatttattcatacatttaaaaataactaagagtataattggattgtttgtaacacaaaggataaatgcttgaaggaatggatatactatttcacatgatgtgaacagtatgcattacatgcctatatcaaaatatctcatgtaccccataaatatatacacctactaggtacccacaaaaattaaaataaaaatattttaaaatgtggtaggtattagtctctatactttttcttgactgggtgatttcctgggattcattacaattttctgattctatatgatcaaaaataataaaaaatgttaattgaatcaataatacatatattgagcaaaataagttatttcaaaaatatattgaagtacaattggaaggaaaataccaagaactttacatgtctgtgaaattaaaaaggtaggaatgatagccccaatcctagtcaacagagtaaaatatcacaaaacttgtgaaaaaataaaaacggatttttttaaaaagtggaattagttttaaaaaattgtataagaaataagaacgtttgtcaaagttagatttaaaagcagaaaccctgtaagcatacatgatgcaaatttaaaaactgaaaaaaggataatctctaaatttgtcagaaaaaaaaaacctccttctccatcttaaagaggtacatttgaattaaaatatattgcgaaggataatatgatttttaacgatgtataaaattgttcttgttgtttcttaaaccataacttaaactctgatttacatcttaaatgtggactctcactgggattctaacatcattcttagcctcaaatatccacttccctggcttctcctctctatgtttataatgtaaatggctcacaaggttatttctccttcctccatctgtatctctcaccattcctaaccttacgggttatttttcaatttggattagtcccctctcacatttttacatattgtagtattaggttcttcaaagctaaccacaaatactacttgttttttttccaaaaagtttattactccagccaaaagtaagtttattccctttttaatttttaaagctctttgtgcctctgactgggaaaatatcatacatatcctcatgttctggttatatatgcagtgtgtatgtgtgtcttatctctcccactaaactttaagctccttaaggactattagagtctaattaatggttattttttcttgtaggctttagcatgtattcttcacagtggagggttccaatctgtgaatgatgagaatataacatatctcattcatttattcagcaaaaaatgtatctatatactgagagaccaataaaaaagagtatacatttcagtgattcttaatgtaagtaagttcaaagaatataagctccaagtgtgagtatattctctttcctgaaaatgaaagatgttattgtggaatatgaagggcttttttctcggagagtcctgacttccacttaacagctgtgtgggcttgagcaaattaatctctttcagcttcagttcattcacttataaaatatagataatatttcacttatggcttatcataaatggcaaattgcaaatatgaaactttccagcttagtgcctgacacatagatggctatcacaaaagaaatgaacattatgagattctctggtgaaaggtgatagatggtcaataatgtaaatactaaattcttttctttaaagtaaagcttagaacaatactttttatgattataagagataattatattttttacacatgaaataatactagcaaaaaatcacatattctgttttattaaaacagcatcttttgaacaattatttctctaagttgtcatatttctttacctttggattttttttctttaaaagaaataaaaatatactgacccaatttttcgaactgtttttaaaattgaaggcatgaaattcagtctttacttagcaagtggattttattatccagaatttaaaatccactggctatgataaaatacatagagtcaagctcagacccaaggtttagagcgagtttatatttctgacttatggcaggtggaagaaccaccaacacacacgtacagaaagaccttatttagcccaatggacatatttttctgtagaaacagaaatttcccctcctttccacattgctatacaatggatattttggtcttctcattctctcatattttagcctaactagtatcctgaagaaaccttttcctatatttatctcttcctccatcatcaatctttatcacatagggttgaggaaatgatttaggtctggagataaagggcattgcattttgctgtccacagggactgtgcacatgaaacaaaccagaaaatgacaggtctagtaaccaacttcacgctaatggagggaaagacacttttctgtctctggttgaacctgaatttaggaggttgtagaccattagctgatagaagtcattttgctgccttttagaaattaagaacaaagcccaaagaccaaaaaaacaaaacaaaacaaaacaaacaaacaaacaaaaaacagagagagagagagacaaataaaagaagagagaagagagacaattctacaattctgtgttaggaagaacaatggatccccaaaaatagccacaccctagaagctgtgagtatgttatattaggtgtagggtgaattaagggtgcaggtggaattaaggctgctaataaaatgacattaagatagaaagattatcctctcaggtccaatgtaatcccaaaggtcattacaagatggaagagggaggcaggagagtcagtgtcagagtaatacaatatggcaaacactccatcagtcattgctggttcaaatgtggaagggggccatgagtcaaggaatgggggtagcctccagaagctggaaatagagaaaaaaataaaaagattgttcgcaagaatctccagaaaggatcacagccctacctataccttgcttttagcccagtgattcccattgctgagctcaccaaatgtaaggtaataaatttgtgttgttttaaggcactaacttcgcagtaattctttatagcagcaataggaaactaacacagtcgtttaacaatttgtacagtctccaataatgcctgtgtcttttcagtgacatgagccatatgttttttctttatgttttctaaggttgatgccttatagtttactagttaggcactacaactaagtacaggttaaggaaaaggctttactggggaaatgtgtaagtgaggattcagttatatcagaaggcataggtctcctcatcctcattagcttcccactgtgaggctaatggggctggctgaacacagtaagagtaggtgttctggcaatggacctggcctcgcctttcctccctgggaaattacattgtggatccacttcaccaggtcttctcctcttgctcaactttgaataatacatttccccagtaaagcctattacttaaaccatactttgtgtcattgtacaattcactctgagaacttggtacatgacaaatgaaagcttcaagaggactcaccttgcatcatgacagcttagcacatttgagaccatttctgtcatttacagctgagctagtcattactgatacctgttgaatacgatttaaaaaaaaaaaaagattttgtcttttttttttttttttttttttttgagaaaaggtctcactatgttgctcaggctggtatcaaactccttggctcaagcactctgcctgcctcggcctcccaaagtgctggaattacaggagtgagccactgtgcccagcaattttgtcttctttttagagttgtctcaagcattgatcttaaattctctagagtacactgggaacttcactgattcattccttcagacaacacaattcattaagcagagaattgcaacttacatgctaaaaacatgataaataccatttctctcctcaaagagttaatggattaaaagggaaaatggaaatgtaaatataaattacaatgcaatacaaaagatgctataatatgggtatttgtaaggtaaggaaataggaagataacagagaaacgtgtgattcaaagatattagctttatatagaatctggactcaactatcattattctcttcccaaatggaaaggaagtacatcctgagataaaatgattaaaaagaaatatgcttcctgactagggaatacaagtctgcatttcttggcaggagaagtgactaaatctgtcaactcaaggagaggcttgactatagtagatgcttaatgaatacttgtggaatgaatgtctaaatggataattagcaaaaaaaaaaaaaaaagctaatggtgcctaaatgatcttactaatcagtacaactaataaacacatgcattttgaagtaatttatatttatagttagaaattaaaatattatattgaatttatctttgacaaataacatactataatgacaaaaggaaggcagaggctttggacttaagaaaatttgctgcagacaccagcaaacctgggtttgagtcctgcctattgatcactgtgaccttagtcatgtcacttaactttgataagttagtttcttcctctttaaaagtaaaataatgttggaacctattctttaggaagtgtgaggaatagaggtagaaatgcatttgaaatacttagcagagagactagaatttagtaagcattcaataaatgttagctctaataataaccaattgtaagtattatccataggaaaaaaggtgttaaacatcaaatgaaattgtatagaagttgaaagatttaatcaagaaaaataataacttcaatataagtattattataagagatcccattggagtaatcatttgttgtgattttggcccatatgtttatgtcagagaaatggaacgtggccaaagattttcaaataattgtgtaaaattgctcctgttatgtaaaattaattgaggccttgcttcagcagctgttatgtgtacatagaggctgcaaaccctattaaagagaatggtaaccatataatcatgtttttcacacattattttgtgctatcacaatgaaaggtttacaaataacagtgactcatttaaatattattgacacaatgaaatgctcccagtgtgagaattactccctaggaatagatctgacattttggaaattagatgatttcttatcagagtgctattttaatataacattacaaactatttttcaagatatcccatgttactgataaccactcaagctaaacatttacactggtcaatgccagcaatccacacacagtaatttggcatcacctgtaactgttccctttgtttcacatagccaagaagtcttctataaacacttcaaaagtatttttgtgagacaaaataattcatatacattattttgtgtagtctgcactgtatttatatctgtaatgcagataaataaatccatattcagatggttaaaagacatacagccaaaatcatagcacatgacctctgttctgactccacatccttgattttctccataccactcatcattgactccacctccacatcattataataaataccacataaaatactttacaaacatgctttcatattagttcggtttctccatgtaattttaaatttttagcagtcatctattcgagatccttctttttttcttatcttatttgactttgaaggcacctttagaagtagaaaacaggtggagcttaccattgctgacaagggatattgtgatctaatgattccattattaattaagagaatctatagcttttacagtcaatgcacagctgataattaatgagctcaagataattttctgttttttctttagatgactttacatggctcacaattgcaattaattttttgataaattgcccattaggagcaaataaagaaaatattgtgtactgtaaggacacatatacagtacagattaaacacaacataatttcatataaatcatttcatatgctgtatatcttacttatctctgtattatagataagaacagtgacattcaaaatagctaaaagacaaccaaaatcataccatgtggtcttagactctgccacaccctttgctttcaccacatcacctccatttcattataatcaatacaccacagacataatttaaaatccaagtgaggctcagcttggctgcctcatctcttcttttctggattaacactagcctgtgaagatactggttacctgagagtcggtaaaggcagttgaaatgcaattcttcagagaaaactgttaaaaggaggcttatttctgcccacgagtttgcagtaacagtagtcctctccgaaagaatgcacatactgtatgtgaaacctaagataatctcaatagagtggtcagtgtttgactatgaagcttaaggaaatctggaagaatgataatgaaatcattttcactttttggccatgacctctcagatcagaacatacttttctcttcaagatggggaaataagtgcaagaaaggggctctctgagactaaacacttctaggaatataacaatttcttggaatagactaattccccaggcttgctcttatctgatttattcatatgacacatgtctgcaggttctagacttgagcctaaacttattttgctaagacatttaatatggatcatgctataggcttttgggcttaaaatagacacataaatttcccaaagcattataaaattattggtccactaccaacatctgtcaatgtccccagctaacagtcaccagaaataaaatggttgatgaagtttggtcccttgactttacaatggaggagaacactcaccatggggaactgtgcagtgtctcactaagaggctgttagaaagaaagacccattacagtattggggattgtgttaaattacttggggaagcattaagtaaattaggccttttctctggattggatgcagttggaaatcaggagtaattctctttttaggtatcttaaaaattattatatggaaggcagagagaacaaagaaggccaagctgtaattggtaaagaagcaacatatcaggatgagagatatttgattatttttgtggtttggacaatattcacattattatctacattaaaatctgacagttttctttttgtcttgatccatcatagtcagagaggggcctaatataatgtttttccgttacattctttatgctcaacagaagaatagcctgttgagcatggtctagccttaagtgttagggaaacttcaattatcacaaaggaatggctgacagtactagggcagttcctgtctgttagaagctgcttatttttcttatagttaagacagatatgaatgcctgtatagtcaatagtaaatctctgtcaacatttcctttaaaatataccctgagtataaccattgctcaaacctttccttgctccaaccttcatccaagtcaacattactgattacttggacctctgcttctagtgggttccccagaaagttctgtcaccatttaacagcaagagtggtctcttccaatataaattagaatattttactctcctgtgcacaaattccaatgggttcccattgcccttagaccagtatccagatccttactgtgaacttactcatggttatttctcagatattttttcactgctactcatggcatcttgggtttctgcacttgctatatctattatcaagagttctttttctccaggtcatcacaagtttcacttcatacctccttcaggtttctgctcaaatggtcacctgttggcaaaaccttccttaaactcttttatgcctcttcccttccctactacgttttatttttcttcttcttcttcatagcatttcatcactactgtatttaaattatttatttgggtatctatttattgtttgtctcttcttctgtaatgtaaattcaatgaggcccagaactacatctggccacagctgtatcctaagagtttagtgcattttctatcgtatagcaaagatataatcatgcataatgtatgtatccacaatatggatttagtcactagccacatgaggatcaggttgattctatggttaggtggcattactttgaatcatataaaacttctttctgcaagtaaagaaggttacatattagtcatttgagatcacctgattagataagaattccccattaccaagaatcaaagggagtcagccccattctgaagcagaccaatttgagggataaaaactctactgcatgaaatgcacccagttatgtaacatcattccttattttatttaatgaatatttatccagaatgtttcacctctgccttttacacagtgcagtgaatgtaaaaaggaataaaaaccttattccttcaaataatacactgaggaaagatggctacacaatataatatgggattaaaatgcccttatagagttagagcatgcattttaatgggaatccagagaagagaattcggaattctgccagaatattatgtcttatttgaggttttatgaatgagcaggagttcactgaaaaaacagaaaaaggattggaggaccattcggatggaaggaagaacatgggcaaagcttggatatgtaagggagcatgtgctattttggaagtacagacatttgctggaatagaaagaatggagcagatttctgaggccttcagtgggtggagtaggcaggtcttggtatagaatcctgtgattcatcacagtggggtctgctggattctcagtcctcaaagtagcagagcagagcagtctaggagctttgggaatttggactttccattgtgagccatattctagctgtgtcaatactcttaccctgaactcctgatgctcactccttagcctttcctatacaacagtgtttgtagtttgtagtgtgacatgcatagtcactaaaaatttgtctatctttatgctcaaaatatccattataaaatatttagatctgaaaatctttgatatagtgtccatagtaataaacttctgtagcaagtgaatataatcactagtaaaaaatgtactgacagaaaaagtaacaattggtctgctattttgtgtgtgtgtgtgtgtttgtgtgtgtgtgtatgtggtcagaaccaaagagagcagaagctatgtatgagtacatatttcttatgatccatatcataatgagattaatacattagacccatttctttcaaggttctgatttatatttgttacattagtttccctttgatttcaagaaacatgcaaaagagaaagagaaatgtataaaatagaaactgatggggccaggtatgatgactcatgcctctaatcccagcactttgggaagccaaggagggaggattgcttaagaccaggagttcaaggctagtctgggcaatatagcaagacccagtacttattctgcaagtatatatatatattagagagagagagagagagacactctattgggtcttgctatatatatataatatatataatatatatataatcaaatatataaatacatataatcaaatatttaaataaatcttatctaatcaagtgatcccaaatgactaatatgtaaccttctttacttgcagaataaagttttatatgattcgaagtaatgccacctaaccatagaatcatcctgatccttatgtggcgagtgactaaatccatattgtggatatatacattatgcttgattatatctttgctatatgctagaaaatgcactaaactcttaggatacagctgtgaccagatgtagttccaggcctcatggaatttacattacagaagaagagacaaacaataaatagatacccatatatacatattatatatatatatatatatagagagagaaacatatctatctctctctatatatggagatatatatacatatatatctttatataaagatatctatatatatagatatatatacatatatatctatatataaagatatatataaagataatatataatatatatttctatttctattatatataatatatagaaaatataaccatttgtcttatataagtaaaattctcatttgcctcaacatacttcttttgaaaacttgaaatctagtttagtaacttagatataatttaaggtttcaacaactggatcaagcccttatcttgaataatttggcaataaatgaataatgccttcttcttagttaggaacatacaaaggacaaacactatcacttagtagcagtatgatcttagcaaaattttctatcaacctttttcatcaataataataattgctacataaactaagttggaatgtatagaagagaatgcacaccatgaaaccttaggatgcaaataaatttccaaaaccacgtagtctatccaaacactctttaagtgagtaactcgcacatcctaatagtcactgaatgtcatgtgattaataaccttcataaaaatagccttttgtgacatctggggcacaattttatttactttaaatagtaaatgtacaatgatttaaaataagccatttaataatttagatttttgatttttgttaaatagaataaacgtcaatataaactttacaaaataaaattagaaacttgaatgatgtaatctattttaggtaccaagatggtcattccaaagataatgcttttatggtgctgatgaatgtggatttaatatgcatttactgaatcaacttatgtgttgccaccattttttctttttcttttttttttttttttttagtcagctgtcagtaacactgggttctgctgcctgcactttatcaataaacgtgtgctctcctaccgcttggtaaatgctgagaaatgtctcttagtgaacctctatttctgcaggctttctttttattattattattattatacttaaagttctagggtacatgtgcacagcctgcaggtttgttaacacatgtatacatgtgccatgttggtgtgctgcacccattaacttgtcatttacattaggtatatctcctaatgctatccctcccccatccccccaccccacaacaggccccagtgtgtgaggcttcccttcctgtgtccaagtgttctcattgttcatttctcacctatgagtgagaacatgcggtgtttggttttttctcattgcgatagtttgctgagaatgatggtttgcagcttcatccatgtcccttttacaaaggcttctgcaggctctctaaaggcagtcaccatgccctttatttctttcaaaatactatcattactgaaaaaaacttcaattaaacttatccaatatacgacattgtgtcaggttttaggcaaagcaatgagaaataagatgattattgaccacaaagatattaacgttttgagaaacaaatgtatatataactaatgactaattgttgtcctgccatcccatagattgccattcacctctcagggccaaattaatgatattcatacacataagctgatccacaggggccaaataagttctcccttccaaagatttacacttgtgcataggaatcctagttttaaatacctgaatgaagtgtaataatcacaagtgtggaaggaaaaggcaaacaaaacagtgaaaaacgtgcaatttccaggagaataaatgaattgtttgttcctagagaaggatctggaaacactgtggtcctgaagtagcagaggaagaagaaggaagaagaagccacagagggacatagagagaatgagagagagagagagagagagagagacagcgagagacacagcgagagacagaaggagaaagggagaggggtaatgatttcctggtgcctttagaacgttccagttttcagttccaatccttcgtgagcctgaatgcatccctgtgcttggactccatgaaaacccctcagattgttatacctcctcacctttttatactctatgtaatgcaagatggatcctttacttacaaatgataattttagttgaaactaatgtgatataataaggaaattaggaccctctagactttatctcagaaatagcaagtttattttactttccctgaaatcttctgatcattgttaaggtggaggaatgagctatgctttaggagggagatgctgaggtagcctgcgggagctggcttggcaatagaccatgtaattcttcaggatctattggcctattggactcaaactgttgggaagggttgtaaaatatgttgattatttaggatctaattatctaaattattcatcatcctttctttttcttctcccccagttctattcttctgtcaattctttcaaaactagctttaatcctattaatccctctgccagattctgggaagagaattagagagacagtgtaactgaaatcaatccatctggttagctcttagacacctagtaaaagatttgatggaaatacgagtaaagcaccttcttaatgagatttgggaaataactgcagatttcatttatgtctgttcaacctgactaatggggaagtatacataacaattgcctgtaatgcaatactgaataaaacttgctgattttccccagggacactgtaactgttcattactttacactgcagtataaattggcccagtggggaggcaggcatagattgaagggagctgtgaacaaaattacatagctaacactgcaggcacctcctccatacttgaggccctggaatcaggctcttaatacatacagtcaaacaatctttctgacaattgcaggtcacatacctagctacacgtctggggaaactacaggcaggtgtggggctcttacaaatagcttagaaatatataccacttgctcccaacaccaccactgggtaactagtccagaaaatgtgtctcctttataggattaacagcttgctatctctctcgaaaaggcaacaatttaaacaatattcaaattggaaaaaaattaaatgttgacaggaacgttcttgcatttgcacaccagatttaccagttaacacctatgtgacttgtcacaaattaactactctatgttgcagtttccatagctgtataatggacatgataatggtacatccgtcagacatttgttgtgtcagttaaacaacatgtaagtgtcccagcaagtaactaggtcatgaaagtgctgtacttgttacctagcaatgttattgttgttgttgctcttgacaacctattataattctgacctcaatccttttgtttttggagagggaacaaggcaaaatggaaaataatagtggactaatcataattgacacagttttaaaattatttacatatatagtcatgcactgacaacaaacagcatttcagccaatgaccgaccacatatctaacagtgatcccataatattataatactatatttttactgtatcttttatatgtttaatacacaaatacttaccttgtgttactattacctacggtatttagcacagtaatatgctgtgcaggcctgtggcctaggagcaataggcttctagagtgaaacctacaagtggtgggaagaaaaggggtatttgagctggaggatgtgtaactaagaaaatggattataggctataccatatagtctagctgtatagtaggcaatatcatataggtttgtgtaagtacactccacgatgtttgcacaataaccaaatcatttaaccatgcatttctcagaatgtattgttgtcattaagtgacacatgactgatattaattaggagcaggtaaaattaatacattaactgaattgtatgcatcatccattgttctaccatctctcaaatcaaaacaatattttctggccttcctctgcttgtgtgtttagcaatttatataatatgttaaccagaaccaggtgcagtgggctcacacctgtcatcccaacacttgggaaggtggaggccagaggagtgcttgagaccaggagtctgagaccagcctggacaacacagcgagaccctgtcattacaaatatttaaaaataattagccaggcatggcggtatatgcctacaatcccagctactcggaacctgaattgggaaaaattgcttgagtcccgaagttcgaggctgtagtgtactatgattgtgccactgcactccagcctggactacagatatgtctatatctatatctatatctacctatatctatatatatatttgtataactgtattcttttactataacccataacccataaccatgagaaaaacagctttcaatgcattttgctaatctttctagtgaattattaaaactgtgggtggacctgaagacttccaaactttataagaacctactatgtgctagatatggaccctggcactatagatataaatacaaatgaaaaacattttcttccataatgcttcttataattcagtgtaaaaatatatttccaactaacttcaccgtgttgttatgaggagcagagaaagtaatcggtattagtagtcgtgataataatgatgatgataaaaatggcggccacgtatgcatattgtgtttttaatatggaagaccttttcaaagtgctatcatataattattacaacaattctatgaggaggttattttcatcctcattttagaagtgagaaaactgaggcataaaaggaataaataacttatctaagatcagactgctaggaaatcatggatctgaggctttaggctatttgagccaaaaattgtgcttgattatctccaacatgggaatctcctaacacagtgtctggcatgatgagaatgtctaataaatgtcagactgatttctcttctgtagggtctcattcagaatattatctgaagtgagattgagagtggttggctcctgcagagatgaggtctttacttaaatatagaatgattgttaagaaatatgatatcaccaaacgaaatatactcatcaagacctgtgcaggaagaaactgaaagattcctagatttgtaaattagagaaggattgcaaagatgagacaactgataaagctgtatttatcagagaatgggaaaagcttagatatacttttttgatttcaaatgtttccactgttaaacacttacatatcaatgctttgaaagcatagacgctctaattcacaggaaacacagtagtggttttaagcagaaatacaacattaacattagagtatatttttattcaaaaaaatccaaaacattttcataagtgttatttaatacaacaaacactgagttcctaaaatgtgttcaggcagtggtgtagatgctgaaaatataaagaaccacatgaaactagttttaagaggcttcatgaagctatgcatgttcttgaataaaaatatctagtgatggtataattcattagaaatagatatgaggggcataagaggacaaggttacctatacctatgtggaggcttgttcagagaaaatttcagagatgaggtgacatctgaactagttttaaaaactgatcaagaatatttaggcatatgatatgtgggagaaagatattctaggcagtgagaatctaagaaagagcatgatatattaaagaaactgaaaatagttcagtgcttctagagtgaaacctacaagtggtgggaagaaaaggggtatttgagctggaggatgcgtagctaagaaaatggataggaatgggaccctaaaagacttgtgcgccattttaaagatgttatatttatgctgttggcaatgggaaaccataaatcattaaaagtaggggagtaacatcagatttttatttcagaaatacttctctctcaaaagttacattttagaggaaaaacttagttatgtcctattttatagagcataactccgatatagtggttaagcatgtgttcacagaagccagaggaaatacattcaattctcgtctccttcacttatgtagtagtcaggcaggtcaactgaagtctgtgtgagttactcttctcatttataaaagaaggataataatagtgctcactcacagacctgttgtaagaattaattgagataacagatattaagtatttacaacagagaaagtcttcaataaatggggttaattattaatgtggttattatattattactattatcattttctctagtcaagacaagtactttaaattttaaaataaatacattttttcatgtaattagttgacttatttttctttataataatgtaactccttgtgtttttgcaaattggtaacaggtaagccatagctagcaccaaaagtaataatgttactttaaaatgcattcactggggatcaaagtaaaaaatgaaataaatctgtaaaaatcagctttagaatttgcatcacttcaggcaaactaaaacatcaaatggaatattgttgaaaatttagcaagtttgaaaggattagtaaaaaattccttgaactaaaatgtcaactgaatttctaaaaaaaataataataatcagagtaattttaaacatattaaaattatcaaaaatgtttttcctatttccttcttagtttttactgatattatattttaaaattatatattattgtccctcataaccaatgatctgatagtttacttaggagctaaaagtgcattcagtgttatttatctatttctttgtgtttcctttgtattcaatgctatttaactatttctttgtattcctccaattcctttctttactccttaaacatatatattcaaagactattcattacaactacaattatttcctcacaaatcaatttccaatcaggtcaagacccaataaaaacttttattgcctgttctcataggcctagatgtttaactagatattaaatataaaatgctttgcttggcatttaaatttaatcctcagttaggtaccttactctacataccaatttttagttagaaacttaaagtttctctctaaaaatgaccgttttctttttccgcttgttcaattttgcctaaaacatcttactttgcacttgcaattgtgctactttattttatttaatacagcagtagcatcgctggaaataataaatttttcaaggacaggagctaggttctgtcttgcctgaagtaatttacttgaagtgatctctagatgacaagtctatcaagtggacattagctggaaaaaggagtctcttgggagatagtccagaacatgtctttccaatgggcagagtatcattcctaaacggataaaattggttcctatggcaaaaggtattagatatgaaaatggtgtatggccttccaaaagctcacagtatgtaaacaggtatatatagtatatctgtggtgtaacagtatatctatagtattaaattatatatataaacaggtacatacagtatgtctgtgatataacagtatatctatagtattaaattatcatctaatactatagatatactgttatatcacagacatactgtatgtacataataaaatggcattcagatataaaaaataattatcatctagaatttcttcctttgtatgattacaatgggatactcaggataatttacaaaataaaaatttcatatgtgtcctacccccataacagcatatgtaaatatgaggctttttccaagtttctttaaattcctaagtttgaatcaaaccctcactttaatatatttacatctgataatcatatttgccagtttatgaatttgcccaaaataaaaagtttaaatgtagaaattgaacatattccagagatacagcactggaataaaacaccctataagaaatccaattctaaaatgagatttgaaaaatattcataaagtttaaaatcagagtaaaatgactgtggttttgaagggaaaaaaatcaaaagaaaaagggtataaaatgtaaatggtgttcctatgtaattaaagagcaggtactaggccagccactgtttcacagagcaataaatacttaaatattatttagatatcttcagattgtcttatgaacatgcccatgcaataaatagctacatggggatttatgaaatatcttgagattacagaactgacaaaaatatttataacaattatacttctatgaactctctgggattctgaagggaatcatattccaattcctaagatatgttttaaaggtcaaatttaatctgtgattctaacattaatgcatttggaaatatgttttatatctactgagcatcagattataattttaattttaagatgagaaaatagcaaatccataaggcaaagtaaagcattcatttagtatctgaagatttctgaaaaacatcttgtggtaaaagtcatagtaaaatatctttttattaactacagtatacatgaacataaatgttgtaaattatgttatccctgacaagaatatcattatcccctcctgaatttacataaactgaagaaactaaactaaataaatgaaataccttagttgttagcttgactaaatcatttttcccagcctaattttgtctatctctgacagatttcaatctatgttaaactcatctcattttattgaaacggaattttctaaggtctccagtcatctaatgtgggaaaaataccaaggcctctctttctttcaaaaccatgaatgtctttattgccttgaagcctaaggagtagtaggctttagacatttattacatttctacctagccattagatctgtttgaattggtgtgcttctttcgcttttcaccgcttcctcacagcacatcaattatttaattcttagaaactactgaagaaactggtaggtaactcaattctcagcctaggttccccacatcaacataaatagtttcagtccagccataccaatatgtattgccatagattaggtatagaaataaaggtgcagttaaatttttaataactgaaaaacaaaagcaaatataaaaataaagctttggccttaagcactttgtttttccatttgcttttgtttttctgttatttgtgtgtgtgtgtaaatatatatatatatatatatatatatatatatgaaaaatgtagtgaatgatcaatttcctaaggtcagtcttgatattttaaaaagttgtaaagattgaatgaaaatctaagtacacagaaaggataagttaaaccatgctttaactattttgaaattttagttaattaatttttttaattttaaatttcaaataatttttctaattgaataactcttcacacctattagaattgacaaaatccactgactcagcaaatgctggccaggatgtgcattaacatgaactctcattcactgcttttgggagagcgaaaaggtacactttggcagtttctaacagaactaaacacactctgaccatgggctccagcaagtgagctcctagatgaacaataaacaaattgtagtacatacagaccatgaaatattactgagtactaaaaggaaataagatatcaagccatgaaaagacagggaggaaaattaaatgcataatactaagtgaaagccaatacaaaaaggctacacactatatgactgtaactatatgacattccggaaaaggcgaaactgtggagacagttaaaagaccagtggttctcagtgattaggacaaagggaaggatgaataggcagaacacagaggatttttagggcactaaaaatactctgtacgatactataaaggtagatacatgccattacaacattagtccaaatccacagaatgtaccacagcgagagtgaatcctaatggaaaccatggactttgggtgatagtgatgtatcatgtagtaatgacaaatccaccactctggtggaggatggtcactgttggacaggccatgcatacgtgaaggtagacagtgtatgcaaactgtactttccgttcaaattttgctgtgaatgtaagactgctgaaaacaataaagttgacaaaaaaatttaaagtaataaataaataataaacaaacaaacaaatgcagagctgagattctcaaccaggggtggtggaaggtggttatagatttctaaatagttgtttttcagtttcaaagcctctgcattttctttgtgaaattgtttaatatacacataggtgattttttgactttttgagagaaagttcaaaactttcatactttgttccagaacagttaagaacccctgcagagagatagtcaagagttattgtatcagttcttatttgtattattttaaatgttatttgattttttcaaaagtacataatctttgttaattaaacagtttagataatcatagtacacaaatgatgttcatttataaatacagctctattttaaacttaagccatgttggtgacacgtccaaaatcaaccagtgaccattaaataatgacaagtagcaattattgagtatgaacttctagaaattatcatttcatgttctggcatcttatttggaatatcaaactgtattaataaaatcactattaaatattaaatcttaataacaggacatttttatacctgcaagtagagaaagctctatagttcccaagccaatttcagatcctcagcactgacaaacatgtatcagccaaaatttgtgtctacagaaacaggtctaacttgatctttgttgtagtgagctaggatatgactttcttccctagccttctaaactactgaggagagttggctagtaaaaatgagagaatagcaatgatgagataacacttcaatctcatcctccacagccatgtgtgaacgccactaaatactgtggcaatggaaagggccagcttcagactgatgtaatttcatcccttcttgcttgtgaacaatcagaagagcaatctcatcacatgcttggattaaccaacaattaactggctatcggcatataactggcaggcaagtcctaaagaaactacaaaattaaccttccaaaaaaggaactggggtcagctcttagatagattcatgtcaaaatgccagaccattatcttaatagagagaattttgcaggaatctaaagccttcgaaagctaccatgcatcttggtttgattatggcattataacaagtaagtttttcgtttaaaataattatcttgtttaacagacagtgacatggaatttttacttatattttctacaaatctgttaacaagaaaagtaaactttctggtcctggaggggagaaaataaaacagataataatacttcaaccagtatagtagagcaagggttagggaaaaacacagttgccacagtacaacatatatagaatatgattaattcactaaacaaggaaataaaataaaagcaactgatataaataatttttattctgctctgactgtctggttcagaatcttctcaatcacttatatattagtttatactgcgtaaaaattaaagaagtgtatgtacagaaattttgtagtgatccaataacaagcttatatctgcaaataaatacagttaaatggaaactcaataatatggaccaaaagaataacttcaactagtaaatattaactaacttaacaataagatggtttggtgaagcctaattacatcaattcaagggaagacgataggcatcaagattttattaaaataaaatttaaaagaattactttataggaatacataatataaaaaaaggaataaaaacttaaagattggactacctcaagtgttgagttctacagcatattaatgctcttaaactatatcaatgtatattattatgtgaatgttataaggattaatcacaaaatgttcttgtaaactatccattataagatacattagctcagatcaatatttcttggaaatagaagatatattctaatgtatattaattagaaattactgatgttactagctgagaaatattgaataaaatattttctcggctagagaaatattcctctagctgagaaatattgaataaaagcagaaataaggatgatatttgttatttatatatgatagttataatttcagcagttcacataatttaaaaagagaaaattttattagtttattcatctaataagtaaccatttaagttaccatataaccagatttaattataaaactaatatcacatttgtacaaaatacctaatattatagtggaataacaaacgaaaattgaagaaatagtaagaatgtatgtcatgtctacacagatttcatagtattcatttgcgtaaagaaaaaagtgaactgtgtgtaccctatcaaaaatcttgacaacattctgactttggaaattagaaaaatgcatccataccccacagagcaagcatcacctgttctactgcaggaaaagacaccataaaatataaaacaaaatatctgcaaccaacatgaaacacattgctggtgtgtagaggtctgcccatatactgtaactttagctgtaaatatctatgacagaagaattttcacttttagcatgtgtatatcaattttctctaaaggtggtttcaatttaatcagcacaaaatcaaaaatgagagccagatttcacatgtcagcatgggtgagcaagaaaaatagatgtaaaaagattttgaaaattgttagactaaagatgttcatagagtccatttcaatctcacgatctcacaggatccctgtggtgagtggaaatggcaacagacaggagcaatcacctatttactgatttactagaaaaatatatggtcatcttcagtggtctcagtagttacaataaatgggcaatgttcaattatttttgtattaatgtcatcagaccatagacacaatttcctatagtattttcttaatgtttacttacaaacccatcaaataaatattataatgcccaacgtcttctcaccaacaaatttaaaaaatgccaaaatatctctgataccgggcagacatgcagataagtggaaacttaattattggaaagagtctgaaggtttaatctatgattataaaattaaaataaaaaatattgttctatatgattatgtcattatacccaataatgtcttaggctatggatttaaaatgaatatggtgtgataattggatgaatgttatatatacacataagaaatgccactcaagacacacagatgtgaatatctttgcgagaatatcctcgttttcatcataattcttatgttgagtttcattttattataaacttccatgtattctaagtatgagattttgaaaaatggatgaaaatatatatcctacctactaatatagttggttggctagcaccattcctaatagaaatcagctgcaaacagctttcggcacaccaaagttttccttaggtagaagaaaggttaaactctaagtcataaggtttacaactttttagaaagttgccagaaattcccagtgatttggccaatactcttctgtttagtgaacttagtttactgatgatagggtttctatatcagtatgtttaaattcatgacctattttgataatggtggcatgtatgtataatgatttttctaataaaatggtaacctgctagattacctgctagatttctaataaaatggtaacctgctagaaggaaattgtattttgttccagaatgctacatactgcaaatgtttcaatttttttttaaattttaacaaattaaaatttgttttggatataaattatcaactcatagtaagactttttcatggggaaacttttggaagaaggcgatgatttctcaaaagcttattttatctaatatgttacatgtaagatcttatatgttacatgtgtatacatatcacacatgcacctacatatatggtaagacaaggggtagaacattatagtttactatggtgatgaaccccatggcatttccctgccttgttatctttgcttgtgtttcttctacctttcttgtgactccgacttatctgaaaacaagtgacaaccaacctaaggttctggttcctgtaatgattttggaccaagaatgaagccttcctaaactgggtatttttaagtctctctctctctagaatgtggttatgggctaaattctgcttgtctaggtctctattatttccttagaataatactatgtgaaatttggagttagcctgctatgtaatgctataatctttcactatgtccatggataggcaaagagctgacggtctgtaataaaaaagcatcttaaataagaaagtaaatttcaaagatggtgcaatggaatctcagtaactttcaatgactgcacaagttcatccagctaggaattaaggctaggaagagaaagctggtattttttaggctgatttgtattttatcacccctgcttaatctaatgtggacctctagaattgcatttctagctttgccagataatacttctatatatattagtttcctcttacagagtataggtcccatgaagaaaagtggcaggcatgactcttctttgcatgctactggtactgtatttatcgtgtaacaacttgggtttaatccttgactccctcacttgggcagtgtgtttagtctttctaagactcagttgacctttccaagtttctacaccttagaacattgagggaattacagaaacaatgtcaaatgctttgcaagatacctggaaacttcagtgctcagtatatgttagatattgttattttcatccttttgctcattagcatttataaagtgctttgactataaacctgttcaatagatatatgctgaatattaatatgaaactaaattaaatgtaagactatagatcaggaattgtcaagctgcagcccatgttccaaatctggcctacagcctgtttttgtacctccaagaagctacaaagggtttcacatttttaagggattataaaaataaaaacaaagaaaaatacgtaacataaatatatgtgggctacaacacacaaaatatctaactttttaaagaaaaagtgtgccaacttctgttatgcatatagagtatgacttgttaaaaatatagaaatatcttttgatgagaaaatctagaaaactctcctgataaatctttagtatgattgggcacctttctaaaatttataaagttgtgtaactaatggtatagctttaataagctgatatcctttcttacagttccttccctctccagttaatccttcatattatggtcatactaatcaccctaatagcatcattgttatcacatcactcaatttgtcaaaaatacatccataaatatgaacatgactaaagaattgagtttaaattctttcaccaatatttaaggctaaactcttactcacttttaaaaatttatctcctacctttctaggacatttatatggaataccagttatactctactcttaatactacatttatgcatatacattgtggttttaaaacatgaccacatcatacttgacacttttctctttaaataatagaatctcatttgcctttatgtaggccaggtgtgtaaatttgcttctaataaatacaaatagtggaaatgatgttatattgctttcaaggtgtgtttctatgaagacactcagaagcggcccatagagacaggatctaaggcctcttactaacagccagcaccacaataccagccatgtgagtgagccatcttggaagcagattttccagccccattcaagccttcaggtgactgcagccctgactgacatcttgactacaacctcacaagaaaccctgagccagaagtgttcaaattagcagctcccaaattcctgactcacagaaactgtgtaattaataaatatttattgttgcatcaagccacgaattcttgggataatttggaataattatatagcaatagataataaatataatatatcaatggatgccatgatagaacaacttttgattctgttttctctttattcaaacccatcagctctgatagttcaaataaacttcatcttcttttctaaagactttcattaaacaaatgtgctaataaccaggtaattaactggacatattttgtgtatatatatatatatatacacacacacacacaatatataatatatataatatatatataaaacataaatttatgatatattttacatattcctctctctgcatctctatcttaagtcttcaacccaaacaatcctcaaagggcagaggtttcataatatgactctcagcagtaagctaggacatctgctgatagtttgcctttgataattatactttaattacacttatcaagatggtttatagacacaaactgttgatgtagtgaatgtctccaaaatttagggacattgatacacacataataaaaattataagaccatttcttatgtattcatagcttcttacatcaaatctatttaaataactgaaaaaaagtacttgtaccaagtgacataaaaaggaacagtcattgttaatctaaataataacattgattcagacaaagatttatctttaaataaaaccatttttcccaatcttaacaagtgtgatcaatagatataaaagtaaagaagtgtaagagtttgctcattggaaatgccaaaaccaactaaatttcacacactgttttactgataatatgaatgagtggttaagactagtgtgtttggaatcagtctgcctacgtttaaatcacagctaaacttaccacatgaattaccctccatgttagttagcttttccaggcatcagttccttatcaataatatggggctgagttttattaccttcatttaggaataaataagaaaatttgagtcaggcactagtacggagcctggcacatgctaagagatcagcaaatgtttgcctgttacctttttaaatttatttacttttactatttacattattgttcagaatgagattaacagtagactgccatgacaaagaatttgaatgatgtaaaattctaagtgaacttctaaggcttttaaactggtatattttgtatttttcaataggcctctaaatcacctaatgagaagaaattgtatcccagaccaattttgaaggatactactacttggcaaccaaaatcctttaatcctcttgtagtaaaggaattataacttgtagttgactttccagttaggaacaggatttcccagttcatcatgaaaggatgcaaccatatgtctaagttcttatcaataatgtataactgaaacatgtttaatttctccttcatttgcttaagaggaaattgttgactctgcacttctgctctttgatgcccagaatggtgatattcagaaagtgttggaaacctgtgtcttaaacttggcagattcaccatcatcctatgttcctaaattaaccccttgaattagacttacttgctgatttgctatattgtgcctgaatttgcaaacaggtaataaacaaattgctgtagtcatttgctatttgattttttttacttattagctactaattattagctactaataattctttaatataccctatattagtttaataggactttatataatcattagtaattgcagtggcctctaggtaaaaaagctgaaaattattagatgtttaatgattatgatcaagttaaaacattaaaaacaaactattaaatatcccatataatccatatttatgaataaacttggggtaaaaccatttcaaatatttatgatggcaattaagaatgcatatggatgaaaagtacttaaattgttcttaatataacaaatatactgtacttcaaaattagcatgcatttagacctgcaactataaaaatgaatttcataacttttttgatgttttaatgctgagtgtccatttcatgataaattctattcatgtaaactctgcagtgcattagaaacagcctgagggaagatttgaagccaaatgagaagaatttgaagactaattcctcaacttaacataagctatactaataaagaagagagaagatccaaataacataattagaaatgaaaaaaggaatgttaccactgaccccacagaaataaaaataacaattagaaactactacgaacatctctatgcacacaaaatagaaaacctagaaaagatggacaaattcctggacacactcacccttctaagactgaatcagaaagaaattgattccctgaacagaccaataattagcttcaaaactgaatcagtaataagtagcctgccaaccaaaaaaaaagcttaggaccagatgtagtattcatagccaaattctaccagacctatgtaaagagctggtaccattcctactgaaactattctttaaaaattgaggctggacacttccccagctcattttatgagggcagaatcatcctgataccaaaaccttgcagatatacacacacgcacgcacacacacacacaaacacacacacacacacacacacacacacacaccccttgaagccaatattcttgatgaacattgatgcgaaaaccctcaaaaaacacttgaaaactgaatccagcaacacatcaaaaagcttatccacaacgatcaagtaggcttcatctccaggatgcaaggttgcttcaacgtacacaaatcaataaaagtgtgattcatcacataaagagaagtaaaggcaaaagccacatgattatctcaacagatgcaaaaaaggctttaaataaaattcaacatcccttcatgttaaaaattctcaataaactaggtattgaaggaacatacttcaaaataataaaagccacccatggcagacccacaaccaacatcataccaaaaagggaaaacctgaaagctttccccttgaaaaccaggacaagacaaggatgtcctctctcaccactcctattcaacatagtattgaaagtcataggaagagcaatcaggcaagagaaagatataaaaagaatccatataggaagagaggaagtcaaactatctctgcagatgacatgattctatatctagaaaaccccacagtctcaacccaaaagctctttcagctaagaaacaacttcagctaagtctcaggatataaaatcaatgtacaaaagtcaatagtattcctgtacaccaacaacgaccaagttgaaagtcaaatccggaatgcagtgtcattcacaattgccatgtaaataacaaaatacttagaaaaacagctcacgagggatgtaaaagatctctatgataagaactacaaaatattgcccaaagaatcagagatgacccaaacaaatggaaacatactccacgctcaggaataggaagaatcaatatcattaaaatggccatactgcccaaagcaatttacagattcaattctattcctatgaaattaccaatggcattcttcaaagaactagaaaaactatttaaaaatttatatggaaccaaaaaaagagcccaaatagcgaaggcaatctcgagcaaaaagaacaaagctggaggcatcacattacctgacttgaaactacactacgtggctacagtatacaaaacagcaagatattggtacaaaaacaggcacatagacaaatggaacagactagaaaacccagacataaggctgttcacctatgaccatctgatcctcaacaaagctgacaaaaacaagcatggggaaaggactccctagtcaacatataatgctgggatgactggctagacatgcagcagattgaaactgggtccctttcttacaccatatagaaagatcaacttaagatgaataaagtcttaaatgtaaaatcccaaactataaaaaccttggaagacaacctaggcaaaaacattctgcacatagaaatgggcaaagatttcatgactaagatgccaaaagcaataacgataaaagcaaaaattgacaaatgggatctaattaaacttaagagcttgggcacagcgaaagcaactatcagcagagtaaagagacaacctacagaatgggaaaaaatatttgcaaactacgtgtctgacaaaggtctaacatctagcgtctatagggaacttaaaataaaaattaaaaaaccattaaaaagtagacaaattacctgaacacttttcaaaagaagacatacatgaggccaacaagcacatgaaaaaagctcaatattactgatcattagagaaatgcaaatcaaaaccacagtgagataccatctcacaccagtcagaattgctattattaaaaagtcaaaacataatagatgctggcaagatcatgcagaaaaaggaacacttagacactgttggtggatgtgtaaattagttcaactattgtggaaagcagcgtggcaattcctccaagagctaaaaacagaactgtgatttgactcagcaatcccattactggctatatgcccagaagaatataaattattctaccataaagacacatgcacgtgaatgttcattgcagcactattcacaatagcaaagacatgaaattaacctaaacacccatcaatgatagatgggataaagaaaatgtggtacacatacaccatggaatactatgcagccataaaaagaatgagatcatatcttttgtggaaacatggatggaacggaatgccattatcctcagcaaactaatgcagaaacagaaaggcaaataccacatgttctcagttataagaatgatgagaactcatggatacaaagaaaggaaaaacagatactggggtctacttgagggtgaaggatgggaagaaagagaggagcagaaataataactattggttactaggtttaatatctagtattaataggtgatgaagtaatctgtacaacaaatttctgcgacacgagtttacctacataacaaacctgcacatatacccttcaacttaaaataaaagtaaaaataaatagataaatataaaaaacatagcctaaatacaccaaataatttgtgacttagcttcttcttttataaactaatgattaaaaataaatatacctcacaatgttgctgtaaagggtaattgagattatatacataatatataaatgaactctaaagtactttatatatgcactttattcctcagagaacaagaatgtcttatacacacacacacatatatatgtacaaacatacaatatttctggtaaaatttttggtaatgtcctattttatatgctcagaacaaatgggttgttttattattcaacaagttatggactcttttatatttgccattagaatggttatcattttaatatttcctaaaatcaaactagtattaagaaagtcaggtaagagaaagatttattaagataattttgggcaacagcttttttgttcctttgtttgattaattcttgctgtccttaaagataagaaaacactcctagagctaggcaattagaaagccattggttatctatgaaagtggttttgatagagagacgtgattttgccaaattgcaaagtattaaaaagtgaatcattgctgaaatgtggaagcaacatatgtaaatcttaattcccccaattctttgttgtgaaagaagacagatcagagaaagaggagggtttagagaggcaagaggtggtgatttttacagaaaaagagggcatgagaatatcataaggacatttttaaaactaaagacaatgatggagacaatgcatgaagtgagaagaaacagcggagagaaagaaatccagagagagaacatttacaggagagtctaagcagcacagagccaagatgcacctttttaaaaacagctttatcgagttttaattccaaaattaattttgagagacaacagagacatttttttcaaagataagaaaaaagtgtttaaaaatacaaaacaagcaggacatggtggctcatgcctgtaatcccagtactttgagaggccgaggcgggcggatcacttgaggtcaggagttcaagatcagcctggccaacatggtgaaaccccacctctactaaaaaaaaaaaaattagaaaaaattagccaggcatggtggcatgtgcctgtagtcccagctactcaggaggctgaggcaggagaattgcttgaacctgggaggcagagtgttgcagtgagccaagatagtaccattgcactccagcctgggcaagagagtatgactccttctcaaaaaagcaaaacaaacacaaaagcaacagacaaacaaacacccaatgtttgaaatagaaatgctcaagatgagtggtataaagaagaaataatttgaaagaagttgaagaagagaacaaatgttaaaagaaataggaagaaaaagtagagatttcactgggaaaataaagcatgtgttactaaaaaagcgatgagaaaaagaacagcttatgagaaaacaaacagtgaaaattgtcaaatataagtttccagaaaatactagaaaacaactgttggtatggcaaaggtgagtttttttcttactgttgtaaagcagtaagaaatatcacatatcacggtatctagtaccgtaatagagacttaagagtatctctgtggagattgcaatgtcaagatatttataagtttgggggactggctgaaggtgggtgtttccatacagtgggtgaattcagactaggcaaggatgctgttataatagtgtagaattgatgggcatagcaaggagagagttctgaggtgagggttctaagagtcctggaaaataattgtttgatgctattaaacagttgcacagcaaatagattttgcaggaactctctgaaacaaatctttaggttctaaacaacttttatcttccagacaagagttgccttgaatagtagagggtgttgatgaagacagtggaataataaacttatgttagtgaagacaacaaactgtggggttgcagatgtttttgctctcactccgttcatttaagaaaaagtggaactagatatgtttccaatttatggcaagaatttctctcctaggaagggatgatattgaaggaacatagttcaacctagtcaatcaagttctattaagacaagtattcaaaatcttcaaaacttattacattctaataatcgacctgtgtaccttcttccaatgaaagggtgaacattgatttttagagattttaagaatgccttgtaaactttgttggattttttattttcttcattcttgaaacctcaaaatgatctctgaagaatatcttatctttgcctggccccctaactctgtgctctttcttcataacataaatacatttaaattgtaagtataactaagaagtatagcaagtgtaatgtgactttgccaagttattatgatttgcacattttagcttaaaagaaactaaatattatagttaataagcatggtaatatttatttgccttataataaccatatatcaataataacatatataaataaatatagattctgaagcatttagtaatgcatgttattacttaatattagaaagtaacaaaaaattaaaattaaaattggaaacaatagtagcaaggaagacccttccccatgagaatacatgagaaaactgggacctaagacaaggagctctgaatatagccaatatgaactgaatcttaattagagaagcgatctagtcttcactgtttgcatattcaaatcttccattaacttgccagcagcacttcagttttaacatatcttcaggacttcattaaatgaatctagatggttttttttttaagttttaaaacatttacactgtgaatatatcattttacttatttatggagtttaacagattagttaatgacatctcctaaagcagaaaaaaaggaagaaaaaatgggaaagaaaccatgaaagacaaacgattaagtaatttagatttttttaaattaaaactacaaggcaaagcgaaatatatggcgcttgctattgttttaaaaggcagtgaaaataaagaagcataatggtataattataaacctttgaatttcttcactgacaaaagcattcaatctattaatgcagcaaaagtgtgtttatatctagctcaagacaaatataatagcattatgtttcccaatggtataattttaaacactgtctataaatgaaaaatgtacacttcgcccttggttaatttttttaagtatccctttgcccttggttaattaaacagaaagtaggattccattgtgagagttctctctactagtggggccttccttctacatttaaaatgaagccttcccctctacacacacacacacacacacacacacacacacacacacacacacacacacacttcatatccttccttctgctgtaattttctccatagcatttatcaccatctggcatacctgttaattttaaatctttgttattacttatttggttaaggtttctctttcccactcccacttccaccctagaatattcagcaatataataacaggaacattgttttgttccctgctttatttccagggcctaggtcactatctgtcacataataggtactcattaataataattgcagaaaaagaggcagaaggaagaaatggttggaaggaaaaaagaaggaaattattattataggtgagttattaactggacaacagagataaacagcagagggacagaattagattcctaagccctcctagaagtgatttcctgtttcacttttatttcactacagtatcaaggaaagagggcctagagctggatctcttctgggaatagtctctactctcacttgtttttccttggcatctgtttttccccaactctcattacactgggcaatttaggacttagcagagaagtggtcaaggacagcactaagcctggcattagggctgaagtactcttagccccacctacacaaaaattggtcccacgtagggtctatgtttgtttgaggacaaaacttcatagcaataaaaaaaccacttgtgtaaaaatcactaatgactttcatgttgcaaaatcccgtaaatgattttcaggcctcaagccctgtgatatcccatcagtggtcaaaaaagatggccatgtgtcttttaagctttctgctagtttcatttccgtaacactggactctaatcttttgtttctagcacactggtcgcttctctcctaacattagtgatgtttactacattatcagggctataaaacagtagaaggcatagttccgttctttttacctaaaactctattttatatcaaattatggccattataaacattaaatgaaaataaagttaaaaagactgagataaagataaaacagcaatatttctaaatgctgtctaattgcaatggctttatattatcatcagcaaataaatcaggtcagaatatacatgatatactttgattaagatatattattaataattatgtatgaaaatccaagctttcaatagctttcttaatttttttaaacacttagtctgatctcttggttgtcttcatcttatgaagtgccaatgaagaggtccaattaggatttagaaaagattctgctatgccattttcttgttatttcctgtgagctcattattatcatgtacaatctgaaatttctttacattaatacttcaaagcagtctgttcatttagtgagacatattttagttaatactagaaaattcaatatttaaacatacttcatatatttattatttatttggttaagttttgcttctagaaacccccacactagaaagctcagctccacaattgctcaactttactaggcatagataatcagatttataatttattgattggaaaaaaatatataaaatactgctctcgatgtctttatactgtttaatttctattgtatcctaagaatgaaaatgatgataaaataatgacaataataataatcatcataaaatgagtaaaaagaggaggaagaaaaggaaggaaaaggattagaagctatcattttttggatgactttgctatgtgtcaagaattcttctaaacaaattgcatgtataataataataatttctatcaggaattaacattgagtttactctgagaatttattccctcttaatttttggatgaacaacaggtaatctcttgtcctttgacatctttactagtctttaggatttctcagataatattgaaaatggctcaacaattctccaaatcctttcattttcataggacataattcaccttgacttagagattagaactaaattaggggagacatagagattggtggccaaggttgagagtgcttgaagggggaaataatctcttgctgagcaattactctccattttggtttatttgtttttattagtcctttaaggtacaaacgacgggggggctgaagcagattaaagggccaggagtaaattaccatattcttctccaagaagtgggcatactccttggttattttcttataccgaattctcaactgaactcctaatccttatcctgagtggcttcaaatgtctactaataaaatgttttatatttcaacaaacattaacagatttgagctacattttcttattcattctaaagtatctattctttatcacttaaatattgttagatatttcagtgtgcttttatactgtcagagttaggtaccttctttttttttattctttataagttattgtaatgaatggatattatttctaagactcccacattttgctactgttacagaaattgtctcatgctttcttcactgaggaggccaatgtgcatttatcatttacacagggattccaatcatttggcttccctgggccacattggaagacaaagaatttcttgggccatacataaaatacactaacactaacaatagctgattagcttaaaaaaagaaaagcaaaaaaatctcataatgtcttaagaaagtttactaatttgtgttgggctgcattcaaagccatccacgggatgcaggttggacaagcttgatctacaaaaaaattcactacttcagggggttctgcactgcagattacgggaggagttccctagctaggtgcacatgccacttagacctcatacttacctatattttcttctctttttcttgctcacccccacacatacacacactcatgtttattcttatttctactgtaatatattgacagcaatgttggcaacattagattaaatggagcaaggttccgttgatgaaaaccatatccagatagaagagatatgaattatacttcttggtaaattatttggccatttctgattggctataacaactaacaaatataataaaataccatttccatttttactgagccagtttaaggagataatgataaattataacaacagattttactgtccaattttatgaacgtggtccagtttaggttttatatactagttctacaaagcattgcataccatatatcaaaaaggtatcatttgacataggcaatagtgatccatttggtttctaaatgtacattctacctatcaatatcagtaaccgtctctttcatagaaacttgcttgttattttcgtttactttattactgtttttcattccattttgtgctcagttttatctataatcttagttaatatatttctatttttatatttttttctgctttggttaattttattcatatgccaataacagcagtcctttattattcatccagaaaactctgtgggaacccagaaaagtagatccagatatgaaattatagattagtatggagaatgatttaagtataaaaattcattcattatagaaatattcaaagagtatctactttgcttcagacactgcaattgaaacaacatcacgctacctgacttcaaactatactacaaggatacagtaaccaaaacagcgtggtactggtaccaaaacaagatatagaccaatggaacagaacagaggcctcagaaatgacaccacacatctacaaccatctgatcgttgacaaacctgacaaaaacaagaaatggggaaaggattccctatttaataaatggtgctgggaaaactggctagccatatgtagaaggctgaaactggatcccttcttgtaacttatacaaaaattaattcaagatggattaaagacttaaatgttagacctgaaaccataaaaaccatacaggaaaacctaggcaataccattcaggacataggcatgggtaaggtcttcatgactaaaacaccaaaagcaatggtaacaaaagccaaaatagacaaatgggatctaattaaactaagagcttctacacagcaaaagaaactaccatcagagtaaacaggcaacctacagaatgggagaaaatttttgcaatctacccatctgacaaaggtgggtagagtctacaaagaacttaaacaaatttacaagaaaaaaaacaaacaaccccatcaaagaatgggcaaaggatatgaacacacacttctgaaaagaagacatttatgctgccaacagacacttaaaaaagtgctcgtcatcactggccatcagagaaatgcaaatcaaaaccacaatgagatactatctcacacaagttagaatggcgatcattaaaaagtcaggaaacaacagatgctggagtggatgtggagaaataggaaagcttttacactgttggtgggagtgtaaacaagttcaaccattgtggaagacagtgtggcgattcctcaaggatctagaactagaaataccatttgacccagccatcccattactgggtatatacccaaaggattataaatcatgccactataaagacacatgcacacatatgtttattgtggcactattcacaatagcaaagacttggaaccaacccaaatgtccatcaatgatagactggattaagaaaacgtggcacatatacaccatggaatactatgcagccataaaaaaggatgaattcatgtcctttgtagggacatggatgaagctggaaaccatcattctgagtaaactatcacaaggacagaaaaccaagcaccgcatgttctcactcataggtgggaattgaacaatgagaacacttggacacagggtggggaacatcacactctggggtctgtcatggggtggagggcagggagagggatactattaggagaaatacctaatgtaaacgacaggttaatgtgtgcagcaaaccaacatggcacatgtatacatatgtaacaaacctgcatgttgtgcatatgtaccctagaacttaaaatataatttaaaaaaaggaagattaatacaactcagtccttgttctaaaggagattatggtcacatctctacacaaagatatgctagtatcattccctcttttgtttcattttattagatttctccgagacagtgccagtggcattcaaagcaaattataatggcagaatgaaaagtagcaacactgcaagtgtaaggtgttttttagagatgctcctgttaatgcagagacatagcaattgggtagcattaaattatgcccccacataaaatttaagtattcaaaacctgaatgtaagtttactcataccggaaaaatcatacttaaaatcactgtttcagtccatgacgtgtatacagacatggtgatttccactgcatgtttttaggtttgggatgcacccgctagattttggaaataagttggaacctatagttttttgctgtattttttcccttttcttttaaatgctaataaaatgttgaattctcaagtctgaacctttcactaagattttccaatagagggtatattctttttcagaattcaacaaattaattgcggaaagctacttcagcgactaaaaatgtcctgtttgtttcagaagcaagaaaatagattacattaaaacattttgtttgagttaaatgtgtgccttacagttcaaaacgaagaattggtggaacattatggtcatatccagagactttatgaatgaaaatagattaacattagatgaaaatggtatgtgtgatacttattatgttatgaatgtatcaggtagaatgattaataagcattggccaaaaaaagaacatctaaatcaaaatggccataaataaagcttgataatatggtttccttttctctctctctctctctctctctctctctcaggaattatgagatctgttattatatttttaggtaactgttcagaactattattcccataacagcaactttccataaatgagtctctgtggcaatggtctatcatagaaatctttgttcaccatttgaaaaggagggattgaaaactataaatttgtcaaaaaataacacatcagcagtcagacaggggaaagtatcatgtggatgctctcctgacgcttacttgtcctctctcccacctgtcttacgaagggcaagtggataataaaatgaggaaaaccatgacagggatgtatgtaatgcaacgaagaacaagcaaaggggtttggaaacccagagtcaccgagtttctaatgctcataaatggtaaatgaccaccactagaaggatttatgtgttcaatattcactgctatacttccctttaaaaactaaaacgaaaaccctgctggaaataaataaaaaatgtaagagatactactatttttgcagttattactgaatagcatgctggttctacttctctaataatcacttttttaccataatgtaaatgattaaatgaatagtcttactctctccaaaatagtaggaattcatgtgttatattactttagtgttgcattccaagttaaaatgcaaaggcaatgcaaattgtgcagtttctttagcttaatgaaaatagagtacctatatatagggtttatagttttacatgtaaatccatatatttcagaacaatataaaaagaaacaggattttaataagagtcttggtgttcatgctataaataaaatcaactccagagaccagtgataatggtctagtaaatataaaatggctgctgagtttgctggcagcttacagtcagctcattagagttattcaaatgtttgcttcataaaggaattagtgaggtattaaaatgctaaacaaaaaaaatccaataatgtttcagcctcagtgttgcacatactttacaacacattaaaccaatatttccctcttctattacctatcatagtcaccagaacattctcattttgttcaactttataataacattatttgtgaaaacatagagcaacctttctctctatctctctccccctgtgctctatttatcatcagtaatgtgctactttgttctccaagcactgaggtatgtccttatagcataggctcccttataaaggtttttacccacataagagtccataatatcatgctcatactaaactcatttcaaacaaaatgctaatcatctctggattctgttgtttttccacaagtaaaaactaaaatttgttttttagtctgttgagatgttcatcagatttacattttccttctcattacagaactttaaaatgagccacacttcacggctcaaagtgtggaagatgtcattaaaccagcagtctaatcaagaaggtgtaaaaattttaattaaactaatagcaggctgactcaattattataaaatatattaaaacacatgctgtacatgtgattatattcataagtcatatacaatttttatttacttttctgaacatcttattaaattgaactatttctttgtagatcgtatatagacaatattcaagaatatatacatatacacacatacacatatgaatatataaggaagtatatatacatacatacactattataaataccactctataaaaatgtaatattttggatatggatcatttcactgtttgcttttttagaacagataatgatgcaatactaaagccaatgcttaagaaatctctttctataccttcccttgcatgtgaatattgcttttcctattttagcttggtgttattcctaaaatcagcaactcttgctttttaaaaatggcaaaattcaactttgttaatgggtgccaaattaaaccctaagtttaagttaatcaattctcatttcatgagtattgtcattgctctgagttacttttttttcctttaattgagccctcattcttgctttttctatcggttactttgcttgtacttattttcttcaaaaaagcccaaaaattttcgaaggacttgtatgtataattctacataatttttctaagaaaaaaatctatagttatcaccaaaagcataaatatcagggtttttgctatgaaaacttgtaatcatggctttgtttaaaagccattggtccatattcacctcatttctagatgtcttacagagctccattcttaaggaaactggataagatagcagtataacttcacactgacaaagagatgttccctctgactgcagaaacaactgcagaatcaacaatccaaagtaagggccaacttctcggatgctaacaatgccacttttgcatttacctgaagtggactatagtttttttgcagaggcagagatgaaaattaacaattaccttggattggcatattggcctgaataatactgtagccaaaacgcatcacacaactttccattcttcctctgctcttgtgtccacaggttggcaaaggacgtctgtcactgtttctgaatcttccaatgttataaatttcaaaggtaaacacatttttcaaacatgttttagaaaacaaagatgacaaagaggcccaatgtatcaatattaagaaaattaaagagtcttacaagagatttcttcacaaaagatctgtattattgctgcaaagaggtattttggggggtattgtttttcttttaatttattaattacactaatatgtatcacttgtctctgaagcagataaaatgtagattcagtagataaatctattttttaaaacaacagcctctactttaacagctatgacagcatataaaaacaggtggccatgcttttggccaggatttatactatcattttttctatgaataacttcctgataaaagatgtctagatatcttccaaacaaatacagtgtaagcacaccactatgaaacctatgcctcactaaatatgattataacaaacattgtcaagaaaaataaccttttataattccttttagaaacttaattgctaaggccacactcaggttttggtatggagagatcaagacctacttcaatagctgctggctctcagttgtacttctgagccatctttaaactacttagtaagcattactccagatggcccatcggcagctgacagcaattctacccaccactgcatatggtccactgatggttgataattgtcattcaggtaaaactcactagagctatgtgccaatcataaaacactcactaaaaaggggatcaaagcctgagcggacatgtagtttctgtcccgattagataaataattagtcactttcaatggaaagcttcccttggatatagcaaaaaaaagaaaccaaaataaaacaaaacagaaaaatcaacccactggggtggaaaatgtttgttaaaatattttgcatgagtgattggccactaaaaccaccgcctacctccatgtgaattattttatgtattttaaacccacttaactgatatattttttaataaaaatggagtagagaacacattttaacttaagcatattctttcaaaaaccataaaactgttttccacagttgcatgcatgtttgtattttaaaatatttgttaagtaataagtttaaataaatacaatttaaacctcatttaagtgttcctggacgggcacggtggctcacacctgtaatctcagcactttgggaggccaaggcgggaataccataaaggtcaggagtttgagaccagcctggccaacatggtgaaaccccatctctactaaaaataaaaaaataaaatagctgggtgtggtggctcatggctgtaatcccagctacttgggaggctgaggcgggagaattgtttgaaccggggagacagatgttgcagcgagctgagatcatgccactgcacgacagagcaagactctgtcttgggggaaaaaaaatcatattgcagaatttcttttatttctttataatgcctcagtaacatggctaactcataacagatctacctttaaataccaactgtttaaaattaataagctataaattctgggtaaaatattttctaaaagtgccacatgttgcaaacagttatttttacctttttgtctcaatgctgttgatacctatgtttactttatattttagggagaatatgagagtaagaaaactttggaataagccttgacaactcaaccttcttaagatcccactgttctcatgtcacatataggttcagagaggatgttatttttaataaactttaaaaggtcaatataaagaatcaaaattactcagttgcaaaaatctgcttagccaaatatctcttactaaaatctatggaatattctatttggtccatggtctaaacttttggaataatgagtgactgtatttgtgaggggaatatagacaaaacacatgagtggagctttggtaattgtattcctcttgatttgaggaaatgcagcctggcatacatgtaacagcatataagctggagtcagactcacatggccctagacaactcacttaaaattcctaagtcacgaaagtttctgtagttataaaataaagataatagtacctgtcgcatagggttggttgtggcaatgtctggggcatagtaaatccttaaaaagtggaagatactatcatcaaattaattttcatcatgtgatgataaaaatttaaatttatgtttttaaatttaaatttatctagaactagaaaataactacagtatttaattgtataaaatttgtatcaataaaaataatgccaaacttaacacagaacattatagatattgttaagtacacagagaaaagaaaacttttctacactgttggtaggaatgtaaattagtacagccactatggaaaaaaagtatgaagagttcgcaaagaagtaaaaatagaactaccatttaacccagcaatcccactactgggtatctactcaaaggaaaataaatcaatacatctaaaagaaaccctgcagtttcatgttaatctcagcactattcacaaaagcaaaatatagaatcaacctaagggtctatcaacgaatgaataaagtgcggtgtatatgcacagtaagatactattcagttataaaaaagaatgaaaccttgtcattttcagcaacatggatggaactggaggccattatcttaagtgaaacaagccaggcccagaaagaaaaaatatcgcatgttctcactcataagtgagggataaaaaatgtgttcacataggcatataatgacagataatatatagatatatattctatatatgttcacatggacatacaatgatagagtataatgatagataatgaagactcagggggctaaggggagtggaaggggggaggatgatgatgaattagttaatggataaaatgtatgttatgaatttcttttgaatacatcatattaattgttttcacaactgtaggaagtaagtagggcattgttccccttccttagacaaaattaaggcacagggaggttatataatttgcctacattcaaaatattttcattgtaaaaggcacaatttaaaccaagatgaccctattccctatgccactgctctcaccagctccctgtgttaccactaattcctatatttggtactctttataaactttctattatataatagcttatgttctattaagagttatgttctccataaatgcctcagcttgagtaaatgtagaacaaccttcatgtatttccctccataagggagatgataatggataaaataatttgatttatggttcagactaagaaatttagaatatttttccttcttataaaatgttttaaaagacaatttgatatccttaacatttctcattgcaggcaaatattgatccttttatctcaaaattattttgtactttaatttaaaaaaagaaattaaaactaattaatgtaaatctataaatgagtttttgcaacattgacaattatttaaataatggttaaattactttacgcgtgtgagtatgcctctctatatacagatagatagatacgtatgtatgtatataatgaaaataaattcaatttgaaatataagctgcaaatgcctataatttagaaaatattttcactctttataaggcatataattatatgtaaaattaggacattcaacacaatgctaatattttgatttagtctcttatatttaagatagtctgctgaaacaaaatgtatacaacaacaaatacctccgtcagaataataatgcaaattaattatgcctgagttctataaaaatatataactgaaatatacttatagaaatctattattagttaatattagtgttggcaaaaggtcaaaaaagattgttatgttttagtcattttaataatgattagtacatggtaggaggcaatagacctgtcttccataagccatcataccccttttttatccctgatgttaatcagaagttgacaacacttagtgataaagaaaagttcaaaatgctttgattatatggacatattttaagcttttatacacttaaataatattggctatcaaaattaaaacttctttatatacataaataataacctataccttgaatgtcatctgaatgcttatcacacagtaagctagttagaagtatatatgaactaccagagaataatacttgaaatcacagacaatgcagacatttctcagctccattaacataagcctctcaagagagctctaaaagtctccttttattgattctctccttttattttcttattttcctaaatttcatcgttcagaatcactgtttgaaaggtttctttccagtttagccatatgtagaaagctgaaactggatcccttccttacactttatgcaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaagtgggatctaatgaaactaaagagcttctgcacagcagaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaagcacatgaaaaaatgctcgtcatcactggccatcagagaaatgcaaatcaaaaccacaatgagataccatctcacaccagttagaatggcaatcattaaaaagtcaggaaataacaggtgctggagaggatgtggagaaataggaagacttttacactgttggtgggactgtaaactagttcaaccattgtggaagacagtgtggtgattccttagggatctagagctagaaataccatttgacccagccatccattactgggtatatacccaaaggactataaatcatgctgctataaagacacatgcacacgtatgtttattgtggcattattcacaatagcaaagacttgaaaccaacccaaatgtccaacaatgacagactggattaagaaaatgtggcacatatacaacatggaatactatgcagccataaaaaaatgatgagttcatgtcctttgtagggacatggatgaaattggaaatcatcattctcagtaaactatcgcaagaacaaaaaaccaaacaccgcatattctcactcataggcgggaattgaacaatgagatcacatggacacaggaaggggaatatcacactctggggactgtggtggggtggggggaggggggagggatagcattgggagatatacctaatgctagatgacgatttagtgggtgcagcgcaccagcatggcacatgtatacatatgtaactaacctgcacaatgtgcacatgtaccctaaaacttaaagtataataaaaaaaaaagaaaggtttctttccaagttcaaattctcaactaatttatcctagtttttctccttttccctcaacactaattcttcaccaaaagctggcatctctagctcttaacacctgtcacattcttttctttctctcaatcctcacgacttcttagatcagaagtggactagtgaaaccatcactgagcccagtattacaacctgatcattgaatatactgattaaaacaccaatgccctcaaatgcagcagtatctaaaggacaacgttaaatgttttataatgctatatgaggttcttctgatctttcactagccttctatgctccagggtctcccttcttcactcacatctcctttctatatgaatgctgggaccaaacaaactactcctatttcccgaggatgacaggttgtttcatacctcattatttttgctcatagtgtccagtgttccttctttattggagcttaccccatccccttttcatttgctatcacatttgccttccattgagaacacctgtttgcctttcttgtcaggtccatacgtaagtccctgttactaatatagctcctcctttttttgttttagtttaataagatcatggtattaagtattattacaattcaaagtgtgcagagacaatgatgtatgtgtttgtccttttctttagggaagatgttactagatcaaaagcagctgtcatgcaataactcatctgaagacccatatggaaagagaccttattacctttcctagtcctttacttttatctatttctgtaaatataagtttatatacacacaggctcttgtgccatttgctgtcttcattaatataaaaatatattttgagatacacgctgtcatctactggacataaatgtcttcagcacttcttatcacaggtactttccagttttgctaatcgaggtatataaaacacctactagtttcaggacatagttcaagggactcctacactgtaaagccagtcctatcctcattgctcaatttctgatagggatatcctctgctctttgcatttcagttacgtatattacagcattattattctgattcacctaggaagaaatatgctcttatgtcatctgtctaataatgtcagatattctgtgtgatgaatgttaccacatggaaaacttgtcacctaatttggagggtgtgtttggaaatagataaaagcaatggggaggaatacaacattataaaaaagtagtaattttataattaatgttcaaaactaaaagttgactcccagagtctatgcttaggagatgacagctatatttttaacataaatatttctattaaagaatgcttttaatgtaaatatataaaaacctttgaagaaaatttaagaaaactctttataaagtgaataaaggaatctataggttcttttagtctcacaattgatcagaatactgtattttaaaacattacatatttatttggaataccattggtaatgtaataaatcaatcactataaacaaaaagtgttattaattccaaagacacctgtgatatttcagatgaaaattataaacaattattatgcaacattttaatctgaatactatattttaaatgtcatcatagagaagagacatcttaatgcccttgactacatcatataacccacaaaaatatgtctgcaatgatgggagaatgcaattattttttttatttcaaatttagttgactctctagccttcagtataaataaaatatgtttaaataaactccatatgcatcactcagtctcccatataaaggtaccaaataagacctatgccttatttcataatgaaaaggtacctcaaggcactttttaaactagaaagcatgatgcaaatgtattagatcaaagattcccgactacaaaaattcaatgtttcagttcaattaataactaaaatttatagtcaactcttaagaaaatgttaaatattctaaattagagaataattatcattggtttgctttgcttagctctccatcttatatttattctagcaacctaaatattcaagagtttaagaaaggagtatcagacattctttctcttaaaaaagaatgcctctgtatttgacaatagtgatcagcagtatcctactataatatgtactcattcatagtaaaggctaacagagtcacaacaaagcctatacttaaaatgattgtttgaaaacagcaggagttaaataacttttctttcaaatataaacacttgcccacactgttgctattggtggagaagattcttttctctgcatgtaatttgttttgtcaaagcttattttctgtttcgcacaatgagaactttattatatgcagttatagtctctgttttctgccacttttatgaatcttataaatctggactggttatggctcccagttaacatgatgctgccctttgcacttctttagtgcatcttaattttttggcttcatgcactgagtgaggtacaatctctatgctaccccgagcgctggactaggaattggtagatgaggaggaaaactctcaagagagcaaatacgaaacactaaactgcgaatttttcaattttatttgaatctcaagtaagaatattttttgaaggacagttttgctcattatttcctaaagaaggggcattactgctccaaggactcgaggaagccaatgcaagttggcactatttgagcaaagttcaaaagtacaatctgtggaaactgaacaagaagaacacttgttccctcaagtgtagccagtgctaacagtgcaaatgaacaggatccagcaggaaatccatatcttccagaaggtgctgtctttacaacattgtaataaggtatcctaatagcactttacacgactcatacagaatgcaaagtttctcaaagcatttagccctcgttttcacaattattttagtatattcaatttcacagaaagaaatcaaaagacagacaggtgaagtgatttgctcatggtcttatgagtaaagaggaacagagccagttttacagtctgaattttccttactcctgctactttgctctttttcctggatcaatgtgctcatcactgcattagacctctgttataaatcactacttcaaattattcttatttatttatattgtactttattcattccaaataatatttgaagacactttaagaattgcttacagcacagcaggaaaaatgaatatctggatgaatataaaataaactaataatcatgcataaaatatgttttattatcctgtataattatttaatgagggttacacattttggctctcagcaacttcacagacaagacaaaggaagaaaaggatgagttataaaaatcagtctactaaaacaaatcaattattcagaagtgagttttccagtggcttatggcccatatagtgtcagttgatgaggctgcctttgcttttcatgttttcagacctttaaaagtacctatttttgtgtttcaaaaatggacatacacacacaaatacactgtacagagacaacgcagcatttctggactatcaattccctaagatgattaaagcggtataacacaaagtgaaagaagtttgaaaagtcatttagtaaactgtgaccatttgtcaagtttcttagaagaataacaccctcaataaactgctcttttagaacacattagaagatgataatatgtcaaaaatactaatgtaacatttttcttgaaaagacagtgtttacaatcaagataattcttctctctatatagacattgatatatgtgtatgaatatatatgtatatgtatacacacatatataaatcacataaattgttttcagtgtccacattagcattagaaataaagagaaatgaaaggatgctctatttgcttctcccaaccctcactataaatgcctttcactcaaagttcatatcatattgtataaggcaatgtgataagacagtatgataaggtgacaatttgtaagacaggaattaatattcatcatttgagaaatagaataaatcataatgaattagtctccaacacattttgttatatgtatacagtacacatattatattatataaaatgcacgtattcttactataatcttttccttacacacacacatatacacacacacccctacacatatgtatataatgcataaactcttacttttctctcttctagtgcttgaaataagttctaatcaattaaaattatttaaacatttattcttcagcttgtctctattatttcctgttttatttggatgaatctctgtccaaaatactgacaggttttctgtccacgagcttgtcaaacattcctcatgattgccatggaggaatggaggagaactaacgcctgaggcttggttcaggaggggcttgaaaacagagtttaagagctaatatactcacggaactaaatatgtactaaatgtagatgcaagatgtccacttacatgtgccaacttgtcagttaagtgtcaatgtgtgggctgagcttaactgggtagtcattttggaagcagtcccttagctgctgagataagtatatatgcaataaccaccttcttagcacaacaacttgacctaattttacaattccccgtgtttccctgaagaatggtacatttacagaacccatcatccctatatacttgctttctgtcatcattagtgatcctcatgagactatatgaaatttgaaatggttttggaatccacattttaatcatagatagccaatatcttttaacagaaagcactatttagaagtatatttcaaaaactataaaccagcttcaaaaatgttacatacattaaatagattgcacaaatacatatattcagactattgcaaattgatagctttttccctcctgagtttccagatactgtttaaggtgttgccagttaaatatgatcagcactgatgtggtatttccaatttgactttcagatcatgtagcacaaaattagcacagaacattaatccaaaaattaatgtggcttgatatcagaagttaccttaaggatgctaagttatgtatgaacgatgcttgattactcttcaaactttgagatactattcctttaaagcatgagggttatttcactgaatattgtcaatatttccgtgtctgtgtttctctactttttaatatctgttattgagcaaacctacagtgtaagaccttgtgctgagaagcagatatcttcaaagaagggtgacatggttctatcttcaaaaattccaacgattccacagaatagtccatttttgttttatcagatatatatatatctgataaaatgctatatatatctgataaaatgcctttcactcaaagtgagttttctagtggcttatggcccatatagtgtcagtagatgaggccgcctttccttttcatgtattcagacctttaaaagtacctattctgtgtttcaaaaatggacatacacacaaaaatacactgtacagagacaacacagcatttctggactatcagctccctaagtctacatatatatatatatatatatagtgaagggtcatgttcctataatataaaagacaaactcatggttcagaaaaatttgatttactcaaaataacatatttactaagtactagggccaatattcagcacaggtggtccatttattaagtaagtcattttcattttcctttttggttcagttttcattcatataacaattactgagtgcctatacagatagtctccaactttatggtctaattaatgatggaggtaacctcatcgtgtgtcaaggagcatctggaattataagggttccatttatgatttttggactttatgataggtttatcagattatcaaatgcattatcagtttatgatatttttgacttacgatgggtttatcacaacataatcccattgtaaatagaggagcatctatacggtgataaacaacaccacattgagaaaattaaggaaaatcagagatagacttcaacttcaagtaatttatgagtctttggactccaattcgatgtttttgtttccgccactcccaaggttgtctggcaactggttgatttcacattccattattataataattattgtttttgttttttaatgagttattatctctatttatataattcctatttcagcagtatatgtggatctctttcaagacctctgtatttacagtttggcaaaggaactggcatactgaaagagaaaaaatataaacttttaaaatctttttattataaagctcattaattcagtctctccttatagtagagagctcagattttcatcatctgtgggaagggttatatctacttgccaggtgtttgatgggtagctgtctgctatttcatgaccatagtttctgaaactgaagtggaggagacagtatgagagaggttctgtagaatgtgagaccaagggtcccagtgagtcatatctctgtgtatccacgctttttgttgtcccctgtttggaccagagagaccatgtgacttgactgctaaatgggatattaacaaacatgatacagcagaggtctgaaaagtgcttgtccgttggagcttaccttcacttgccactgagaattcctctgccaccagcttaaactgtcaactcacagcatgttttaagccatttagtctgtttcacagcaataaacaacaaatacagagaccttcgttcagactccggcatgttttgtgtcactcacgcgtttgagagtacttcccctgaatgactttttatgacccagctagggagaaaaaggatgccccaagcattgtcactactaagtctagagcaatgctggcaactaatgctatcgtcatggccagctgtgaaaaatcaagcaaacaaacaaaaccctacatctggattacttctattaaattaaattgtattcaaggaaaaagtactagaatgaaaaaggaagataaacaggattgttaagcttgaagttacattggacatttatttacaaggtagtggtcttggacacatatttaagggtgaagaacagaatgaaaaactctctgaattcaagggtttcactattaagtcaggcagaaagtaactatgatcaggaaaaaaaaaggtaagatatttttgtgcaaactataaagtgagttttaaaaaagaacaaaataacaacaacaacaaaaaataaaaataagaaagacacagactgtttggaattttccacaattatttttcctacttttcacagccctctccctctcttactttctctgtgatggtggtgggaggagccaagggagcaagtaatagggcaggaatgaaaatcattatttttcttcttaaataatgtttcttgttgatacattcatttacactgtactgtttatttttaatcttccctaatttttaaattgggttgaaatttttcaagtgctcatctgttatctgtgttgttacggttttgtaatataacgtttgcataaacttagaaatacatgtatcctggaacttaaagtataacaataataaaaatatatatataatagtttcaaatataaattttgcatctactaagttaaatatcctaattaagcttttacataaatggttaaaaaatcggctattactatttttactattagtaataactgctctggcaatataataaatgtactttactagaattatcttgaatttgttataggaaactataaaaacagtttttgtttgaagcatcaggtattcctttaaatactcaataagttaaaacaacattttctaagattgcaaaaagtttatttttgttgtcattttagttagttttttaagttagtgctatgaatttttaaaaagagcttcttcaaaatacaatttgctataaaatatacagtactatcatataaatcatatcagcatagatatgaacactccatagaaatattttaagaacagctggaaacttcctggtaattcatatgtaaagaaagggtggtctggagatttgagtggagataaatggataagaaaaaggagaaagaactggtgatgagacatagagaaagatagagcaagaaaacagcagaggcgctggtgagaaggggttaaaatcaggaaccacagcaaaagtaaacgtgttaatggtaaatgcagaccaaacttgaaagcaatgagaaatctaggttggacagatcatttcacctcgagagccaataatatgaaataatagccaattgtaatagagtatattttattaggtgtgggcagtttctcaaattaaaaccaatattaaggttgtagaggaacacaaatcctgtctggatccatttacttcaacactaatctccatggcaatgaattgttctaaattactaatttataagtagaaagatactgaaatttggaatatagactcctggagatgaaaccactgaatgtgaatccctatgttcacacacttagtacctctattttaatcaaaatcattttttactcttacttcaaagaaatagcaaaaatatttcacagagtgaaaatatccacatgttctcaaatttctaaagctataaccttatttaggacttcatcgtttccaacccaaattttggctttcgctttctatccagtctcatgtcctccaattttgctctctcctagtccaccatccacaaagctaccagactgatgcatttaaaatgaaaatctttcatattagttaccttacaatcattcaactgctttccacaataaaagctcatatattggagcatacggtgaaaggcctttcctgatttgatctgtatttatctctttacaagtactaagagaccaagatggacttcctttactctttcctatgtatcaggcagtataggcattctgaatgttttgaattttctcaaaagtgccaggttctttcatgttgctttacttttcaaatcagattttctattcagaatgcttttcttccctttgacaccgaatatatttattacatttcaagcctcagtccaaatgtcaccatttctgtaaaaactttccaattgcttccaataaagtatttttttttcctttctgttctcatcatatctcaacttatccttattattgtgcttattacttactatactatactcatctgttcatgagttggtatttacacttaaccataagtcaatgaatggtcagtgacaatattttaaatatctttgcaatatctgtttgtatctggcacatacagcaggtagttaataaatcaaaataaataaatgaatgagtggtttaagtcaaataaatccacgacaaataaatacactagtaatatattcatttagtatgtaagaggtattctctagttcatttatttaatatttgcatacatactaccatacctattagtaaattacaatcattggctatcagttgacaagactaaatatgtctactgtcacaagacacatcatgtctgatgactaaaaaaactggagaaaaaagttgaaaaatttttaaagcttattttttattttagtatacgctaaatataaatgtttgaagaccttacataatcactaactatagctgattctctcataaaattctacaaatctagttcttgagcttagtcaaatacatttgatttgagcttattatcctcaactaaaataccttaaatgcagaatttgttattgattattcagtaaatgtaatttaaaatgtttcttaaatccttatttttaaccaatatttaattatttctttccaaagttattatccttttggtatgagaacaaatctgcaatcaaggaaaaagggtattgaaggaagtagaaaagatttctgaataggttttagtagcacttgctaatttacttgattagttcaaaagttgcagaattatgtaagtctgaaaggtaggagaatgttacagatagtttgacctataagaataagtttgatccgatattggtttatgtggaggcatagagaaggggcaatccaacagattctgaagaatgactctaaagctataggtaggtcagcaaagggatctctgatttgcttcttttttcctccagataggtaaattaacaaagcaagggttaataagggagagaacttggtagcaaatagtcagagaaactgagtccctgccattgctgagttcttgcaagaaatgttcatttgaaaatttgtaggttagagtacatttacaaggggaaaacaaggcaagcataaatctttacttctgcttgtaaaaccattgttaaatgttgtctataatgataagaagttaaaactggtagtattatggtcctatttttgcttgttgggaaaataggatacactaataattagactaaaatatacagtatggcagccaccctatcatgtttcttgaaaaactgacaaattaccctttcttgacatgtattagttgattgttgtatgtgtagaaatgaatgtattcacacatgtctgtttggatattcttttgagggatcaagtagaattttctcctttggcatagaattatacattttaagataattaggaaaatgaacagaggaatagaattctgccttctaatgtgagcaatttcagaaaaaaaaaaaaaggcctggatggtgtttgtgtttttttattagagatagagtcatgtgttaatgtggattgtctgaaataaagtcagttcactataaaatgttcacattgagactatatattcttagaatccggtcacatataccaaaaaattaatgaaacctgcagcataatttttctaccttgtggaactatcagataaagtaatgtctgatgataaattgggtttatggtgagccgctacattcaatctatggtagtaaatcttccaaactaacttcacatagcctgcaagccagagtcaatgtactgttcaccaactgtcccttgaatcaaacgaaatttgacatactagtattcccctaagaaattatctcttatatgaagttacaaagagctcacaataatactgagaaaagaaatattctgaataaagtaattgaaattctctttcaaatacactccattacttcagtagatatccatttataccttaatgttacattacttgatgcctcatagattttttttctttgcgtggaatgcagatagacattctcatatcaaataagatttattgctaaatagctttcccatgaggtctgcttgcctttcccttaggaattctcctcagtattagagtccattacctgttaactacaagctatttcataaagtgcctggcttcagaagatgttaattagaaaaaaaaaagctaataatttaggactacacagagctatttacctcaaattcacacacacacacacacacaaatgtttttccaacctcttatgagaaatcctagaattcatttttttttcaatttacttgttggtgtctcctataagttgctttactctatttatattaataggccacactgagtgctgattgtggctttctttaaaccagttgcccaacattcatattcctgccaagttagactgtataaattgaagtcaagggtcaataattatccagtgactatttaactcaacatgcttacatttctgttgtagctgccagaatattcagaagccaaataaaaaccaataaaagccatcagcttatgttaggtgactgtatcacctattctatccccttactttgattacctctgctttgttttattctgaaatattttattctatgatgtttaacgtatatgcaatttaggtgctttcaaaatagacaatatctaaattttaagtaataaaagatatttaatgactcacaaagaagaatacggcctatttgaaaaatgcatagctccatagtggtaagtagataaaaacacctttacagacataaatactaacattatataggcaaaattattcaactcttccaattccatattaatgggtaattaatgtttcttaactttctttactgaggttgtaggacatgtgatattattctactttaactccagcaatcaaggaaacacagtgggatctacagaatgaatattccactaaagacaagatacatgcctactatgacaattatatgaaatataaaggaagattaatgacaagtttatttaggaatgtaatgaaagtgaaatgttatttggaaactcttatgattccatgagatataacaaagacaaaaaaaaagacctaatagaaatttccaatttaaatacaataaagtgtaataaaagtgtatcatgattttggagacataatgttcagataatctttctgaataaattagactttgtgtttaaaattaactaactttttctaatttttaaaattgtttcatgcattacatgtcaacaattagaaagccacttttctcacagaaaaatagagtaggaaaaattgtacatgtatacagaagaacaatacaaaacacagaaaatacaaatgttgttaagagaagggcacatgctattggcctggaagagtgagatgaagagttcagttgagaatattaggaaaaagcaaaggtatagaggatttcaaacattatggataaataaggtgctttggtgagaaggaatttcttgtggacaaaaagaaacaaaaggaaaagagagcataaaggtacaagaaaccaaaaaatcttgcacttacaggaggaactaattatagaaaagtggtatgagctaagcccacaaagatcaaattatagccagatcacagaaggtcttgtcaactgtgaaggagtcagaactactttgagttgcaattgttgactttgaagcacttgagcagaaaagaaatgttgttggagttgcatttttaggcaggtacagagagaagctggaaacagggaaactaatgaggacatgtctgcaataggagcaatgaagtaaatggaggtctacactactgctatggcaacagaaatgaaaagaaaggaacacatttgaaaaatggcaacagaaatggaaagaaaggaatacatttgagaaatatatagaagatctatgcatacaggacttagtaaccagttacaaattgggtagaagagaaaagttgaagtatacttagaatttggtttgcatgtctggaagaccaatgaaaccattaagatagagtgagtcagggacaagggctggcttgagaacagtggctgagcagatggaacacttaatttgggaagcactaacaagaaagtaaaacaaaaacatcatgcctaaaaatgagcataggtaccagaagcacaggcataatgaggtcaagacaaaatgagaagcatgaagaagtgaaagcaagtgaggtctacttttaagaagtttagtgctaaaaaaaactaacaacaacaaaaagaacacagaaaagatatgttgaataagtggtaggagtttggtttgcttgttggtttcttatattaacctaggagcaggtaaaccaaaatgtgtgtattcagaagtgaaaagggcccagtggagagggcaagatcaaagattcagtaaagattcttaacacaggatccagtatcattccagagcggggaagtacccaaattcaagcccacatgttcagcctctagaaaaagaaaaccaccttctccaccccaccccctttgaaatagaaagaggagaaaggatttgatgctacaggtagtccgagataaaaatgaagaaagctaaggagagtcatatttgacagctttgacttaataatatgtttttaaaaatatgttgagaggaaagaagtgcaggaaaaaatggaatatgaagagagtaggaaaggtctgaaactgtagctccatggaatattcaaaggagttaggaagagatgaatataagaactattgaagagtagtgctggtttggcttaactttttattaaaactatttttttctttttttttttttttttttttttgctatgacaaccattgcacagctaaaagattgaaattctcctcttttagtgggacccaatatactttccaataactccaagaaaatcaaatagtatagaaatacactctagattttaaaaaatcataaatgtgttcttttcaaactgaggagcaagatatcattaaataaaatatgatgtaagtgtgcctaagtgaagttgtttagatattttgtgtgcatggcatgaagccatgggacttgatgtttgatttatctgcaagaaaacctgctgccctaatcaccagtaaacctcaggagacttttgcatatcaaagggacaaattgtttcaatattacgggtatttaaaaggaaactggatccatgaagagagtgatgactttgaaaagaaatgcaaaaaggttttcagaaatcatgggcctaatgtttgtgccacagcatactgcccatgcttatatacctccagttatgcagaatatgtacaagcaaggacacgtttacagaactccatataagtgcaaagggtatttagtgagacgatcagcccaaatatactctgataaacctaggcacttcataacattataacaataatttgctcacataggtattgagatttagtggttcagagagaaaacttttgccaactttcatcccatgtatcctggcagggcgattcctgtagtggaagcagcttttaggaagaaaagtctcctttctagatctcctgatgtgcagcaaggtagctaacaggagatccatttcagcctgcgtgcagcaaaatttagtgccaagtcagctaattttgtagtctacacttgagcacatggcatgcagagaaataattgtcatggaagttaatgagaagactctattttaggttaaccacgtcctctgtcatgtcctacaccatcatcttccttgattgaaggtacctttgggctctcatttgctactgttaatattctcagcttttcacataactatctctgaacactctggcttttgggagcttggtggaaacctgaacctctgccatcagatgtggttttgccaacattttctgagatcaaatcattcttcagaccaaattgccttccactattcccatccaccacatctcctgttttagagcattgaaaaacaataatataactaatcatactatatacaaatatttgttttttatttctcaaatacagacaggaatacagaaagaaaaatgcaagactaagaacccaaagaggtccatcacagtgaagtacatgaccagagcttttgatctaccacccagtttccttcctcattcttcaagtaagaaggtcagacttcaggttctctattatttactgctctattattctatgcaaagtagtataagtgacatgctgggtaatataaaacaatggaagaggtgaattaggatactcagaattcacattaacagagaaacttgaaatcaagcacaacctatgtgctgagaatattgagaataatcatactgtctaacagtttgacactggcacacatagtccccattataatcactgtgtgtgagtgtgtgtgtttgtgtgtataatgtgtgtagctataagtgcatgtataagtatctctattttttagttgaggaaactgagccccaaatataattgaattattcattacgcaattgtaactgaggctacaaattcaagtcttttcgagtcttaagacagcattaactttactacattaccataactaaatagggtggaaaaattcctaacttaaggttttgattcttccaaacttttaagccttgaatgacagataacataattagagagttggtgatagcctggctcttgagaaactggccaaacagagggcaacaaagaggtctacttctgtatatatagatagctgctgcttttgagtgtttctgaacagactaaagtaaaaggaaagtagccacaatggctccaatggctcctgccctgtcatattaatcaagatcatataaatcaggtaagtactaagtataataagtataatacttagtgaaaggtggttcatctaaaacatagagatgaaatataataggaagtgggtaaagtggcaagtgatagtgaacaccttaaatataccttaccggtagtggtttaaactttacatgtatgatttgtatgatttgatcccttcttcactaccatctattaaaatgaaaattacttttttcctattttacatctgaggatattagagctaaggatgtttagttaacttggccaaggagccagcctaataactggcaaagtggaaagagtctttatctgttctcccagcccaatgctctgtccaacgcatcaaatcacactcaagggcattttgcatgcccaagagaaagcattctctccaaatagagaagggatccacttaccacattattatctcttactaatatttcatgctttttcaaatttagagtctttgcaaatacttcattaacttagtaatgattatacttaatgaaaatagcagttattcatatctttgaacttaagacaaaaccaatataattttaaattgtaccctagaacttaaagtataataaaaaaagattctctccctctccgtctcccactttccacggtctccctctgatgcccagccgaggctggactgtactgccgccatctcggctcactgcaacctccctgcctgattctcctgcctcagcctgccaagtgcctgggattgcgggcgggtgccgccacgcctgactggtttttgtattttttggtggagacgaggtttcgccgcgttggccgggctggtctccagctcctgacggcgagtgatctgcccacctgggcctcccgaggcgccgggattgcagacggagtctcgctcactcagtgctcaatgtcgcccaggctggagtgcagtggcgtgatctccgctcgctacaacctccacctcccagccgcctgccttggcctcccaaagtaccaagatggcagcctccgcccggcggccaccccgtctgggaagtgaggagcctctctgcctggctgcccatcgtctgggatgtgaggagcccctctgcccagccacccagtctgggaagtgaggagcgtctctgcccggccgccatcccgtctaagtgaggagggtctctgcccagccgcccatcgtctgagatgtggggagcgcctctgccccgccgccccgtctgggatgtgaggagcgcctctgcccggccgccccgtctgagaagtgaggagcccctctgcccggcagccaccccatctgggaggtgtacccaacagctcattgagaacgggccatgatgacgatggcggttttgtcgaatagaaaagggggaaatgtggggaaaagaaagagagatcagattgttactgtgtctgtatagaaagaagtagacataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctccttaagagtcatcaccactccgtaatctcaagtacccagggacacaaacactgcggaaggccgcagggtcctctgcctaggaaaaccagagacccttgttcacatgtttatctgatgaccttccctccactattgtcctatgaccctggcaaatccccctctccaagaaacacccaagaatgatcaataaatactaaaaaaaataaataaataaacataaataaataaaaataaaaaacaaaaaaagattattatgcacataactgtatataaaaatgcatcatgtatatgccatataataaaatacgtgcttaacttctttatctaattgtcatactagcttgctgttgggaactataagcaatttgtattatttaaggcatgctatttgtcaataattcagagagattttcaagaatgtgcaccacgattatttattgctttattcaaagcctttcagaatttatagtccctaatctgtagtttatattttacgaatccttaggtatgcaaaaactgagagaggagtccagttccattttaaattaagctattatccttgaaaagaactgtaatattaaaatttgatcatatattttactgtcttgttgtttggcaaatgtgctttcctcagtccgtgcactgatcagtttgtagtcattatttaaaaccatcctgctggcctttgttctttctgtgaaaaggcttaattcagaagacttaaaagattttagtgaatatgactgctgctctaccatcacgtcttaaaaaattgttggctgttattatttggggggcacttacattctttggaaagaaaataaacaggttattcatatagaatttcaacatttttaatcattcttaacacatttgatttataaaaatctctaagtactctgagaagtcaaaacccatattgctagcaatcctacatgtaactcactagagggtttgtaaatgccacttaataacatgatagataatcttgacactttactcaagaattctgcatttttatgtttttagtccaccatattaagaggttttaaaagtatttaagtatacgtattttgatatttctgattagtttgactcactacacagtttaaaacacctcaagtggcaaaatatacactaatagataccaatttgaggctctattttgaacaaaacactgtttcaggtgtgctggggccaagcagagaaataaattattgttacaatttatgaattacatttgcttatttccttatttcactagagaattaatttctgaaacaaaatgactggagtctgtgattacaaataatgtcatcattctgttttatataataaagtcaatcccatggcaattgtggctttttcttttttaatactcaaatgcagttgagtattgtggatgagatccttaatgagacatccttggtttgaatcttggtcctttctacttcccgcttgtctgatctggtgcatatcttcagactgttcattatctgtaatcggatgattaaaatactatctacctcgtagtgttgtttcaaggattaaatgaatttcacacattcagcaactagatcagtgacatcagtgtgtggcacaaagcaggtactataaaagtgttcttatccttgttatattgaagtctgtaaacaaatttcactaataaagtggttttctaagtattcatgtgtgtttttcaattagaaattaggctcattttaatttacttgttcttaatacgaatgctttcttagctccttctaaaactatctgaacaaaatgagacaacactaaacctcaccctactcgtatgttacataccacagtaacttcatagcgtcagttaaaggtattattttcgaattaaagcttaattatttcttctgtgggaagaaggagaagcaaatatgaaagcctacctctggagcaaagaaagagctttcctgttagcttctgaattaaaaattccttacacttcttatttatatccttaataatttacagtttcatcagtgagactagtagaagaagcttcaagttcaagagcaattccaaattgttttgaagaggtattatcaatagattattacatgcaaatagaagaatacacaaagaaagctttgtactttattgtgtatatatatggcacattttcttccttcattaatccattggtggacactcaggcttttccatacgttggtcattgtgaatgatgcttcagggaacatgggggtacagacatatttttaagatactgatttcatttactttgaatatgtgcctttaagagtgattgatggattttacggtaactctatttttatttttttttgaagatcattcatactttttccataatggctataccaatttacattcccaccaacagtagacagagttcccatttctccacactctcaccaaaacttgttatcttctttttttatattggccaccctaacatgtgggaaggaatatctcattgtacttttgatatgcattttcctgattagtgttgttcacctctctgatgattaatgatttacctagtggccatttgtatgtcttctgaaaaaatgtctattcatttaaaaaaatcagattattcatttgtttcatttcgttttgttagctattgagttgtatgagtttcttatatattttggattttgcctcatgtcagatacatggtttgcaattattttttcttataacattggttgccttttcatctatgagttgtttccattgttgtgcataaggattctagtttgatgtagtctcatgtttatttttgcttttgttttctccgtttttggaatcagatccaagaaatcactgtgaagagcatatcaatgagcatttctcttatgttttattttgggagttttatggtttcagaccttatatttagagatccttaatccattttgagttgatttttgtgtgtggtatgagtttaattccatttgtttgtatgtgaatatataattttcttaacatcatttattgatcatcctatcttttctccattgtatattctttaagctcttgtcaaggattagttgcccatatatagatgattttatttctgtctccatattctgttcttttggtttatgtgtctgttttcataccaataccatactgttttgattactatagacttgtaatatagtttgaaatcaggtaatgtgatgtctccagctatttgttctttctcaagattctttgactattcatgagattttgtggttccatataaattttagaagttcttttaatttaaaaaataacttaagaagtttggtagatattgaactgatctgtatgccacattggatagtatagatattttagcaatattaattgttccaattcacaaccatgggatttctttccaattatgtgtattcttcaatatcttccctcaatgttttatagttttcagtgtccttcatctccttggttaaatgtattcctaagtattttatttttatagctcttgcaaatgagattgcttttttaaaattatttttcaggcatttcattgttagtgtattgaaatgctaccacttgtgtatgttgatttagaatcctgcaactttactgaatttattatgtctcaccagttatttttttttgtgggggtgttaacatttctctacacaagattatgtcatttgtaaaccaaaaccatgtaccttcttcccttccaatgtggatgtcttttatttttgttcttgcctaattgttgtttaggattttcagtactatgttcaatgaaactggtaagaatgataacccttgtcttcttctagatattagaaaaaaagctttcagcatttcaccattgagcgtgagtcagctgtaggcttgtcatatatggcctttatcatgttgaggttaccccaaacaataggctggtatttaaagttcttttgtgatttaactatgtattttctgaaaacaagcataatacaagatagtatccaccagttattaatgccctataataacgaaagccatctgtcattagagtctgtttctatgaaaaaaatagcaaactatacctactaaactgtaatcaacagattatagttgataaacagaatctggatacccagatttccattttatcatttcagctagttattgtttaattacaaaggccacatatttccttgctttcctgaacatttgccatctgttcccaatactagatataactacccttctctattcctcacctaaatccttatactgctgatgactttggaaaatagtacagggttttacagtctaatcatgacaatacatctccaggatccttgagccaaatacattcctcagaatactttttttaaaaaactgaaattgattacttgtactttgtcatcaccaaaaatatctgtagcaagacatactgttctcagcatccacttctaccatcctcactattgtaactcacagtagactatgcctcctactttactgaaaagatacaaaccattacctagcaatcattcttccaccttaaacatattccatattttctacctcttctctcccatagttcttgcatcagaatgtgttcatcctgaaattattctttgtgcttcaatttttcattcttagcttaatccaggatttgcattaattgtttcctcttgcctttggacccttcatccatttacttgcttccctgtacccaaagcacatatgcagaatttttctttaattctaaaaatgtttacacacacacacacacacatgcacatgcacacacacatataatagaaaactctaagagtggtcctaaagatgaaacaaagtgatcaaatgtactgagtgcagacaaaaaagttcaaaacctcagtaacaggcaagaaattaaagttgagaggacaaaaatatttttagaatattttctccagagatgcatagtgtatatttgactttttaagaatactttttaaaaatgtcctattccataccatctctcaactaacctgttatcaccttgttattggttttctgtctccccacattttaagaaaactgctcactcaaagcttatcaatgatcttcttgacacaaactgatgatgtaactcttttttcagcctcctctggagcctctgtagcactgctgacgagagctttccaattgtttttttctttcattactttacgtgaaagaattcccattgttctgcttttatttctctgctttcagttactaaggtatttatcctcctttcgacctttaaaaattccttccatctctaatttcagtgttttagttccttaactttactgtcctctacttggtcctcaactatcaccttatgcaaaaacgtctagctctatatttcttgtcttaacctatcctttaagtcatacttacatgtccaatgactttttttacatctccactctgatgccccagccacacctcaaactcaacattttttaaacctgccatcacccacattattttgctttacagtagtttttaattccttttgttcgtgatctctctccttctctctctccccttttgtctctcccattcgtcaccatataatttggatagaaactttatgggacatattcatcctttgttgagaaccaatacaatatgttctccaaattctgtgaaatgattggtaaaacctttgttcattaagttgttcaaaatttcagcgatgtagatctttcttcatcatttatttataaggaaaaaactattactcctactgaatgtgattactttcagtagaatataaaatatgtaaaaccaattgtgttaccttttttgctttgactgctaggaaatcacaaaataagatgtaatgtagttacaaaaaatattagaagtttgtttctaatcccttgttcttctatttctgttttaattctcatattatatagctgtctttgttataagccaacccaaaattgtttatgcctcaggctcactagaaccaagtagaaagaagtcttgtagtctttgtctattacataaagatgaaatacacagatagtttgggctcattaagtaaactacttcagactctgttccattcataaaacccgataaggctaagcaacttcagcagcaggagaaataggaacctataaaaatgtaacagaaaaatacaacaaattaaatgggtatagttttaaagtgctgttttgaaataccatttcatagctatcattgtttaaaaacctgataataatttttgaagctccatttaccaagtgaatcaaaacctctgcataacgtgtattgcacttgccatgcaatcactaagcatgatggtgttggttagcactattagaggtggaaacatttcaatttatttttgtttgtttaaaagatcaaagtgagaactttaactctagagacacattaaatccagagattaggactatagtttaagaaaatcaatttttttcttgtttgtttgctagttttcattaacaaatgttatggatcagtcgtcaaatagatagcacctttctctggaaaaagaacacaaattctggcaaaacagtaaggcaggctttgatgcagactcagacacagcagatttgtcccagattcagagattcatctttttcagtgtgttttcttttcttactaaccatctcttacaggcaatgcaatggaaacacatttgtagtctattttatacttccttaattttcttcaaacagctttgcagatgatacagaatataactcatttctgtatctaggactttctttgttagaaaattcattgcatatatataggctgcccccaattcatgaacaggtagtagtccaaaaactaattgtttaaatcagtagctaggaatatgaagcacattttttctttaaattgactttatatgaagtactgtatactggtttcagaattacttataaaagccaaaatagctccaatttcttgagactctgttaaatgtcagaaaaaatattgtatattatacacatctcattgttttattaacttttttcttttttattgagctaatgcatataatcagaaacttcctgacgtgcacatatcttaaatgtagagctggagtttcagtaacagtttattgaagtataatttgaatgccataaaattcattcattttaagggttcaattaaacaatttatttttatatgtgtatatacctataaaatggctacctggatcgggatattgaaagtttccttttgcctcttttcagtcatacccatgccattccatggaagtaaccattatttgaacttctatttccacagattgttttttcctgctcatgactttatattcatgaaattagtcatcatatagtctataaagtcttggttatttctgagaacgcttctttcagtgtcttcacgtgtattagtagtgtagcattccattttaagaatacaccacacttcatttatttcttctactattgacagacattaaaattatttccattttggggctgttatagataaagctgccatgagtactgaaatctctaggtgaactattactggatcaaagagacagtgtatgtttacttgtagcagaaactttcagaaagtttccaaagtagctgtggcaatttttattcccaccagcaaggtatgagtgttcctatttctgtttattactaccaaaacacactgtcagtcaatagaaatgttgttgggtgtgttgtgctacttcattgtaatttaaatttgcataccttttttgaaaacataaaattgacatacccatagccagactaactaaacaaatagagataagacttatatataaaatcagaaatgtaaaggatcataaggaacctttattaatagctatacaccaacaaatttgataaattagagaaaattgatacattactcaaaaatatgaattacaaaagtgaatcaggaataaatagaaagcctgaacagaccaataacaataaaagagattgaagcattaattaaaaatctcccaggaaagaaaaacccaggacccaatggctttatagctgaatttgaccaaacttttaaataaaaattaatattaatccttcttaacttcttccataatagagctggagggcataatttcacattttatgaagccagcatcaccttgagacctaagacaaagatatcccaaggaaagaaaactataggccaatatctctgaagaacattattgcaaaaattactcgacaaaatattagcaaattaaattcaacatcccatcaaaagagtatatttcatgatcaagtgggatttatccttatctaaaaggttgttttaacatatgcaaatcaaccaatggatacatcatgttaacagactgaaagatataaccacatgatcataacaactgaagcaggtaaaaacattagacaaaattcaacgttctttcttgacaaagcctctcaacagtttagacatagacgaaaagttcttcaccgtagtaaaggacatttgtttaaaaagcacagctaacatcataataagtggggagaaactgaaagcttttcctttaacatctggtacgaagcaaagatgcccattcttgccacttctatttaacacagtactgaagtactacaaagagtagacaagaaaaagaaataaatgctatccaagtaaaaaaggaagaagaaaaattatctgtatttgcaaatgataccctttatgtagaaaacgtcaaagacaccaccaaaaactgttaggtctaataaatgaattcaataaagttgcagaatataaaatcaacatgcaaaacatcatatcatttcttttattttttaactttaaaaaggatttttttttattacacttttaagtcctggggtatatgtgcagaacatggaggtttgttacatagttacacacgttccgtggtggtttgctgcacctatcaacccgtcatctacattaggtatttctcctaatgctatccctcccctagccccccatccatgacaggccccagtgtgtgatgttcctctctctgtgtccctgtgttctcatcgttcagctcccactcatgagtaagaacatctggtgttcggttctctgtccttgtgccagtttgctgagaatgatggttcctagcttcatccatgtccctgcaaaagacatgaacttatccttttttatggctgcataatattccatggtgtagatgtgccacattgtctttatccaatgtattattgatgggcatttgggtttgttctgagtctttgctgaattgtgaattgtgccgcaatagacatatatgtgcatgcgtctttacagtagaatgatttataatcctttgggtatatacccagtaatgggattgctgggtcaaatggtattactggttctagatccttgaggaatcaccacaccatcttccacaatggttgaactaatttacactcccaccaacagtgtaaaagcattcctacttctccacatcctctccagcatctgttgtttcctgactttttaatgatcgccattctaactaacatgagatggtatctcactgtggttttgatttgcatttctctaacgacccgtgatgaagagctttttttttttcatacgtttgttggttgcctaaatgtcttcttttgagaagtgtctgttcacaccctttgcccactttttgatgggattgttttttcttgtaaatttatttaagttccttgtggattctggatattagccctttgtcagatggatagattgcaaaataaatttatcagtattttaattaaatattttaaagaaataatattaagaaaagaaatttaatagtatagtttctccttaaatattaactgcactttttccaattttttattatggcaaatatatataacataaaacttcctattttaacaattttaagtgtacagttaagtggcattaaatacattcataatgttgtgtagtcagagagtttcggagatggatggcggtgatggttacccaactttggagcatatctatacacaaataacgacctagaccaaaaataaatcaagaaaacaatcccatttacaatagcataaaaagcttaggaataaactcaaccaaggaggtgaaagacccgtaaactgaaaactagaaaatacagataaaaaaaattaaataggacacaaataagtgaaaagctattccatgcttatggatcagaaacactaactgttaaaatgttaacactacataaagcaataaatagattcaatgcagtccctatcaaaatcccagtggcattattcacaaaaatagataaaaaaaccctaaaatttgtatgaaaccacaaaagatcttgaatagccaaaacaattctgaaaaaaaaaaaagttgaaaacatcatacttcctgattcaaaagtatattacaaagctatagcaatcaaaagaatgtgatacttgcatacagatacacagaccagtggaagagattaaagagccccaaaataaatctaaacatatacagtcaactaatttttgacaagggcaccaaaaatacacatgaggaaaggacaatgtcttcaataaatttgctggatttacatatctggatttacaaacctggattgacatatccgagacaatgaaatggaatccttctcttacaccatacacaaaaatcaactcaaaatggatgagagacctaaacataagacttgaaatcataaaactcctagtagagaacatagaggaaaagctccttgacattagtcttagcaatgatttattgggtatcacaccagaaacttaggctacaaaagcaaacataaataaaagaaacggcatcaaataaaaagtttcttctcagcaaaagaaaaaatcaacaaaatgagaaggtaatcaacagactgggaaaaaacatattttcaaaccatataacaaataaggggttaatatccaagatttacacataattcatacaacttaatatagtaagaaatatataacctgattaaaaactggacaaaagactcgaatagacatttctccaaagatgacataaaaatgtctaacaaggacatgaaaaagtgctcaacaccactaattccacaggaaatacaattcaaaactctatatatcctcataactgttaggataactattataaaaaagataagagataacaggtgttggtaagaatgggggaaaaaaggaaactcttgtactgtgttggtgcaggcattatgggaaacagtgtcagatttctaatgaaattaaaaatagaactaccattctaagaaaataaaatcaccacctcataaagatatctgcaatcctatgttcattgtagctttattcacaatagtcgagctatgaaaataatctaggtgcctatcaatgaaaaaatggatgaagaaactatcatagtttatgaacattattcagccttttgcaaaggagatcctgtcacttgtcacaatatgaatggacctagaggatactatgctggatcaaataagccagacacagaaaaaaacatgttgcatgatcttccttgcatgacattctttttttttttttttttttaagatggagtctcgctctgtctcccaggctggagtgcagtggcacgatatcagctcactgcaacctctgcgtcctgggttcaagcaattctcctgtttcagcctcctgagtaactgggattacaggcgtgagcctccaggcccagctaattttgtatttttagtagagacggggtttaaccatgttggccaggctggtctcgagctcctgacctcaggtaatccgcccgccccagcctcccaaagttctcggattacaggcgtgaatcaccacacccggtctatcttgcttgtatgtgaaattttaaaaaagatcaaatatatagagatggaaaataaaatactggttaccagggtcaggctgtgggaggcagaagctatgaggagatgtaggtcaatcgatacaaagtatcaaatatttaggattaacacattgagagatttaatgtaaactatgaggaatgatagttagcgtattatatacaggagttttggtaaatgagtaaattatagctgcttttgtcacaagggggcaaaaataagtaaatatgtgagctgacagtacacaatacagtttattttaaaaaataaaataaaattgcctttctctcttaaggaattcatgtagaaatatttctatatgaatattggtcatttcctttttatttgaatgtgtaggagtattttatataatctgcaaatgagtctactatctatctcagtgacttttaagaaaggtaatatgatctacacttaaatgatggtaaaaatgagattctggaaagtaaactaattcaccaaacacacacatcttgtaagtggtagaagcagtaccggatttagcctggctcattcaaaagcctgtgctctttagagcattccacactgtggggcacataatgtaagatataaccaggacataagaaaaactatcttgggggaaatgaggtatcagaaacatttttgtctggataagagtaagagatgtgcctatttccaccagtccccctttctgaacagtgagagtgagctagtattggaagtgcattgagaaggaagtaagatatctaaaggaaaaaaaagaaggatataagtaaaaaaaaaaaatactgcatttcacaaactttgttgaaagagatactagttacaggacatattttcttgctgtcctgagaaagtagtacattgtaaaatgtataaaaattaatatacaaattagcatattaattattgtatataattatcttaaatttatgtaatatagcattttaaaaattatttgaaaagagaacagttttccagagagtgtgtatatatacacacacatatataatataaaaatatatattatatatatgccatactcatttgagtaatagtcattatctgggtgtggttatcacaaatgatgtttttctgttgcttttctaaaatttctaaattttgatgatgtatgtaatgcctactatatgttgagttgaaaatgggttcagttatctaatatattatgtatacattaagacaccatcatatgcttatatatttctgaatatacgataattataacttgtttctgggtgctaggattacaagctttttgttgttacaattttaacgagcatttatttgagaagtgattgggagaactatatatgagaattcatgttgctcaaatatgtatctgcttaccagaagttaagcagatgatacatataaaatagaaaccaatttaatagagagagacagaggatgaaaaaggagatgacagatattgaaaacacagaacacagaagtagaactgaattaataaacaagaataagttgtttatttcaattcacttggtttataactctttacaaaaagatttgaaagaattaaagaaaacttttcaaaactacaaaaaaagtgttgagattgaattcacaatgacctcagtacaattgttaaggaaatagtcttaaatttcaaggaaaaagagggtttttttttctatgtctataagagaacaaaagcaaactctttcaaagaagccaaagcattattgtttcagagttctctgctgtgacactcaacttcagacactaacagaggaataacttcagagtcttacaaaaaagaggtgtgatccaagaaaaaaagaggtgtgatccaagaactctgctttacccaagcaagttgtaattcacatatgaagatgagagaaaaatgatttcagatctgtgaactttcataaaatttaccatcaaaataccccttttattctgcagaggttgaaaaaataaaatagaattataaataaataagagaacttctgtacatggacattcattactatacaccaaaatcaggagaataactctttattttaaaaagataatcctctgttagcataaagtataagtacaaatacctataactataaatacctatagctataaacatattaaaagttatcagattaagaaagaaaaatgtggccatgtgcagtggctcacgcctgtaatcccagcactcttggaagctgaggcgggtggataacttgaggtcaggagtttcagaccagcctgaccaacatggtgaaaccccatctctactaaaaaaaaattttaaatgcaaaaataaagattttaaaaagctgggcatggcactagaattgctcgaacccggaggctaaatttgcagtgtgccgaggtcatgtcactgcactccagcctgagcgatggagtgagacaccaaagaaagagagaaagagagagagagagatagagagacagagagagagagagagagacagagaggaaaggaggaaaggaggagaggagaaagggaggaagggagaaagacaggaagatgaagatgaagatgaagatgaagagaacgaaagataaattctgaccattacagctactttgtgtgtgtgtgaggagagcatacagaataaggtacacccctatatcacagattaaaagggaaggaaataaaaattataatagaaatgcataaaggtcctagtgacctaattatgatttgaatccaatcttataaaataaaaattaactttttaaatattttttaaagtagaaaaaaaaactcatcgtctcatgtaacccagagataaaaggatatttcaatgtaacaacggtaatgtcagtaggctaaaaacattaaattgcttatcattaaaaaattccaggtgaaaatttgacatccctcccaataaaatacttttgaaaaataaaataaaatactattttagaaatagtcatatagcctaaaactaacattacaatcaatgacaaaatgatggtcaaagaccccttcaaattcagtaacaaacaaggctatgaatcacaaccaatattgctcaacattatagggaatcctgctaatttaaaagacagagcaaataaaaatatgtgttataaaggtgaatagtgttatttatagaaaacactgagtgccttggaaggtatcagattaattcccactaataacaataaagaaagtcaataatgaatcctggttagtaatacataatcaaataatatttatgtaattcagcaaagatcattagcacacacaacagacatttgtttgcttataacaacagcatatgtacatgacatgtaaaacctttgccacctgccacactagccgcaacaaagttcttttagataactcccctgcgcaaaaaaggaggtgttcataacatttttttgagtccaagtagatgcaaataaatggaaatacatataatgaactggggtcgctctattaataccatatcactatagtaaatatataggcttaccacaattccacctactaaagagtgtcgtcatgtgccacatgacatttcagtcaatgacagactgcttatacaacggtggtctcataagattataccggaactgaaaaatttctatcacctggtgttattgtagccattgtaacttcatactgaaaagcatcaccttttctgtgtttagataggtttatatacacaaatacctacactgtgctacaattccctacagtactcagtacagcaacatgctgtacaggcttgtagcctagaagaaccaggctatgccatatagcctaggtgtgtaggctataccatgtaggtttgtgtaagcacattctcaatttcacacaatgctgacctcacctaacatggcatttatcagaatatgtcttcattgttaagcagcgcatgactgtttatacagatcctaaatactataaactaactgctacacagttccaaatagtaaatactatatgaatataaaaatgcatagatttaggaaaatttcaaatacaatcaaaatacagttttagaactatgattaccgattgaaaaacttatgtggagaaatgaatgagcgaaactaaaaatagcaattctcaatttgcagtagctggggatactactgtgatgcctcttgcctatgatttgttgaatgataaatcttttcttcacggtatttgtttctatcctccaacaatcagatgaggtaagtacttttattatgatttctctgttttattcatacaatgagaaaactgatgctcaggaagcctaatatctagcctgaaattatactagcgaaataatggagtcagtatttgaatgcaggcagacttcactgcttctctctcaattatttgaagataaatatcataaaagaaattttatgccgggtgcggtggctgatgcctgtaatctcagcactttgggaggctgaggcgggaggaccacctgaagtcgggagttcgagaccagcctgaccaacatgaagaaaccctgtttctactaaaaatacaaaattgaccaggcgtggtggcgcatgcctgtaatcccagctactcgggaggctgaggcaggagaatcacttgaacccaggaggcagaggttgcggtgagccaagattgtgccattgcactccagcctgggcaacaagagcgaaactccaactcaaaaaaaaaaaaaaaaaaaaaaaaaaaagaaaagaaattttataacaacgtgtatagctctaaagtgaaaatcagaaatgtaaagcagaattcagacttcgagcatctgaaaacttcacataaagtttaaaaaatggtaaagtaagcttctcaaatacaaagggggaattatgactagatggcttagtggcaaaacctgcatagcaattcaaggaaagggagaaatagaagcataattcacataaggctttaaaataattttcagactggactacaaaacttgccaccaagcaggtgtgagagatgtagatgctgaatgtccagaggatgcactcttttctaggaaactatgatagcaaatactatgagcatattagagttccccgggaaccacatagatgatggcaaccatccatcaacctttatccaatccactctgacctgtgactaccctcactcagaagacattgccagttgttttgaagtgtgctatgaccaagcaccaagaagtttctagtctatcaatgttaacagagtacagtgagaagagtatacaatttcactacttatgggggcagataaaaaacttggctctactctcaatagttgtgggatgttagatctggcatctgccaaaagggaataaacctgtcaatatactgtgttgttttaagaatctgtaacaatttgcttgtgaaatatctgcataattcctggaacagcaattaagttgttttcctatcatattattacgaatatgatgataaccaaaattattattattggcatcctaagaatcttctccacaagtcttactacacatgcactgcaccctccccatattactaaaactcaaaatgaataacagattttaatagacactccttcatctgcatcaaggggaaactgcatgcacacaaatttattacttacacaaaatttttaaatatataaacgtgtgtgtacatgtgtgatagttgtgattaaaattacaattatatcaatatatatgtatgacaaaaatatacattccaaaaaaatggatgatatatatgtgtgtaaacacaacacaatagagatgcaaattgtaatggagtagagagagaagagggaacaaataaaatataaaaggatagctacatagaaaatgtttatctaaagcaaagaaatataaattaaaaacaaacctaatttatttttgtcatcattcaagtaaaaaacataaagatacttctcaaaggaggcatttatttggccagctaacatatgaaaaaaaaatctcatcatcattggtcattagagaaacacaaatcaaaaccacaatgggataccatctgatgccagttagaatggcaaccattaaaaagtcaggaaacaacagaggctggaaaggatgtggagaaataggaaaacttttacactgttggtgggagtgtaaattagttcaaccattgtggaagacaatgtggcatttcctcaaggatctagaaccagaaataccatttgacccagccatcctgttactgggtatatacccacaggattataaatcattctactctaaagacacatgcacatatatgtttattgcagtacaattcacaatagcaaaacttgtaaccaacccaaaggcccaccaatgatagactggataaagacaatgtggcacatctacaccatggaatactatgcagccataaaaaaggatgagttcatgtcctttgcagagacacagatcaagctggaaaccatcattctcagcaaactgacacaggaatagaaaaccaaacaccatatgttctcactcataagagggaggtgaacaatgagaacacatggacaccgggaggggaacatcacacacgggcctgttgggcagtagggggccaggggagggatagcattaaaagaaatacttaatgtagatgatgggttgatgggtgcagcaaaccaccatggcacatgtatacctatgtaactaacctgcacattctgcacatgtatcccagaacttaaaatataataaaaacattaaaaagaataaaggaagtcagagggaaaggcttattaaaacaaaacagaactcttgagaggatgtctttcctctcaatgacaaattcagcagtgaatgtttatgtatatttatgcatatataaggtattatgagcaaaaatgaatggttactaggaaggcaaaaatggtggaatattatccaatgaatacatttaattactcaaagtaatatattaaagaagaaaggtcatatattcttgcccacagattcagaaagcccatttgacaaaagtcaatatccatttatggaatggatgtagaagtaagtgaattagaaaaaaagttatccagaattgtaaatataactacccaaaacctatagtaaataacacacttaatgctgaaattaaaaattatcctctttaaagataggtatatagtaagtatgtctactactcatgcctttattcaaatagtatactagatttcatagctggcaaaagagttataccaatccaaatggaagaaacaaaagacaaacattatggttgcccatacagaaaacaacttcagttatgaagtagacccagacaactttcagaatattcagcactttttcattcctctacacaagcaacaaaataccagaaaatattttaaaagtcagcatttataaaagtgtctaaactatcaggtgtatggcaaaaaattgaacaaaataattgaaaaacattataaaacaggacataagcgtgaaagatgtgcagaagcagagagaaatccttgcattattagatgaaaagatcattaaagatagcaatgcactaattatactagattcagtgcaatttcagtcaaaattccaaaggaaattttatgaaacgtgaaaagctcacactaaagttcagagaacacagtcggtggcaatgtaaattagtatagccattatgaaaaacagtatggcgcttcctcaaagaactaaaaatagagctactatatgaccaagccattctactgctgagtatatatccaaaagaaagaaaaactgcatataaaagagttgtgtgcactcccacgtttatcacagcactattcacagtagccaatatatagaaccaacccaagtgtccatgaatgaatggataaagaaaatgtcatatgtatacataatggaatattattcagccatagaaactaaaatcctgacatttgtagcaacatggataaaactggaaggcattatgttaagtgaaataacccaggcattgaaagacaaatttgcatgtactcactcatatgtgagagctgaaaaaaaaaaaaaatctcatgaaggtagtcaatagactggtgttaccagaggctgggtagggtatttgggagggggaataaagaggcgttggttaacaggtagtgtttggtaccaaaatagggggcttatatttaacaatgatttattgtatatttcagtaactagaagatatggaatagtcccaacacaaacaaatgacaaatgtttgaggtaatggatgtgctaaatacccacatttgatcattaaacattatatgtttgtatcaaaatataatacacaccacataaatatgtacaactattaggtatccataaaaaaattaaaaacaaaaataaaaaataaagctcagggaacagtgaagactcaaaaatagcaatataagatgtatcttatgtgaagtatcaaaatccattatatagctaaagtagataaaattatcatagtaaatggatttcaatgtcaagtttataaaaaccttctaagaaaaacagtctgatgcaatctatataaaatataaatacataaaattatgtttcaatgtatattatgtaatgaaagtatgaagacttccagggaaataattcaccctaacttcctgatagcggtgactcctcaggagaaaaagaagtggtaataaatgggatagactagggttttgttgtggatgccctcctctgcattgtaggttatttaacaacatttttggctttaccctttggttaataatagctcccttctccccagttgtgacaagcaaaactgttttcagaaattttcccctctgaggcaggggagaaaaactgcttctagtagagaaccactggaatagactatctttagtatcagttctcaaaaggaaacaggagtggtggagggtatcagaagaaagatatgaaataaaattataaaatatattgcagcactattcacaatagcaaagactggaaccaaccaaatgcccatcaatgagaaactggataaagaaaatgtggcacatatacaagatggaatattatgcagccataaaaacaatgagttcacgtcctttgcaggacatggatgaagctggaaacatcattctcagcaaactaacacaggaaagaaaaccaaacaccacacgttctcacttataagcgggagttgaacaatgagaacacatggacacagggaggggaacatcacacaccagggcctgttgtgggttgggggctaggggaaggacacagcattaggagaaacacctaatatagatgatgggttgatgggggcagcaaaccaccatggcatgtgtatacctatgtaattaacctgcacgttatgcacatgtatcccggaacttaaactataataaaaaataaataaaataaaattataaaatgtcaatctctactgaattgggggtttgggggtcatgggtgtcagctaaattatttctttgtactttttaaattgtttgaaaggtttcatattttaaaagtttcatcaggtagtatgactctgtagtttaattgtttagagtactagttgtagtttaagactgccctggcttgtcatctgagtttttagtgtttgtatgattttgtacctgtttcttattttcttcaaatctcagtttccaaatctggtatctgtgaaaattaaatgaaataacccacatgaacatcttagcacagtgtctcatacacagtatgtgctaaaacataattttattatcaactgaaattaatatttctttgctcataaagacttcatggaaatatttatgatatatagataaagaagtcatcgttatagtaataagtataaccataacatattttatattttaagttgaagagatgtcagaaaatatttataaaatcaattttagctttaaaatgaaaacacacaagtaaattatacctagaccataattatttgaaaaggaaatgaacaaaaatagcaaaccaaaacatcataagataataaatatcaaagaagtcacaaggcccgacaattcaaaaaacgatctttgtgattatttcaatttatgcctcatgtttaaaatgacacatgtgagtttaaattcaaaattttatttagcttatgagatatcacaaaatgataaaatttttgctacatgctaataagggcaagtaagaacaagatattcaacataaatttaaaattatatgaaaattttaattagaatacagtaaatgaactatttgtccaagtccttatttaaaaggtgttagaataagtctagagcaaaagaagtataaaagcaatgtttgactttagaactttatgcataatgaacctctttttcaagacttcctaagtatctgacactgcaaactcatttattctctaaaatccaggacaatgacaccttgaaattaaatgtttgtactattcaatatttgttaagtttcacattacagagatgggtaactttgcattcaagaatttataatttatcttttgcaaatgtggtccacaaaccttgactttctttaacataggatgtctggtaaagccattcttgaggcaggttggagtagttggggactggcggaaacaagtggcaatatcagtgaagtatagaatcacaggctacttcggtcatctattcacaaggctgagcaggagctcttgagcatcttcacaatgtttgggataactctgctatgtgtaataacaaccttcttttgaatagtatccaatgcctggaaaaatcctagatgttcagaaacagatttttttttctattttcctctgtacctaggtagctagaattctcttatacatggagaatacttataacatcctagaaaactcaaattaaacatatatctgatatagcaaacctaaatcattacttactgagaaaacaatcattataattataactcaagttatttaaaaatatttcaaaaagggacaaggagaaaaattttaaaaaaattatagtatttaaaaacaattaaaagtgagttaagcaagagattatattgcatataaattgtttacttaatacattaagtttatttaatacattatttcttaatgtattaaacattaagcttatttaatacattaagattattttaatgtatatgaccaaattaaattttaattgttatatcacgctccagtacccaaaattattttaagcacttaaaattggccgacatagaaatttggtgttcttgtgatccgacacatgtggccacattaaattcaaacagctgtaattttgtcttttaaagaaataaacattagaatcaattagaacacagaatggttatcatggagaggtagatatgacttagaaaaaaattcatgttgaaagtagagacatctctcacattcacataccaaaaagcacatcttcccctcaaaatctgtgtagttggaaagccaccatagttatggttgtgtctggatactagcatgtctcacttttatctagagatatctcagtgctattaattgacaatagtgaacttggaagaagagataatctatcaatctcatattccaactataaaaactaatgaacaagactgagcttgcacatgcgtgagtgtgagtgtgtatgtgtacacatatgtgtttgtatggaattgtaacatcagaactaaatttactcattttgtaactaaaataccaaatgttgatttttgagtaggtacatcatttctgattgacattttttatgaactcaatattttgcaaatcccaccactccttccaaacagaaataaataaatgaaagtgttcagtgatcctaacatttgaaaagcttaaagagacatttagggaggataaatattcttggaagttgtgttaaatattcttgaaacattcttggatcattataaattattgccccattgtttttataaagtaagtgtcaaattaaaagctcctcttaatgttgatgattcagtgcaaattatttcattttatattagattccccttgaaaggaaagtttcagaaatgggattttgtcactaccaggcctgctttacaagagctcctgaaggaagcactaaatatggaaaggaaaaaccagtaccagtcactgcaaaaacacacaaaaatataaagaccagtgacactatgaataaactgcatcaactaatgtgcaaaataaccagctagcatcatcacgacaggatcaaattcacacataacaatatgaaccttaaatgtaaatgggctaaatgcccaattaaaagacacaggctggcaagttggagagagtcaagattcatcagtgtgctgtattcaggagacccatctcacgttcaaagacatacataggctcaaaataaagggatggaggaatatttaccaagcaaatggaaagcagaaaaaaaaaaagcaggggttgcaatcctagtctctgaaaaaaaacagactttaaaccaacaaaggtcaaaagagacaaagaagggcattacataatggtaaagggatcaatgcaaaaagaagagctagctatcctaaatatgtatgcacccgctacaggagcacccagattcataaaacaaattcttagagacctacaaagagacttggactcccacacaataatagtaggagactttaacaccccactgtcaatattagatcaaagaggcagaaaattaacaaggatgttcaagacttgaactcggctttggaccaagcagatctaatagatatgtatagaactctacacaccaaatcaacagaatatacactcctcagcaccacataccacctactctaaaacagaccacataatttgaagtaaaacactactcagcaaatacaaaagaatggaaatcataacaaacagtcactcagaccacagtgcaatcaaattagaactcagaagtaagaaactcactcaaaaccacagaactacatggaaactgaacaacctgctcctgaatgactactcggtaaataaataaattaagacagaaataatgaaattctttgaaagcaatgagaacaaagagacaacgtaccagtgtctctgggacacagttaaatcagtatgtagagggaaatgtatagtactaaatgtccacaggagaaagcaagaaagatctaaaattgacatgctaacatgacaacttaaagaactagagaagcaagagcaaaccaattcaaaagctagcagaagacaagaaataactaagattagagcagaattgaaggagacagagacatgaaaaacccttcaaaaaatcagtgaatccaggagcggatttttttgaaaagattaaccaaatatatagatcactagccagactaataaagaagaaaagggagaagaatcaaatagacacaataaaaaatgataaaggggatatcaccactgattccacagaaatagaaactaccaacagagaatattataaacacctctacacaaatcaactggaaaatgtagaagaaatggataaattcctggacacataaaccctcccaagactaaacaaagaagtcgaatccctgaatataggaataaaaagttctgaaattgaggaaataactaatagcctaccaaccaaaaaaaagcccaggaccagatggattcacagccgaattctaccacaggtacaaagaggagctggtaccattacttctgaaactattccaaacaatagaaaaaaagggactcctcctcaactcatggggccagaatcatcctgattccaaaacctggcagagacacaactagtaaagaaaatttcaggccaatatccctgattaacatgatgcaaaaattctcaataaaatactagcaaatcaaatccagcagcaaatcaaaaagcttatctaccacgatcaagtcggtttcatccccaggatgcaaggctggttcaatatatgcatatcaataaatgtaatccatcatataagtagaaccaatgacaaaaaaaaacatatgattatctcagtagatgcagaaaaggccttcaatacaaattcaacatcccttcatgctaaaaactctcaataaactagatattgatagaagatatctcaaaataataaaatctatttataacaagcccatagccaatatcatactgaatggggaaaagctggaaggattccctttgaaaactggcacaaaacaagttatgccccctctcacctctcctattcaacatagtttttgaagttctggccagggcagtgaggcaggagaaagaaataaagggtattcaaatgggaaaagaggaagtcaaattgtctctgtttgcagatgacatgattgtatatttagaaaaccccatagtctcagcccaaaaactccttaagctaataaacaacttcagcaaagtctcaggacacaaaatcaatttgcaaaaatcacaagcattcctatacaccaatagtagacaaacagaaagccaaatcatgagtgaactcccattcacaattgctacaaagaggagaataaaatacctagaaatacaacttacaagggacatgaaggacctcttcaaggagaactacaatccactactaaaggaagtaaaagaggacacaaacaaatggaaaaaacattccatactcatgggtaggaagaatcaatattgtgaaaatggccatgcagaccaaagtaatttatagattctatgctattcccatcaagctaccattgaccttcttcacagagctaggaaaaactaatttaaattttatacggaaccaaaaaatagcccatatagccaagacaatcctaagcaaaaacaacaaagccagagacatcatgctacctgacttcaaactacattacaaggcaacagtaaccaaaacagcatggtactggtacaaaaacagatatacagaccaagggaacagaatagaagtctcagaaataacaccacacatctacaaccatcatatcttcgacatacctgacaacaagcaataggtaaagaattccttatttaataaatggtgctgtaaaaacaaggctagccatatccagaaaacagaaattggaccccttacttagacgttatagaaaaattaagatggattaaagacttaaatgtaagatctaaaaccttaaaaaccgtagaaggaaacctaggcaataccattcaggacataggcatgggcaaagagttcatgactaaaacacaaaaagcaatggcaacataagccaaaactgacaaatggaatctagttaaactaaagagcttctgcacagcaaaagaaactatcatcagagtgaacaggcaacctaaagaatgggataaaatttttgcagtttatccatctgacaaagggctaaattccagaatctacaaggaacttaaacaaatttacaagaaaaaaataaacaaccccatcaaagagtgggtgaaatttgtgaacagacacttcccaaaggggcatttatttggccaacaaacgcgtgaaaaaaagctcatcatcagtggtcatcagagaaatgcaaatcaaaaccacaatgagataccatctcaagccagttagaatggtgatcattaaaaagtcaggaaacaacagatgttgaagaggatgtggagaaataagaatgcttttacactgttggcgggagagtaaattagttcgaccattgtggaagacagtgtggtgattcttcaaggatctagaaccagaaataccatttgacccagcaatcccattactgggtatatacccaaaggattataaatcattctactctaaaaacacatgcacacgtaggttattgcatcactattcacaatagcaaagacttggaaccaacccaaatgcccatcagtgatacactggataaagataatgtgacacatatataccatggaatactatgcagccataaaaaaggatgagttcatgtcctttgcagtaacatggatgaagctggaaaccatcatcctcagcaaactaacacaggaacagaaaaccaaacactgcattttctcactcataagtgggagctgaacaatgagaacacatgaacacagggaggtggacatcacaccgagaactgtcaggggatgggggacaaggggagggagagcattagcacaaatacctaatgcatgtggggctctaaacctagataacaggttgataggtgcaggaaaccaccatggtacatgtatacctatgtaacaaacctgcacgtttagcacatgtatcccagaacttaaagtaaaatggaaaaaaaaaagatttcaatcagaataccacccgaattcacagtatgttaaactagaaaagtatagtcattatttcccattgaaaacctaataagcattattacacttacaagtaagatggcaagaagcccatttttcacttacatattacccacatgttgtataaaatataaaatatgaattttaagcttaccatttgctatgtgattttgggcatataatctgagtgttttcagccacggccttgatacctgtacaaaggagataatacccgtatctggaaactacttagcatttcccagtggaagctattcatatcacccctttaattagactcctgcctagaagatgcatttttctatagcactgtgccctttataaagatgagacagttaagcaacatataattaaattaaacatatcttattacattagtgaactagagaagtagttcagtttgtctgatttcttttccagctgagaaaaacactaaactttccattttacaatttctgctgctcatttttgacttaataacatatcaaaatacaattacagagttactatattctgtaatatatatgtatatgtatataaatatatatatattcactcaaataagttgaggaaaatttcagaaacaaattctattgcctatggatctgaatgttgcatttcccttatgataactgaaactgaacaagaaaattcagaaaaatattagtatttactatccagtgagatcttgaaatgaaatttcaaacctaaaatataaatctatttatgtctctccatacataaatctatttttaagagaaatattaataattgaataaaaagttttttaaaagcccttcaaaaacgatgaaaacttttcaaacattacacaattttcacagaagttacagtgtaattaagtcagaagcaaagtttcctggtagtgttttccatacagaatgtttggctaggctaaaataaaatgaataaatataatactaaattctatactcgtataattctcagaatgctaagaaataatggcacagaatttccaggcacattctgttacatgatattccaaacatgccctgggcgtttacacacatggtacaacaaactaaccttagaggtacttgtgtgtcatgtgcagagcattagccaatcttcatatttcaggcttttaaagaccaacacataggaaaggtggaaaaaaacaaagggagatgcttgtaatacatcatttctttgaaagcccctagtggtggggatggggataaaggaaacctaaaagaaactcaaacttaacttgtactctaacccggcacgacttcaactttaaaccacacattttgaagaataacatgcagacagaatatactttgaaaatgttgaaaggattccagtaatcaagtgacaactccttaaccaagaccaagctagcctgggtaacacggtgaaaccccatctctaaaaaaagaaaacataaataaataaataaataaataaataaataaacaaaaatacaaaaatttgccaagcatagtggtgtgcactggtagtcccagctacttgggaggctgaggtaaggtcgcttgagcccagggttccaggctgcagtgggccttgattacacgactgtacttcagcctgggcaacagggtgagatcccatcttagaaaaagaacaaaccgcggagctgtggtgctgaaaagtacattcctaaagactgtttcaagagtcttcaatctgaaggggcttgttattgcagggatgttaaagaaaatccggggtcttaaaatttttcgtttttaagaatcaaattttctacccctaataaaaagggagaagtctggaggcaagctttatcaggaagatatgaatgattgttctcatcctggtgaaagtatactccaataaataggtctcataagctaatggttttatgacctattttgctgggcagggagaaaacaaaaaacaaacaaaaaattaaacagaagataaattcaaccccatggcaagtgtgccacactcagatgatgtcctattctcggcccaacttggtttgtccccaatacagaattttcaacagagaagcacatatctaattttctcaaacatgactttgagggtcacaagttctatccattctctaccaggcagctgagaaaatgagcagagaataaagaccatcatattcccaccctccagctaggattataaggggaatgaagcaagctagtattacaaggggaagaaagtaagtattataaggtagtattacctgagaaggtgagtcaatgcaatgttacaaacgctattttggtggcaattcatatgccatactcaaagattaataaatagaaaaaaagcaagacattttttataaacttccgaagaaataaggaagaaagaaagcatgcaaaagacaatgaaaacagataatttgaaaaatattatctcaaagaagagaataaaatattaacatatttatacaatattaaataaaaacaattttacagattacaggaatatttttcaatgtgaactctcaggaaacaaaagtaaaaatgagtaaacagaatggcatttgtatcattgaatcaaactataaaagaaagagttccacaagcctacaaggagagttaactgtgttaattacaaaattgagaaaaaaaaacttattcaatatttccacaacttatttaaatgctagggaaattatcctactgtaagacactagtattcctgataaaaatgcttaaactcttctttgataccctgtaataagattggaacttgttctgggaagccattcatttactccagtgactcaagtcgagtcaataataacatgcaagcaggttcttccctgcatctcatttggtacttttttttttttaaacagttctgtttgttatagatgatcattaaaaatctatcctgctcaagaaaaaaaaggagaggtgttctgaaatatttatggatgaaataatgtggtgcctgtaatttgctccacttaaaaaaatccagtggcaggggtagttaagggcatagacggtatatggatattatcaagccaatgaatgtcatttgggtgaggggcattttaggttcattctagtatacacttgtgcatgtttgaaatttttataataaaaagtaaaacaaaacaaaacaaaaaatatcctattggattttttatggagaaattatatgattcaaattacagctaatctgatattcatattgaatataaaaacatattcatagatatcaccgactcagaaataatattatccatttatccttcccaaaagacataactgagtaatgtaacatgaatcctgaaggaagactcacagatgtatttaagaagacaaggatttgcctgatttgtgtgttatcaatgtctcttagcctcatgagaaagaagttaaaatatagtttttgaatgcataagtgaatgaatgattgaatgattaaagaagtcatgacagccatgaacttattgtaaatactcagcccataatcattaaatgttaaaaatcctcataggtatgctatagagtgaaaacattttttaattatattaaaattggctaaaaatctcagaatatagagacaaaaccgaagagcagtagcagtcgaagtaaggcaatgggaaagtgtaactacatatattttctcatcttttaagagaggtagaggacaaccagcagattcatttgcttctgaaatacagcaattgaaaattaagtgtaaaatataagcttaatttttaaaaggagacaaaattatatttaagacttagactttatcctctccagactttcagaggggtacaaaatgaaagaaggcatggagtgaaaaaaagaggaaagaaatataaaaaagtgaataaaaataaaatgaagaaaataagataaaaaaaacaaatgttggccgggcgcggtggctcacgcctgtaatcccagcattttgggaggcccaggcgggagaatcacgaggtcaggagattgagaccagcccggctaacacagtgaaaccccatctctactaaaaatacaaaaaattagccgggcgtggtggcgggtgcctgtagtcccagctactgaggaggctgaggcaggagaatggcatgaacccgggaggtggagcttacagtgagccgagatggcgccactgcactccagcctgggcgacagagcaagactccgtttcaataaataaataaataaataagtaaataaataaatcaatcaataatattataacaataattaggcaagataaagaaataaagggcattcaaattggaaaagtggaaatcaaattatctatttgccaatgatatgatcttatcttagaaaaccctaaaagacccctccaaaagattatgatttaataaatctctttggagaagacccctcaaaaagattatgatttaataaatgaattcagaaaagtttcaggttgcaaaatcaatgtacataaaccagtagcactgttatacaccaacaatgaccaagatgagaatcaaaccaagaacccaatcccttttacaacaggtacaaaaaaataaaatacctatgaatatacttaaccaactaggtgaaaaatctccaaggggaactacaaaattctgctgaaagaaatcacagatgacacgaacaaatggaaagaatcaatattgtggaaatgaccacacttccaaaagcaattgacagattgaatgcaatccctattacaataacaacatgattctttacagaattagaaaagataatcttgaaattcatatggaaccaaaaaagagcagaaatagccaaggcaatcctaagcaaaaagaacaaatctggaggcatcgtatgactcaacttcaaattatattgtaaggctatagtaaccaaacagcatggcactagtgaaagcagatacacagatcaatggaacacaatagagaatccagaaataaactcaaatacttacaaccaactgatcatcaacaaatcatataaaaacacaaattggggaaaggacattctattccatatattttgctgagaaaattggatagccacgtgtagaaaaatgaaactggatccttatttctcaccatgtacaaaaatgaactcaagatggattaaagacttaaatctaacccctaacaccataaattctaaataaaaacctaggaaacactattctggatactggcctaggcaaataatttatgatgaagaccccaaaagcaaatgcaagaaaaataaataaatgagacctacttaaactaaaaaagtttctgtacagcaaaagaaataatcgtcagggtaaagagagaatctacagaatgaaaaaaaaaattgtcaactctgcacctgacaaaagactaatatccagcatccacaaggaaacaaattagcaagcaaaaatcaaataaccccatgaaaaagtgggcaaagaacatgaatagacatttcttaatagaagatatataaatggccaacaaacatatgaaaaaaaagcactcaatgtcactaatcatcagggaattacaaattaaaactgcaatgagatatcaccttactgtagccagcatggccattattaaaaagtcaaaaaacaatagatgttggcacggatgtggtgcaaagggaacacaaacacactgccggtgagaatgtaaattaatacaacctctctggaaaacaatatggagatttctcaaggaactaaaagtagatccaccattcaactgagcaaacccactactgctcatctatccaaagggaattaaatcatcatatcaaaaaacattcaaacatgtatatcgcagtaaaattcacaattgcaaagatatgaaatcaaaataagtgtccaacaaccagtgaatgaatatagaaaatgcggtatgtgtgtaaacatacacacacacagacacacacaccatggaatactgcttggtcataaaaaatgataaaataatgtatttgcagcaacttggatggaactggattctttaatctaagagaagtaactcagaaatgagaaagcaaatactacatgttctcacttatacgtgagagttaagctatgggtacacgaggtcagacagagtagtacaatggacattggagactcagaaaaggggagtgtggaaagacagttgtacccctacctattgtgttacaacatatactatgtgggttatgaatacattgaaattccagactttaccactatacaattcatctatgtaaccaaaaaccacttgcaatcctaaagctcttaaagatttttaaggaccctccaagctgttttccatagtagttgtattatttacattctcacgacaagtgtacgagggttctcttttctccatatccttgttgagtatttgttattgcctgtcttttggataaaagccattttaactgggataagatgatatttcataatagttttgatttgcatttctctgatgatcaatgatttggagcaccttttcatatgtctgccattgagaaatatctatttagattttttgctcatttttagtcagattattatattttttcctatatagttgtttgagctccttatgtattctggtcattactcccttgtaagatgtgtagtttgcaaatattttctcttattctgtgcgttgtctcttcacttttttttcctttgctgtgcagaagctctaccttgatgtgattcaatgtgtccacttttcctttagatacccatgcttatgggatatttctcaagaaatactacccagatcaatgtcccagagagtttctctaatgttttcttgtagtagtttcatagtttacggtcttagatttaagtgtttaatcaatttttacttgattttttttttgcatatgaaaggagatagaggtctagtttcattcttctgcatatagatatccagtttttccagcactatttattcaccagattgtcttttctccagtgtatttttggcatatttcttgaaaatgagttcactgcaggtatgtaaacttctttctgcattctcttctctgttccattggtctacgtgtctgttattatgccagtgccatgatgtttaggttactatagccctgtggtatgatttaaagtcaggtatgtgatacttccaattttattaactttgcccatcacagtttagactattctgagtcttttgtggatccatataactttgagaatttttttctatttctatgagaaatgtcattggcattttgacaggaattgcattgaatctgcagattactatgggttgtatggacattttaacaatattgattctttcaatccatgaacatggagtatctttccatgttttggtgtcccctttaatttctttcatcaatattgtacagttttcattataggcatctttcacttctttggttaagttaattcctaggtatttaattttatttgtggttattgtcaatgaaatttttaacatttctttttcagattgttcccttttggcatatagaaatactgctgatttttgtgtgttgatattatatcctgaaaatttaatgaatttgtttatcagttctagtattttttttggtggaatctttaggtttttccaaatacatgatcatatcgtttgcagacaagaataatttcacttcttgttcctgcatacaattgaaatagattgttcagtttattggcaggcagtttctcatagtagatactaataatcctttgaatttctgtggtatcagttgcagtatctccttaatcagtaatgttgagcttctttcatatgctcattggctgcataaatgtcttctttcgaggagtgtctgttcacatctttttcccactttttgatgtttttttttttcttgtaaatttgtttcagttccttgtaaattctggatattggacctttatcaggtgggtggattgcaaaaattttctcccattctgtaggttgcctgttcactctgatggtagtttcttttgctgtgcagaagctctatagtttaattagatcccatttgtcaatgttggcttttgttccaattgtttctgggattttgtcatgaagtctttgcccacgcctatgtcctgaattgtatttcctaggtttattctagggtttttatggttttgggttttacctttaagtctttaatccaccttgagttaatttttgtataaggtataaggaaggggtccaatttcagttttctgcatatggctggacagttttcccagcaccgtttactgaataggagattctctccccattgcttgttttgggcaggtttgtcaaagatcagatagttgtagatgtgtggtgttatttctgaggtctctgttctgctccattggtctatatgtcttcttagtttctttattggcccattggtaattaatgagtatattatttaacgtctatttatttgaacagtttcctaaactctttttactgatttctagttttactccattgtagtcagagaagatgcctgatattatttcaattttttaaatgttttaggacatttttgtgacataacatgtggtctatacttgagaatgattcatgtgctgaggggaggaatgtgtattctgaagccattggttaaaatgatctgtaaatgtttattagttccatttggtctttagtacagattaaacttgatgtttcttcattgattttctttctagaagatctgtcccatgttgaatatgtggtgttgaaatctccagctattattttattggggcctacatctctatttagctctaataacttttgctttatatatctgggtgctccagtgttggatgcatacatacttaaaactgttatatcctcttgattaattgacttatttatcattatatactggcactctttttctctttttatagtttgtcttgaaatctatttggtatcacgagtatagctactctcactcttcctggtttccatgggcatatctctttccattcctttattttcagtctatgggtacccttataggtgaagtgtgtttcttataggcaacagatcattgggtcttctttttctatccatttgaccactctgttttttgattgaagagcttagtccacttacattcaatgttactattgataaggaaggacttactcctgccattttgtttgttgttttctgtttgttttctgatcttctcttccttctttcttcccttcctgtcttctctttagttaaggtaattttctcctgtgatatgatttagttttgttcttttcattttttgttgatacattataagtttttggtttgagtttaccatgaggcttgcaaatactatcttataatatcttataacccattattttaagctgataacaacttcacattgtttgcataaacaaacaaaaagcaaacgaatatagacacaggaagagaagaccaaatacggcatgttctcactcataagtgggagttgaacaatgaatacacatggacacagggaggggaatgacacataacagggcctgttggggggtggagggtgaggggagggaacttagaggacaaattgataggtgcagcaaaccaccatggcacatgtatacctatgtatgtaacaaacctgcatgttctgcacatgcattctattatttttagaagaactttttttttttttaaaaaggagacttgtagaggtactacctctattatcttgggcaatatctggaagaattctctgaattaccaggtagagactcttgttctcttcccttaatttctcccaaatgaacacagtctctctctctctctctctctctctctctctctctctctctgttctgaaccacctggagctggggggtggtgtgacacaagcaaccctgtggccaccatgactaagactgtgccaggtcggctgggcatggtggctcgcgcctgtaatcctagcactttgggagcccgagccgggtggatcacaaggtcaggagatcgagaccatcctggctaacacgatgaaaccccatctctactaaaaatacaaaaaattagctgggcgcggtggcgggcgcctgtagtcccagctactcaggaggctgaggcaggagaatggcacgaacctgggaggcggagcttgcagtgagccgagatcgcaccactgcactccagcctgggcaacagagtgagactctgtctcaaaaaaaaaaaaaaaaaaaaagactgccaggtcacacctgaagccagcatagcactgtgtcttgcccaaggcccactgtaatcattccctgactatggcctgtgtttgttcaaggtcctgggactctacaatcagcaggtggcaatgtcaggcaggcctgtgtccttccattcaggatggcaagttcccctaggcctcaagagtttttggaggtgctgtctgggagccagggattaggataaaatacattagaagtctacttggtgatctattttactgcagatgatctggcactcaaaccatgagactcagtccttcccactcttccctcccctttccaaaggcagagaactctcatcaacggccaccgccaccacaggcccatggggagtactgccagaccatcatcaatgttcccttagggcccaaagtctcttcagccagatgtggtgaatattacccgacttgggactcatctttcagggcagtgggctcccctctggcacaggagaggtccagaaatgcagtccaatagccaagtcctagaatcaaggaccccaagtgtccgcttggtgctctaccccactgtatcttagctggtacctaatgtgcaagacaaagttccctttgtttttccttccacttttcttaggtggaaggagtcttgccccatagacaccacagctgggaacgtgctgagcctcacctgaagccagcaagtctaagagtctcacccaaagcccttaacatagtactaagtatcactgctgatcactcggggcccaggaactcctcaattatcaggcgatatatcctgccaggactgggtcattgccttcaaggcatcaagtatccttctgcccctgggtgtgtctagaaatgtcatccaagagctagggcctggaaaggggaccttattaccctgactggcaccttatcctactgcggctgagctggtatccaagatgcaaaacaaagtcttcaccacctttccctctattctcctccagtggagataagaagtctcttttggagccacaagccatgcagcctggggtcaggggaggggtgatgacagcaatcccttagctgacctaactagtgtctcagtatggcacatgtacactgtctctgtgcccagttcagcactaggactcacctagaagttgtagtccttgtggcctagactgcctttcaagtttatttagagctccagagcactttggcctgcagctgctgagacttggggagactaccatcattgtagtacctctgcagctgctgcaagtcttgcagatcctcaagttcggaccactgggatcagcaatttccctctggctagggatggtttaaatggtccctccatggttagttatcagctgagtttggtctagttttgttttctgttatgatagggcagcactgagttcaatgccttaaaattggtgtgctttcctctccccagcacacagaaacactccatgcataaagctgcagctgctggggaatgggggagggatagcattggtgactccagactattttgcttacctcttcagtgcctctttcagcaatataaagttaaaaccacgtactttgagtgctcacttgatttttggttcttatgaaggcgcattgttttgtgtttatgtagatagttgttaaattggtgtccttgtcagggaagagaataatcagtagagactcccattctcccatctttctcctagatctcagtagtcaatttaaagtaggcttaattgtttaagtgatcaatccactagggaaatcttttggagggatatagttatttttctctatatcaacatttaaattggtagacaggagaaaatgattattagggaactaatgacatcctttacatacaattgcaaaagcagtgtgtgataataaagagtatttattttatattaatgaatgatttaaatatctgacaactaatatatatttaccaacaataagatgaaagaaaaacagaaaataggatgtaaaagacagtgttcataaaaataattattgccatcatcctaatagaaggtcttgtatattatgcttggaatttgcagtaaccattctattacatgccctacttttatagatacctctcttctttccttctcaaatcagtctgtcataaagtccctggattaattcagcctaaagcatttttgacatttcttaagtttatttgtcattagtttggcttgaaatttaaatgattttgcaatctggtctcaatttgcttttcaatttttctctatattctccttatgtaagttacagttttcctcctgtctttaaatcatatttcacactctagtttttatccatgcataaggctttacctattacttccataacattcccttatacatttcaggcaaatattttggtacttggcttgatcctccagggaacatttatttgaaattatatgtcatttagcatattttgctttttgctttgcgccttttaaaaagttattaacaactttactactcctactgtttaaattctggaagaataggttataagtggggttataatcacttttgcatttctctatcttaatactgtacacataatcactagatttacacacatatacaaacatatataatttatttgctttgcaaaaatttggtctttacattcccaccagattgcaagcttcctgaatgcaaagagttgaactgccttgttcacagttatatacctggccgctataagcatatccaggatatcctgtgttcaataaataattgataaatgaatacatgaatatgagtaatcacaaatgaatgttaaaggtaatatattgaatggattcattcttatattgaaaaatgcaacgtataatcacatattattagcttataatttctgaaatttaatggacaagaccacctttcttttcattgaggaatacatgtttctaataattttagactctaatgtctaataattttagattctaatgtcaagtaagacataagaattagatcactgaagacatgacattttctgtattttatagtctacttgtatttctaatagcaattataaagaatcacgaagtaaatatcaatatggaatctttaggtatagatgctacatcatttttattgcatgcctacaagatgaacaaaaaaaacccattgaaatggttaaaattataaagggccaaatgagcaaaaatatttccacatagatgatttacaactagataaaaaaaaatttaggccccattaaaagacctggaggcttgcttttagagaaaaaagtagtatttctaagacgatatgccacaattttcagggtttctttctttttttttttattatactttaagttccgggatatatgtgcagaacatgcaggtttgttacataggtatacatgtgccatggtggtttgctgcactcatcaacccatcatctacattaggtatttgttctaatgctctccctctcctagtcccacaccccacaacaggccccagtgtgtgatgttcccctccctgtgtccatgtgttctcattgttcaactcccacttatgagtgagaacatgcagtgtttggttttctgttcctgtgttagtttgctgagaatgatggtttccagcttcatctatgtccctgcaaaggatgtgaactcattgttttttatggctgcatagtattccatcgtgtacatgtgccacattgtctttatccagtctatcattgatgggcatttgggttgattccaagttttgctactaggaacagcgccacaataaatatatgtgtgtatgtgtctttatagtagaataatttataatcttttgggtatatacccagtaatgggatggctgggtcaaatggtattactggttctagatccttaagaattgccacacagtcttccacaatggttgaactaatttactccccccaccaacagtgtaaaagtgttcctattttttcacatcccctccagcatctgttgtttcctgactttttaatgattgccattctagctggcatgagatggtatctcattgtggttttgatttgcatctctctggtgaccagggatgattagctttttttcatatgtttattggccacataaatgtctttttttgagaaatgtctgttcatatcctttgcccagtttttgatggggttatttgtctttttcttgtaaatttgtttacattccttgtagattctggatattagccctttgtcagacggatagatggcaaaaattttctcacattctgtaggttgcctgttcactctgatgagactttcttttgatgtgcagaagctctttactttaattagatcccatttgtcaattttggcttttgttgccattgcttttggtgttattcatgaagtctatgcccatgtctatgtcctgagtggtattgcctagactttctttcagggtttttatggctgtaggtcttacgtttaaatctcagccctaaatctcgttaagcagataagcaacttaagcaaggtctcaggatacaaaatcaatgtgcaaaaatcacaagcattcctacacacaaataatagacaaatagccacataataagagaactcccattcacaattgctacaaatagaatacaatacctaggaatacaacttacaagagatgtgagggacctgttcaaggagaacttcaaacccctgctgacggaaataagagagcacagaaacaaatggaaaatcatctcatgcttatggataggaataatcaatatcgtgaaaatgggcatactacctaaagtaatttttggattcaatgctatccccatcaagctaccattgactttcttcacagaattagaaaaaactacactaatttcacatggaaccaaaaaaagaacctgtatagccataacaatcctaagcaaaaagaacaaagctggaggcatcaccctacctgaattcaaactatactacaagcctacagtaaacaaaacagcatggtactggtaccaaaacagatatatagaccaatggaacagaacagaggcctcagaaataatgccacacatctacaactatgtgacctttgacaaacctgacagaaacaagcaatggggaaaggattccctatgtaataaatggtgttgggaaaattggctagccatatgcagaaaactgaaactggaccccttccttacaccttatacaaaaattaatacagggtttcttttaataacacttggtcaattgttgaggactgtgtttgcctaataccacataacatcaaacactcctattcttatattttcattttctaaagctttaaagtttggaaatttataaagttaaaaataagatttcccccatagaatagattcatatgtaacatcttttcacttctcccaagactctcaactctttaactgtaatttaagtgtgccatacacacacaaatacaccttttacctagaatactattaattatacctaataactatgatctgtttaagttacatgaactaatacagcaattatggctaaatacaactagcaagtgaaggtagatgatgccatatctatttgacatactgtattcaacattaatctttatgtttcttatcttagcataaatttgtataccagatgccttcttgtaattaacacgctgggatttgtgagcagtagattttgctggtaacaaactccatcaagtcgacatctgtgatttatacctccaactccttttcaatatatttacataatcagttcaatttaagcccagattatacattcttcttacatttttataagcaatatcctctaaagatagtttaaaagtaaatcaaggtaaaatttaattctttcttcttttctaatcaaaacacttatcatgaacatataatcaaattctctgattacatgcatttctattttaaaagaaaaaataggtgattttcttctgataaatatatataagatcatttactctaatttctgtcaacacaatcatatccacatcattatatgtacatagctttataagcattttaacagtattggcctcatattgttctttggaattatgcctagatgctattagtctcatttaactactaaggaaattgagtttcaagaggtcagatgacttgattaagatggtttaaattccagcattataatttttttgttttgtttacctgctgtatgtaagggaagattttaggtcttttctctcagtctggggctttttttttttcactctaacaaattgtttttaaacacaggtaattgtaaaacttaaaaaaattttctattacggtataaatgtaagatgttatttaatataaaaattttacagatgaatctgattatttataagatatattaatcatagtatatttaatgtcagtttcagatactgtatattaagatagaattgttttgatataattttattcctaaaaattctagtattgggcaaattatagcatataatgtattgtaaaaattctagaagatgcatttgacatattgttgacatacagatttggtaatcaaatgtattgttgccatatcatcactaaaaatctgtcttaacataagaatattgctgataattttatgtcgtgctcaaggtaaataattgatcaaatgtgaactacattttcacatttatcacatgatttttattttatcacatgataaaatgtgaactaaaggaatacatatcctttaataggaaagaagtttatttgtcacctatgccctagtttctcaatgttgtacaatcacaaagagaataagagagagaaatggagtagagttatcagaaatcagtaagagtgtgttagaattaaaggagtgcacttgggtactctactgatgaaacatctcttttccacaaagtcaagtcagaaatcactcagacttgagagacataaggaaagactggagcttaaatagaaaatccacttcactcaaatcctgattttacaattgttctgctgttaagagaggaatctgggcttccagatgtcagctgatggtgatagtatttctcacctaaaatgaatcctcattcaccttttattattctcctataggaatttgttctgcctagaattatcctctctgataataatgtctgataactctaacagcttttactatgtactattcactgttttaggtgtcttatattcattgtctcatgtaagttttggcagttatataattgagctaaaaatttcagtaaggataaaagaggaaaatattctaatatatttaatacataattcctaagtggaaacatagagactgtatgaaacattgtaagctataaatacacaatttaataataaatgctaagaaacaacatgattgctggtatggagcatttaaaatgtgaaacatttaaatgtaaaaaattattacttaatggtatatgttacatagaatctgtagtctattttatttagccagttaaatttactgattgggaggaataaattgtattttactaccatatagagaaatacaaattggctgagtttttacattatcaaagttgtatttagtattgcatgtgtttcataacatcaatgatatgttttatgaaaagcatttgatcaaggttattaaatatttttaaattattgtattattaatctagagtaactgcccataatatatattactatttcaatatgtagaaacaaaaccataatttcataatattttaacattaaaaaacagcctttgtttaattattagtgatggctataatataaaaaatgtatttaatgcagacctaatttagggtattgttatcttcgaatttttgtaagagcacttgaagctattaccagaactgccagttaagacaaaaacacatttaagtacagaaagataaaattttctggatattcactactaacactctggcatttttcgaacatcaggcaaagatatataagccctactttatataataaaacaggaacaaatgtattaaatttattaaatcatttatttattaaactatttagcagctaatttattaaatctatttgtttttgcactaagaatatttgacatttgcaacattaatattttaaaaacctgctttaagttctgtgagaaatctccaaactggtttctacaatagctgaaataatttacattcccaccaacagtgtattagccttcccttttctctgcagcctcaccaacatctgttcttttttgacttttgaataatagccattctgactggtgtaagatagtaactcattgtggttttaatttgcatttctctgataattagtgatgttgagcatttttgcatatgcttattggctgcttgtatatcttcttttgagaggtgtgtgttcaggtactttgcccacactttaacggggttatgtgatttttgcttgttgaactgcttaagttccctatagattctggatattagacctttgtcagatgcatagtttgcaagtattttctcccattctgtagactgtctgtttactttgttgatagtttatttttctgtgcagaagcatgaaatactacacagccataaaaaagaatggaataatgtcctttgcaccaacatggatgcagatggtggccataatcctaagtgaattatcacaggaacataaaaccaaataccttatgttcttacttataaataggagctaaacactgggcacacatggacataaacttgggaacaacagatgctgcaggctaatagagggtggagggaggaatgggggcgtggggcaaaaactaccttactagtactatgctcaccacctgagtgatgagatccatacccctaacttcagcatcatgcaacatactcatgcggtaaacctgtacctgtatccctgtatctaaaattaaagttgaattttaaaaaacttgcattatttctgtatcttttatcacgtgacatatacatgtatactagattgtaagctccataaatcaagggcatgcctgtctcttctaaccatgtactctcagcctttaatacattgtttggtacacagttcatgctcaagaaatctaatttaatgaatgattgcaggaggttagtcatctggttttcagacatatataaatgtagttcaaacatgtattttatttgcgcatttaaaagtctataattgaagttagtttttagaatattctttaatgttttatggtgcaaggattaatcttatttttataataaatgcaatggcggatatgctaaattattttgaaattttaagcaaatttattgttgagaatataaaattatgtttaaaaagaaaagaatatgaataatgtgtgtatatacttaactatgtaatatatatttacgaatgaaagatttgctattatgtttatcttctacttttattctaaaattaacgtttattgttttataaaaatatccacagtcttctgactataaaaaacagtattaatagtaaacaaaatatttaaaaatgtgataggagaacttttatgtaccatacactggattgcttatctagtctgttggttaatagctggactttttattattagcttcacattaaaagattagctaaaagaaggtcatgacttcagttaacagaaatattgctcatgttttgcttgcttcatgcataatttataatctatttgaaccaaatgagctgcagagcaatattacaattaacattcagctcttccatggatttggttgaactccctttaggatactgtttgtaatgagtagcaagacatgacatgctacctaacatgccaccacggattctgatgcttagctttttaaagaaaggagtctcaatacattaaaatgaagttatgacttcctcctaagggcctagaaggtgaacaaaacaatcaagttacaggagagaaaaggttatcttaaaaataatctgaatttataattgataagcaatatgaaacacagtatttttgtttgcataccaaaaaaattaactgttagctttattggcactaataattatcctatcatttgcttcatgtcaattggttataccacattaaaggaaggcttccttgcacctgggtcaaaacaggtcacatcaaatttctcttttatttcaaatatctcctcaaatctgtaaacagaatgacaaagaaaacttacttttaagatatacgcatttttgtatgaaccaacattttcagtaatttgactataatagatatcttatagcctgagacacaaaaaaaaggtaagaacaattggtgttgtatattataaatagcaattaaggtaaaattttcacaccaataaacttataagaaaaaaagacttaaaaccttcttggccgggcgcggtggctcacgcctgtaatcccagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaccttcttgaatatctattccctcagcaaaagttggggcaactttatatctcagttaatgttacatttgttaccaaagaaaattcaacaagattcaagtatttaagctgaactgtctgcccagctaccactagatttatccttctgtacacataccaagcttgaggtttttaaaatgagaaggtcctcattgttcaactcccacttatgtgtgagaacatgcagtgtttggttttctgttcttgtgttagtttgcccagaacttaatgtataataaaaaagagaaagtccttactaaactcgatagattattattactagggataaacaaagaccatatattcaacctgccaccatcttttttgtatctgcccaaaacatcttaaaatctcttaccatcaatcataccggacagttcatgttttcctgaaaaatgtctacattattaactgtttgtgaggctgctgtcaaatgtgactaatgaaaatgtttgaaaagcatttttaaatgtgtgtgattaatcaaatcctatatggctgctctgcaatttctaaatagatatgaacttgtttctaaatttatgcacaagccaccagaattaaaggtgtaatcaaatcccagatgtgaatccattctgaggtcttattttcaaactaaatttgtaggtttctcctcttcccttgatttaagaccaccatgtcccacattaagtttcttatcattatttttccactatccaaaaactttttcataatatttattgtcatgtgccaaagagtggaattttatttttcaagtagttatcctaccaggttatagatatatctttttaaaaaaatgttaattttaaaaaattacaaaatttgctttcagaagcagagattcctggaggatggatgaaaagtctcataattagctttagagtattgcctgtgccagctttctttctctgtccccaaaccaaatatctttataagaccatgacctttttccaatattggaatatttttctattttaaatcatcaaatatatacatttctactaacggatttctcccataagaagctatggcttcaataatacatttatttagtacttctagttacaactttcatgcatatgtattacatttggttcttgcaagcattctgtaggtcagtaaactaactttctgtaagaaaatgcattcaaagatggcctatccctgaaactattaactccttgaaggccacagacttcattcagaacctgaaaaaaaatgcatactctttttccaagaaaaacacaagaatatataaaaatgcatacagatttgaagtttcagagggttcatggacaaccttgattcttttgttaatttttaatttttgtgaatacatagtaggtatctatatttttatgtgaaatatgttgatactggcatgtaatggataataatcccttcagggtatgtagagcacccatcccatcaagcatttatcctttgttttacaaacaatctaactatactcttttagctatcttaaaatgtacgattaaattattatttactatagtcactctgtagtgctagcaaataatggatcttttcatcctttctagtttttgtacccattagccattccaacttccccccaacccctccccaactacccttcccagactcttgtaacaatcctactctctatctccatgaattcaattgttttaatttttagcttccataaataagcaaggacatgagaagtgtgtctttttgtgcatagcttatttcacttaacataatgacctccagttccatccatgttattgcgaccgacagaatatcattttgaatagtgttcccttttgtatatataccacgttttctttatccgttcatctgctaatggacacttaggttgcttacaaaccttggctattgtgaacagtgctggaagaaatatgggaatacagatgtctttatcatatactgatttccttaatttggggtatatgcccagcagtggggttgctgtatcttatggtagctctatttttagtttttttgaggaacttccaaattgttcttcttagtggttgtactaatttacattcccaccaacagtgtagtagggttcccttttctctacatcctcattggcattcactggtgcctatctttgggataaaagccattttaactggggtgagatgatatctcattgtagtcttgatttgtatttctctgctgatcaatgatgttgagcaactttttagatatctgtttgccatttgtattttttagtttgacaaaggtctgaataaacatttgtccatttttaaatcagatttttttctatagagtcatctgagctccttatatattctggttattaaccccttgtcagatggactgtttgcaaatattttgtcctattctgtgggctgtgtgtttacttcgttgacttcaattattaaattaagaagctgagatctacctaatcactcacacccagcagatttaactgaccttaaagttcatatcattaattaacagtactaaaagttacataaaaccatgagagaaaacaacttgggggaattagacaaagggacagtattcttaagaatatattatttgttcttcactgatgttttcctagtactgatagggaacaaaataaagggtaggatatattaatagagtgggactttaagtattaatcgtctctcagattcaagttacaaaataaatacactctaattgctttgttgacaaattcaacacagaaggtatagacgaatgcttctcaattctggaagcacattagaatcacacaaggagtattaaaaaaattacccttgtctacgatcctatcccctgagagatactgatttacctggtccattatagagttttgacatcattatgtttttaaagctcctcaggagattctagtgtacagagttgagaaccactgctatatagaaaccaataagaagaaaatcgagcttaattttttttaagaaaatagtgtgctattgtgaaagaggtcccaagcaagagaaaagaaaacaaacatttcatggtgagaaaagaaagccaacatgcaaattagcaaagagagggattttcaagtaaattttgtcaaattaaggaaaacctattaaaaagatgaagaagaaaaataatcttcctatggccagaaaattaaaaggaattaagactacattagagaaattgtaactatataaataataaaaatataaggagaaagaacatataaaatttttgataaatccaaatttaagcagtatacatgagttatgaaggagagactttacagagaacccaagaatcacataaatatgttattataattaatttagctatttgcaaatttaaaattagtattaatctctatacacaataaggtaaaaaagttgactccacaagacacaattttcacccaactatttgattaaaggtcagatgttctcataagttctgccagctttaatatttttttgcaagcaagttagtggaaaaatacagaataaatagagtacctatcaaattcaaagaccccattgcctaagcaggctaaaaacgaaacactgtgcatgcacacacatacatacacagatacaaaaactgtaatatatgtaagcatttcaaaaatgtaggtatgtatcttatactgttgcatgtagttatctagcaaagaaaccagttgacccataaaatatccatttagttttcagataataatataatacattaatagtaatagaatcactgaatcttagagtccgaagataatttatatggttaattccttctctaaaacattctaacatattgatagcaatccctctaaaacatacatagcagaaagccatagattcagtatctgtattctttccattgcattgtccatcaacttataaattgtttttgctttattttgaaaactttaatcattgataatccttgttttcctttagaatgtcaattttctttttgaactatggttaccacaactcggtccaatactcccatttttgtctctccaatgtatgatgatttacagaattaaaagaatggttatctggagagtgaacagtgaagaattcattgagacacagctgcaatacaaaaaaaaaaaaaacaaaaaaaaacaccatttttttcccagaaaagtttggaaaatttaataattaagtgaataaattatggtcactttgtcgtgatcatcaatattactaaacaagccatgtatatagcaaaagaaggttcgtttttaagattataagttagagttcaaagtgatttaattttcaatggtaataaataccttaatattatctaccaaaaatattgaataatatccaaataatcaagtcaatttttttatttttagaattaagatttctaatagtacctaaagggatttaaaatgtttaattggagaagagaggggcaggatatatagaaaaagatatttaacctaattattttgggtactttatcttttacttaacaaacatttttgagagactactttggcaggtactattggatattggaggttctgaaaatatagcagtaaagaaaatagacaaaactatcttacctcctggagattacactttagtaggccagattaaagataaatgaatagactatatggtgggtgagacaattatacgtgctaggaaggaaaataaagccaaataggggacaatagatgtccagggtaaggaaagagactgtaattttagaaaagatatacgaaggctgggcgcgggggctcacacctgtaatcccagcactttgggaggccgaggtgggcggatcataaggtcaggagatcaagaccatcctggctaacacggtgaaaccccatctctactaaaaatacaaaaaattagccgggcgtggtggcgggcgcctgtagtcccagctactccggagactgaagcaggagaatggcgtgaacccgggaggcagagcttgcagtgagccgagatcgcgccactgcactccagcatggggcacagagcgagactctgtctcaaaaaaaaaaaaaaaaaaaaaaaaaagatgtacggggaaagtgtcattgaatggcgattcttgagtctaaagccaaaggcggtaactattgctgtaacaggtgtgatatatgcatcgaactctctcctatctacatgtacacaaacagtcttaaaatgaacatcactgcaagccagtattatgattaacagttaatttgactctctagactttttatttaaatatctagattaaatccacccacagctccaagtgacagaacacttcggtttactctgcttagtaggcttctgtatagacttaatttccatgcaaatgaaagtaattttgattgccacatggtattattgcctcagaaacgatggacatttagaaacttttggtgcaagtttccaaagataagagcttggaagcagaagggagagccatatcaattcagagtgtaacagcaatatcaagataaatttgtttggaactttgattttacatagcaactcttccgaattcgtcaattgcacaaccctatgaggtaaacaggacacttccttttatcagcattttatagagaaagaaactgagattcagaaaaaataaaattacttctccacaggcataaagctaattactaaagaattacgtactaaaatctgtgtcttcttattcctaattcatgtcctttttcaattcatttacctgactaccccacatgccttctccctgccaagatgaaattatctcttactattatattaggagatggatgtgcacctgtctgttaatgttaacagaggaaaggggttgctgagtgtctataaagctgacttgtaacactggtgtatctgctacaacattggctctacatacatatcaagcaattttgaactgctcaaacaccatgccaatcttaatgcaagagctgtcatagccagagattctaggataccatcagaaattgcagtcttgcaaaagaaaaaaggcaaaaccttaaagtgaacaggcttcaagttcgggtagcaagtaatatgtctgctacaaggatatacatgtcctccacgctgtgatttctcaatatgattaaggtagtctaattcaaattcattcagcttatctgaggtattgcaaaagtgctgttgcagtcactggtgacagtattcccaaagagaggcaattagacttcactagatttaaagtttaggtctcattatatatgatattttcagctggtacacatattgtagttttcatgaaagagctgcataaaacaagggttcctgtttgagctccactgatcctttaagaatgctgactgccaaactgccaattgtgttctcaaagaatagacatatcagccactgagtcaaacagctacgaagctctcacctgtcaacagtgggtaatcaagaaacaactgaaagatataccttcagaatgccagaataaagtgttaggaaacatcggattgctataaaactttccctcctgtagtcaccaggcataccatgggttaaagcaagcatgctccaaagccacatctttctccacatctttcttgaacagcaacaacaaaaagttaaaaaaaaaaaaactgcagattaaacccagctatagttccatgttatcaaagaaatactattttaagtgagtatatgtcattgctattgaggaaaaagcatgtacatctagcatagaagccaacaggaaattattcataacagaattatgttttacataacactttaacttaaattttaagcaatattttaattagatatatcaatacataagcagaaaaataatcaataagtagaaggtgtatgaaaagatgagggagtcaattcagtgatcatagtcttgaggtatgtcagctataatgatcattttactcacatttctcccaagatggtgaacataaatatcattgaatcaaggtactatttaaaagacaaatagatggtatgaaggttattgattgcaagtggcaatgtttttctaatacatatttcatagaagaatgtaaagattctctatgaatccagaagaacagatgggtaaggggaaatggatacttttaaagcttcaagactttttttatcacttttaaaaaacattttgagataattttagctttataaaagatgtgcaaaaatagtatgaagaattaccatatacctgttccccaaattctccatatacatcttttataaaaataggacatttgtcaaattgaaaagtaaccttggtaccatactattagccaaagtagagaactttgatttcatcagtttttccattaatgtacttgtattcaaaatcatgatttcgactaatttatgtacattttaaaataactaaaatagtataattggattgtttgtagcacaaagaaaggataaatgcttgaggtgattggtaccccacttaccatgatgtgattattatgcattgtatacctatatctcatgtaccatataaatatacacacctactatgtattcacacaaattaaaaataaaaaaattatattattgttgctccaagatctaatccagactactacaatctatttagttgtcagggagccacagtttcctgcaatcagtgacatttcttcagtttatctttcatggccttcactctgttaaagaacactgtcaattatattttagaatgtatttttgtaacgtacttcaatttgggtttgcgtgatatttccttatgattagactaaaattagacatttttgggaagtcatccacagagataatgtacccttctctgtgcattaaattgggggcatatattgaatacccttaatttctttctcctgcctgattgccctggccagaacttccaacactatgttgaataggagtggtgagagagggcatccctgtcttgtgcctgttttcaaagggaatgtttcctgtttttgcccattcagtatcccaaaatctccttaagttgataagcaacttcagcaaagtctcgggataaaaaatcaatgtgcaaaaatcacaagcattcttatacaccaataacagacaaacagagagccagatcatgagtgaactcccattcacgattgcttcaaagagaataaaatacctaggaatccaacttacaagggatgtgaaggacctcttcaatgataactacaaaccactgctcaatgaaataaaagaggacacaaaacaaatggaagaacattccatgctcatggataggaagaatcaatatcatgaaaatggccatattgcccaaggtaatttatagattcaatgccatccccatcaagctaccaatgactttcttcacagaattggaaaaaactactttaaagatcatatggaaccaaaaaatagcccgcattgccaagacaatcctaagccaaaagaacaaagctggaggaatcacgctacctgacttcaaactatactacaagactacagtaaccaaaacagcatgccactggtaccaaaacagagatatagaccaatggaacggaacagagccctcagaaataatatcacacatctacaaccatctaatctttgacaaacgtgacaaaaacaagaaatggggaaaggagtcgctatttaataaatggtgctgggaaaactggctagccatatgtagaaagctgaaactggatcctttccttatgccttgtgcaaaaattaattcaaggtggattaaagacttaaatgttagacctaaaaccataaaaaccctagaagaaaacctaggcaacaccattcaggacataggcatgggcaaggacttcatgtctaaaacaccaaaagcaatggcaacaaaagccaaaactgacaaatgggatctaattaaactaaagaactttggcacagcaaaagaaactaccatcagagtgaacaggcaacctacagaatgggagaaaatttttgcaatctacttatctgacaaagggctaatatccacaatctacaaagaactcaaacaaatttacgagaagtaaacaaccccatcaaaaagtgggtgaaggatatgaacagacacttctcaaaagaagacgtttatgcagccaacagatacatgaaaaaatgctcatcagcactggccatcagagaaatgcaaatcaaaaccactatgagataccatctcacaccagttagaatggcgatcattaaaaagtcaggaaacaacaggtgctggagaggatgtggagaaataggaacacttttacactgttggtgggactgtaaactagttcaaccattgtggaagacagtgcggcgattcctcagggatctagaactagaaataccactggacccagccatcccattactgggtatatacccaaaggattataaatcatgctgctatgaagacacatgcacacgtatgtttattgtggcactattcacaatagcaaagacttggaaccaacccaaatggccatcaataatagaatggattaagaaaatgtggcacatatacaccatggatactatgcagccataaaaaaggatgagttgatgtcctttgtagggacatggatgaagctagaaaccatcattctcagcaaactatcgcaaggacaaaaaaacaaacaccgcatgttctcactcataggtgggaattgaacaatggaacacttggacacaggaaggggaacatcacacactggggcctgtcgtggggtgggggtagaggggaaggaaagcattaggagatatacctaatataaatgacgagttaataggtgcagcacaccaacatggtacatgtatacatatgtaacaaacctgcactttgtgcacatgtaccctagaacttagagtataataaaaaaataaaataatagtaaaaatataaattggaggcatataatgtcgatatgtgtttttagtgatactaactttgaacccatggctaaaggaaatacctgctatgattctccactgtaaatttattattttttcctttgtaattataaaatatttagggggatataataaatatctatgcacatattatatatgcaggtaaactttgacctacttatatgaagatccataggaggaatttgcctgcaactccatattaaaaatcattgcaggataatgtggtgtaataatgatttctattttcctcattcatccttcagttttaattgaggttcctctgtgtagtaatttatttgccatttgtttatttcttcagttgtttataatactcatatttgattcatagatatggattttattctttggaatctaatcttatgttacggttattttactcctcttgttgtttcagcttcatccattaggtactctttcatgttggctcctgtgcccttttgattgatccatctatctatctatctatctatctatctatctaatgatcattatagctgacttacctataataaatatatttacatttaataaatattatatatatatatatatatatattttactcacttacttactttctggcatcacaagattctccaggtacatttggcgttttttaatgccctcactcaccttgcattgtctctactgcactcttacgattgactgtatgtccaaggagccctggttccatgatacagaggacagtatttcaaaaccaagatctggatgctactatgttccttgttattagaatgttacaatttctagcacctattaggatatggagctaagatatatatgcatgtataccaactcatatatatacaggtatatatttattcctctatttatctgtatataagttttaaaactataattccatttcagtacctccaatgccaatgagcatcacgaggttcactctagtattcctatttccttattggtagctgctttctacaacagaaagaattcgagttcttatgatataatatatttaatactttgctcagctctagtatacatataaattaatttcagaatttcaaccagtaaccctttaaggatcaaaattatcaactagagtacagtgtttgggaactgtttctttgtatttggccttagaatatgaagtcaaatgtcaatttgccaaagttgcttagtttcattcctttctttcccataccactcagtatgggtctatgattcattgttaatacagttagaatcgttttgtcacagcctgcactccatgtaccccctcgacaatctgattgatctttacaattcacatacacaaatttcactttttatagtacacagctttatgggtttgaaaactgaagttcaccactactgtcacatatagaacagttccctctcctcagaaatttcactgtgttataccttcctaaaagatccaatgatgtgttttcttacctagtgttttcttttttaaaagcatcatataaatagggattatgcaaaatgttgctttcggcatatcgcttttttgtttgctttgctttttgtgtatttttaatttctaatttttatgaatacatatttgtacacatttatggagtacacattatattttaacatgagcatgcaaggtgtaatgatcttatctgggtaatggggatgtccatcattttaaacattgattatttctttgtgttggaaacattccaaatctactcttctagttattttaaaatttagagtaaattattgttaactatagttgccctattgtgctacaaaacactagttcttacctaaccgcatttttgtacctattaaccaacccttcttcatccttccctccccagtatccttcccagcctctggtaatcaccattctattcactacctccatgagatgaatacttttagttcccacatatgactgggaacgtaagacatttgtatttctgtgactggtttacttaatgtaacataatgttctccacttccatccatgttattgtaaatgtacttatgattcatacatgttattgtaaatgtacttatgattcatacatgttattgtgtgaacaacagtgtatcctttttatcattgagaataattccagtgtatggaatggatgtgtatatcagaggttatttactcatttcatagtcgaagtatgtgtgagttatttacaattttttggcaattatgaactttctaaaaccttcataggcaagttaatttgtgtgaatatgtttctaattctctcagataaatacctaggagtgggattgccaggtcagaagataggtgtatctttaatgttactagaaactgccaaattgtcttccaaagcggttgtaccactttacctcaccggcatttgctgttgccatttctctttatttatgtatttactgagatggagtcttgatctgtcacccaggctgtagtgcgatggtgctatcttggctcactgcaacttctgcctcctgggttcatgcaattaccctgcctcagcctcctgagtagctaggactacaggtgtgcgccaccacaccctggtattttttttttttttttttgtatttttagtacagacaggatttcatcatgttggtcaggctggtcttgaactcctgacctcatgatccacccgcctaggcctcccaaagtgctgagattacaggtgggaaccaccacacctggctaccatttctttaaaaactttttagacattctatagttgtgtaatggcatttcattttacgttatatatccctttaccacatgtcctttactcaacttctccatatacatcttataaaaccatggaaccatatacatatctgtgtgtgtgtgtgtgtgtgtgtgtgtatatacacacacacatatatatacatatatatatacgtgtatatatatatacgtgtatatatatatacgtgtgtgtatatatatatacgtgtgtgtgtatatatatatacgtgtgtgtatatatatatatacgtgtgtgtatatatatatgtatatatatatatacacacacgtatatatatatgaagtaaaaactatgattaggactaagaaacacagaaaaaccaccattcaagaggttgccagatcaggctatagatggcatggtaataagaagataggctgttagatgtagttacaaaaaaagcttatttaccttaacaaaaaaaatcagtaaaaattaaaggatgtcaagacaaattatactgatagagtaagtaatgaaatgtcacaaataggaaagagagggagagagaatgtgtgactatgtgagtagaagatttcaagaaactgtgaaatgaatgacgcaataatcattgagagaaagtatactgccaagaatggtgagtttgcatagaataaaaaatgttgaccatgggtaaatgctaatggaaagggccggaggaaaggcttgaagatgctatacagagagatagtgctcctatgatccataagtatgcggtggtgggttggggggaatggagcttagacaaatgatttttatttaatttctactttaacagaaagcagcaatcaaagttgaacgcacaagtaccttcatttctcatggtgagtcaggtttctattttatttctgaagagaaaataggtcaatttgttgagagggaaggaggaaatggaagaaaggttgtgggtggagagtacaggactttggtgaggttttggagaaaaatacaagctacctaataaaaatcacacaaaaggtttgataagcacattaaggaccaacctaaggttgcaaaccagggtttagagtattaaagtataactagagaagacaaatatttgatctttttattgcactggagttgaaactgtccatgtggtagaaaggaaagaaaaaaaaataatttaagggtactgtcaagaggactgaaattacttatcatgagatctaggatagatattatttaaataaatgaaagaactaccagtttggaagaaaaatgaacagaattgtactgatttttgtgttatcagagccaaagacaacctggtgaaaaatagctgaggagaagatgatcttcagttaacattattgaaggatagaaaatggtaccagtattttgtttttgtttttctttttgtcactgttattatttggttttatgattgtgtgtgtatgtgtgtgtgtgtgtgtgtgatttaatgaagcgtttattttaaaaatgttgtttggaagttatataaggataatgtctaaactgtagttaccagtatgaggaatatcagtatatcagtgaatgactataagtgcaacaggacaagcagtttttcttgtgagacactcagctgttagtttaggaggaagttaaacaatttggatgtggttaagagtgtttactatggaatggaatttcaaaaatacaatgaaaatattttaaagtgagagaagaaattgggagtgggaagaatcatcaaagaagagcaatggcaattgcaagcatacaggaaataaggaacaggtagataagttagtcattagagctggttaccaaatcaattccgctttttctgggaacatggtaagattgtaattttcatctcctttgaagttgggcatgtccaagtgatttgacttggctaatgtaatgtgagggaaggtgatgtgtgtcacttcctggtgaatactttgaaagtcagggcctgatttgccaagtctctatctcactgtggcagtagtcaatgattagggcctccctggcaactcacattggacacacagtgcaaaagaaatttttaaaactgtgtcaaatcactgatcactggggattctttttaaattcagcataacctaggcctcctgactgaaaaatgagcaagataccaggatgagccatggtattctcagggttccaagcaatgcaaaaccgtggaaataaagttacttcaaagaaggcacacagatggagaatcaaatgacaatgacttgacaatgcttactgttcccttatgtgtaagctttgtagatcagtattacactacattaatgtcaattcatatcagctaacaaatccaatctacattttaaatcaattattcatatggaacaagtgagtaaaggtcagtttataacttggataacatatttataaaatgaataatcaactaccaatcaataaatacaaatttatacatagatacatatatttacttgttcatttttgtacaagtatagatacttctaaactctgcatatttaatttttcttttatgtatttttttttataaactcttctttggggagcaaaatcaaaattttaagaattacaattacatttagaactttgattgataaaatatgatatgatcattagcagtctttaacattcataatttgagcatttaatcatatatagtatatatacaccatagtttgttatagacatatatagttatatatataaaataaacttttttataaataggaaggtgatttgattttctcttaggcaatgaatattttttattttattgcagtaaatattcaaattatttccaaattgcacttattttttctgtattattcatggttttggaattcagtaacttttcaagaacttttatttgaatagttaaccaagtgacttttttttcctcttgagaatttaaagttaaaaaaggaatgcaaaacaaacatattctttattgtattatacagactagataaatttacgtataagcaagatagtttgttgttgatgtatccagatttaataggcatcacagtggtcccaaaatgtatccacatggttctttaaaaagtatgaatttctactactagaaacatacatgtttacatagtagttcaccattaaaaagaaattattttttaaaaatgcaaatgcttctgggaaccagggtaaaaagatggattaaattaattcatataaaattgttgatgatttttatcagattcaattgttttctgaagaggaaaaaagagagattgttagtacttaaaaagtaatgtaataaaatcacctaaaaattgacaaaataagaataaagctttgctacatataatattatcccacccacaatttctcaatctgtatctaatttataggccttttaagacaaaagccagtttcccataccaactttctaacacagcaccaaacacactggcaagtataacttcaacagattcttgctgctaatggtaatgtattcttctcagacaccaattctcatgaactatgagaaaagaagagaaatataaattttttatgctccatgtcttttgaaaaatgctaaatactgaagttgctggatatctaatgataaagcctttgtggtccacaatcaaaactatagactacttggtcttttattaccataaaagggcaacgccatttggcgatatacactattgctagcttgaagaacaagaaaaagtacaacataggagctatgatcttatgaataatgtttaaattttttcttcatagtttcagcatattttattttaggcccaagtaatatttttacatttttattgttttaatttttatttaaaatttgtagtaagaatacttaatataagatctaccttcttaacagatttttaaaagtacaatacagtcttgttaactctaggcatgatatttcacagcaaatctctagaacttattcatcttggctaacttaaattatacacctgctgaatagtaactccctatttctctttcactcagaccccagcaaccaccatgctactcactgcttctattagtttgattatttttcataccttggaatcatgcagtatttgtccttcgttgactgtcttattttacctagcataatatcctcaaggctcatccatgttgtcacatatggcagaattttcttttttatggctgagtaagattcctttgtatggatatactacattttactcatccattcatctgtggacatttaggttgtttccacatgtttgttattgtgaatagagatgcagtgtacatggtagtgctaatatcttttttaagatatttattgaaattattttgaacaaatatccaaaaataggattgatgggtcatatggtagctctattttttattttttgaaaaacttccacaatattttccacagttgtttcacattttatattcctactaacagcgttcaagggttccaatttttctatatcctgatcaacacttgtctttttttaaaaaaaataatagtcatcctaactggcatgaggtgatatctcattgtggttttgatttgcacttcttgacaattagtgatgttgagcacattcttatatatctgttagccatttttatgtcttctttggagaaatctctacttaagcccttagctcattttttaatgaggttattagatttttggaaatgagctgtaggagttccttatgtatattaaaaattaaacctttatcagatatatggtttgcaaatattttctccaactccttaggtttccttttcactctgttgattgctctctttgctgtgtaaaaggtttttagttttatgtagacatacttgtttattttctcttaatttgcctgtgcttttagagtcatatccatgaaatcactgacaaggctaatatcatgaagcttttactctgtgttttcttttaggagttttagagtttcaagtctcatgttcaaccctttaattccttttcagtttattgctgtgtcttttgtaagataagggtccaattttattattttgcatttgaatatctagttttcccagcaccatttgctgaagaaactattattttccaatcttgtatgcttggtaaccttgtgaaaggtcagttgaccaatcatgcgtgctttcacttctggatttgctattctatttcattggcctatatgtgtctttatgtttgtaccatactgttttaattactgtagctttgtcatatattttgaaatcaggaatttcaatgctttcaattttgttctttcttaaggttattttgtggattcagggtcatttgtaattccacaaaaaattttagattttttttctatttcattaagaaatgccatttgaattttgacagatattgcactgaatctgtagataattttaggtagtatagacatgtaaacagtatccagtatcccaattcatgaacatgggatgtatctccatttgtttgtgtgatttgatttttttcatcagtgttttgtatttttcagtgtacaagtttcttacctcctcagttaagtttattcctaagtgattatttcttataggtgctatggtaaatgggattgttttcataataaattttgcagatagttttctgttagtgtatcaacaatgcaactgatttttgcatgttgattttatttactaaaattttactcaatttgtttattatttctagaagtattttttgtggactctagggttttctacacataagatcatgtcatttgcatttttccttcatagattattactagttttcagattaggagaagagaacaaactattttgtccaatgtaattttcagaactacattaatattatgtgtagtatatatatgaatgtatcaatatctatagttatagctgtctatatacatatatacatttatgtaacacctctcatttgtgtataatgttattgcagttactggtgagagtacaatgtacaaagacagaagaaagggtctttgcttccaagttggaaatgttaacaccagtaatctttttaataaatatatttctccattgacataatattcatttataggtgtttaccttttgaatttaaaatgtgtgtttaaagaatctgtataagtcaatgaaaatgaataattttacttttctatatgctgaaagatccactggttctaaggtagagagttttgaacagagtttggaacttattgaatacgaattggaatatattgaatatgaacattactaaatatatacaggtataaattctataaccacttagagaagaaaggaaaaaactgtcacatgggtgaatggactcaatgacctcaatccattgttctattccattgttctaactagaacataatagcattgttattgaatacctgtgtactgatcacctgacaaataattcaaatttgatattaatagtgagaaaattaaggataataattttatgtttttttaaatggttcaatatctttcaatcaccaactacataaatcatgaagaacatttcattagggaagctgaagagcctggcgtatggttgtacatctcacttccagagactggtaaattcacttatcgtatctattaattacctacatgtagggcaaattttacaagtagaaaaaaattaagcaccatgttggcaatcagtccagtggaaattgagtgtgaaataaagatgtttcattccatcaagtttaaggaattaaaagtcaaatgtgtacagcttggtcaaggttaaaatttatgttaagatcatttacaatttttttttttttttgagacggagtctcgcactgtcacccaggctggagtgcagcggcccaatcttggctcacttcaagctccgcctcccaggttcacgccattctgctgcctcagcctcccaagtagctgggactacaggcgcccgccaccacacccggctaattttttgtatttttagtacagacagggttttaccgtgttagccaagatggtcttgatctcctgacctcgtgatctgcccgccttggcctcccaaagtgctgggattacaggcgtgagccaccgcgctcagccttacattgttttttttttttaaataataattgaaattgttttaacagccatttcaaaataattaaaataaatcctcttcatacataaaagataatgaacagggcaagaagatgccatgctaattttctttttctgggtagattatttttttaatggtcagaagaaacctgcactcttatctcctattttcagctaactcttaccttttgcctcccagctttctgatactacaaatccagcagcatatcctcattgtcagacgagaaacttgaaagggatttcatatggtgaaaacagttagataactcttgaggacaaaatggcaatgtaaaaatatcctcctccagctttgccagtacacaaaaaatctaggtcattttattcagcgggagaagttattagaagaactcctctcatttcctccacaaaaaaaaaaaaaaaaaaaaaaaaagcaacctcacaaaatttaatgacctgcgaattctcctctggggaaggtaccatgccctagacatttcattaaatatatatgtactgttactaagactttaaaaatctgatgattgaaaacacattacaaaaataacataataaagatattcaaacatctaacaattaaccaatatatgccaaacaaaatgtttggcagaattttaaatgaacagaaattgagccaactccatttttaaataacttcttagagctgagtataatgtgtcttagcacatagaggcatacctcattttatcatgcttcacagctattgcatttttttataaactgatgtttctggtaagtctgtattgagcaagtccatcagtgccaattttgcaatagcatgtgctcaactcatccctgtgtcacattttggtaattctcttaaaatttccaactttattattattattattatatctgttacggtgatttgtgatcagagaatctttgatgttactattgtcattgtttcggggactcataaaccatgtccatataaaacagtaaacttgattaactaatgttatgtgtgttccgactgttccaaagtcctgcatccccccatcaatttccctctcctcaggctcccctattccctgagacactacaatattaacattagcctaattaccaaaaaccacctatgcccccaaaactagagaaatacaaaaattagtccagttaataattcaacaatggcctctaagtattcaagtaaaaggaagagtcccatatccctccatttaaatcaaaagctagaaatgattaagcttagtgaggaaagcatgtcaaaagccaagacagcccaaaaactaggcctcttgtgccagtttgtcaagttgcaaatgcaaaggaagagttattgaagcaaaagtgctactccagtgaacacacggataataagatagcaaaacaaccttattgctgatatgaagtaaattgtggtggtctacatagaaaatcaaaccaaccacatttccttaagccaagccctaaaccagagcacaaacctaactctcttaatcctacaaagactaagaaaggtgatgaagctgaagaagaaaatcttgaaactagcagaggttggttcatgaggtttaaggaaagaagccatctccataacataaaagtgcaaggtgaagcagcaagtgctgatgtagaagctacggcaagttatccagaagatctagctaagatacttaatggaattggctacactcaccaatagatttttaattaagaagaaacagacttctattggaagaagcataccatcttagaccttcatagctagagaagggaagtcgatgcttggcttcaaagcttccaaggacaggttgactctcttgctaggagctaatgcagctggtgactttaagttgaagctaattctcatttaccattccccatatcctagggcccattagaattatgttaaatctactctgcctgtgttctataaatggaacaacaaagcctagatgacagcacatctgtttacagcacagtaaatagaatatttttaaacccactgttgagaccaccctgctcagagaaaaacagattcctttctaaatatgactgcttattgacaatgcatctagttgccaaggtgcaagaagattaatgttgttttatgcccagtaacacaacatgtagcctatggatcaaggagtaaatttttactttcaagtcattattttagaaatacagttcataaggctgtagcttccatagatagtgattcttctgatagatctgggaaaagtgcactgaaaaccttccggaaaggattcaccattctagatgccattaagaacatttgtgactcatgggagcagatcacagtatcaacatgaacagtagattggaaaaagtaggttccaactctcacagatgactttcagggttcaagatttccatggatgaagttactacagaggtggtggaaacagcaaaagaactagaattagaaatggatcccgaatatgtgactgaattgctggaatgtcacgttaaagactgaattggtgaggagttgcttcttgtggatgagccgaggaagtggtttcttgaggtgggatctactcctggtgaagatgtagcgaacatttttcaaaagacaataaatgattagaatattccataaacttagtaaataaagcagtggcaggatttgagaggattgtctccaattttgaaagaatgtctactatagtcaaagtgccatcagagagcattgcatgctgcagagaaatccttcgtgaaaatctgagacaatcaatgcaacaaaatcattcttattttaagacactgccacagccatccaccctaaccttcgacaaccaccacccagattagtcaaaagcaattagcatggtggcgggaccctacactggcaagaaattatgaccgactgatgggatagatgactgttagaatttttagcaataaagtatttgtaataaaggtatgtacattgtttttataaacataatgctattgcacaattaataggctacagtatagtttagtcataatcattatatgaaatggggaaccaaaaaatatgtacaatgtgcttttttgcaatatttgctttattgcagtggtctagaacctgcactctctctgaggtatgtctgtatggtctttttgatccataagtacacaaactgttagggaagggatgtatacatatgtgtatatccacacactcatagatggatataatatttaaggaaaacagggagattaggtgtgaaggaaaggtactggtggtacctgacttcaaataccgaaaggtttggtcttcctgacttacctcctcccagtgctactccataggcagtggatattgaaggaattgtgcctttaacactaaggagtctctgaagggactattctttgtaaactaatgccagggccaatatctgcaaaaacttggggcagtaaaatatgaggctctgaatacacagccctcaagtgtgtggtgtggacatcacaagcgtcctcttcagtggtgcttatatatgataattcagaatttgcacaaagcttttgagaggtgcttttctattaaaggctgagaaagcctgttttattttttaagacctctcaccacatggtgtaatttccaaaagcttgaactttctaaaggaataaacaaacctgattacttacctatgtcagaatgtttggaatttgtgcctcttaaaagtaatagcaataaaggtgaatccagattttacagaaaggactgatgtactgagagaagcttataactctgaaagcaccaactgtgacctactgggaagggtagactcaacctgaaccatcatataatgttttactttattttcaatatgatgatacaggttcaagaataatttcagttttcagactgaaaactgagaaagaaactgagggttctttcagtctgagaaccctcaattttgatgaaattagcacagtaaagctgaacttttaaaaaagttgaaaataaaaaattaatgcataaatagaaatattaattattttatagcataaatacaacagtgttcatctaagaagggtatttcctaaatgagaagctaggtttttaatcataatttttattaatgttctgtgagggggttcataaataagtatataatatgaagtactagtttacaatcaattttttgatgaaatattcctcttacagccaaacacctgtttcacgtttgttggatgtataattaatgcagcctaatgaacatgcttcatcaaaatttctctgtggttgaaaaataaaatcagagtggtaggtcttgccaattagaacatttgggaaatatacattaaaatgttttaagtacatatcgtgatgttttaatttaaggcagagtgtgcctagattgcaaaatcctatatgaaatcacgtaacaaatgctacgatttaccactacatagtaccacgtataatcaacacttgtgttgcctgcctggattctctagaaggcgtgtgtatttcctgcatgccttgatatattaggtgtctatgacaaagcaactgtcccaagcaacacttctcctagctcagcaagtctcctactgttcccacttcagtcttttctttcctcagccatgccctgcaatcataatgaaggcattcatccttctgacaataagtctgacttcaaccctttaatataaacaagcaggtagaactgtaagaaaaaatatctttctaataaaatacccccaatatttttcaagtatatttatctgtatatatatatatatatatatagacagaaagaaagggagagagagagagagagagaaataaagagagagagagagagagaaagcggctctaatatgtttgtttacaggtgaaattttacataaatggctattgattctctttatgattacttttgaaaataaatgatgtgtccattgatagaagtaaaaagtcaaacataatgctggtaattttgatttcaggggcctaactatatattctagataccaaaaacttttatcatttaattaataaaatgtaaaatgctcattcagtgtgtttgggctgccataaaaaaaggtcacaggtatgatggcttaaacaaccgaaatatattttctctcagttctgcaagctagaagtccaagatgatggtgccaacatggtcagtttaagctaagggtggttctctggcttgcagaaggtgtccgtcttataagtcctcacgtgaactttccttggtacacgcacagatttcccacactctctctttcttcctcttctaaggccaccgatcctatagaaaggcctcatctccagatgcagttacataagggaatcaacatgtaaatttgatgtgttaggagccgttcaatccttagcatgttccaaagaaactaggcacttgggagcatctatcacaccactacctgcaagatttacatttgttccgaggcagcgcaaaatgtggaggcagttctaaatttaaagtcattgtgtttgatacatagtttactgtacgataagtttattactagttttattttttaattttaagcaactacatctgaaacatacacacgctaacatggtatgtctatgtatctataacttaataaaataggaaaatgaaattatcctaacaccataagccataaaataaaaatatttttcagaaaaaaaaaatcattgcattaacagaccaaatcctttatgaagtcaatgttgtattccgtcaaaaatctttaaaagaaatacatttttcaataaggatatgtgttgccattgagagcacatagtctcttcagcatttggattcagcatatattgcagcagtcaaccatttttcagttaagaggagtgttttatcccctagtaacgtataatctcactttgagaagagaaaatcgagttcatggacaactactaaaaacagttttcaattaaattcatactattataggctatttttatttcatttttacattgtaaaagaaggtacctgttactgtttttaaatcatagctacaggtgaatttaaaaagataggggtaaattgtaaaaacaaaccaaaatatgatgctaaaaaaaaaagcaaaataagtgtaatatattcttggtgggctcatagtagggtagatcacaacactaagacctatatcatatgtttcttctctgcagacaaatgcttcggtttctattttcagggtagtggtctttattttctctcaaatgatattatcaggaagaagtattattttgacagttcttttattccaagagaataaagttagtacatttatccaaattattatttaatttcccaggattctagttatcagatttgtcaagccatataaaatatgaaattcataaatatttctaatatttcttttcacaaatttctgaagaagccctgcaataataacattagaaacatgtagatatatttcagataaaagtctccctatataatggttgaacaggatgccacaatgcaaagaatggcagagaattttcacctgcttagtgttggtattctaatcttgctcagagtactttttctataccaagccacccaatcattatatactcagtacaaattacagatgatatgaaaattaatccaacaaaaacttaagatttcagggcacaacctaaacaactgtaattgatttatagtttctaatcacatagttctaagttgatgttatttgcttcttgctttaggcaagctctttattgtcttacttcagagtcttgaggaaataaactcatttagaaatcataaaattaaattatgaataaaaatattctccacacatatccagaaagcttgagccatcaattttcacaagtcagggaaggatccacaaagattttcaaagtgtgtgtgtgtgtgtgtgtgtgtgtgtgtattttccctgaaaaactgatacattgaagaatccatctgccattgagtcatcacagggttctcgctttccactttgtttttacatttgttcttcgcccacttaacaaaaagtaaagcccacttctcaaacatcctgtgttaaatgcattgccctaatactgtgctatccaagacatagttactaacctcatgcggttatttacatttaaattaattaaaagtaaataaggttaaaaattcagcttatcagcctactgcccacatttcaatttactcagtagacttatctgacctagtgggtgttgtattaagcagtgaagattagaacattcctgctgtcatagaaagttcttttgaaaaacactgttctaagatataaagtctctctgaggggcaacactgccaactataggtcaataccaactaagtctttgaagaataaaatagcgcatttcattcagatgaagttctgttgagaaataaaaggaaatgaaaattaaaggagaaaatcatgtactctttctgacaataatttcttgggcacatatttcaaaaatggatgattgtgagtataatattgctaaagtgtggctatatcattgaacacatttttaagtataataattatttctaaataaacatgttataattactgaaaatcatacccatgccaatttcatcttataaggaaaatgatagatttgagaataaataagtaaaaggatgtacatgttttaaaaaattatttcaggagcttataaggagaatattttgaaggtagttatacaaaactccttttggttctcacaccagaaatctcttataaccaatctcttcattctctgatattcctaataagtttccacacagtaccctccttactcctgttctttaatttaattatctttcaataccctttacataaaagagttacccaaattttaaaacaatttcttccacccacccctactggcaatagatacagtattgaggttccttaaagttacagtagtgcagtagagaagaaggaaattttattaacttgtcgattctcaatgagagaattgccaagcaaacctcagaaagaggggaatggctaaggcaagcataatatgtgtctgtgaggaaaagcttcattatctatgtgttcatcctcatctgcagatggcaacaaattgaggaacatgggtccagaaatccagtttctcctttctaactactattcttattcctcttagcctgctccaaggagtcttatttaatataaatgtacaattgaaaagcaactctatttacttaagatagctctcaccaacttcagagtaataaattagacaaaagacaaatacaattggaaagagttatttatcaccaggctatggtgtgaatagacagaaactaagaataaacaattaaattgatttcaggctttgccatttctcttcatttctttaaaacagataaatatgctcgcaagtctgctcatgcctcccactacagaggcaggggcattcatgactcagtttaccaccgatgcagtaaagaacagcctcaaacagcccgtctcaaacaaatgagataagagactaggtaacaataattagtgacacacctgggaggtctgtttcaaaacacatgaactactgaatacagattatgtattcaatgataaagaggaactaagaataaaagcgtaagctaattccaaatgcattaggtagactggaagaagacaattccaaagaaaagccataaatggcttgtacattgtcataaaatttaaaaagcaacaaggttaatacatgtagaatagcttaaaaccacaaagaacactagagatgtaaaccactggaaaatgaaacaacaggaggttaatttgagaatttcccctaaaattcaatcaactttaaggacctacaaatgtaatcaccataagaagattcacactgataattccgttaacactaactagaatgatttgctttctaagtttatgtaacaagtagagccattatatcagcagatgggatttttctttagcaataattacttatgcatataattcattctgcctagttcaagataatagttgcatattcaatatttatggcattatgagaaagataattatgtggctttcaagtgaattacccttgattatagttttcttgtttttatatacactatattctaaataatccatagtaaatattgataataatttaaaagattaaagctaatcatgacctaaaccttccattgattcaatttcctttctcacaaaacctcaacaaggattcttcacatcataccctataacacacacacacactgagttgaaagctcagcaagggcaggagcctgatgcagatctctacagtgaatcctgctctaaattcctccagaagaaatgtttctttcttactgttctcatcatgaggccacagaaagaaggagttaaaaacatggatgctccaggcagatatcctgagtctgattccaagttctaccacagacctgctgtgcatccgtgcatgagttattcaaactctctggacctccccatctccagtttccacatctgctaatctacctcttaggattgtcagagtaaactgagttcacatatataaatgcttcaaacagtacctgacacataatccatgctgctactattaatgtggagaccaccttcattatagaacctgttacagtatattataacatcttttaccaccacaagaatgtcaaatttaggaatatatattctattaaaatatatacaaaatatgacatttgtatcatatgtatactcagggcctagcccaatggccagcacacattgacaattgatgctgtataaatagatgtttgatcacctaaatggcatgcacataagttgacacacaacttgtccagtaatttgggcattaattaacattggtatatagcttgcttgtataatcctgacttcttctgaaggcagttgagatttaactgtgagtgtctttaaatattctctaacaattactcctttatccatactatttcaacaacattaaatgatgtttttatagttatatattcatattagttactcaagtttttaaaagaaattaaacataattaaaacagatttatatctatatatgtttgtgtggatagggttagttttgtggtggatggaaaaaagagaaattgacttttttaattaagaaaaatagatgtgccggaaaaatttatggcttaggtttagtgaagctcctagtttagtttctttcttttttatttgttcatgctataaaataattcattttcatgacaatgaaagcaaaaaatagatttgatctccttgatttattttagctgatgcattcacatatctcttttaaatgcaagaactcaactattctaggatctagaaccagaaataccatttgatccagcaatctcattactgggtatatacccaaaggattataaatcattctactataaagacacattcacacgtatgtttattgtggcactgttcacaatagcaaagacttggaaccaacccaattgcccatcaaggttagactggataaacaatatgtggcacatatacaccatggaatactattcagccataaaaaagaatgagttcatgttttttgcagggacatggataaagctggaaaccttcattctcagtaaactaacacaggaacagaaaaccaagcactgcatgttctcactcataagtgggagttgaacaatgagaacatatgggcacagggaggggaacatcatacacggggcctgttgggggatggggggcaaggggaaggatagcattaggagaaatacctaatgtagatgatggcttgatgggtgcagcaaaccaccatggcacatatatacgtatgtaacaaaactgcacgttctgcacatgtatcccagaatgtaaagtataataataataataaaaagaatgagttcatgtcttttgcagggacatggatgaagctggaagccatcattctcagcaaacttacacagaaacacaaaaccaaacaccacatgttctcactcataagtgggagttggacaatgagaacacatggaaacaaggaggggaacatcacacactggggcctgtcttggggtggggggcaagagaagggagagcattaagacaaatacctaaggcatgtggtacttaagacctagacgacaggttgttaggggcagaaaaccaccatggcccatgtatacctatgtaacaaacctgcatgttctgcacatgtatcccagaacttaagattaaaaaagtcaatttaaaaaaaatattgcagtgattgacacccgtacttaagaatatttagaaaactgtttagacaatacatcttctaaaataaagtctatagtaaaattatctttttctttcagcctgaaattcctgtggcctgatattagactcaaacttaatctatacatccatgttagagagtaggttttatacttagttcattatttaaaggtatccagtggcaaaaataggagtgtaccaaattagactttttagaggaaaaaaatctaaaatgattataatttacgaaaaagtaagaaatgcaaaaagtttaaaccccatgcaaatggagtacatcttttttacaaactcacttttgtcttgcaaaaagtacatttttttcagaacaagtgttccctaatagcaattagcacacttaccacgttttgaatgctaagtattattgtcagaaaaagaagtcaataaaaggtagtaactgatcccagtgctgattcagggaaagcatacaatgagcctgcaatagtgagctgtgtgtgaacatagcatagagctcaggaaatgatgggactatggcaaaataataattaatcataatgataataagagccagattaaaagaactctcacaggcttaatttaggaaatctgacaatcaaaataaataatgatgacagtgaactataatgtattgaactagaagaaaaattcacatgttaaaacagatatcaaataaataaataaataaacaggagaatagtgaaagttcatcctcacagcagactaccactgctaaatgtagaagatattagaaaaatgccctattaaatccaccatagttataattaatcgatacagacaatggatgctaaaatcagtagacaatttttttttttttgagacagattcttgctctgtcagccaggctaaagtgccactgtgcgattgtggctcactccaacctccacttcccaggttcaagtaattctcctgcgtaagccttccgagtggctgggattgcaggtgcaagccaccacgcccggctaatttttgtatttttagtagagacggggtttcaccatgttggtcaggctggtcttaaactcctgacctcaagtgatccgccctcctcagtctcccaaatggctgggattgcaggcatgagccactatgcccggccaatggataaaattttaatggaaaatgggatatatacacagacttaaaagatctacatcatattacagtcagttctgctataacagaataagtgttcctaaaaatcaccatactatgcaaaaatgcacaacaaaaacatagggatgatggggaaatgggatgacagacagaatactcaaagacagcatcactgacacattaaaatagatgggagcctaataaaaatggtagcatattaaataatgaagtaatatataaactacaataaatatggcactttaccttgaaaaagacttgaaatttgcttatattcatgagtgttggaagaattgtagcttgtaaatcattgtgaagtggtgaaagggaagttctctgacattggatacaaagttgtaatatcaaatatggctggctttaaggtgtatgcatgtatgcattttgtgtctttctacatgccatggctcaactgggtgcaattttctgtgttcatttagtgtttctccatgacaaaaatcacaaataaacaaacacaattgtagctttgctgcaataattttctgatgtatcaatggtattccaacaaatttacattttcaaagaaatgtaatagcagaactaactatagttattgtaaagtggacaatggtaactttcccatggagaactccaacagaccctgccttcaccaagtgatcagaattaaccttatttaatagtgggaataactgtattacatgccatgtaattcatttaatactttattttaaaattactctcccacttgttggggagcctaatttcatttagcagtttgtaaaacaagcattaatttaaattaatggacttttaagctgatatttgttgcagaagcttatatataagattttagattacttcagtgccacacccacctttatgtgtttgcatccaactatgataaatttatgtatgtcacgacagtggggacgctgtgagctgaacagcaaatcactctaattaaggttgatgacaagaacaaactgaggaaactggtaggcctctgtaaaattgacagagagggacaacctcataaactggttggttgtagtcatgtagtagttaagcagtatggcaaagaatctcaggccaagaaagtcactgaaaatatttcaaatacaaaaaatgaacaaatgacacattggttagtgttcctaaaataaataaataaataaataaaaaatacataaaaatgaccctatccaaatggccagatgaacagtgtctgtgcaccttttgtaagacttctgttgaatgtggttgtgctgtaaaagtcctatatatatacactatatatatatttatataatatatataaatcctatatatattagatatttatatatattagatatttctaatatatatattagatatttctttaaaaacattgcaccagggaatctctcctaaatagcaggttttattcttttaatcaatgagaattacctaataaataaaagttttcttttttgctttgtgtgtaaggactcttagaataaaattcaatgcttccagactaaaattctcttaggttgtggttttcatgtatttacctgatccctcagttttatggctcctcatgtaaattttcagaaagccatctgctatttttttagtttgtccccaccaaaactcatgctgatacatgattcccagtgtggcagtgttgggatgtagggtctagaggaaggcatttggatcataagagtagctccttcatgaatagattaatgccctctaatgctctccagatagggtgagttctcctgggaatggattagctacggggttattaaaaacagtctggcatcctgggtttttctctcttgcttcctctctcctacatgatctctttgcatacacaggttccattcctgctttcctccaggagtggaagcagcctgaggccctcaccagatgtcaccactcaattgtaaaccttctggccaccagaatggtgagctaaataaacatattttctttataaatcacctggtctcaggaattctgtgatagcaacacaaattgaactaagacagcatccagccatcatacatcacttatgtatttagcaattaattagctgttgacaaggaaaaatattcttatattgtgtcttatttgtagatgagaaaattctttggagatgaaatttacaatcatagagtgggtatatacactcagctgtctcgctgagtctttgctgatttatttccattgtattgaaattagtctaatttttggtgtttttttttcagtaatgtattaaagagtatgaaacacataaacctcatgtcacacacttataaataataataaataatggtaatatgaattaataatgaatagtcccatgtataacaaaatgatacaaactaacacctccatctgcattaatatgcacccaattatatagatatcagggaattaagagctttttaaaataatcgacaggctagtaagaatataataataaattaaaaacttttcactattatctatgttttaaagccatatttcatgcatactttcatctgaacactagtgacctattttataataaaaacactattttataagcatttcagagcatataactagtttcacctttttttattaggaagttttttttaattaaaattgctcagttaaaagttaagtttgtagcctatttttttctaagggaatattttatttattaataaatataaaatatttgttatcctttttcaatattcatagtgaaatgtatttttatttgaaaccaatttcactgaaagttttaaatttttaagaagagttctaaaaaatatttcattaagggaaacccttactatcattgtcaggttgtttaaggattatatcagcattgtagtgtaatgtgattcaaagatggcaatactctctccatatcttttaaactttaacatcagagttctaaaaagatgttaaaattactctatgggaccatcttccaaagttaaaaacttaaaatacagcatattagataaattctcccatttcaaattaaaaagcaatggttttgtatggaagaaaacatattacttcacccattattaactttcatgataaaatattttatttaatttaaatataatagtgtgaccaaagtttactttaaaatgatgattttggtgtttgacttttctaattcagaaaacataattgaaggcaaaagcaatggttttgatatgagcttcctaggcaggtatttttatagcccattaacataaatatgtgattaaaattattcagaagcatttagataggaatttcacaatggaaacataaaaccttaacacaacaggaccaaatttttgtttaattcgtccttactaggttggcagacacaagtcatgcccttcaaggtttccaacggcaaatgctactatctactaagaagaagaagaaaaaaaagcagattacttttaattttctattaatcatctgcatttctgcttcaatttgagaggcaccatttcatttaattagtcctctcattataaatattttccacagtgattcagttgacacaagttttctgacactgactgtgcagatggcacaaaactggtgtctggtctcaaaggaactatttgaccattgcaataaaagagcaataaacaaaatagcaacattgcagcccacttcagtttatgtaggcagtcagccttttatcgctgtaaaaccttgaaatggatgtatgagctttgctgctataaacaaagagttgtttacagctgggggatggcaggtaccaacagtggactggagcttcagcagcctgaatgtcaggaactgactaatgtgaagaaacatattgtggcttgttttatggagaatatgttttataaaccccaagggaccatttatcacaaattcatccactctgtagcagattgctgctttaatgttgaatactggatttcagtcaggttttcaactaaaaaattgaggggaaaagtccaaatgttattttgtttctgtttgcttcatattgatgaatctcaaatttcagcatagaaaatccattttaacaactcatcctctcccttaaacaaactaaatattttatgatttggggctgattcattagaaaatttacatctacttaccgtcgtgagctgtttcaacaatgccatttatttgtaatctggtgagcttactgtatgccaacatctttaaaaaaaagtgtctaacaaaaatgcactttgctaatgggcattggaaaatgtatactgtttcccataaaatgaaataatcaagtcaccacagcaagagtttttatagccttttttaaaaaaagtcaataaataaagccacaaggatatttcacagagatgtcatggttgataaccattaagtgaatataatatatttgactttactcattacatataaaacatcattacatgagaaaacaacagctcatctcagtctcatgaaactgtgcacagcaagttgaaaattgatatctagccttgtgtcagcaactctccctgttgtaggtgaatccaggcatatggaataatatgtcccaagatacccttttacctctttatggcctctattgtcacaaagtgagaaagcagacataggtttcacacaggtatgcttgtcttaatactcgacaaaacagttggttttgggcttcaaaaatcaaaggaaagtatttggggaaataataaccgtgaagagggtataaaagagtttttttccagtggttagcaaacctcttacagcggaatcacttgtgagtgagcgggtgtcgtgctagactactgtttagattcctggaccaaatcctaatccatagagccaaattcttcagaggcaggaccaaggaatatgtctgcttaagaaactccaaatattactgtgatacacatatacaggtgaattattaaagcaattatataggaaaaagtataaatataagtgtaatatcatctgtgcacagatagtgaacatttaaaaatttgggggattcagagaaattctcttgtaagtcacagaattttattgatttcttctaatttctgccttaaagcttttctccttgtcctttcaagatttcttcttttgttctgctgctgttgactcaagcatagaatacaattcgttttaggttaaaatctagactaatccatacatttattattttcatgtttatgagaaacttcataataataattttaaataaacttccctatcctattaggaattggatctgtttgcctaactaccatccattacaagtagagttagaatggctcaatcaatgtgctttctggttatgttttgctggaactatgcagttctgagtgtaaaaaatgcacactccacgctgataagcacttcctgttcctggttaacacagaatgcattgcttgtataaatactggcccagggaacactgcagagaataaaaaacataagtgaaaagtcagctgtctcattaaaagtgaggttaatacctcagaactcctcttcttctacctgaggtttgaatgtaaccattggatcatgccctatttcatggtaccaattttcttttaaatctaattagtaattggcaatgctttatttccagctattagagtttcacctaagccagcaactaatagtaaagcagtacggttattaggtaattcaaatgaaagcttcaaagctccttttccttctggggaatctcaaactatcccataattgggttgggcatttcttttctagctctgaaatagcattctgtgggatgaacagcatttgctcctttttagagataaataattctaaaaactataggactattgtcaccaaataaagatgcatggcgagatctatcagattataatcactaaattaggtcatatagtttaacaacgtatttcttatgtgaaagaaatgatttaaaaaatctaagtggcttaagagagtttattctagagctgacatgatatctcttacaactcagccttcttcacacactgatttgttaatgtcagccttaattccaaattctgttaatgagctcaacaacacattctgttttgtttcctatttttgttcttgaacttgtttttgctgctgttaatttgtgttgtacttatttttataatgtgagatcgagtatgtaaatcataattggctgaaaaatagctatgtaaaaattgggcattaacataaactaaaaattgtcaaaattgaaattgcaatgatttttggtatttacttcaactctctttctttacattgttttttcttgaactgtcaaatcattgtctattccttctatccatcaaagttttgtgcttttctttacatgatttcctccaaatatttagctaatgtatctgttttctccttcagtgaacactccttcagtgagtttctgattatatccatatttatatttatcatcataatgtcttaaaattctctcttataatctcataaaagtttcctaataactaaatcttacatgacttaaactgaaacaagccaggcttttccttattcctctatgcaggtatcctaaagatggttgccagatcagcacccttatagtgtaaccaggaagcatgttaagaatgcagattctcaggccccaacccagtcgaactgaattagaaattctgaggatgacacctcgcaatctgtgttttaccaagccttccacctaaaatttggaacctctggtgtagaatataaaacccagctccttgatgtcagacagacctgaatctgagtttaggcttgtcaacttgcatagtcttaatcaaattgcttaactctgattggcccagcttgaatcacagtgcctatccctatccaatcactgtgttcaaataaatgggaggatttgtttggcttatccatccttggccatgagacgacactgtggatagagaggtgagaaagcctcatcataaaataaataaataaataaataaataaataaataaataaataaataaataaataaataaaaagggagaggagtggttctgtaaagaaagagatgatgaagaaaaacattttctgttctcaatgactttgttcatatttccccctctctattcttcatctaaggatctgtaaccatttactttcttccaggcttgaataaaaatcaattattttcaggagctttcttcggttaatccctctctctatatatacacaattttaccacacttgaaaatacaatctttatacaatttctttatgatgattcccatgccagttttcctacatgattggttttctgactgtgctataaattatataagacaggaacactgattctcccctctcatctcccttgcattttgttaagttctcccatatataggatgtactgaataaattctttcaagttgttaatcctgtttatcttttagattccaatctaaatcatataaaggacttgagacattatcttattttttcttaaaatgtgtaacaaatttatttaaaattatgttttgagtatacagatcttataattgaaaaccctgataaatatcttgaatcttgatatatagtatcatggaattttttaaacaagctgcttctaccttattttctcagaagtttaaggtgtttataaatactaacttctaatactccagttacacagtcatttcctgggtcaccagcctgtgcctggaggaccttatccagggagtaaagttttggtaatggctcttccctaaatccaaagcatcactctttccacattaatgcaaatgctcctgagaactgaaaatacccctttctctccatcctgatcttgcacttacttatacaggtcaaattagggacaatcctttcaagagaaaacagcatttgaatttatcattattgtttatcacttttttgttgttgttttgaggtggagtctcgctctgttgcccaggttggagtgcagtggtgtgatctcagctcactgcaaccactgtctttcaggatcgagcaattctcccacatcagcctcccaagtagttgggattacaggcgaccgccatcatgccgggctaatttttgtatttttagtagagacggttttttgccacgttggccaggctggtctcaaactcctgacctaaggtgatctgcctgccttggcctcccaaagtgctgggattacaggcgtgagccaccacgcctggcctgtttatcattttaatagaaagtctaactccatgttttatgtttgactgctgacagctttcaaatcccaacagtcctttcacccttctgccccacacagggccaagctgataagaaagtctatgagctcccttttttggtgccaacttgaagtttaaactacataaaagccctactctgtgagcacacaagcccctcatcttagttccacccactaaccactattaaaacctatggctgtggaccctctttgctctctgtcaagacattttcagatccgctttggaggcggacctcctttcccagatagctcacaatatgagtcataagagtttcatcacctcttgttgtatgggtggcatcatcaatcttgacatctcaaattttaggtgaggggcccatcttgcgtctgtggtgtatcaacaacaatcattattatcattgtatgccaattaatcagcaatgttttaaatacttctctggaattcttctttgtattcagataaactaaatcaacatagtggggcaaactatgtttgttggtttgtttatttatttattttgaggtggagtcttgctctgttattttgaggttggagtgcagtggcatggtcttggctcactcaacctcctcctcccaggttcaaccaattctcctccctcagcctccagagtagttgggacaactggcgtgcaccactatgcccggctaatttgtgtatttttgagagacagggtttcaccatgctggccagactggtctcaaactcctgacctaaagtgatcttcctgcctcggcctcccagagtgctgggattgcaggcatgagccaccggacccgggcatattgttcttttaaattggtgttctgtgtaaaagtcagaaattctgggttatcagtcctaaagtccattaccctcaattagtctgaatgtgcctaccatctttctgaatcttgtatgaggaagatttaaagaaatcaaaccactaaattatcttttattactccttttcccatgtataatttgctaagtagtagttttggagtttttaaccaatatttctgaaaatatctcattttgcttgcttcttttcatccattcctacatgtttagtttgcatttgtaacttatattaatgttacaattcaggctaaaaggtgtaatgtgttccaaatccactggctaggtggatgcatttttccctgctcaaaaagaatgtggtaatttttgtttctttatttgtttaagtatacaactctcaaggctgaggttgaaatttggctttgtttacaagtaacatgaagtggtgtgtagactcagactagaacttaatggatgtttttcaaatcataaaactactctgcagtttggcacaatttagaatgactggcaggctccccttagcagaggccaaagaatgaaataccaggggtgttgcaggtcagtgcactggcaggggtgtatgggaaagcttgcctggctttagctcctgcaattactcactcaagttcatgcacgataaaattgaatcaagtaaaaaaagaaaccattaaacattgatacgcactacacattgacccaaggatgaaaaagagactattttccatatgcttcctttatttatctgctttatggcataaaacaggacttaattatactattttattcccatagatagtgccctgtaagagttggaaaatgtattcattctttaaatgctgatataagaaaagaaggattgtaacatcaatctaagctgccttgattaaagatataatgagagaacaggacaaccaaaaggaaagatgtcagttcctgtcatttccacagaaaaacatatccaattgacggaacttattttttaagtgttataaatttccagttctatacagtcaccaggacctttatgtacattatttcatttaatcataaaaggattatatgttccaaattcttaaggcaaatgcattttcaattgtctgttgattattaaagagtaaaaaatcataagtttatgcagtgagtgtattttccgattcttatctccttatatatatttatataatacacaaataaaaataattgtgtcaataaagaaaaagttagttaccattattacatattaaataaatatatgtttgttattctttatatttattttttgtcttgacaactacaattttaaataaacatatcaccacaggtttttaaaaaggcactaacatgtttaatactttaatcagacaattctatggaaatttaacttctataaaaggtaatataaagatacatttataatatgtagcctattgcatgcaactgaagacccctccaaaatgggttaaatatatttaataacaaatgagatttttaccaataaaagtgtaagacagttgacaactttcatcaattatttgattgtgtattttcccctggcagataaaactgaagttccattaattggcataattattatgttgttaaggtatttgtaccctaacaggtcataaccccatttataaacatagtaattaataaattaatgcacgtggccaattatttctcaaggtgagaaataaagtcttaaaatatagacttttgtaattccttcttatcttgaaagactaataaaagacttcagatataataaatttaatcaaaatctacttgcagttataatgacaaattttacttaataaacacagctgctttgtactaagaatagcctcctcctgtcaatctctggtaattctgcatcagctcatactgtattacaaaacagcatgaattttttataagttcactgaaagggtttgaaagatggtattctacttactatccacttgttgcttggctttaaattgctatgtaaggatttaaagaaaagtacaaaacataaatcttaaatattttatttaaatcaggtactctatattagaacttggtcattctcaaccatgacctctaataccttacatagttataaatacattttgttgaattttaaaaacatgctcatatctgataaaattacttaaatacctagtgatgttgtcttattagaattaattaattgttattatttcaccttataaacatttcttatttatttttctctcagagttataatagttgttgatcacttacctttatattggtaacacatatattcacagtgaaatattgtagctggaaatatttactatagattttcttcctttttttaattaactaatttatttatttttttgagacagagtttcactcttgttgcccaggctggagtgcaatggtgtgatcttggctcaccacaacctccgcctcctgggttcaagcaattctcctgcctcagtctcctgagtagctgggattacagacatgcactaccacgccaggctaattttgtatttttattttatttgtttatttatttgtatttaattttagtagagatggggtgtctccatgttggtcgcactggtcttgaactcccaacctcaggtgatgcaccttccttggtctcccaaagtgctgggattacaggcgtaatctacctcaacaggacaattttgtatttttagtagagatggggcttatccacgttggtcgcactggtcctgaactcccgacctcaggtgatccaccctccttggcctcccaaagtgctgggattacaggtgcaagccaccacgcccggccactagcttttcatttttaactaacatgataaaggggaaggcataaagctaagtttgtctaactctacatttaagctaaaaatttgtctaaagcaatttatgaaatattatataatttacttatataatttgatttcggagacacctttataacaatctaattaaaataccaaattctgactgctaagagttctttgcagagctgaaaaatttactcatagaatttgtgtgtgagtaaaatataaaattctggtttccttaactctaccagtttgaagagtttaatatatatatatacacacacacacacacacacacacacaaacacacacacacgtacacacacacacatatacatatatgtaaatatatgtttatgaccacagatgtgttcctgatctatcagcattattggaaaataacattatgttgtcttaaggcatcgtgcttaagcacaagatgggctagttcctttgaagttggacatttgaactatagtaaactctaagcttttgcaacataacttgccaagggatagagatggttggctctggtgccaagagctattaatacatcgcagtcaacaacctttcactgtttgcataaataatagtagtatataaccacaatgcaacatcttaacagaaacataaaatacagatagggtttgaaccatatctcagaggtatatccaagtgctaagatgtcggggaatctgcttgtgatagaaaagatccaatgtggagcctgattgaaggtagaggagggcagcaataatatagaaaagttccacccaatgaatgcatgtctcaagatctgaccactatttcaacatttttcacaccactcctttaaggtactatatcatcatagtcttaataactttgaaaaacaaatagaactatagtttataaggaacaataattgtccttccctactttataagtaggctctttctacatatttatatacttccacatataaggtttctgagataaacatatctttatatatcataaatatatctttaaaattatgtatggtgtccctagaaataaagtgctaaggataaatctgtcacagggacaaagtttcataagatagtctaaaatatgttattttgaaagaggtttatataaatgagaagacaaaaatgtaccattttaacagaaacaaaagtgatacaacagcttatcggcatactactataatagaatgtcttttcattgttgcttttttcttaattcttttcattgttgcttttttctttaacagtgtacttaaaaacacattttaaatgataatgtgacttaaatgtctctcaataatgggataaagcaatttttcttcagtgatctatcctagatctgaagaaaagagaattatcacccatcatttgctaaccagcaaccagtatttaaggctctaggactataagcactctacactttggaaagctcgtcaggtcagacaatcattttaaagatttttgagtatcaaatgtgtaatctgacaacatcctctttttgaaaagtaggttttcttcctactgaacaaatgcagcttgaaaataggaatagccaaagtcttgagtatatttcactttaatgcttatcagcaaaatgactaatggtcctacatttcaatgacaaaataattttggacattactacataaaaatagggaaatgttcctcaaatatataataaaatttcagaactcaaattctgtcccgtacttacctagaaaaacaagcacataaataaaatgtaatttttttctggttcaggaaatggtcgcatctctcttttctttaacttttataagtttaagttttagatatgtaaaagggagaaatgtcaataaaccgaactgcattagagacgtattttactgttccactttaaatatggaaagacttctaagacaactgggcagagcaaactcccacaagggtgtggtttctatggagcccctctttcatacaaggcctacatatggcacctgttcagaagctgcatatcagagatgtctttaggactttactcaaaaggtactgatggaagatgcaaagtggggagagagaattctttcccttccctgcatgcctggaggtattcatagcctaccatgaagatgaaaattgtgtggctgtattgttagatatatagttttcaagcatgaggggtcatttctttcagatattttagcatgcttttgaaaagggctatttacactatacacacaggccttaatacaatctggtttatggctaattagttcaactggttgtagcacagagattataaatgtaaagtttattttaatcccttgtttatttattgattgattttgtatttattttgatccaggtaatattgtccttccattcaaagcataccatgtttaattgagcaactactcaaaaataagttatgcatatagaccaagagaaacttgcacaaattagtgtaaagaaataactgaatgtagaagtataaataaaggaaaaacagttctgttgaggagccgtctctttcagaagttttctctggaagaaccccaagctgagcaaagttctttcttattgctagacaatagaattcttggcatttctttctttacttcctctcttgtatttatttttatatgtgagttttcctaaatttgtactattattccatggaacacaaggcacagcagaagctctttgaatatggattccctgatcaaattaggctggcatattataatagagtctcatcttcaggaatgaatgcatcttagcacattcgactatataagaagtagtgcaaacaaagtaacattttttttaaaaccctgaatattttcagcaactcttattcaggaaagggacacaactatcattagctttatcctaccagtaattataaatatcccttgggaccaacattactctattagtgagggatagtattggcctgtgagtaaatgaaaacacaaacagacccataaacaaattacatgtgcatgtatttatttttttttctatgtaacaaaaattctggaaagtagctgttcttagtttgaggttagtggctcatgtgtatattaaagccttgatatgtgatattatcttaacattttcctcatgtctccatgaaggaaccagtagttctagctatcaaatccattttctatgcaaaagagagaagaaaatgagaaagaagaaaggtaattttctgaaaagcctcagcaaactttagtttattgctcattggttgcagcaaagtcacagagaaatctttactgcaaagaagtaggggaatttttttttttaattttacatattttcacctaggaaaatatcagggtctattagttaaaagtgaggaaagaacaaatattgtataaacaattggtactaattgacacaatttcctgggtcaaaatatggaaagcattatatgcctttctaggagaggatccatttttattgaatgttgcatccttatcaatgaagcataatagatagtcaattagtaatattaatgtgagccctatagaaagggttctagcaacatataaaagtatagtttgcaagaggtacatatgaataacaatgtttgcattgtacaaaaacttcaacggccagatagatggatacatagcaaaatagggaaaaatagaaaattccccattacaaccctaactagtatattaaggatattagccatagttcttgaagcaaaatttgaccaagtttgaccagcactgtacaggtaagagttttttaatcgtgtgagggaccactaaagctgttaatggaggcaggtcatctgctgtagggttcattaagcctcaccaagactccaatataatagtcctacaggtcatatgacgctttttctctaagtgtaggctaacaaataaactttcttatttcaagtcaacctataacatacctcaatatcaacagaagaattggggcagggtggggatgacagagagcaacacatttctgctagtagaaaaagtttctcatttacaatttcacaaattgttctcattttacaattttacaaattattctaaggttttattgatttatagaatgtagtttgattaatggttcttaccaagggttttttttttcttttaagtcactgccagatttggtgctaagtctgtttccagaactgcaaaactttagcaccaaaacttgacctccagtagatacacaaagatgttaccatgctctagagtctgtgaaaaacattagtcttttgataccttctcagatgtgaaagcattgtctaataaacatgtgtttagagcaactttgacctgtgagattaaaaaaatctcattcccctcttccctgacacctaccttacacataagaaacacatatatgaataatatatttatagtatatgcttcattctagtgtctttttctatataagtagtattgtgtaccatcaagacattcatcacataactgtagacataacaaacatatacatatatgttatatatatatatataagtgtacatatagcaacacttggtgaatttaaaaatatagaagaggtggaagatgctaagcaatggaggaagtaacaatgacagattgctgtatttttaaagatgaatactgttattttatcttccatctcttggtgctatatgaggaataacatgatatttggttgggatcgtgttttaatagagatgtagttgcatggtaatttcagtaatggatttctctaagtttgtaatcaatcatgagctaaagacatgtttacaaacatgataattcagattaatctgatgggctattgagagagagaaaagacagagctctagcagttgctgtgggtggaaaacattttatgagcctctcacagctctgagacagtgaacctccgctttttaaaaagcttaaaaaaagaggtaaacaaaatttaaattagaatacttaaccatatttaaagttgggcaaaagtctgggaagtgacagaaactcatatattaattgactcaagattagaacatatgcggaatgagctttccttttaaatgtaagtaatcttttactctctatatataagttgttgctttttctcctcctaagaataaggagaacttggctatcaatcatacacagaaggagatactctctgccacccagctattaaatgaagaaatgtacattttctacttcatatatcaggcctactgatatattttcatctatggcatcaatcactataggagcttaagtacttgaaaatgggaacccaaggggctcagccaccaccaatgagggctcagctgttctgtgaaagcctggaaaagtgaaacatctgaaagacctaaaaatacagcttagagtctcagcgtaagcactgaccatgtggtgtccctggctcctggaatcacacagaggatttgaataacttgtgcaaattctaaagacaaagaaaaaagtggtagcactgagtttctcactagtgatttccagaatgtgaaggaaaccaggcatcctttgccactagattaactttgagcaacatcttagaatgctgggagatgtgtgcactccaggagaactgccaatgtcacagacaaaaggtttcagcataattataaagtctccatgggggaaagaagcacagtatctcactggagaaatggaaatgatctttaggacactgttaatgtgcataaaattctggatagcaaccaactgtgaacacataaccattaaatcgcaaaggaaaataagagaaaaaaattgcatgtgtctgctttgaacattttccacaagcaacttcatgtatgagacaattatggcaagtttaaattttgtggttttgttcaattcaaaaggaaagctattatattaattacatcaacttatagacactttgtcttatcaatatatgtcctgcgtaatactcaggattatagaataattgttctgtgtagcatataaaaactgtctcctggtattcctaattcttaaccatgtattattaactaatgtaagtactgcttttaaaagtagttgaacataatgcaatgttgtgtcaaataaccctgttagacttctacatccaaaccgaacagccctctaatcaccagtgagaatctagagtttcaggagttgattccgatgaaggattagcttttaactaaaggaaaaaaggaaaggggaaagttgggaaaatagaaaaaaaattgtctatcatttagtctaaattaatccccttctcccccatccttgcaagacaaagtggctatgctacaggatgaaggtagcaggactcattccagcagagattaggtgcaacttggagtatgtacgtagcaatataagagtcaggctgagaactacagagagaacttgacacagatcattatgtttagacccctgagggccatgtccctatccgtcagtgtatatccactccagaagattatctcccttccttaaggagattctagtctgagagtataaatccttagctctaggaaaagccatgtgtacttctatgttgtttgtcttcttcataaaaactatctgataattcttgggagtattccactgtacttccagagaagagaccaggttttaaaaagatttttttttaatttagattaaaaggtaatgaaaaaataatggttcacagaacaattccctcctcccaaccaatgtgtcttctatcattcctcaaaattgttaccccaactttattgtgttacccatcctcatctttcctttaagcatagtgccttgaacgtttccaagtatttcacccctctggcaggattgatgaggatggataggttggatcccatcagtgacattttcagaacaatgaaatctaagtgcatcacagatgaaagaagagaaaagtgacttaagggactgtctgattacaaatgcaaatgcaaagctgctcctgacaataacccattgctaatcaatttcctataactttcactacagtttcctattccaaacattcttcactatccacaagtcccctttgctaaactattaactgacaaaataaatcaagtactttcttttatacatatataattttttaaatttagattcagaggatacatgtacaggtttgctacatgggtattttgcgtgatgctgaggtgtaatttggatttcctttaagcagagtctgacatgatgatttgggtgaagttagtctaggatttaattccaggaaacagaagtgagggagtagggaaggatgaaagacaataaagtgtgcttcactgagctggttgctgatttaggcaaatggaaatcaatctttttggagaccctctgaggagtcctgtagaacctacctcagaattaccacactgaaagacaggaaggctggtaaaattagactcatttcacccattggttgaaaatggtccttgggtgcacacaaacccaaaggcacatacactttggagctgagagagtgtgttttagagaaagcctaaggcaaaaaagcagaaataccccatgatatgtgcttcaggtgggatgctggaaagatgcaaagaactatctatctcagcttcagctcttctgaaattggttgggcaaaagaaaggtgccaccagtggccagatataagctttttctccacctctacctctctttctaaatgttattccacacatcattacatatattggcatggttcccatggccttattcacttcggtattaactttcattctcctatggctgtacactgtacacacatttctaaacttgcccttcataaccaaaaccaggtctcccttaatagcatggagactttgacacaactctgtcattaaaattacatattaggctgagtgcagtggctcatgcctgtaatcgcagtcctttgaaaagccaaagtgggagcatcacttgaggccagaagtccaagaccagcctgggcaacagagtgacacccccaactctgcaaagaaaccttaaaaaaagtagccatgtatcatgtcacacacttgtagtcccagctacttggaaggctgaggcaggaggatccctcatgtccagaggttccaggttacagtgagctatgattatgccactgcactccagtttggactacacagggagaccttgtcaccaaaaataaaaaataaaaataaaaattacatatttaccaccgtgattcatgttccttgtgctatggtttgaatgtctatgttcctcaaaaatatatatgttgaaatcgtgaccctgaaggtgacagtattagggagtagagacttttaagaggtgattatgaaggtcctgaagaagaaggcctcatgaatgggaattgtgcctttgtaaaacaggccctaaagagctgccttgccctctccacatgcattaagtctatatctataaaccagacatggaatctgccagtaccttgattttgaaatttcctggctctattatagaattataagaaataaacttctgttgtttacaagttacccagtctatggcattttgctacagtaccttgaatgaactaagacaacttgcttcccactattgcttccagaccattcatgttgggctttggcaggatccaagctgagaaagtaccagcatatgcccagaaaaaaaactagtgaaaaatgactttacattattcagaatcctgagacttgaaacatgctgtctttcatttctaccatgtttggttactacttcaagtactccctttctgcacattcatccactcagtcgaattttctactttgcatgcatgttttcaacacctaatgccaaatcacttctctatggaggtgctttggagtcttcaagcaaacatctctcccacaaattttcaaaggattcatgttatatcacttggctcaaatgaatgattgtctctttttattagtacaattttgcagtcatttcaagaggttcatcctcctattcacactgttaatggagttttgaggtggtggtatcatttttttgtaactccaagttagtgtgtgcaggccattcgacactaatagaacagaaaaccaagcttttttatctgtattaagaatttaaggtatcatcattccagtccaaaagtttctaaattctctaaatatgaatgagctatcacaccatgcttttggatacctattgctccccaaactcttaattttgcaatcacagagaatttcttgagtgctgaaaccttaaactccatcatgctcttgacccaaacttattatttcacactcttctcattcttctgtcttttttttctacatgatcatgtgtaacagtgtcttgacccttttgttaagtttttcagtttttcctcctatctccagccatcttagaatcccataatgcatcacatttatatccctaccactgtggacgctagatcaaccaattgctctttcctctctccaacttccattctgttgtcaaaaaataacatatctgaatgcaagaggagcactgcagatttatggcaggagatttctatttcctttcagtcttctagagaaaagagaaagaagtggccattctgctctcccatggaaagaaaaaaaaaactcacattggataagcaacaggatcttcacatggcaacagcacaggttgaggcattcctatcttctctgtatggaaaaaaggaaacctattcttgtcctaaattgggtcccatgactctcccaatagatacaatccagtttctggagattcacgttgcttgatatagtagtcttgatgatggagtttatgatgactatttgtcctagggtagatttatttacagttcaaagtgggacacaagaattcagctgaggcagtctgtgcctccagttgaccattccctgagcccatcatagtgatcactagcaacatctccatgctgagaatcacagaagcacatctggatttgttatattcctgtccatccagcctaaggaggagagaatgtagtaggatacagcacagtccccacccaggcagaaagcaaagtaataattgcatgtggaagatcatttatgagcatatcttagatcctagcagaaaatgaaaaacacctagaaggctgaaacttttgtgattatgcttgagatgggtcaagtcatagactcatatgttaacaatctttattttttttttttttacttaaagatgtaatggttatacaggaaaaaaatcctacacataaaatagttcacaaaaaataattaaaattctcatccctgagttgtattccaaaaagaaacagctataacttgtttgttatgtatacctccagagatttttccaaaatatgcaagtatgtacatattctctccaaggatagacattcacctgtgtactttctttttataacacaaaatcatttcatatgcaactgagtttcatctggctttatttacttgtcaatatattttaggactctttctaaagtggcatgtataaatcaaacaaatccaattcattttaagaactgtgaatatatatgtatacacacatatattcaaagagagagagaaggagaaagaactatgcagctagttttcttattaataatgtttatagtgttttaaaatcttccagttacacaaattagtcaatgaatgtaattaatatatgtttttactcacttgtacagctatatctgttagatttatacagtttaaattactgagttaaagtatgctaaaaatttacattttggtaaactcagtttctgggagactgctgtttttaattttttctaccaatattgttctttaatatcccctttattatattttcttggataagtagtgtgggaaacatgtttgacctgatttccatacaagaacatcacaaagttacatttcttaatctcttaatcccatgcaaatgtccatcccaaatctactggattaagagcttttaatgatgagaccttttagtgtataactcaaccctttctgcatgccgttaaactctactgttccttgcccttaaatggaaatatgtttcctcacttaaattggctctttttcaggatgttactttttccccaatggattttacttctctggtgaagtcattcaataatctcatggacctttagcttgttcacctgaacaaaatagaagcagcaaactataaataatttccaggaccatttccaggtgcaatcttcttagctccatactttttcatatctgtgtggctttaaaacatacttagaaactttcagagtaattactctcttcccttattaatttaaatattccagctcaatttttctgatcattgaatattatccacagttttttctttaaccctctagtttcataacagcatcaggtatttgagaattccaatttccaggataatatattatttgacctttgctattaacatttttatacatccctaaagatgattaacaggtttatacatttctttttttaattttttttgtttttgtttttttcaagatggagtctcgctttgtcgctcagactggactgcagtggcaccatcttggctccctgcaagctccgcctcccggcttcacgccattctcctgcctcagcctcccgagtagctgggactacaggcgcccgccaccacgcccggctaattttttgtatttttagtagacagggggtttcactgtgttagccaggatggtctcgatctcctgacctcgtgatccgcccacctgggcctcccaaagtgctgggattacaggcgtgagccaccgctccaggctatacatttctaaagatcatgatgtctaccatttagataagaatgtgttagagtagtgattaaattgccacccatttccattgctctaaattatgaaattgttataatttatttgactggtccagctagagtctttgtaaaagatcagttaaaaacaaacaacacacaaaaaacctttaaactactgtcagaaaacctttccactgcaacctaaaatatctaaaaatgacctgattccaaatcctatattatccaatttttacatagctaaaaccaagccttatatatttgtcaaagtaaggagtatgttgtggtgcttccagaagaaaataaaagacaaactcattagttacaggtacaacaaataaaattcgcaaaacgttttatcatatacctaaaaaatggttatcttacttcaaattgtatcaataggaaggaagatattacctattacacaatagcagttagtcttcagatgtgtttcaaacttaactgggggtattcccttgcagttctgggctgaaatccaagctattaggagcacttgggtttttgcagccctagcatgcctttccccacctccaaaactacattcgatcaaacaagattagggtaaaccagtctcctacaaaaggcaagaatactcaacattctaattaccggccttgaaaatgtattcctttttgcacacagacaaatcctttttattacatgaaaacaaatatgccctgaaatttggaatactcagataattttaaaaattgaaaagaagttttacaaacaagtgctagaaaaaaaccacaaaactcaatcatcagaataaacactgccaaacaaataagaaactagattcctctaagattctttcaagtaaaagacattgtaaatattgagtactaagaaaatatcaaattagtgaataaaataaaaaggtcatggtggggcagaagaataaagagcgtgaagagaatagagaaaatacagggaaatgtatgctagtgaagtaaaaatgaaatagcatagttgatgagaatacatattaattataaaccttcagattacaacaaatttcagtaacaaaatagtttttaaaacataaataccttttgcaactgttttttatacttctgaggcctcatcctaaaaagttatctgagactgcaatcagtatttgcaaccaaagatgtttactcaatagtatttttgtagtaaaaacaaacaaaaaataggactgatctaaatgtcaaactttagagaaattactaagtagatcatttcctatcaatataatagctatacaaaatgttaggtagaaatgtaaaataattcgaaattttacaatgtatgtgatcttaatagagtggtaaatatttaggaaaaaaaaacatggaaggagatatgctaaacctggttacaaatgggggatattatgaaaacagtgtttttccatgacactatatcattttaggtatattttatattttctatagggcacatatattactaacattcctatttaaaatgcaaggaaaaacgtagaaaatactgagagtcacgtggtgatacaacgtaattaaagaaaggccctcaaaagtttaaaagtccttaataattgttacttttcctgtttttaatccctaggctcaaattttgttgactttaacagagccctgaaatcgcaccaataagtattttgttgacaattatttttacaagatcttgagtttttaatgaacatctaaaaacaggaggaacacatttaacaacaggtgtgggcagataaatggattaaaatctaaatatgagattaattatattttagaaatgtactgcgggaagatggattggtacaatacagtaaaaatacttcaactaattttaagcaacagatagtgatttgctatccaatacaatcaagagtgaaaaaaatgctaacttggttagaaacgttgaaaaaataatacaaagaaaacgggtaagtacaagtaatatatcagttaaatagcagacatcctatgaaattacggatataccaggtggacaacattcctgtatggttatattacttatgaaaaacaggctgaatttacttgtaattcaggttttcaagcacataattgaaattacaccatggctttcattacaaaggaccatttgattaaaagaaatgcaacccagtcaaattagtagaaataacagaagatttatattaaggaaacaaaaaacatgggatggaaagaatttcatagatattgtaaagtcataagcatctgttttctgcttctctttttctctgtctctcatttaaaaggatgccccatcctatgaaaggatttaaaaaaataaaatgtcaacataacacagtattgtcaaaagattagcagagagagtgaatacctgtctccaacgcagcattctttctctctttctccctctctcctccctctccctaacctttctctttcattgttatgtttgattttgtttttgttttttccttttactgggctgcacaactcagcaaaatgtaaacctgcttaagttagatccagctttcccataacttgttattcacaaagttttcactgctgctctgctatcactgtccccaaatctccaaacctgtacagtttcagtgcttccaaaactttgagtatatttctgtgttcctggttcaaattttcaaaagagaaatctgatgggctcagcttagattaaatgtttacccctggaccagtctactgcagcaacatatggaattaccttagaaaaacgtaggcagctgggataactcctcgggaagggctaaggaggtcatttccaaagagaaggcatacagtttgcagaagaagtgtttcagacttctctactacatagcatatatatttatgtcacgttctaagaagcatgtaaatgttttatagcaaaattattatcatcaggactgttttaatgagcctgtgacctgtgcaatttgcacagcattctgcacagagaagagcccaacacatgtgctctgttggaatcttgttgaaattcttaatactactggaacaaatggcccctgcattttcatttcatactggactcataatttctatggttgtatctgactacagtccttgctactgaaatgcacaaattccttaaactggacaaggctaatatgctgaaagagtgccctttttgactccttcagacttagtgccccaaagaacagaagataaaagtagtcactgacattctaaaacagtaatttaagactatgctaatacactcaatatattgaagtatcaccatttatcttaaattgtattaaaatccaatcatctttgatatagatcattttagatgggatattaattataagtagatgatggaggaaaaaataataaaagtttcagagtcctggtaaaagtaatttgactttaagattcttgataatattcctgaatccctagtgtttagcaaatccaccaaggagatgtaccttcatacacatttcatcatgttgtctgaaccttctctgacccctctccaacctctccagcttgagaacacagtaggtgcagctacttagccatgtggccttgggcaagctacttaacatttctcagcctagttaatttattacagcatttaccatgatgttttacaatttatgtcactttttgtctacctaccagactatttggtaggttcttcccaaaggggggagtttcttttttatttttgtattgcaagtgctaaatacagtgaccagcacatagtacaacctttacaagtgtttgaagaatggatggatgaatggattcactcaatgagaattttgtaagcatgtaaaaacaatattccctagtttactaaaaaccaaaacaaagcatttgtttaaggaaataaccaccagaaaaacaacacagtcttggaattgcaactcttttcacacatcttgttaggaattatgttttaaaaggtatgcatgtgaaaggaaaaactgatcacctttaccagaattactgaaaatcctatttctatattatatattttgttggggaggtttccacatccggaggcttggagacaaggttaagtaagcatcaacttcatgagagtaaaaacaaatgtaatatgagttaaatacaggacttagaaaatagaaaaacatgaagaccttaaatgcttccactgaagagaaagatttcttaaaagttttaagaatcccatgaggatctgatggaaaaacctatcttaaggacattttatatgcatacaaattatagtattaagttgcaggggttatacaagtcctctaaaatttattcatgcacatccaaatgtatacagacttgcaatattaatttactatgctatccattaaccaaatgtgattatttaaatttaactaaaattaaaatttcagttcttccatcatcagtcacattccaaataatcaatggccacacagttctatttaagttacatttttaaaattattttttgttttagaaataatctctcatagtcccaacactgctgatacacactaagctttctttctgaatctaaaataaaaattgaaatttaataagaagtacaaatgagatctaattaaactaaagagcttctgcacagcaaaagaagctaccatcagagtgaacaggcaacccacaaaatgggagaaaattttcacaacctactcacctgaaaaagggctaatatccagaatctacaatgaactcaaacaaattcagaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatatggagaaataggaacacttttacactgttggtgggaccgtaaactagttcaatcattgtggaagtcagtgtggcgattcttcagggatctagaactagaaataccatttgacccagccatccattactgggtatatacccaaaggactataaatcatgttgctataaaaacacatgcacacgtatgtttatcgcggcactattcacaatagcaaagacatggaaccaacccaaatgtccatcaatgatagaatggattaagaaaatgtggcacatatacaccatggaatactatgcagccataaaaaatgatgagttcatgtcctttgtagggacatggatgaaattggaaatcatcattctcagtaaactattgcaagaacaaaaaaacaaacaccgcatattctcactcaaaggtgggaattgaacaatgataacacatggacacaggaaggggaacatcacactctggggacagttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataaaaacaataaaaaaataaacaaaaattcaaatgaaggttgatgtccagtttaatcaaatatggagtaagaataagagaatctacacacatgcaaaactcaaagaaatatcatacatccaatccccagaatacagtgcataaagtgctgtaccagtcgcagtaaaccaagaataattaaatgacatttaaatgaagtatgaaccaattaaaattacaaatttagttcctctgtcacactaaccatatttcaagtgttcaatagcaacaggatgctagtggctaccatactgtacagcataaatatagagcctgtccatcactgtggaaagttctgctgaacaagactgacacagacctcagagagtgcttaacctagaagaagtgtgatcttgatgaatgtgggtgaattgggtggggagaaattctgttcggataaagtgtaaatatgagtatttcgtagtgagcctaaagttgatttttttcaattcttccaaatactaattccatgaatatataaaattgacttcaatgcaaaaatgacaaccaacagtagcattgtattttagatggtgtctagattttggttttaaacagacccatggttgaaatccatgtcttctgttttaagctgggtgaaactttagagcaggttattgactttttcatttgaaaagtaggaatagtagcacttatctgtcagggtcgttttataagatggaaacagaagacctgaagcacttatttaacaagtatatttaagatatggtagcaaatgtaaagatacttttgacatggagtagtctcagattccctttagtatgtttgattgattttaatgatcagtgttgaataatttgtgttatttctccactgcaacttgattatactgaacgtgattatatgcacttatcatctttacacccctattacctagaatactgcatagcacacatcagtctttcaaaaaaaatttgttgaatgaatatgtgttcaaggctacagattcaatagagaccaaatataacccaggaataaaacccaggactcccaaatctgtgtggtgattcagttcaaagtgcaatagacagagaaggaaaatgtcttcattttctattttgtgacataatctttctatcctcagaaggtttcactttttgttttgtgacataatctttctgcactcaatttccttctctgtaaaatgaagaaccgagattacatgatccatcagcacttcagctgattctctgactcttggcttttaatattaatatctcccccacttatactatagcatatcccacaggatataggataataaaatcctctggcttataaataagtatgtattttatgtttcagaggtcaattaatgccacagaatgcctttaattgtattactgctcttatttatttttgtttaaagaaggaatatttaaggctacatttgtaagtaatgaaagaaagtataatacttgcaaaacataaactgataacattaattgaggagtgaaacatattccattatctcttttgtatttactgctctatctcattatgaatcctttcatcctatatgtgagacatccatatccaagaacctgaagatgatggtctgtcttgagatataaatcactctgccaagtgttctttttacctatgtactatgaccacttctctgaactcaaatagaaacatctagtgagtattcagttcttcttcaacgtaatggagggtttcttataatgtaatgaaatgttcgttaacttttttttttttttgctgcctgtatgttcagtgtctataatcagcacaattagaagtaacaaaagctctttgagaaaactgttctgtatgtttgtctgttttgttaagggaagagcagcaatataataataaaagttgaaagttactgaagcattttagttcatgcatctatttgaaatacaaatgatccaaaactttaataatagaaacatcttgaaatcctgaataattattttattatattgatatcacataaatatgagtacatgaatgtactttcagaaagttaatacgtcattaaatttattttccatatatttatagaaaactgtaatgttaattgtaatgtgccatgcaaacaagtattatttcactgactcaaattttctacatgcatagaatagtccaaatgacacagcacaatgagtcagaaagcctgtactgcagttccatttctgagccacctttcagtcatgtgactataagcacattggagacttagagtcaagatttgctcagatacttgatttatatcatgctttgtaaaatgatttgtagaaaaaaagcaaaagccatatatagatacccagccatgattgttgtaactatatttaaagtatgtagttaatatataagattcacatttaaaaaaattatagaaatgatgagacattaaggcctaataaggaagtgaggctactacagagcctagacataatctgtgggaatgcctatccttcaaatattccctagggcatgatatctgtgtaattccccacttgtcatggaaaattgctctgaataccagaaacatgctaggacaaatacagcattcctgactgtcagcagtggttttcctgggtttggtcacatgactcaaattgagccaataagaactcttccttatgatttgttaaaatccagctggcagaaaggaatcctttccttttgaagttaaagttatgaaggtgtaagttctaatgtgccattcatcatggattcaggtcaggaaaatagccagaaggaagaaatgagaaaaaaagagacagaaaactatccagccatatgtacacttgtgacacaggcacagatgtgtaccccaacagtcctaagactcaaatcatatttctcattatttgagtatggaaaccagtgtttccctcttaatattttagctaatcctacctgactttccaacttttatcataaatattactaatgaattagttacattatttaaaatatatttatttcaatgtagaaattcaatttcaaaaattatgcttaaataccctgtcattgaaacactgttgttgttgttgttttgttgttatcatcgttatttttttttatcttttaaattttggaggaggtgtgcagacttttgctttacgtgtctaaatggttgtataaataagatgttttgcttttgaacaaattttgatgttgagtaaaacaatttttgaagtaactgtattatatcatatatagagtgacataattatttatttatttatctatttataaaatagcattggttttgtggtatgtttaaagagacatgtcctgtgtaaataagatctataaaattatgtttgatagaaaagacatactctacagcccacttattttgaaacatcatctgtgccagttgtttcccctacctacatcctctttttttctctctctcttttgagaaaggatcttgctctgttacacagactggagagcactggtgcgatcatggcttactgcagcctctggggctcaagtaatcctcccacctcagcctcccgagtgctgggactactcgggagtgtgcaccaccacactaggctattcttttttttttttttttttttttttgagacataggggtttccctgttctgcctaggcttgtctggaattcctgggctaaagtgatcctcccacctcagcctcccaaattgctgggattacaggcacgagctgctgagtccagcctcatatccgaattttaaaatagacgaaaccgttttccagtgaactatattttccctgatttcttcgtaactgacttcttttaaattttggcagtaggaggcactgaaggaactaagaaggttgattaaaagaaaaaaaaaaaagaaattttctgcttctgtttctagcagtatgatagttcctggaagtggccatattagctgggctaaagtgattctttccaagggcagatagcctaagaagagctatatcctttagagcatttctagcctcaatggaggcaacatccctgttgaatccatggctaactgcaagactaatagcacaaaattgggtgcagactcaggggctcaccaatattacttttgattcccaaattcactcttatctaccttttgctgttctagcctttcaaactcttatgactaatttactgtattaactacctgccccttctcatttgaaacacctagaatagttttccttttaatgaatagaccataatgaatacttacacagcattctttttcattttatttttggatatagtcctgagaaagttttacatgctattcagttaattaataacctgtctaacttcatcttctctctttcataaataaccagttgactatattagggcatgaagtccaacaatgatggcttggctaaatttgaaactttctaggcctctaattttctaatcaattacatgaaggaattcctaatgtagcatattttttataagccatgtattgctcatcatttgcctacagacactgtgatatacataataaatttgatttctcaaagattacacttaaaatatacaggaatatatatatataaatgtaggcacgtatttctatttaaagacatatttcaccaaaagaccctatcatctgccaaatcattcaaacagaaacttaaaattattcataaattagattatgaaaataaaattttaagtaatctccctcatgctcaacttcatcattttaatgctctttttctactgtataaatattccttggtggttcataattgcctttaagatttatctgtataattgaacaattatttttgtagcaaaaattatggaccaagcataatgtattaagaatgctgaattagacacaatcttgactttatacagtttatgatctggtaaaggaaattgactttcagaaaaacagcccaacaaataatttaggagattgtgtttatagtaagtactgcaaaattttaaaatgctgttacggaactgtataaatttttaaacacacacaaacacacccctttggataatgtataacaacatcagcagtaaccaggcttcctttcttaccaatccctaacttatacccagtatagcaacctagcttactatagccctaagttttctcagacgtcatcttactcttttacttatctgagcctttgcaaattccatttcttaactctggcacacatttacttcatcactttttccttgttaatatacagaaaaatacaatacatatacatgcacacacccacacacacacagtatgtataatacatataaatgttcaagcccctcctttttctctaaggttaaccactaatttgacttttacttcatcattcttctgcttttcttcataattttgcttcctatttacatccttaacattatggtataaggttgtctatttttgagttttatgttaatggaaacatactacatgtattgtctttcatgtcttttattcaatatcatgtagaattcatcaattttgttgggagtcacggtaatttgataaatttctttgctcaggtactcatcacattaatttgtcactatttaacaattcaacctttgtgagcacttgtgcctttccaggtttttaagatgatgaacaatgcttctgtatatattcatatatgtatattttttggtgtctatttaaaagtttttaaatttctatctagaatttgctggattgtagggtgtgtatattgtcagcttttctatagaatgtcttagtattttacaaaaaggatgtgccaatttacaactgcagtgtatgaaaattcccaattgttttacagtcttagtaatatttagtattgttagacttaaaaaatttgcaactaacctggaatgtaatttttaaaacttaagtagattttcatatgataactggttatttcgatttcctctttgtgaaatgcctaaggtggttgtttttctgatttgtaggagttctatgttctgtatattagttaattagctgtctgttacacatattggaaatatgttttctcattcagtgtcttttcttttcactctcattatggtattttctggacagaagttcttagttttaatgcaactgaagtcagcttcttctccttcatggtttgcgtttttttgcgacttaagaaattttcccttaccttgagtcatgaagatactctcatagcatcttccaagtttttaagtaacttctttaggtatcttccaggaactgatttgaatgtggaatgagtagggttcaaaatcattctctcccttatcctcataggaatagtctgtttatccagcactattaaaacatttcttttcattttcacatgactacctctcactcaatatttaggattctgttaaaatgttttatttactctataaatacttctgtgaaactccctctttccttcctgagcaatccctatggtacgtgactctccacccatgtgcttacatagtatgtttgcttttctctctcctagtatttagtaattagtgttgtgagagcctacatattgtctctctcagtgaactaccagtgcctttaagaacagagatacactaagtaatctttatatttcatatacctagaaccatttttagaataaatgatatgacaatccagacttcactaaatcttaatttactgtggtcacaaaatgaaaatgaaatacttcttaatgtgtttcaaggaaaaaatctatcacatattcataataatacaaatttcaatttttgagactattattaggtaaatactatagcttttctgcaaaaaataattagaatataaaacttctatttccttaagtgataagttttcaattgtaattttatagtatattatctgtaaccagtttccaaagaacaccaccataatgtgaccttattttgaaagacaatctgaagcaggtcaggttgtattagagtgggtgcttatagccctacccttttgtttttccttgatatccatgagttggtctctaaagttattttagaatctgatagtcaaatggaataaactgtaaaaatcatgactctctgtaacagtaaatacaaacttttaaatacacattgttttaaaaaaacctttggtttttctactaccaaataattatttgtctctgaatttttgtctatatatatacatatatatttagtgttcagtatttaaccttctaattatgtatgtatatagtttagaattcaggtgtcaccagttaaaccattgcattaattttcattaaattattggaaacaatcaatatgatttttgcatttttttgtcttaataatatatcattgttttattttttatttttttattttttattttatttatttgttattttttaaaattttattattattatcctttaagttttagggtacacttgcacaacgtgcaggtttgttacatatgtatacatgtgccatgttggtgtgctgcacccattaactcgtcatttagcattaggtatatctcctaatgctacccctcccccctccccccagcccacaacagtccccagtgtgtgatgttccccttcctgtgtccatgtgttctcattgttcaattcccacctatgagtgagaacatgcggtgtttggttttttgtccttgtgatagtttgccaagaatgatggtttccagcttcatccatgtccctgcaaaggacacgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtcttcatagcagcatgatttataatcctttgggtatatacccagtaatgggatggctgggtcaaatggtatttctagttctagatccccgaggaatcgccccactgacttccacaatggttgaactagtttacagtcccaccaacagtgtaaaagtgttcctatttctaataatgccacatatctacaactatctgattgttgacaaacctgacaaaaacaagaaatggggaaaggattccctatttaataaatggtgctgggaaaactggctagccatatgtagaaagctaaaactggatcccttccttacactttatacaaaaattaattcaagacggattaaagacttaaacgttagacctaaaaccataaaatccccagaagaaaacctaggcaataccatgcaggacatacgcttgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttacaacctactcacctgacaaagggctaatatccagaatctaccatgaactcaaacaaatttacaagaaaaaaacaaaaacccatcaaaaaatgggcgaaggatatgaacagacacttctaaaaagaagacatttatgcagccaaaaaacacatgaaaaaatgctcatcatcactggccatcagagaaatgcaaatcaaaaccacagtgagataccatttcacaccagttagaatggcgatgattaaaaagtcaggtaacaacaggtgcattattgtttagagtaagactttactcttatctccagaaggctcacagccaaagtagtgctcaattttaaaacctacaccagtattcccggttaacatatctatttcttctccctttcatgacctggttttctgaatttttaaattattattttaataacttattggaatacattctctttaatctgagttactaaaattcatcctgtatacttgtgtatatgcatgtctctctctctctctctctctctctctgtgtgtatatatatatacaggctttttacctccattgagtagatactatacaaatatattgtaaattagggttgataaattattaggattaatttcatagctatgtaattcattataacattttctctataatccactttttcttaattttctgttagattcaatcacacatatttctccaaagtgagacaattattgaattgcattttattcaatcatgtgaccacaattcaataggtaaattatattttggtgtgctttacctcgagtaaattaaaataatgcatataactaatgagcttggtatatttgtggatgtaaagaaaaatattttccaaatagtaaatactgcaaagtgacacagtagttctagtgttactcattagatatactcaatgtcttgctctgaatgtgttttttatgatatataatatgtctataaaataagccaaccttaacctattacttatatatactaaacaggtcattttcgtataaaactatgatctttgtcaaatgtataaagtgtaaaattattaacttatattcttggattttctaaaaaataaaaaaaagaatcttaaggagactgttcatgggtctctctcacccatctttctccttcacaaatcactggactttatgtaatctgtttttgcatttgttatccatactctccattttgataaattagaatatccaaggatatccatcttgtttgaccattcaagtaataatacattatcagactaaactcattaagaagtccaaaggatattaccacctggctactgcaagaaagtggcccaaaggtcacaaatgattatggggagctgaaattgccaaacaagattagacatatcaggagtgtgttctctctctcaattctaaaataaggcaacataattactacaaaaagatattgaaaggacagatattgatgaacacatatagtatgagcggaagaatagaacaaaccttatgtaaattggaattctgaagaacttagatcaggttctggaaaaatgcacacacatacacacacacacacacattctcacacacagtgggatgggaaccttattattttattccatggcctggcccagctttctccagcattttgctagtcaggaccatctacccattcaactccctcctttgcctgaaaatttacaaatgcgattttcccaaatctaggacatttatatggttacactacactggagattaagggtcactctgtcttcaagcctggagctcaggcttcaagtgctctattggcttactatctcctatgtcgtcagtattactggaggcactcccagttgcaaacaaggtgagtcttctttttttttttttgtacagggttactattctttccatatatggctcctttactccagagcattttaggcgatagaaatgaaggcctcaaacccataacagtgtgcagcagaatataccagaaggtcatgctgctggtttttgtggcatttccattaatcttccttactattttatgcatatttgcattatagtgaagtattttttaaaatatgaatggcattatatatgacatgcagcatattttgtttttttaagaatataaactagttaaaatatatgaggttaattattgactgcagtttttaaatctgatttttcttatgtgaaaacactatcagatcatacttgggtttcagtagatacgaagaaaattaatttagaaaaatttacttgactttgttaaagttaattaaaaactgataccacagccctctgacatttacattatacctatctttagtatacaaatattttcaggacactttggtatttctttatgagtagaggataatacctttatttcatgtgttgtcatcagatatcataaatgctgtgttaaattttaatggtttccatgatatagtaaagaaactagctttcggaatgagacaggccttgatttaaatccaggttcccttacttattggatgacagaccttggaactgtattgttttctgtgaacctcagttccctcatctgtaaagtggtcatgaccaccatcaaggaatgttactataaaactgtgtatgtaaaatgccaatatataaaacagtggtccccaaaccgttttcagcaccagggaccactttcatggaagacagtttttccgggactggggcagggggatggattccagatgaaattgttccacctcagatcatcaggcactagattctcataaggaacaggcgacctagatctctcacatgagcagttcacaatagggttcatgctcctgtgagaattgaatgccgctgctgatctgaaaggaggcggagctcaggcagtaaggcttgctcgcccactactcacctcctgctgagaggccccattcctaacaggtcacagaacagaccagtaccagtctgctgcccaggggttggggacacctgatataagaggctttgaaatactgtgcatgcttcctaatacattactctatgtattagacatacagacatagaaacagtgacaggaaacattgaactccataaggccacgattattagaaaatgaaacaaagccatattttctcaatatgtatgactaagaactcatgtacctgcatagtaaagtatagaatttttggaaaatcattaactcttccaggcttaggggctatatagggaaatacaataaaatgagtgttttaaagctgtgcaatcattacaatgataatcgggccagtatatctagctctactgtaggactcacaatttatattatctaataagtgtcattcctggaggaaacaaccattgtttaaacaaaaagtgcagtattgttaagtcattgaccatcattgtcttctggacaaatcatctcaatatcacactttgaagaaagtgatttgaccaactctttaaacttgttcctatgaggtaaagtgggacaaagaatgatgtcctcaagaccaaaaacagtgatgaaggaagctaattgcaagtgaaatccatagcataaagctgtcagcatgtagatgggggaggaagagctattcttaccaactaaaaaaagcagttgtccatgcctgtgatgtgtgtttataattcagaataagaaataaatcttaggattaatttacatagaatatttattctatgtactcaactctccactgaatcaagtaaatgtattgactccagacatgaacatgctaaatagcttttactaataaacaacatcacttttggtggaaaactgatgtctctctagaaccagaatgaaacagtgtccatccacagagctcactccaatttgccccgtttcttttttttatttttttaaacttttaagtttttttcaaggtagctgctgatgcttttgttttatagcatgtgtgcagaaaattaacaggatgcatccattccagatgaggtactgtatagaagaaccactattggatttccagatgggaaagtgattgttgagttgtcaactgaaatttgacaggatctgggcaattaccaacagaattagcagataccttacttgtgagtatacgagtagtccccaatacgtgatgcctccaacacctcccccacaaaaatagaacaagattctcaactcctgaatttagaaatatgtgctaatttcaccaaaagaattaatcttattttatatctgtacattttgatgtttttttactttatcaataaaaaacacacacgaatgttgaatgttatttaatcccaataaatctattcctgtttgcgcatgaatacaagttcccaaatgcaagtaaccccaactcaaaatcctgaaggtcgcaaatttatttctgtatacacatccagtaattattcacatttgagttcagatatcctcatagtgcacacaggtccagtcattttgttaggaacaagaaacagtatttgtatggaggaaggcaagatggccaactagacatagccaggaggaagtctttcaccaagagaccagggctcaggaagactgacacactcctagcaaattttcaggaggaaggcattgagagcagatggagagaagacacagatgctaggctgaagggggaggaagctgggaatcctgcacggggctacagcgcacctggactctttcctggcccctagtgaaaaggaaatagtatttgtatctcaagtattttctggaaataagaaaaaataataaataagaaaatgaggaagttgaaggagtaggaaagagaagaaaggcaaatgtgagagaagcggaattgtttctagtaaagacatggaaggtaagaaagatgagtaagtgaagcagaccaccatggcacgtgtatacctatgtaacaaaactgcacattctgcacatgtaccttaaaacttaaagtagaataaaataaataaattaataaacccaggacagtgaagcaggatggaagtggataggcatgggtcatgtggggagtttgccaaggaagaattccgaatgttaaaatcagtaacctgaggtatataatccaaattcaaatagagatttagatattgaaacaaatgagggacactcattctatgtaagacatctataacaaatacaatgattttgtaactacctcattgaagttcacaggaagtaagagaaatgatagatgtgtgtgtgtgtgtgcgtgcatgtgtgtgtattgttttaagttttctgggtctatctctgccctccaatcttatttttttaactaacagtttcaagtttgtcattacagagattctatccaggttgtcaggaaagcataagaggaaccgttgaacttcaaaatgctaatccattctcaggaaatgaagcagcatagtatattgaaataattactgtactctgaggtagtcggtacaggtataattccaaatctgtgactatagagaagtacacatcacccctgtcttcaggttcttatcagtaaaaggaagatacaactacaactagagagaaaggaaaaaaaatatatcatttctaagctctggctaagatagggaaagtttatgattcaaatacatttgtgggttaatgttcattaagattttgaatagcttacacaggaagttttcatagcaaatttgagaaaatgaatcattatatgatctaagaaagtatgcttccatttctatattaacttatatcaaattcacattacattagataaattataaatggttcaaatatatatgtgtgtgtgtatatatatacacacacatcaaatagatatgtgtgtgcatatatatatatatatatatcttagattctctttcttccccccatttaaaaataattacctaaagaaattgccttttcccatttgtctacaaaaaagaatttaagaagactttctaaaagtatttgagaataaatctcacaggaactacagaaaagtgcaatgtggagtaaaaaaatcaacaaagaaaaaaatcatcaggaaagatacaaaaactacttttaatgtatgagaaatatttttcacatcatgatgagattaggcagtatgaccaacatcctttagattactgaaatcactggctattttcacttgaaaacataaaataattttcttcccaattatttgacactgtagacatcaacaaaaataggtaggtcctttcaaagattagtaatcatcattattaagaatttaaagatgatcaagatcaatttcccaatactaattacaattaaacaaacaatcttgaagaatatgaaagttgggaaaaatactaatatttaccattcattaaataactacaaaattaaaaaagaacataaaaaagttctttctctaggaaaaaatgatgtgttctacctagtcattgcattttatgagggccacaaatagatttttttagtcatgatctaaagtagaaaagcagttgcaaaacaccagtgtctttgtttatgatctagaaattaactgtgcacattctccttggtaattaagcaaaaaaagtcttcttttaaatcagtcttgtaaagtatggctttattttagattcaggatgagtaaaatgcatgacagacaattccatgcctgctatacctgcctgccaagaaaagaaagtggtcatttatggtgattacaaaccttattaagtgaactctctaggtcatatcttcaaaagagacaggtagcattgcttgatgtattttcttttctagctccagtctctctctctctgtctctcttccccacatattttttctgttcctctccccaaccctttctctccctaggggttccaacatcattgctacattgctcaggagatgaatccattttctttctgctaattcctcttcctgggaagatggagaatctcctcattgattttgactggggaattattttttttaagagtagaacagacttctgacctttcaaatgatcagattaggatggttattttcacattattaagtaatcaaggaacatatgcattagaaagagtttggttcacaggcaggcctgttggagtctaaaaaaaatattttctactgacaattaacccagattccatttcttcccttgcctatgaatcacttgggaagctaaaatgcattttaacattgcattttgcctaaaggctatcagtaaaatttaattttcttactgcattgatttttccatcataagttgtaacagtctaatgatatcttataagaattttcagtattgaggaaaaggatgcaaatgatttaccaatgataactgtctgggatatactgtgactttgagggaaactttctgttgctttttaatggctgattgtttaaaaatatggtacatttaagaactctgagagagtttaatatgttacccctccttaaaaatagaatctcagtatttaaaaccaatacatgatttttgggcaagaaattcagggtccacgtaaaaggctgactgttattgcaaaaacataatgttgcacagtgaaataaggtgactgaaagacattagagcatggcggactcacctcttagactaggctacatttgataaaggttgactgattttcttccctgctaaacgattgtctcatcactgaagcttcagcaaaacttaaaataaccatgttgagaaaacataaaaaatagaaccagtgtcacagtaaaatcaacagaggattcaatatgccatatgttcaatagctccaagggaatattttaattattatttcactttgtcttaaacacaacagttgattacaaatataaaataaacatttgtgaacaaaaaattaaccaagttaaatacatcattgttaacaagggtagatgccaccaaatggaaaatgtcttaattgccaacactcacccttatatttaatatgttcatgtggccatgtctctagtacttattttcatgcaattttatttctacttttttttttaacatttaaagggcttgaaatagaaatggagaacatctgtttcaaagaaataaattgttctttaaaatgtcatcaaaataatgtagaaagccaatccttttcctatttttaaagctgtaattttttttttaaaccactatgcatactggggtacttttatggaaagaaataaagaaaactgcatgtcttcattgtttaacaaggatatccatttccaagtaagttaactgatatacccatgccaaatgaacattcaaaatgtttagtttcattttataaactaatgtgtcttttctttagtcagtggaaccagaagacatttataattaccaactaattatgatccattcactaatgtctgtcatcactgctgagctattgatcattcatattgaatggtaagtcaaattacagattgaaggcaaatttctgagactgtgatgttaataatcagctttggcttttaaaacctccaactgatattgactggatcatgtcttaccttgtatttatcactctgttctcctgttgagcctccaaaagaattaagccctaccaacatctttcttttcacccagtgggcctcagtttggacttacaaactcaagaaaaatgaaataatgaattttaattgttttatgcaactgtctgtagcaatttgttacagcagcagtaggaaactaacacactgataaaatatgatttaccagactaaatggttaagcacttacctataaattaaaaatcaacatagaacttaagatattttattgattaaaacaagcaaacttacacacataaaacacatatcactaaaatatttttgaaggccttcaaattacaaaaagcaatttacattatagtaatagttcatgtttatagtacaggaacaagaatgagttaaactaaatattccaaatcagtacaagttatttccttttttttttttttttgagacagagtctcactgtcacccaggctggagtgcaatggcgtgatctcggctcactgcaacctccgcctcccaggttcaagcgattctcttgcctcagcttcctaagtagctgggattacaggtgcaccatcacacctggctaatttttgtatttttaggagagacggggtttcaccttgttggttaggttggtctcaaactcctgacctcaggtgatccacctgcctcggcctcccaaagtgctgagattacaggcatgagccaccacacccagcccattacaaggtatttcactgagggtttctcgaatgtctcctaaattttctaaacacaattagatgcacagattataatgatttgagtttaggaagatattgtaatatgtatgtttcctatatatacagaaccagtaaaattcatacttataaaattatatatattatctgaatagttatgttcagttttaaatacctttattttaggggttcttacaaatttttcattcatgttatacaaaaatgcagattaccaaaatataaattatatccatcaatacacgattcaaaaacagaaaaggtccaatagaaactgttgattacctagtcttcttcgttatgctgctatatgagtcatttatattcttacaaataaaaaagattgaccaataactgggaatccagaaactcacctcttctcatagaagtaaataattgagattttgtcatgcccaaaagtattgtgtgaatcagtaacacactacagcattgccactttcgttcatattagttttttttgaataatttcaacttttattttagatttgggggtacatgtgcagatttgttacatgggtatattgtataactcagaggtttggggtacaaacaatcccgtcatccaggtggtgagtatagtacccaatagtcgtgttttgttttgttttgtttttaaatctacattttatcttctatttttattttattttattttgctttaagttccgggatacatgtgcagaatgtgcaggtttgttacgtaggtatacatgtgccatggtgatttgctgcacctctcaacccatcacctaggttttaagccccacatgcattaggtatttatcctaatgctcctcctccctctgtcctccaccccttgacaggccctgatgtgtgttgttcccctccctgtgtggattactatgcagccataaaaaaagaatgagatcatgtcctttgcaggtacatagatgaagctggaagccatcattctcagcaaactaacacaagaacagaaaatcaaacatcacatgttctcatccaatagtagcttttttgccctcccactccccatagtagtccccagtgtctattgttcccatctttatgtccaggtatacatgtttagctcccacttataagtgagaacgtgaagtatttggtttcctgttcctgtgttaattcacttaggacagtggcctccagctgcacccatgttgctgcaaagaacatgattttgttcttttttatggctgcatagcatttaatgttgtatatgtaccacattttctttatccagtccactgttgatgggcacctaggttggttccatgtcttttctattgtcagtagtactgtgattaacatataagcgcatgagtgtttttggtagaacgttttattttcttttggatatatacccagtaatgggattgctgggtcaaataatagttctaagttctgtgagaaatctccaaactgctttccacaatggctaaactaatttacattttcatcaatgtgtataactgttcccttttctccaagacctcaccaatatctaatattttttgatatttttaatagccgttctaactggtgtgagataattctcgtggttttgatttgaatttttctggtgattgacaacattaagcattttttcacgtgtttgttggccacttgaatgcctttcttttttttaagaagtgtctattcatgccctttgtcaatgttcaatggggttgttttttgcgtgttgaattgttcaagttccttataaattctagatattagttttcactcagttctgaaatgtatagaaacctgaacattagagggttaactctttgttgttctagcttaattaagcataaattataacaatgaaatacttcatgtgtgtcttctattaaattcaggagaacctagcctcactcttttttctataaaagtgacaataacacattttagtaaaatctctagcttacctaaggttaaacaacctttcgaagcaataacattggcatcactataagcatttcagcacatcttagctagagtgtgaaataattttgatatgactatgccatttttaaaataaaatattacattctttgtcttgggaatgtgatttgatttcaatcaacagtatataaacctgtaccaatatattcatccttaatgtaaagtataagtctatgtgcctaggcacatatgtgaattcaatgatgatttaaaacactttttggttcttgtatattttcttgtttcctttgttttacatttttaattgcataaaattttgttaatatcaattatttcaatcattttattataagatatgggattgagtagaaatgctgtctggaatttggcagtctaggtgaaagagtattaataatactaataatcataatagtagtattgggtgtaactctcatattctgaaatgttatgaattataatacatgaaagttaaaattataaattataatagtcaaagaagaataaaccaggtctcacagagacaaagtgattgcactgtaaaacatgggtagtacacctagtctcatagtcagagtatctgatccttaaataaatttttatttcaccatatccttttatctgatacatttaaactaccattagacacacataaatcttaatatatcatagacttgcatgtctaatgagaaccaaatagttcactgatttcctcaaatataggaaatgtttgtcagagaagcactgttctcacagtaaaaggcagcaaagcacaggagcctatattgcaaacctgggatcctggctgcatgtgttcccattcttggttctgccacttctcggatgcgtaaccttatgcaaattacaaatgccatctctgggcttcaatttcctcctttctaaaataaagatggacaatatccttatcccacagagctattatgagaattaatagttactatctaggaagtacttataacgctacctggtgcatattaagcactgtagaagtatttgttcaacaaatgaaaaacagtattaagtctcaaaacaactgtcaatcttaaaaagaaccagttatattccaaattctaaagaaatatataagaaatgcaagacaaaatatttttcttgcatctactccacccttgaaaggagactgacaagtttatagactgctcatctgtttattcatagctataaccaaacaatttaaaccttctctttcaacattatgatgaatgtcatggtaggggcagttaagaaagcaaacacttttcaaaaagttcttgaggtaatattcaaagagtgatgagacagaagtattcataatttctgctaatttagaactttgatgctattcccaatgatagttaccaggaatcaaattaatgccagtacacttagcagggtttgtgtattttgtgtacaattacccaccacatgctggaataagacaactcgcttgctgtgttaattgggtaaatcaccatttttatttcactatccctcagtttagtctcagcagtttaggtcatttctgaggaatataagggtattaaatagaaattaaatgatgctttttaacaagtgaagatacttaagttctccacagacagatgctttaaatacaggttcttatattaataatatttatcagaagataagcaccatcaagctacatcacccataagaaagtagaattttcaatcattatcacaaataataaattcataacaataacctagaattaagcatttatgctattcaaggattcctgaattctgaagttggaaatttgggggataataagatatccttttggcagccatgacaagttaagtttttctagaaatttagtcaggtgcttcttggcagtcctgtgctttattctacccagaaattagggtatgtcatgtgggatctaaccaaatattagagttagaatatagctcaaggtgcccctggattaatggccatccggtgaaactgtttatcaacaagaagcagcatgagccattatcagtttttgatcaataaagattgatttctataccggaccttgttttttcatacctctgtcctcatattttccttttctcttttagctctgcctatactgttggtattctttcctactcccaagcataaggtttcaacaaaatgtgaaatcaaagttatgctaatatcaatttagaatcaatgttaaagttctcctcaaatccactttactcagctgtatattttgttagcttgtttctactttatccatattataaaactattttaatttttctttcattttcatttagcaaaagcacagtctcagagttgacaacaccctaaaagtttcctctactacatatctgggatgactagccatctaaccttgaatatttccattttagggtgtatttaatatctatccatccatttagtatacccttatgaagtgctccttatgccttagataatcgtgtaaaaagataaatgcagacctactgacaaaaaaacttatattgttacagaattaataacactaaacaaaaaactacacacaccattgagataaatactgtgcagaagtaattcagggtactgtgaaagtcattaatggtgtaaactaacctagaaaactacgtcaggtgacaaagaagggtttcttattaggaagtaatatttaggctaacatgtaagggaggaataaaagtgaaatgacataggatagagggaggaaaaaatagaagtgtatttgatagaagaaagagcatgaactaatgtctatattaggctaatctataattcagtccagcaagtatgacctttggatgataaagtctgggagtgggtggtattaaaaaaagaaaaacacacacagaggtgaagagttgggtgatgcagcagttagaacctttgttcttttgctgtttatctatctgtttgttaagtatcccaatgcagaagtttcaggcagagaagtaaagttattgtggaagaaggaagttcacgaggagttgggtcagcagaaagatgcacaaatagcgggtgacctaccttttagaagaggacaaaagctaacatgtgagatggtatgcttttctgtgtattgactaaggaggtaagagtcttttttttttcagtcatgccagtttcttggaggatattgggctcttgagactaatgattaagcaaactgaaatgcagacagaggtcccctggttgtggttataaactagaagttctttttttttttttagacggagtctcgccctgttgcccaggctggactgccgtggcgcgatctgggctcactgcaagctccgcctcccgggttcacaccattctcctgcctcagcctcctgagtagctgggatacagcaagcctcctgagtagctgggactacaggcacccgccaccacgcccggctaattttttgtatttttagtagagacagagtttcaccatgttagtcaggatggtctcgatctcctgacctcgtgatgcgcctgcctcggcctcccaaagtgctgggattacaggcgtgagccaccgcgcccggccacaggtgttctatatagttcagtggtattgatagctatgctctttgaaaggacagctgtgttatttcgaagggcagctgtcagaagcgcattaaataatgtcaaagcactgagttaatgtctagaaacctcagagaagactactttaggtaatgtctacctttcttcccactgaaaacatgggatggtataaggtacaccagtaacaattctgagcattgccagcctaaaaggagctttcctctgttagtgaattgtgagtcaataaggagacattttctcttagaaatgtctttctcacattaagcctgagatgaatgcttgtgtgttggcacttgaaatccttacccctcttcttctctctcctatatcacaagtgctctagcatgactggcatgacaattacaaaaaaaaaaaagaaagaaaaaaaaagaaaggctcttatctctttcttccttggtcaatgcatgaaaaagcataagcctaggaactgtatttggctcctatcccaacatggatctatcaaaatacagcttagtttccaccaatgagatgcacttgtacaacacagaagataaacagaattatttctgacaatggcatgaagttatgtggtttcaatacaaaaaagaatttgcagtagcctctagattttcctcaataaaacacctactttggtgctgcaagtagacatgatcactcagtagagtctactgtagttccagatctgggtttcagctgacatttctgattctttgaaagccagtggtgaacccaagaactaatggtagacttctttacattttctcttccagctcttgtaaaggatttacaagcaccatttttcctctctatgatatcttcctgtttaaactacctagatttgtgtcactcaattgaataatgacatatatcagtagaaataagtcgctgagacaaaaagccagatcttgtttacctgttcaaagaagcgatgtacagttggtgtgcagtacacatttgttcaatgaataaatatatgaataaaacataagaagtatctgactccagttgttcaatgcaaggaagcttcttggactatttctgaaccagaaatttgatcccatcactaaagcaacattcatatgttagatgcacctttaaaccatcacccaaactactctcaggccaaaaattgcatgatgtgtaattgaacactttttagctttcagacgataaataactgatgatgacataaagtgccaaactaatctcacctccatttcagtcatgtattgtgattttgactccccttaaataaattgtgaaataggcttatataacacaatattgatatttagtaatattaaatatagtttcccgtcagtggggagaattacacaaatagtgatgaatgggagaaggaagagcactaaaagtagtaataattattattaatactttaatttaatcttattttcataatattgaagtaataacttattttttgtgctcatccttctcttggatatttgctatttgtgtaattctcccattgatgaaagcccatatttagatactatcttatacttcaccttttacatgctcttctaaatctcatccagacatctcattaggagatagccaattaacaaatttacctttagaagtcaaaagacagacatattctccaattcagaaaaaaaaaatcacgtttctccagaaagcttttagaaaatgaatatttcaaacccaaagaatttcagggctgaaaatttggtggggaaatctcacatcatgccatgttatctaaatcagcaataaatatactgaacctaaaatatgtaatgttttatacgttgcttttttaaaaaatatagtgaagggggaaatttaaagtatctctaaattgtaggaatgcaatcaaaggagcattagagaaatagtatacatacacacacacatacacaaacacaccacacataacacacacaagtgtgtggggggaaaagggcccttattaaatactggagactttccaggataatacctgatttatttccagttttgatattttaaacagattttagtttacaaaaataacctattttacacatttaaaaacaacatgcatgggaaagtcatatgaaaataaattccactcagtgatataactaggttagcaagaaaaacctgaaatctaatgttgacaaatgaaaagtaatacagcgtgagtacaaagctataaatctaaatgttgtatgagaaattcatacttaatatatttatttgaagctagataggtaagatgttcttttcaaaacacagtgcagtaaagaaatttacataaaagtaaattataagagatttaagcattcaaaaatttttctgagaatcctgttgttgtttattagacaaacgtctctccacaatctgcaatgaaagatacagcagagagactcaatacgagcaaataattatttttatctacaattaaatggcatgaactgtgaggacaagagagaaaaaatgtgaatcatacacctttgtaacctttacaaagatggtgagaagagttttacaagaaagaatactaaatatagactggtatcatgccaacttcaaattgctatattcagctcaataaaaaagtgaaatagaaaagagcaatcatgagaacgaaaatattcaaaaaagatgtcgaaaagcactgttttaaagaaagcccaaaaattgcatggaaattctctatatagtaccttgtgagactaaatctaccgcagttagtcatgagggaaataaatgacaacgatagtaagaatctaaaaagaatgaattatgttcttatatgtctttcatcaggtttgcttgcgggcataagactttctcagaaagtaaaatgaagcaatgactaaagtgccgagaatgaattattccttcttactatctagaaaagtgtaagttactgtcaatcctgaaatgattcttcaaaaatttgtgtttgcacatacatgctcacttatagacaacttttttttttttttttaccatgcttctttgtcatcaatataattaactttcagattcaggattgctctcattttgtagattttcctttgttttttaaccccacaaagtatttaatcaacacacttttgcttatcattttgcattttacatgataataccctggctatatttatctaaacaattaagggtagatggtgaagacaggctatttcaccatcaagatcctagaaatataacatttaataaatagatcactgttaaaatttcatggtgatatttatcactaacaacaaatcacatgaggtgttattacatggataaagtgaagtggtgaaggtgtaatcatgaaaagacccattgtgacaggtaatacacaaacaagtcaaagaagctgacagcaaaggtccttacattcagctgtaaggaagctgcaaagaacagctcaggcatctgccgccctgcctcctttaggataaatttatcctgggcaggaaacactaaaatatttttcacaaaactatcgtctggataaaattaaattcattaacaagttcaatggacctgataaaggctcaatgagaataattcattgattagagtttaatgagtatctatggcatatataacattttgagtttaattcaaacagaatccatatcataagagtgaaaattaataataaaaataatggcaataataagtaaggagagttgcaggaggaaagaggagaaagggagatgctaatatttaaggaaagcttatgaggagttggttttgttaaaaatacctgatccagattattgcatttcctcatcactctttcagaaaaattatctgagatttggagaagccaaatggccaagagcatatagcttgtcagcagagaaccccattctggtttatacctgctcacttaaggactaaattcatatataacatgtagttggcacttaacaaggtactcaagatgcaaaactgaagatatagtctattccctccacactttagtctagtgaagggacccatagagctcaggagtaggtataagggctgtataaacacagatgatggaaaaagcaaggacaactcatggaaagctgaaaataggacataggccccaaaatggaattaaagcagatctttctgacaataagttcatattcctagtttactagatgaaaatacagctcatatatcagggttatcctcacaaaagataattccagtaccaagtagctaattgatcatagaagacaatgctgtgtaagttctaaagtgttacataaaaagtgttttagaaagggaataagatgactgatttaccaggcagacaaataggagtcccataataataacttgtcagactctattttatgcccaatgctgtacatagtttctagttcaaagagatgtcaatgacaaattaatgagtgctctcagttttatagttgcagttttgttgactccaaggtttgtggtctttgtaaggtagtgcaaagtacatgagtaaaatgatgcttatgacaggaacaaatattctgcaagtacaaattttccacttagtaactatcttacaaactctgttcagtaagtattcaaacagtcaatgtgggaccatgaaggtgtcattttggcttattgtacacacacacacacacacacacacacactcacaatgatagttatacaaacaaaccagaaataaatattaatctaagctatccaaataaatggcccagccatggaatcagaactcatactattgatattagaagatcaacacagttatatttgaaagacatatattgaaaattataaagcaaatattcagtaaaagactattgctcagtattttaaaatttctactgaatattaaattactaagtatatttcaatatgagaaattatcatctttgatattctctaaacaagggtctggaagacacttaaaaggcgatctcttcctttaggtctttagtcaaatgcctctttattagcaaaagtctctctggccccctatttcaaattgtataccctacttcaacactgcctatactccctttactgctttattttattttctccttagcagataacagtatctaatatattttttcttttaacattttacttggtctatttctctcactagaatctaagcctcatctggggaagataacttactgaatgagtaatattgtagaaccttttcgtctcacaaaagaagaaaatgaatatatatttgctcatgacttatcagggctggacccaaataattgcatagagttgtctcatgtatagaatgttacctaaactcaggcttttagctgtaggtaaagttgaaatcatatctaattgaaagtcagaaaacacagtaggaatcctcacattaacctataaaaggatttcagaaatgtctgtgtgggtcagataaacaggtcaaaaagatctggagaaaccttgttatcaagagcaactgaaaatctccttgaaagagaacacagcctataagagggaagaacacaaactgaacttgacccaataacaaagttttagtcacagggaaagaaaggaaattatcagtgaagtgtgggaccagtcactcagattaatctgggttaagtttcacacatttgagtcctgtgaagaaaagagagttgaaaaggagcttataagtaaaactgaagaagctgtttcaataaatgactaagacattagagcataagtagccaccctctagtaaagtataaaagaaaaagtaaagggggagagacagacagaggcattcttgccaaactcaggaatgaattactgtggtaacagctataaaggactccagtgcctcaactatgaaagaggataaaacctttgacccagcaaattcctgacacgagacagcagaaactgatggatacagtggcatctatgagatatcagatattcatagaagtaggcagcagaaggcttagaatcaggataagaggaaagcaagcattagaggaggtcaagtgatagctgatttgacttttgattgaatttacatttgaacaggtgaaatatctgcctggaacgcctaagaatatttagcatgttttacagaaggctaagaaatgcataagctagaatattttaaaaacaaatttaatttgttattactattaatatgactccatttgtagccacctataggacatagaaattcacattaaagaaagaagtacaaaactaattgaaaataaaaataaccaagtgtaataatgttccaagtttgacaccatgtcaatgaggtgaaaacagcaacaatctacaatatcatactttctcaattaaacttctgagcactagtataaagtgataattagcaagattcaaattttattgccttaagaacaatcatacaaattagggtattcaggctgaaattaagtctataatatttactaataacaggtagtagttggaaaatgtcatgtaactattacaagcacttttatctacaatcatgacaatcttttttttacattttaaaaatcagcttaattgaggtataatttatatacaattaaatgcacctattttaaatgagcagtttttcaaacacatatacccaggtaattactacgccaagagatagaatatatttattatcctaaaattaccacttgctcctttatagtcaatcttccacatcttctcctctgccagacaactactgatctcatttctaacactataaattctaatattctgttttagaacttcatattaataaaagcatactgtatataatatgttgtctctggcttctttttgtaaacactatcttagattcattttcattcttgagtgtatcagtagttcattcttttttattgctgtatagtattcctttgtatggaaatacagtaattgcttattcattctccatcaaattcatttttgaagcagtctcctcctctatacaggcactcccccaaaatctcctttaggagtttcacaaatgtaaaacaaaaacccattcattatttctagtagaaaactacataagtcactattagcctggaggcaaatgttatatactgaaaactgaataccttgtataatgcaaattatataaaatatatataaattatataaatatattacactgtatataggttatacctaaataaagctgatttaagaatgtttgaaaaacagatcttcataattgacttttttgtggataaaaatgaggtcataccttgagggaaggactacttacaatcccaaggaaaagactgatgggcagattccaatatggccccaaagatcccagcctcttaggatgctcacacttccttatttagacctgttttgtgtggaccctgctgaatgacccaattctactgaggtcataaaaggcagggtggcatttctttctattgcttgtgcttactccatctctatttatattattttttgttggtgcatgtgtatgtgtgtatgtctgtggtttgacagtggcagacaaatttaaagaataaagattaatttattttgtgtgactgtaaaaagcaccatgcctgtactactggcacgtgttttgagaagacaaatgctcttgtggagctatcttaattttgtcttgttttgctttgagagttgtttgcaggagatgtgaacacaggatgaaaagatttcataaagaattcaaggagagttgtcatctaatgctgcagaatatttaaaacaatgcaaactagaccctcccattaatgtacatttcttattcattgcaagatctattaaaatcaccttgttggaaacagaaaacgaggtcacaccttgagggaaggactatttactgtcccaagaaaaacactttggtgggcagcctccaataaggccccaaatatgccagcctcatggaattctcatactttcttattcccacctgttgtgtgtggactgtgcttagtgactcaattctcctgaggtcataaaaggcagggtggcatttctttctgttgctcatgcttatttcacctctatttcctaccatgtcacaggcagccctagcaagcccacatggcaaggtattgtagttgagacatggatcctccagactgagtcagtcctgacgtggctacagaccctaactcccacccctgacaatttgattgcagccttgtaagagattctgagctagaatcacacagctgagacactctcagaaactttttagttgttttaagtcactcagcataagagtactttgttgcgcagcaacagataaataacagaaggcctaacctagaacaaaacacagaaactctagtgatgagtattaagactgaagcaagcaagaaagttattttgccaaaacatcctaggaattggtctgaactccccaggaagatagctatatgacactcacggaaaagggttaatggaaaggagctgtgagctaagtggggagatgtcctagaaggtcccaggatgacatatgtgagccagtagactaaatctcaccaaatgcagcagccaatttaattaccctttgggtaaacttactcattattatcaccaaaacttcagaaaaggctgtttaaaatgacagcttggtttctccttttgtgaagaggggaaaaaattgtttcgtgatggggagaagatattgaaggacagaacattacagtatctcatgaataaagacttgggaccccagctacaggtaatagccatgtcagttataggtggccaagcagtggttcaatatgtctactggtagtgagaggggaagccagctggacttactgggttgagtggggacttggagaacttttctgtcttacaagaggattgtaagatgcaccaatcagcactctgtagctagcaagggtattgtaaaatgcacaaatcagagctctgtaaaaacgcaccaatcagcgctttgtagctagcaagaagattgtaaaacacaccaatcagtgccctgtaaaatgcaccaataagcaggagtctaaaagtagccaatcgcagggaggattgaaaaacgggaacactgacaggacagaaacggaacatgggcggggactaataaggaaataaaagctggccacgctagcccagcagcagcaacctgctcttgtccccttccacactgtggaagctttgttctttcatgttctttcgctcttcacaataaatcttgctgctgctcactctttgggtctgtgccatctttaagagctgtaacactcaccacgaaggtctgcggcatcattcttgaagtcagcaagaccacgaacccaccagaaggaaccaagtccagacacagtagaatataatacaatgtggcactttgaaaagtggagcaaataagaagaacatagagttgtatcctaaagcagtgcctcttaaaccataatagaaaacacctggggatcttgttaaataatggcgataattcaaacagtctggggtcaggcctgagcttttgcatttcgaacaagctcccaggagatacccatgctgctgtccataaactataatttgagtaataaatgtatacagcacatgtaagagtgattactcacgaggacataaagaaataaaatattggaatggacattactagaagcctcaaattcctacaattaaaaaggtgggaactcagtcataaatatttggatgttattacaagtatgacttcatttcatattaatagactggttaaacctagaagaacaatatacaacatatagaagagattagggattttgaagtcaccagtggcttcagatctgtgttcttgttctaaatatgtctatatttatttaaggctatatcatgaatagtcctgttttaatatatatgacagacttcatattaatacaaagagattttgaattttctaaaaattttggcagacaacattttttatcttgatccagagaaatgttaatgaatgattttaaaatgaagggaaaatcttgaagcaaaatatgtttttccataaaaaaactaagcctatttgtaaccttgaaaaaaatgtctttttttcttattgcatagacagaacacaggaaatctacaatttccaaaatatttcctccagccccaaatggtgctttctcttttcatacaaagcttttctctctcaatgccattacagttttctgctttgtcttaaaaacatttattcagcacatagcaacattaagttattaaaacgggaagtattgaaatttttccctttctcgctataagaataactaaactttttgtgttgtgcttccatcttttctacttattttaaatcatttatttcagttgctttccccttccaaataagttatagcctgttatgtagaatatgcctaaacaagcagattacataatctactttactataattacagaggacactttacttctagttttgagaaaacatttgttttctatgcatttcccttaaatataaatgaaggagaaattatattgcacatgtcttcagtaaaactgaactgtataatgtttttgcagtccttattactgacactagaagtgcccttttatatttcaattttcatttaactaaattcaaaaagataaagcacctatgaaattatgatcaatgattaataccaaatcagtctaaatgcaagcaagaagcttaataaagcaaaaataaagtgatgctatttatacctgagttttcagttaatttattttctttgaactgctgattgccttgaaaggcagatatagaaatgccttcaataaaatgctacatttctcaaacaacctgctatgttgttggagtttaatggctgacagactaatgagaacgaatggcttacaatcttccaagactgacccacttagtcattcacaccatccatcgaatgagagactgcttcagaggtacaaggtcacacccttgcaacaattattctgtctaatgaggtgtcacaagaaatctactggttcaaaggtgtgtggtaggggcagctgggcataaaatatttggtgtccttgcaccgaagtgtagatacacatttctgagcagctctttgtcacaataccatattaaatgaaaaatgctacttagttatggaatcatttgcactttaaagagatagaagtgatacaaattttactttcatgttgtcaaggatttgttggggtggggcaacttcggagacattttccccccaaagctcaatgacaggttgacttaattattcaaataactatttataggcgataattagaccatatgttaatctcagagtttaaaataaccaatttgcttatattgtttcgttcttgtctaactctgcagaggtacaattttcagagtgaaaatgaggcttaggtcaaatcaaagcatccattaacatattattgtgtctacagaaatccataggactgtattaattatctaggcagctgatgtaaagaatttttttagtgttaattgctaattaaagaaaatcaatggtgaaaagtaaattaaaaataaaaagagatgaactataaaagataatgaggcaatttacaactaattgaatagctttacacaaattttccctcaaatagccaataattacttccaaataagttggaaaaatcagtgataattcagtaagcttcttggctctaaatttctgcaaagggaagcaaagtaggaccctttaaaacatgttttcttctcggttggtacaccaaataggctaatcttccatagacaagtgggttctttttggcggctcattttgctacacagatacagagtcacacctatgatttaaatataatttgcctatattatttaatatttctgggtacttttaatttaattgattcacaattattattatatatttataataaaaaattagaattatgtacatatgtcagtgatctgcattagctgttttccaaagcacatcttaaagtggattttaaaataatctttctgtaagctctaacactttactagtggggggaaagaagctaatattccattatatatcagagtactttttcccttatacatttaagatgttttaaaaattaagaacataatatgatatcttacaataagattgtcaagtgtatatcaaagactgcgatctaaaagagaaaggatcagatactgtcattgcctccaccctttaatcgtgtgatttgtagtgcatttctttaaaaaattattaaagctattttcctttcaaatcgtttttcttctaatccaccagttatatacacacaaatagatacatgcgtttatacctacatttgctgtctgatttattcctacaaaaacacattaagttagataataggatgtctgtttcacagatgagaaaatggcagttttctgactctagtaactgtctcacgttcagtaatccagtaagcactgaagctggaacggaaatcagagtttgactacttctaaatctcaggttctttaataagacagaacttacattgaacacacaaaaagtaaaagttgttaaaatttcccaaagaattttatgtctatagtaacatatatgttatacccatatacacacacatatatgttagctaacttactcccatttactgagcccctgtcatacagagacactagattaagcctttatagtcaaataattatgaaggtatattttgttctaaaataatgttttatggttataaacaataactaattgtaaaggcagtataaattaaaagaaacaaagaataagcacatatatttaaatgtagactacttattatggaatggcataatttaatgattatattaattattttgtaataagcagggaattaaataagttaacccatgcttccacattgagtgtaatgataaacatccctaagagctggtagaatgtgaaaaattagaacctagtagtaaagaatgggaagttaaagagaagaaatttactttgtcagggataatatgatttatatatgtgagaactggctaaattctaaggtactagcttcatagttgttaataatatctgcttttaatattagaatagcattttgttacactgcatgaacatgaaaaacgtgcaatacatgagacatgactggtagtaaaaaccaagtcttaggtagtatatgtaattttcccaagttaatcaaataaaacataaatatttataggtgttttttaaaggagctacttccaacagcctaaaaacatgtaactatctttgtgtgatggttattacagggtcctatctaggttatagtcttggatttattttccatatatatatatatttcacatatatatttcacatatatatatttcacatatatgtatgaccaaggattgctggaggaaacaaatgctttattacgaatagtacaaaaggtaagttaggacataaaagggttccaaaaacaatttctctccaaaatatgttacttggtaccaagactgccccttttaattgtttatcatatgcaaatacacatgttactatctttatatcctataataactcaatattttatttgattttatttatcaaaaggaactttataacaagctatgcttcgaatgaatatgctttgagcactgtcagggtttcattcttcaaataaatttactcacttaatgtaatgattcaccatttgactccaaaaagataaactggcattttcttagcattggaatatcaaattagtagaaatcaaaaaatgcagttgggcttcatttaatatccactttaaaataatgcatgacttgaaactttgttaaggagttaaaacagctcatttagattggaaaatatttttaattaacgcattctgcacttcaacagcaggttctataatgtaaatgcagtggtaagcaaagatttcattaacttccaccagaagtcccagatttaggaatatcggctgtaattagaaaaattaaagctacacttcagaattaattgaaattattaaagtatttactgttgcattatttacacctagaatgtcagcaagaagcataaactttctagtgaataattctatagtttatattaagaacataacaggacttccattgaacattgagtctttccaggtgggccttctataagctttcatcgcattttgattatctggacaattacataaaaactctttgctgggaaagcatgacggctaatgcattcttgatggatgggtgtgacgtaatatataggcatttgctgccctcatgaaatctaccagcaggactcactggaaactgagatattcttattggacaattgcactgtgtatggagtgacaagaaagccacagattgaggtccagttttctaaatgtagaagataaaacatgaagagatgtgaattataactgtagagtatcagtgttgtttttgttattatttgattttccttagatattactccgaacttgaacatattatattcagttttacataagtattatacattttgaatttgctagctcgaagtaaacatttcttcagaaagtaaaattagcctaatattaaaattttaagtaaataaaactctgctcatgatttctgcttggaactcaccaatacagcaaatgcagatacagcagcatggaagggacataatggtaaagatatcacagcaacattttagaaaccttctataaaatgttatatgtttaggttattctgtgcagaaaataaaattatccaaaaagccagtcacattccttattgcacagaaagctggactggacgttgtcacctggattctaatttcacctttacttctgagaaatttgccataagaatttggcattcaacattatggagcctcttcttcctcattagtgaattaaatgttttgaaccatttttatatatgtatgtgtgtgtgtgtgtgtgtgtgtgtgtgtggtgtgtggtgtgtgtgtgtgtgtgtgtgtagatggatagacagagaggtaaataggtagaaaatccaaactagagtagataacaaaatatctgaatcacctattacagattcagagagtaaaggagactagtagatgatataaagaaaggaagagaaagaatgtatgacactaccaatttttgatatgatgaggagtaaataggtaaaacagagaatacaaactccagtatctatttttctgttcctcttactaataacagccactctcaaattttagctaggtacacaactaaacagctatgggactacatttcccagcttcacgtgcaactgggtatgaccacttatctaggttcaatggcactgacatggaaattgctttgtgcggcgaaattggacctattttccttgatttcaatttagtccatgatccaaatctgaccctgtagatgaggaccattccctaggtgatgatcgagcaatgtgatggcagaaacctgtatctacgaatgaccatgaaaaaaaccatgtcatcccatcagcctgaactactcaccttacgactgttaaatgattataattgagttattatctgagtatgatgattataatgaccaataattccactttgtttcctatacttgtttgggaagtcttatggttacagtagcttagtctttaacttatacaacaatgaatgctgaatatttaaattataatatgcacttttctactgcagtgtagcatatgggttaacaaatactttaaatgtatttgatttgacattaatcaggaattctgacatatgaccccaaaacttggggacagggtggttaagaattcttagactggctattctatgggcataaataaacaaataggcaaagaaccactgtttgccaggacaaatattgcaacattttcttcaaagtttggtcatgaaaatttccaaactattcttctattcatttggttgttaagttacttaatcagaaaactcaattttaagattttacacatattgaaatgattcaagattgctctattttaaaaaatagcctatttttctccttcacttctcgaagttttcatcaataacagaagagcttgattatttccccttctaatcagaggcttttacgcttcccagttatttcaatctccccaacagatcagcatcaataatcatcatgcttaatcactgactcaaagaagcagtctcccaatattatgggttctttagatgataggaatattttactattgataatattgacattttcataattgccacattatttttggcttgtgacctaaagaaagtgttcatgtaatatatttaaaggtcatttaaaatacagagatggaggttgtaattgtattacttactttattttaccacatagtattcaaaatctggattacctttcctaagacatatcaaaattgatcaacttaaaatgatttgtttaaaccattatataaatcaattttctttaaagatcttttttaattggtaattccatagaaacttggtcatatgttatataaatattaaaaaaagttttctggaatttcttattatcaaagctacactttaaaaaatcatatcatatacactctccctttttaatctgtatccttcttttcaatgtagattttatgttgtacaatgcgtgccacaagcccagaaagtacacccaatttcttaagattgatgagagtaactctatacatgccatactcaacagatgttagagcaacatctccagcaacaaagacctggagctcagccaatctgtgagcaacaaagtacatgtctacagaggccaggctaagtaagaaactcacacagctccaggatggtgagccaaaggtagctaaccacttcagagttggcaggggagacacaacataaaatttagctagaggtcattactttgtatggcagacactggctgctgctgggaaacaacagaaaactgatcaatttgttgtgcagaataatatagtaggtggttcatcatgagcaaatccacaaaaacagaggtccctcaaaagttggatttcatggtatatatgttattaactagaaagaagtctcatacagagtactatatatgatactctgaaatcagattcaaaattagtgcttgaagagaaaatgcatataatattacaaaatatgagacagcctctccaacagagaaaaggcaattataaatcttcattatcacatcattttcatcataagctaactaaattattcaatttaaacttcaaggtgtttttagctttattataaaattctacaggggaaaatagcaagaaataaagatgaaaaggtagtttgcaatttaggtaatgaagattccttgatgtcacaccaagattttttcttaacattaccctacattaaattaaaaataataatattttaatcatgatcatatttgcattttaaaattcccattggtggcagaaaaaacgaatagagtaagtaaggtagagtcagggagacagtaggtagccatccaagtaatatttggtaaggccttgaagtaaagttatggccaaagggaagaatttgatttaaaaaaaaaatgttggcctgataggacttgatcactaataggtatcatttttatggtaggcccctactgtgctaaatgtggaggctaccataaatttgatgagacaacctacatttctaaagtaatatactgtcttacagttgcaaattttgcttattttagctaaataactggacttactacatctgtttgtctgtggagacctaatccaatatatcttgtactatatatactgtattttcaaattatattgcatataatgattatattaaatatctagaatagtgactacaaaacaaaaactttggacctgaattttatatcttctttctttgtaaaaataaaggaaataaaattatattattgctgatgtgttaaatatttgaggacttctttgtgttgcttttttaaccactgctccttctccaagcttttcagcgacagaaggcaaaaactctagctcataacaaacagtttaagagtttagcagttccatgaaggtctccagtggaaaagtttacatcatcaaaaactgctcaggttggcatattttctactccttaattctcatttacaactgaaaattcattgaattttcttaacaagtaatcagaagaccttagggaagaaaggagctgtctcataggggaaaagataatccaattatcctgttcactacgtgtttacatatctttcacacctgaaaggaagagatttggtgctcatgaaataaatgtcacaaaacaactcaactttaactttctattttatatattttaacttccgatttttgtatgtattttatgcatccctcctaatgtagggaaacgcaattttgtatatgtgctttgccatcttgtggtattaattaaaattttaacctgacaaatgtatacctgagacataagaagtgtcgatccaattcgctgtgaaagagcaaaggtaatatttttcattcaatttttaaaattcacataacatttctgataatttcatataacaaagacgtttctcttgtcctttcaaaattagggcaccaggtttcaatcaatacacaggcagcatttctcatatattagaagcccaataaatgtttactgaggattattttattcaactttttaaaaaaatttgatgaatatggagataacagtttcactttcatctccaggtaatctgaagattaaaccatgagttatgttgtaactctgtgtcaggtgagcagccatgctagatataagaacagtgatcaacgtatgagaaagacaaataagaaaataaaagtaatttacggttataatcaagtaaaatttcaacaaatttaatacaatgtgacgcagtggtgtaaataagagacagaatagatggcaatgaggcataggtaatacatagttcaccacaaataattgtaattaaaatgactcttagaaggccaatttttggttttctgcttcctactcatttctttgctgattataatcagtatccttacattttatcttgcatcagttaatcacaacagtctcatttcattattatgtggggcatgcattaaaatactctgaattatagtaactggcagatgggaccctgttgatcctaaatgtcactccactccaccatgagcttatcttccctacctccacgttgctattccaccatgcctctcatatgaggtgaactaactcaaaactcttggttggttcaaaaattgtggcttttggtcatggattatcaagtacaacaaggtgtttaaggagctgatataccataaaatctgacgccaagaggctgtagaggttagagtggtaggaactgaatgaattaatcttcccaggaaaagggacccgagcttgaagggccaccccagggaaaggcagagagcacagcaggttctctttctgacagattggaaatcccaaaggaagaaaaaaatacactcagaagcatttgtgccacgcttaactctcaactttgggaggagatacactggagttagttttccttgatatgatttgccctctgcttctttgttcccctgggcagcacttttacagtatctgtcctcctgcattcacatttgtgatcatttacttatgataacttgtgctcacttcatttgaaagaatttgtcttataaaagcagatccacaatctcacactttttctgcttttcatgtacagaatctagataactgtagcatttaccttccgtactaatatgcacatctgggaaaatacgttattaactttaggcaacttaacctctatgtgctttagttttctcatttataaatcaaagataatgattgtaccaacttcacaggaatgatatgggtataaataagttaatgcatggaaagcacttaaaatagtgactggcagatatgaagcagtcaataagtgttggctattattattaccttctatctgaagatttctcaagaactcatgaggcagtatataagagataaaattcaagaaaccaagaagaataaaaagatcatagtgaccttgaaaccatctctgatttagaaacaaaaaagtgtaattacatacttcttttaatcccactacaagaagtgataaactacatatgagctgcagattattatatggatgagaaggatgaatgagttgtaagagaaatgcacaatacagacaatagtataatctatttaataatgttaataacacaccctttaattgttcataaggccaacatagtcattcctgtgtgtcaccatagctccctatgaagttaaaaaacataggcagaagaggggaacttggcaatagaaacagaaataggaagagaactgatgagtaatggaggaaagaaaagcctgccatggtgaggaccatatattctgacctattctgaccatattctgacctagcttcttcatctctgtattcagcagcatttgattcacaccaaagcattcttgaatatggcctgaaattcctttctcttaaaatagctatctatatctgtatctataataccatcagaatatctctcagaatgcactgatgtaatacttcaaaaagccagtatgaatgtgtcttagtgaatgtgtaatttgttttattaaatcctggcatgttttccaagtgggagaggtgtatgggaaaataggaagacttcaagcccctaaaaaaaataaaaataaaaaggaaggaatatcctcctgaggggcaggaaaatgggagaataaagcactagacttaatccctgagacaattatactgcaagaaagccttgttgcttgcaaccacacaggtataaatgatgaggctaagctattctttcagagctaaccacatatgtttcctaggagaaaacaaatggctagcacatatgacacacaataaatacatctattcagaggagttgccactggaattcttacacactaaaattataagccatggtccattgaaacaggtaccatagataagtgttaattgagaactaattgaatgtattatataataaaataggaaattacaaatgggaaatattttttctatacttgtgatgcacataatttagctttaaaatttacaggtataaaagttttttgaaggtgaaacaatatatcatcttggcactgtttttcaaaagttcctgctgagtagtactttgataaaggttttcagggggaataaaaaaggaaactcttcaaacttaagtcatagatgtttccatgattttttttaagagaaatcaagacgtgaacttagggtaacttattaacttcagcagtatctaacaatcccactacatttctaaacatttaaattgcacttttgccttcctctttggttatttgatccaaagtacacattataagtcctcttataagaatatctcacctcaaaaggtacaggaagaatttcctcatttttctctgtctattctctttcctgagaaaaccaaagcacttctgctattatgctttggttatagctgaaaataacatgagtcttgactgtaactgctattgtattctatgaatttggaaatataagggactggtgcatagactgtaaactgctgcagtggtctggcgatttatttgtgtttttatattgtgtcaatattaggatagtacggcgtatttttatcatgctttactgcctttctagaactttggagagttgaacacacataaggaattagcactggagtgagaagatgatgaagggtgccaagaaattccagtggaaaacagcatagactgcaactgcctaataagcaacacagcttccacctaggttctaaaagcaatagctgtgactcaggatgacagcaaaggagaaggacaataaggtaagtgtagatacgtatctggaaatttttctgtgatataaagggagaaatgccttagggaagagattcctttttctctatggaatcaaaaattttatgataacgtggatacattttataagaccataagatggtcacaattgggtagtttcaaattgctagcacatggctgttttactcagcactccttgacacataggagactcaatacatatttgggactagataatattatatgatttatgctgccgtattatgcatattgcataatcctgactagtgattctgacttgacaacatttacaagcttgaaaatagaagagggtgcaacctctgcaagtagtttgaaaatagaagagggtgcaacttctaagagtagtgcataatgtgaatatggtacctgaattattgtcctatccttgatttctgtagcaaaatcaaacaggaattactatggttcatgaataaactgtccttctcaatggttccagatggttatattgttatcaacagcaaaaaaacggaaaagtgacaagataaaagtgtgagccagacttccctagaaatctgatgaccacctaaccccaaggtgaaagatttatctttcatcctgataaccatttgggtgaagaataagaaatgaaataattctgtctctagcgtgagattaatgagtcactccttctaccattctctaccccctccatccttttccactgagtagaatttctaactttgattataaagatttgaggccaattattgggaaaaaatcccaaggatgctagcttatgtgagtatttttcctaaattctaaatacaggtttttcgtaagtggcctacactggttccactttagaaacaggaaacactccattacttcttctttattttctttttttttttttctgtttctgtgctctaaattaacctttcctggaacttgagataaaatatgaggtttgggttattttctatgtggtataaagaagctatatctaggcctttatcttaactgagcaaggactatttaaccagacaagggaatggaagtattcctatgatacgtatgtcatgttacatgtgggtagtagtaaaaaatgcatgtgaacacaatgcttgcctggctttgttctctgttcgtgtagctgctgaaggagtcccctttttaacacaaactacatttgagaactataactttggacagtttgtaaaatctataattcacagaagttctaatatgatgaatgcattgagacttctgtagctgattacgtaaatatttgcaaacttaaaaatgaattatttcaaaagttcatgaattctgtatttaatcataatactttaattgttcccttacagagtaaatcagatagcattatatatgcaatgattcatacaaggcatcccagtagaaaagacacacatttaatttaagctatctctgatctcatgtgaaatgtatataatcgaatatgaaattattctcttcctttttagcatctaatgtaagtaaatgtatttgagaatatagaggtaaaatatttttgcttcatggttatttcaaatttaaaatatttacttattataatatagtatttagaaaatacatggactcattattaaaggcaacgctttggtaatatggtgtattgttgaactttgatttaagaactaattagagagcaatttgttatgttacatactagtctaagtcatttctttttgactgtttgattattatacatacacttttaaacttttgagtacaccattttcactaagtcctattttgaagagaacagatgtttttaaacacacacagatacataaatgctcacatgcaaacacaaaataaaatgcaattgaagtctctacaattaatcagctatattggctatattttacaatttaaaaaaataagtatagcatgatctcccagacttcagtgatttaaaatgtacatttcatagagatacatatctacttgctgcaactcaaatattcctatcacatatagaaaacaattggtcatattgattttcctagaagaaaaaaaaagtttccaatttcatcagttatatcacatgaattataatgaaaaataaattattggttttctttaagaaaagcaagcatttaaaattaacattgcatatattccttctttgtattcattttccatgattggaagttttgttattacatttttttaaagttaatgtattgtatcctacaagatcaatgaaactattttattgataatgtagttagaggtgtaaaaattattgtctgtgtatttacttggcaatatagcatgtgagatggtactgaacaaggatggaaaacctctctgtgaaactgggatattcaaccaactttgatatcttttatttttgaagttctcaatttcctctttaaaatgcaagggttcaaataattttttctatggttctttctagctcttacagtctacatgtatgtaaggaataatatatatttatttaaattgtgcatatttatccaaatgtgatgctgcaaaatagcatacatagagatttcagagtgggaaaaaggaagaccaaagacactaagcatccccttttacttattttcttctcatatccttctgatattgggtacagtaataaaatccaaaaataattatacatgtaatatgctctcagtggcagcagcatagggtcatttagagaaacttgagtccacctcttcccttccataatctccatcctgctccttcaaaaacactccaaataaacattcaatctcaatctacgtaacaagagtgtccaggcactgctgacctgacttcaggacaatttccttagccctctttcaaacaagatggctgcccctaactcctacaggattctcaaactgccacagtataatctgagaatttgcaaaatgcaacttcagttatattcagtatattagtcacatagcttgaaagactttcaaattgctaagccaatttatttacctgacagaggtacagagagtccagattacctccttagggtcacacttccaattgtagtgatgaaagataaactcaaaacctttgttactacaatcacatcagtgttctcctaacgggtaatgttcattttttgattcttcattaattcttcttcattcagtgaattttaagagttttgaaaagcttgttacaagtacagttaatgtctacattgtttgactgtatcaggagacatttatttattctttacggatgccaaatgcttttgacaatcctaaaaaaataaaacagtgaaccgacagtagtggtaaagaaattgcactttaatacataagaagataagttcaaatggcattgaactgggtacaaaattctacttatttaattttcattataacttttaaattagcattcttgaatatttgtcatatcatttgcattgttaaagtttattaaattcaggataggtgtaagcccaaaaatatgtaactgaaattaaagtgtttcctccaaacaacagagagaacttgaaataatgttatttgctgcattaaatgtgagacatacatagatagtagctagatcaatagagacacatggatagatatatttaattctgtaattttgaaaatcacatttttttcagaattttctaaaaagacattaagtaggtaagtttcaaacatgtaacatgcatttcaggtcacctattatcaaattattatataaattctgttcactcaccaccctctaccataatccagttttagaattgtaaagttacattaatcacacttctctaactgcagaacagtttacaccagtggtaaccacaataattgtcatgtgcactattagtcattcctaaaattttaacataatattctgctaattcttggatataactagcaatattttagcttttcacttactctccagcattattaaagaaaaatgtgcatttgcagaactctgcacctgcatacatttggattcctgcatcctactagtaatacacaggaaagatatcatggcattccataaagaataaagcaaaaaaagttatgaatagctcaaccttccaatatcacatctaattagcattgttttctttctaaattaagtgtatttagtaaatagtaatcatgccttgagttccataaaatataagaccatgtggtcaacaaaatcatctttatgttgctatagttacaagagtaggcttgtaaattttatgttaatattaaaagaaaagaaaaacatgtttgccttcaccaacagcaactgaaagcaaatgcaggtatacagcactttattagaaagaacccctttagtaagcacatgtaagaggaattaatcattcattccctgcagactgcttatgtatttcatcgggccattatctgatctgaataacaagaacaattgcataataaaacacattactgctgacactagcaactttcttctcaactttaaagttgcaactacctctgtacaggacagagagctggtggccaaaaaggtgacaatttaatcacccatcctgctttgccatttttatctgttattatatagagacagggatcaaatgcatgtgcaagctttactagaaacagctttcattcaggctattttccttagcactatgacataattacaacagaggcagaatgtatgtcaggttagttttaatgttacttacaaatatttgctttcagaaattcaaaaagaatgcacaaatctgtcatgtcttctctactgtgtaaaatatgtcctatactaatatatgtaataacatgtttgaaccactgttaaatttgccctacttaggtacaatcttcccctttatttttcaataattaagtttttttttttccaaatatcagatagcctctcggacatgtgaggtcagaaatgagtagaggttatgtgctataatccaaatctgatcagccaagggcttcattttaaatcacttaaattcatttttaaaccaataatagaaatgttagctaagagcagtaatatgtctaagaaaactcatttggataagaaattaaataataatcaagaaacaatgacacatctttctcaaatgattccatatatgataacttcatgtcaaccaattcattaactgttctattgtcctgtctcattaccctaaaaacttatggcccaagatatttagagctttcaacactgagtaatcaaaacaactctaaaacatctctacttttttgtaataattgtaacttagcttactcttataatttctaaaaccaatcccccatgaatacagatgcttttatatactcacttaagtaaataaggaggtaaaaatatactcattctaccattatcaacaattaaatacaaggaagcccttaggtataattaataataagctgctttattgaaagaaattctctgagataagtacttttacttttcaatctggtttttaacttataaggggtttttattaaaaagtatgtattatactgagaaagaaattaacagttaaagataaaagggataaactttttctaatcactattagactctagtcagtataagtactaccatgtcaaaaaacttaggatttgttaaaaatcaggtctgttttgtctaagttgcaactcctactgtatctactgtatatgtaacaatgcaagaagaattagattcagaatccatttggcagtgataaagaaaaaaatgctgaaatgttattgattctctccctcttgtgcaaaacaaactgagtcaactatatttttcctgacataacacaaaggttttatttagatattacaaaatattggcaaatgttagactacatgttttttatatatatgtataatgaacttattaacccttttgtagaaagaagagtgtcctacttctgtaaaaagaaatgctacagctactgacatggtgatgttagccccaagaggaatactgcctgcaaaagtttttgatgcagagatattcagccttaggagacaccttaaacctgtcactggctgctgagccctgtcagagtttataacccgctgtgtcaaagtcacagtctcagccctgccctctccaaagtatttttcacattctctctccaaattaagttcattctaattctccaactattctagttccaggattttcctccaattattatctccttacaggcatgaagaaatcgcaacagaattttcatctggtctttcaaaccatccttattaactttcccttttccgccccccccccctttttttttctagagcttttcagaactaaagataaaacaaccaaccaactgaagtcagagtagggtgggagttagcatggattagggctgaggttgaaggtggcaggagaagtgagccagtagggttagatttttcaagctttttctagataaccacccttaaatcttagaaccaaccaatgtttaacaaagcaggcttccaatagcccttgaacaataaacgtttaaaaatcagttttccagtaaggctgcccatactgatcccatatcgaagtcttctaagggctcttccaaaaaaaaaaaaaaaagaaaaaaatgcttagcgaaccacttctcaaataggagctactgaagttatataagtcaagttattcccaggtaaaatgaataaactgtccacagcattggacattgggcattgaaaagcatcagcatatgcttcactttagagaaaagaaagacagaagcacagtttacttactaaagcagccgctccagtcctccttggaaaccctgaggagtcttctcttttctttcctaccagtcaaataaagaattgtctttctattccacacaggcccagaataaactgcaaaaagggatggcacatgcacagcagcccgtcagggtttggctttggtggggtgcttcgatttctgattgtttcaaaagtgggatcttcttttccggagggagggggcaaaggaagaaaaagaaagcgcgctcggaaagccggcttgggtcctgctaattattctgaaggcaaagtacctgcactctccccgccgaggctggctggcggcgccg

SEQ ID NO: 2454 - DNA, 419702 bp, Homo sapiens; identical to SEQ ID NO: 2452

SEQ ID NO: 2455 - DNA, 419702 bp, Homo sapiens; identical to SEQ ID NO: 2452

SEQ ID NO: 2456 - DNA, 419702 bp, Homo sapiens; identical to SEQ ID NO: 2452

SEQ ID NO: 2457 - DNA, 419702 bp, Homo sapiens; identical to SEQ ID NO: 2452

SEQ ID NO: 2458 - DNA, 741021 bp, Homo sapiens
gttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctgagtttgtttactcaaacagaagtttgtgaaatttgtgtgcttaatcctcaagacctacacacaattagaatcagcatttcatgtggtctttttaaatgtggctttaatacttggttgtagaggagaatgttaaccgtaaggcttggcttactttgtaaatttaacaaaacaacccaggaaaaacgttttaattggggcacacttgttatcatttaacaattgtcaaatgctgacatgtgctagccattgtgcagacgcaaaaagatacaatctctaccctcaggaagcttaggatgctaaatcgtgctttaaaaaaaaggtttcaatctctttccaagagaggcagttaaggaatgatgtgatttatattaaaagagatttctccctcaactgtagccaatccactttaaaaggttaactactagcattagctctcattaaccacacaattgcatttataattaaggtaacagcaactcttccacaaaaatggaaaatgtctagaattgtggataaatattgcagtgcatggaagccaataatcatggcttgagaatttatcaccttcagttacaaaaagtgcagtaaacagaaacatttgctctacatttataaattgctcaaaaatctttgctaaagatcttacaaattcagtaatattacagaacaattctaatcaatatttaataaggttaactacatccttagttagatatttgataaactttgcttttcaataatgccagtagatcttgggagaatgggtagaaaggcttaattaagctacttattaaataactttgaaaatgaaggtccttcactcagttcatggaactggttgaggtcatactgaaacagaacatcccatgtcgaatttgctttatggcccatgttatggcagaggacgtctccatccttctcatgactcaggtaggaggggaaaggtttattctgccatcaagccatctaggatattttatgtaaatgcccattatctataataggagctaagaatacaactgtgttaggtgccagtaatacaattccttaataagaaaaaaaagtatattactccattaaacaagtttctttaggatcttgaaggcctggcaaattatttttcagcttaggagatatgctgtaaagccaagtagcaaacataaagtaaatgctaataagtttccatatagccatatttataaacaaattcaccctatagatgtcaaatatccatactaaggaagtaattttatcctaattaaatacactctagaataatttatataatgatattatgtatttaaagagaaaagcatgtcccaaatccagcactctgatacagctgccagttgggcataggtagatatatatatatatgtatatatatacaaatatatagttatactcagtgaaattaacaagacccaaaggtggtattgtctaggaataaaagggataatttttgttgttcacaaaagtaacttgtctagcaccacacatcagaaaaacacaaaaatagcacactctagttctaaacagctatgtctaaaatagattatatagtaaaaccggtattatacagcatattgtggatttgataaacagataaatatttgcactgagtaggctgtttataatataacattttcttatctatacagaatgaaagccaaaaagttaactgtatagagatgtgcagaacaacattaaatattatgactcaaaagcagggacaggtaaatttgaaagaagagtaagagagaaaatgtttacaggccgttacaagttcttaagttaatagtaaataaggaatcgattgctcaagttgaagaaagcagtaaacaagagattgcatttacatgcagatgtctaaaatttgtattttttaagtctatgcacaaaagtcatttgttttattgcttgacattcagttatggctagattatttaacctattttttttgtactttggaaacaagaatattgttaaaggtgccataaaaatggacaacactgaaaacagtttgcaaataaaccacctaacactgcagttctttatacatattaaaagccttgtctggggtttgtcatatgttaaatattatttaaagtgggaaaatatgttgtagcttgaagcctcccattggcccaaacatccaatacaaaaacacatctccacaaaaggagcaggcagacaatacaggtacatttatagaagcagccagctaatgtcctaatgtttaaaaatttaccactgtttaatatgagatttcaaactgtgtggataacaggagaattttggattcaggaagatgtatacagtacatatggattttttttgtgaaatcattttcactatattgctcaagaattatctgcatttacatatgcaatctgttcagtgataatcaagttcctagaaatagtattcatccacattaaagtaataatgatgaaaaaggaatcacacatgaacactggagagaatttagttgttcttagagaacaacataatggcatgtgcaacatgtcaaagctaatagcaagctatctttcattagttcttagaaggatgaaagtaaaagaagtgtggtactgctaatgtggcaaagtacattaaatgtaaacagcaaacacagatttcctaggcatctatttaaaatattcatattcactttctcaatataagactccatgttatgttgcatcactgacaaaaggttgtttctatttggattgaatattctgtcattcatttataaataaatgactgaatgtatttattgctctaagttctgagggtttggttgaacatggagatcccccccgcccatctaggatggctacttggtgtgaagtcaggcttctggattcttttaaaaattattctgagagcctgacaacactgatctcacctacacaaacagacagacagacccagaagtgaaaccaattgcactgtggagacattgctagtcagtcttctcatctcttaaaaataaatagcaataggaaggtctctataatacaatctgatggaacctctttactaacattatgtttagggatagaatgaagacctgtatcatagactcttaccaatagatcaagatttactgttgcaattgcgtttctgggcacattatttgatctataatataaagttgttttcatggggttctatatcataactttataagaagtggcaatcacatgttatgtaaaaatgtcaacgtgtgtgtgtatacacacatatacaaatacacatagagaggagagatttctaccattttccatattctttattatcaaaaacaacatggtaaaggtatccttttcatcttacagacatgggaagttttcccagattatgttcctctatcatagtaagaaaatatataaatcttcttgtgaatgtgtatcccaaggtggaagaatcagagccaacaattacattgaacttctctgactttatggaaagtaatatgtggaatatgataacaaaacggtatttcaaaaatataacatgtaacactaaatgttggctcgagttgctgctgtcatacaggcaggttttgttttgtctttaaacattagctcttgtaatgcatcagatataaactacacatgtagaagtaagaattgttttccatgaaggaatttttggtttgcttctagaggagaacccatgaaaacaatagttaattgctggtattttaaaaacatatttcatcttttacctatatcactgtactgataggcaggtctctcctcttattactggattttaaaattttcatccttaatatgtagaatttgaaatagtttttaacatatgatgctatatatatatttatcatgaatattttaattattagagaaatggtaactggaatatgcaaggactatactttgaatgatgctctttgctggtacattattaatttatcttttgaacacactggcataactttgctttggaagttattcagtgttttgaaacacaagactgacgagcacatcaagttctaaactcaacaaaatgagacgagagtaaagagtttacacacacgcagttctatatagttcacttgtgccttggagggatagtattattatcattattattaataataaaaaacacaatttgtcccagtagtactggccaccctgttttaagagttttaggagatccctgagcacattgtttctgactcttaaccccaactccaaaatgatagggcttctatcgttgataccaagatggattgtcattcacagtaagtcaattataaggtgcttatttacccttgtttttcaccagtcagcacaaagaactgtcagaaaataactttttattattatcttaaaataatagcattggaaggacatatgatttaaacaatcaatgttggaaacagtggctttaggattattatctggctgcccctcaacaataacaagtgattcgatcgacattccttagccaaaaacaaaaggcaaaacaaaaaaaaccaaaaaacaaaaaaaccccaaaaaactgtacaaatatgtatttttccctgagggatcaaggtacacccgcaagtgctctatgtacatattgcactagagaggaatgaagaacatgtgcaaaaaagcaacaatgagagaagcttacatactacttaaaccttttcatgaaagatactactaggttgttttgcattttggaatgtcggaacacaacaactagctattccttagtctaaaactaaaaacacacatttctactatggcacattcaatgaaataaaaagttttccaaagacagatagacaaattccatcaagaaaataatacaaagtttgtttgtttgtatttttttttttagaaaattacattactttctttctttgtttcacattacaaaatctttttttctttacacaaatcacattttattgcaggaatatttcaagtgccatcaaatatttatagaagggttaaaaaaatagaagtctctctaaagtggtccagacaaggctttgtatagaataaatctttttttccccatcttctagttttgatttaagtattttgaatacattttcttttccattgacacttagtagcctagaagcggtccgacgcacacacatcatacacatgcaaatcacacacacacacacacacacacacacacacacacacactccttcctcacctgaccctcagcccacccccatacgctcacagataactgggtatccacactataaagaacaaccaaacttagaagcagtgtcttaagtcatgtttttcttaagttagaaagggtgaattaggatgctgaagactttaaaaaaaaatccatagctttaatacacgttaagatgctgaacactttaaaaaaaatccgtagctttaacacaatttgcaaactgtccaaaaagcactttcatctgtacttttgtttgcattgtgaccaaggccaggtttttcacaatataataaccatttggacaccattggaacagaaggtattcaggctttgtacaaaagccttatttgccttatgtaaaaaaattgtacaaaggcattgtagcagcggggctgacagtgatgtggttccaatccttaaaagactattggagactgaagtttaggaaactttaattataaaaactattaaggataattgttctgatatcacccaagtattttatgtcatcacataggtgtttttgtaataatgaagaaaggaaaatgcaaagtttttcacatccttttctgagctccatattttttttaaactgaatttattgtttaacatcagatcccaacttagatccaaatagtagtcagttgtttccttgtttcatggagcatgtctctgtctacaattccatcctattatgtcaatcagtggacttggctcttaagctccaccgctgcttttctttcagaaacacctgggaagaagcatcatattacctatcttggtttaccgtaaaagcaatgtcaccatggcatgactattactgtggttagagcatgattgtttgtaggtacatgcagaatcccttctgggaaaaggaatttctttttaagttcatcattatgttctctctcacccttagagaaattcaattagcttttattatttcacaaatcgacactggaattaggtttagttgctctttaatgcgctagcacctgaggctggtcatattcagaaagctttggttaaaaagaagttaatatactttaataaaaccatccccaaatttagtgaatctgaatgacaaaaaaacaaaacaaaaccaaaaccaaaaaactaaaacacaaaactcaaacaaaaacaaaacaccatttccccccagaggagaaacaatagaaaaaaaatggatgaataaataactgaactaagcttggtactcttttcagagtataaatactactgatctttaaaggaactatgcttacttaaattaaagatttgatttaacccttcttgccccaatataaatactatatgctgacagttagcatctctctataaacacataaaattttacatgcctgtaagaaatttaaaggaatattactcttctatttatggttaaactcttactatgtttttggaaaaaaagttggatgttatttaggcttcatacacacatctgtgtgaataataccttccccttttccaagtccctcaagaaacaagtcagaaaagtcagtggagttagaaacagagtgaagtgctctgggaagcccatgctggtaacctagcatgacgtgaagagctgcaattcctgtagaagattccgcagggaccccaatggcagaggagactatttctcagacataaagggctgcatggaaactcctaccttaacacccatcggagatgttcccttttctgtacaaaatggtctttgaccagtagtttgaatcccacccctagtgcgactaaaatcatcgtctaaatgcctacattcccaaaaggtcacttgtttttaaaatatgcacatctgtttatcagactattcctttccccttcccccactagggatcattaaaaaaaaaaaaaccatgaaattaaacaaaaacaactcagtatttctcacctgaacacacaagccaaataatcttctaaatatttaataaaataaattacagtccacagtttcctagtgaagataaatacaagagtaaatgtttgcagctagcatcaacttcactttaaaggcttaaagtatttaatatttaaataagagaaactggttcaacattgtatgcttccctcaccctcctatccatcgtttttcaaatatggagagcaacattcttgaattatagcatctattgacaacaaatctagaattagttcactctgagataaactcatagggttcctagattataccaagaacataaacattcacaaagtaaatacttcatgtcctcacatggggagtgtgcatttgctcaggatataatctttgggtccttcttataataaaagctagattccaataaatattctggttgttgatttgttctcaaagcataagaattccaagttgagaccgagtccatatttaactactgaattgtgtaaaatgagcttctcctccccctcgcctccatgaggtggcattttaaaaagctttaaaaaaaaaaaatgagcatgatggtatatgtccaccacgccaatcaatcattcaactttgtatgaagcataaacacatctatcattaaacttaccaaaaagcaaagtataatttagggagagttccgtttctaattccaaattcacatgttaaaaaaaaaatccaacgtggtgatttctagatatgaccagccagtctcttaaaaataattttgtaaacagcagcataaatacctcccaacgtaccttccaagccttctcagttaaacttgtgtttctggtgcacatgcgacacgacagtgaacacgctagcatttaatttaaagaaaaaggtgcaaaatgaaagtgccttatcaattcaacaggaaaagctacaccagtaactacattttatattacttaaaacaatatataaacaatatctcttttagctatatatagtcttcatgcccatttaccctgtaatatattataatgctattgttgctactgctatggacccttttcatgccatcctgcggactggcaataatcggtgaaaaaataaaaacttccttcatgaaacaaagagctagttgtgcaaagtaatgccgcaacctccgctatgcacaccagtcaccgattattgctggactctctgttgttactgacagattggtgactctgtagaaagtctgtgggcagtgagctacaagaaaaggaaatcctccgactttagtaccctcctcctgttgtaaacagaggtcaatgatcaagaagtcaagacagaaaaagggtccatatctgtaggcataatggaaatcatatgcatgagaaaaacaagttcaacttttatttgttttcattgtttcccctcctttgcctgaccccgatcaccaaaagatgtgcagtgtgtggcgctccaggtctgtgcagggccatataaagtgtctcggttaatttttttgtttgtttttcatgtttgtacttcagacattctagaagtgcttaggtgataacatttacccatcaatttgcattgctggctcaaattctgaagtgaacaactccttgtataatggaggaaaatgaagtcgcacaatgtctgggtatattgctttaaatgccattagcttttctgtatgtcgtccacataaggctcttaaggtagacaccttgcatattaactgtaagtgaaagaaaggacacaccgtcaggcaagaacaggcataagcatcaaagatcagggaacctgaatgatctttatgacattgtttataatggtgaaacacacttaaagcaacttaaacatccagtagcagaggattggtaaaaataaatgatggctgggcgcggtggctcatgcctgtaattctagcactttgggaggccgaggcggttggattgcctgagctcaggagttcaagaccagcctgggaaacacggtgaaaccctgtctctacctaaaaaaaaaaaattagctaggcatggcagcgtgcgcctgtaatcccagctactcgggaggctgaggcaggagaattgctagaacccgggaggtggaagtttcagtgagccgtgatcgtgccactgcactccagcttgggtgacagagcaagactctgtctcttaaaaaaaataaataaataaatgatgatatagtcatgtcatagaatgccaagtatacattaaatatgattttcaagatgaataattcaataactagaaaagatgttcataagcaaaagttggcacagcttgtcagcagcagactcatacagaacccaaggctcttgacttcttctactccaagatgccttctgctctacttcctggaatcctgccttctaccactgtgcaaaaagatgtctagtgatggagaagcgggtgaggggcagtggtgggtgggtagtgaaggcactgcaactggaagtgatggcatcctctacacattttatccagaactggcactagtcaactccgataactacacgtttcttttcgataaggagttttgcctgtaataaagcaatgctgggtctgagcaaaataatagagtcagaaggcctggatggaggccctagcattgaccatttaccagctgagggtaatgacacaatttgcaaaattacttttagattccaaagcacctcacaaaggcaaactgcttattattttaacccagaataaccttctctaggaaatgttttcaccagatcttgtccacatgttaagtgctgtttataatcagagatcctaatggtactcttgcatttgggcaaagagatggagagtgaagctcctgacagggctcctcccttccacttcccattcctgcccgtttgctcatttaacaggtgcaaaatcaaaaagcaaaacagcaattaacccccagttacccctttctggtctaacatagctataaaggagaaaaaaaaaaaaaacaagcaaacaaataaacaagaaaacaaaaccaaaaacttctcacatcatctcacacaataaaatacataaaataagaaagaacagggctgattgttctaagaccaaatacatactactagcaatggcactgaaggatattagcacatttaaaaaattgacattataatcatatttattgtgaaagataatgattggtaaaaatgaaaccttatgctttgaatacagagtagtgatgggaaattgacaaaaatgcaaaagtcatttactgttgatgactagtgaatttaatggaagtagaactaatattagtatatatggtcatcctgattaagtcttttagtcctttataacttcttcctaaattcaaagattataggctgggcacagtggctcactcctataatctcagctctatgggaggtggaggagggaggattgcttgaggccaggagttcgagaccagcctgggcaacatagcaagatacccatctctacaaaaaataattaataaattagccaagtgtggtagcacatatacctgtagtcttagctactcaggaggctgagacaggaggatcttttgagcccagaagttcagggttgcatagagctatgattgtgccacttcactccagcctgggagacggagtgagaccctgtctctaaaaaattaataaattcaaagattatttttacagtttatgtcagtgcagaatattaactctgctttatgcctaactttgatggaagagaatttctagaatgtaactttttttcctacattgccttattgctgcaggacactttgtaatcaacgatagtaagtataatttagactgaataatgagctgtggctcaacagaatttttttgaaatggaaatttatttctttttagtagcctgttgccttctgatacttttgggaattggtcatatgacttacatgaccatattggcagcatgatttgtgccaggggatagttcaggccatgccaactagaagcctttggcactcacctttgttagtattccatcttctcggtgattcttctgtaggacgtgttgaagagctagctgaattttctgttgcagtttttcaatttttaccttttcttgcagccatgagcgatctaagcataaaaaaatgatattctttagcattcctctgacatggtgtcaggatccttcttctccggattcttttgatacggataattatatcacaatgaatatttagagactcagaggccagtttcactcctctttcaaaatttctcctaatggagtgaaaagtgatccaaggaagttataaaacagggtgttaaacctttccatttttaccaatacttaaaggaaggatcctccccttccaaaggataaacaattaaatatgaggccatactcatatgagtgcaaatgaaaccatcatggcccctcgagacgttctaataattatactttggaatgaaatattcattatcgatcctgctagcttttttgaaaaataggaaagttttcttgtaatctttgtcaactaaaattgtcaatagaattccaactgacttaagggttgttaatttaggataaagtctttatgtctaagtcttccaaatagaaggtagtaacttagcaaaagtgattatccccaaacatgcactactggttgaaaacacagattaaattcagataatctagtggatgacatctaaatggattttaacaaaaaaataggatgtcttaaaaatcttgttatcctggagactggtgttaagacaggcaaccctattccaccacagcatttctcttggtatcaggaggttaattctggactggattttgttcaattctcatttctttacattttgtctgaaaggcatgaggttttctcaaaagaatatatgtttgtgttggatgggtggaaaagagagggtgttatttgaagacttaaaatccaatttaataagggtggagacctctcttagtagctcccaaatattttatagctattaaacgtatgggccttgtaaaaattctttatcttagacaattcgaaaaccatttttatttttatttggttgtcttacctgctgacatcagtacaaatgcagaaaataatgcaatttcatcttcagtcaggtgcatagaacataaactctttccaaattcaaacacaaagctaataaagtcttcacaacctgccaaaatgaaaacaaagacagtttagaattttgattattgtcttaggagaaaaacctaggtcttaggttttcctaaggttctcctaagtccaatagaaggtcttaggagaaaaacatggggaaggtgaagagagatctagtggttgaagatcagaaggaatagtagtaacatttctacagtataatagtttaaaatcttaaaagaaaaatctgtttagtcatcaccaccacttccatcacatcaccattgccactgtcatcctcattgaaaataatgagattgaacttttgttgtgtgactactgtggcaagtattgctctaaggtatttctttgggtttcttcttattttaaaacagctctatgaaggagggattattattatcccaattttagaggtaaggaaactgagacttggagaggaaagtaatgcacctaaggtcacacaggtagaaagtacagcctaagaagaagcaaagctaggctgactgatttcagagcctacacttttaacctatagagtctaatagccatattctaactgatatgttaaattaactcatttttgttttcaactctatttcatctgaaacatccttaaaaatgttaacaaatgacatattctggtggtaaaactattataactatttaccaacctgaaaacacagaatgtgaaagtcccctagaataataatccgttttccaaaagactggttaagtttggtgtctattccttcagatttgcatattttacatataaatgtatatatttaaatgacaatgtgctacatgacagttcattatatatatcatctgtcatataacttttaaaaaaatcactcattttagatacttatccattcttcttaataactatgttcattttatttaaattatagaaatccaaaatttattattaattattctgagacagagtctcaatctgtcacccaggctggggtgcagtggcatgatctcagctcagttaaacctccacctcccggtttcaagtgattctcctgcctcagcctcctgagtagctgggactacaggcgtgtgccaccatgcccagctaatttttgtatttttagtagagatgggctttgccatgttggccagactggtctcaaactcctgacctcaggtgatccgcctgccttggcctcccaaagtgctgctattacaggcatgagtcaccgcacctggccccaaattatttattataaattatatatcatggtttcacttaactgtaacttttatttctttgatatctgcatttcagtctcattaatggttactgtttgagggggatggaagggcaaagcttttgccctttgcttaattttatgtatcagctcacatcctaaaggtcatccgaataatatatcaccagcaaatctggtttcttaaaatctggaagggaactggaaggacacgtcatataaatccctttgattaccaactagataaaatgaaactctacatctttacaagtaatgtagacaaaaaacttttgagctatatgacttttctacagtgactaactagaaagtaaaataggtataaaaccccttaatttttgtttctaaataaagttttcattttgtccaagcagagctttcactcaacccgcatcttttcctatagccctgatttgaagaaaaggcaccttgatatccccttacctaaggatttgaagacgtcggggctggcatacttcccatcaaagtacacggtgttgttctgagagtcaaaggcacggcacattctgataaacaccacctctagagaacctaagcagaggcagaaatggtttgggtcatttgggtcatctgatgttagtgagtttgtttctaagctgctcatgtagagactccttctgcaacagcatggtgggtgtcgtgtgcagtttagctagcgggttctcagtcacatcagctgtctatccaaaagggcagagttttctatgtaattaaaagactgttgtgctgaagctaagccctgtttaactgaagtgagggttgatttataaattacttccttagcactcttctacctcgcaatgcagagtctcagagttgctaggaaagcatttattcatatgtactaaaaccaagaatcaaaaacaagtatatctttctgagttctactttcttcttcctaacatcataaactcggaggacttggagtgtagaaacaaaacacacgtgatgggaaaatttgggaatgtaggtgaccttcaaattaatcttttcacccagaagagaagaaaagtggggggaatgtttcctgaatatatcttaaaacctttgaaaagaactccatttctgctaagaaaaacctgagctattatcattggagaaaaactgttcccgacaccttccttaccaagcatttctttaataagcgggtgaaagcaggttaggaagagatctcaaaattcacttgcaaagcacatacctgcttttagaagcacaatttgatcattttgacacagttccataaatccatcaatgcgtttggcaaactccaccacatactgtatagcttctgtaattttgatggcacacaattgccacatcacctcccgctgctgttaaagagggaaacacattaacatcctccaggaagatgttagcttttgtagcagaagctgcagagttatgaaagcaaagcatgccactgctttagccctgggccacgaagagtggcaaagtgggatcttattttattttattttatttttgagatggagtctcgctctgtcacccaggctggagtgcagtggaacaatctcagctcactgcaacctctgcctcctgggttcaagtgattgtcctgcctcagcctcctgagtagctgggattagaggcacctgccaccacacccagctaatttctgtatgtttaatagagacagagtttcaccatgttggccaggctggtcttgaactccggacctcaagtgttgtctgcctgggcctcccaaagtgctgggattacagggatgagccaccgtgcccggtctggatcttcttttaagtaattattttgccttgggaaatttaacaccactttactttgggggaagggagaaaaggagaatcaactgaatttattgtgcacctactatgagctaggcgctttatgacatccttgttttaattcactttcataagaatattttttctggctgggcacggtggttcacgcctgtaaacccagcactttgggaggccgaggcagggggatcacttgaggtctggagttcaagaccagcctggctaacatggtgaaaccctgttcctaccaaaaatacaaaaattagccaggcgtggtggtacacaccggtactcccagctacttgggaagctgaggcagaagaattacttgaacccgggaggcggaggttgcagtgagccgagattgcgccagtgcaagtgtcagcttggcgacagagtgagactgtctcaaaacaaaacaaaacaaaaaactggtggatatgggagccaggattcaaatccaagcatctctgactctaaaatcctatttcatatactttgttgcttcttactgttttcttgcttctcctttgtagctttggctgctggcattacctgctacctcaaaggcaaacaaagcaatgtgttgctattccccaacatgtcctgttaaattccttttatattcgcactctccatttcagttacagaatggtctggatctttttcgttgctaacttgtttccccaatcttagtttcagactgttcccaccgatatgatggggtggaagaaacactgaattaggagccaggagtcaaggtctggtcttgatgtttcactctccagacatgccagtggatgttagttttcctcaaatgtaaaatggattcacttagataatcttgttgatctgggtgttttacagaaaaaggcaagtagggtactatttgtcagcctcatattgctaggttcagactggagttatgatcacagcttctaaattttttttgtatatactccctaatacaacttccagaaacatgaggcttccttgtcaacttccagaaacattaggctgagattattttacataaacttccagaccttaaaatcttgattgtgatattgagacaattctcaattcatttagacttttggaagctgcttaatctattctcctgttgacaaatggaaggaggtatgtgtatacctagaaagcacaatagaaattatttgctattgctgaaattttgcatctgagttaaatggcaaagcctcaagtacattagtagcttcagaaaaaagatatttaaacagaaacctgatgacattcattctttagtctgtgtgaactcttgaccaactttcctataccaacacccttcccaatattgcctcaatcctaggaggaaaaattcctcagatcataccttgttttgatagttctcaatttcttcctgtaaaaaggtctgccacgttatctgctggagctcttctctcaagtattggcaggtttccagatgcgatttagatatattctgtgcaaggtgttctaaggagaaaacgggagatcacaaacacgaaaagcgaagttctttgaataattggtgatttaatatttgctttaagaaataacaagtagaaaacaatgtgctgtgcgagttttgactgtctttacacatttaaacaagtaatttggaactgttttgtatttgggaacgtgaaggaggacagggactttgcaaagccagcatttgaagataagacctgctgacttcaaagaccctcctgactttgcccttgttctgtgcctttataccaatgtctaggaatgaaaaaatattgacctagatagacataggaaatgattgacgtggtgcttcttcttggcatttttatgaagacacatctgccacataacattgacctgggaaggattattcttattcttgaaaaactagaaaatgatattcttttatggtgacaactaggtatttcttttgtttttcctgcaaattgcagaacaagcattactgagggcctaccatgtggctatgcatagtgtagttgtgaagccacatactctggagctagaccatttgagtctgtatctcagctctgctgcttactagctgtgtgatctcgggtatgttatttaacctctttgtgcttggtttcctcatttgtaaaatgagggaaatggtacctatttcacagggctgccatgagaattaaaagagttgagcccttagaatggggaggattacttagaatgtgctacagaatattagttattattatacttgagcataaggagtttgaagatatgaaagacctagaggccaaagaagttttctctaggagcttgtaatctggtgaacacgtatgaacacactggaaggacaattcaagtctagataataaggtataaagttgaattacagaagaagagaaagaaaaaagtaattgaagctgtcagaaaaggaagagattggctgggtgtggtggctcacgcctgtaatcccagcactttgggaggctgagctgggcagaccacttgaggtcaggagttcaagaccagcctggccaacatggtgaaaccctgtctctattaaaaatacaaaaaaaaattggcgtggtgttggctgtctgtgatcccagctacttgagaggctgaggcaggtggatcacctgaggtcaagagttcgagaccagcctggccaacatcatgaaaccctgtctctactgaaaatacaaaaattagctgggcgtggtggcgggtgcttgtaatcccagctacttgggaggctgaagcaggagaatcgcttgaacctgaaagctggaggttgcagtgagccgagatcacaccactgcactccagcctgggcaatagagcgagactccctcttaaaaaaaaaaaaagaaaattatatctggggaaatggaacaagcagttttgtgcttggtgtattggagcacagagaagctcaggcaggaggaccacatagaaggctgctagaatctagatgccaggaactaacaatttggagcagcttggtaataattgttctggaagggaaggatgattaaagaagtattttttaaaagaattgacaaaatcccatgaatataaaaccatatcaaaaaatgatccctctccctagggttttgagtatagaataggcaagtcattttaaaagaacggtgctgaatgcaaacttggcaacactagggagaatatctttttgtttggaaatttgttactgcttttgtcaaacagaagcagacttgtttgtgtgaaaacagagcaggttcacctaaatggagctggaaaccagaatctccttagagacactgaaacataataaacctgaatggccctacttggcaacacatagacactaaaacagcatgaataaataacataaaaaataaaacacaaataaaagaacaaatgtaaaggaaagaatgagaaactgagagtgagagagagaagccagtaaattacatgtcttagaatcaatgacgctggagaataggtgagtaaagacaaaaataatggggagtaagaaacaagaaaatacataaataaggtagtgaactacctcttttggaaagaactctcactatataaggtcgtttctagaatgtaaaccaatttttgccgataaaaaaatgatgaagatgaagagtcttcgcagggaagtagggggggatgctgtggagtgaaggatgagaagaggctcatatcatttccttccaggttatgtttcatttctagttaataagatacttagcatcttgtggtttcactttgtcttaagaaactgtggccacttatccctacctatttaaaacagccaataaaaagtgagacaacaaatcatgcagtgtacctgacataccagtagagggcagtggttgcattcacaccatctgctcaccaacagcctttcattccaattcatagtcgatttggcaagtgtaagattttagacactttgctatttttaaatctccatttcagcaaaggcgagtatggtcaggctgaataaaattcgagaatttaagcgtggtctctcagataaagtctggaatagtgaaataccttgggctaggagttaggagacctggcttctgtctgagctcagcagataatctatagtctacctcactttgtgactggggcaagtcatgtgccccaaccatgactgcttcagcaatacagccagcgcctcgatacttcagatgggaagtcctcgcttctgagttagtcacagattttcatagtgggaaggaactttagatagcatctggtccaaactgtccttgtttaacaaataataatgacattaataattatgatagcagttaacacatatagcattcactatatgccagtcccacataatttgtgtctatcctgaatatgtatgttttctcacttaatccttataacaaccccaagagaaaggtactagtattatctccattttacagaggaggaaactgaaccacagtgaagtgacttcttcaaggtgtcacagctggcaagtagcagagctatgattcagacacagacctttatattctaggagtagagaaactacagctcgcagatgttacgtggtgtatactgggttgtataacttatattaatgccaggaccacaacccatataagcggatttcttgtctcatgctttgcccagtatatcagctgtttctcctgcgcaaagctttagatatcaattatagtaacaaacctaatttgcacttaaaacctaggtcgtttatctggaatgtctaattcaggtactaattgtacaccaagggcaaaatttcctagccaaggatgaagtcatatttttcactaaaagtaataggttgtgcatactacacttgaaagagagaattggacttaggatgtgttggtttataatttattttcctattatacaattggtttcacttgtttaaaatctgatgacaaagtttagcctaaaatgaagtcaagagtcttagttaaagagatagcaggctttaagccccaaaagaaataccagggaaatttaagtagctttggagaagcagcaacaagacttgggccactttcatgatactcttagctccctgaaacactttgcatgtataaatgggataagagaattagagcccaattatatactttccagataaatgctagtttagttttgggtttgggaattctcctagtgatgatctcatttaatttatcttggtaaataccacaacacctgtgaaaaatccctaatttaaaagcacatagagcaagcatgagggggcagggctcccagactgcactggaaagtgagaccatggaagaggaagctgacttgtccgggagcctcagggaatcggctcagccatttctggccccacttcggtatgagtgcattttttagccaaagtgccatgttcaagggcacgctttgcctaaggcctatggatttatttcaggattgaatatttgacaagcaaacaggacagagtcactagtatttatggtaaggtggaggcaaacctaaagtgagtcaggtcatttttcatggtatcatgtcagctttcaatcaaatccttattcatatctgaaaattgtactttcattacagttctgcttaaggctcagccaaccaagatttcatgacaaaaatggaaggtttttgttctagttcaagaaaaaaaaaaaaaaatcaaacctacctctgctcagcttggcttctagttcagaggtttctctgttaatcaaaagagctgcaatacaccttttaatgctgttcagtggttaaagaccaggcttaaaatgtccctgctcttgaggatttaaatttagacccataaagagatgcttgtgtaaaaaccgtaaagaacattcaatttgttctatttggagaaagattttactggaaatataaattttcacttaaaagatgttttatggggtgcagaggtagagaaaccgtctaaagaacacagccattatttctgtgaactgaggatttctgtgctcaagtctgaacctgctgtttcttttccgtctgaagtcttcattctctccttgtattaacttagtcatctccacagcaactaattgacatatcccaaaggattataaccttgtgtgaggaaccaccaggaggagcagatcaaatttaaaaactacaaaggttcttatcaaagtttttctaataatagtgctgtacttaaaaatcgattaaatatagcagcggatgttaacacaacttcctcgaaatggaaagttgcccattgtctgtgttatcaacatttctaggtcacatctcccaagaagcagtaatgttccagcaataagaaaaggacagttttttgtcttttgcatggtgagccttatatgaattacatcaattttgtcaccaatatccatcatcagaacattttggtaagtaaagaagctgatttctgttgaacatttatactatatatcagagttgcaaaaatgagatgcctacaggggctgtgcatatgatataaatggcgggagtcaggtgggcccattgaaaggtgtaatcccctggctgttgccagttggctgttgacattcacaaatgttggctcagtgtaaatagatcattttttcccctcccacaagaagctaaaaaagctgaacttttgggtataattatccaaatttaaatattagcaactgattcaaaaattttaaaactctgccctgggcaaaaaaatatgtctgtgggccaagttcagtttgtggactgccatttttttttttgtcaccttaggtataaagcaatccttggaatataactaaagtaaaccactaatgaagttaatgtagccatttcctgaacttacagttttctgcagaattcaaagactgcttccgttggttttgccccatttctaatgctgagaggtcaatgcatgtattggataaaccatgggaaacagcagagggtcaaaagcaagggggcagggcagaaaattaagtggcccaaatggtaaaggtgaattgcatcatttagcagaactcattagaggaaagtcagacataccccttttacttcaaagggcatgaatagagcatcccaggagaagcatgcatgccattacctaattctgccatggacacagttggggaagtctcgccgttggtgaacgaacagtagggaaagaagcctgatgctggtgtgtagtcacatattggttctggtttgattccattgatatcaagacctgactggtctggggaaggctgtatgtccaggtagaagctgctgacggcggagtctgccttactcccctcaggggtgtgcccgtcaatgtagttactgaggtcgtcgtgaagttccgtcagcccgttggccgagatgttgtaggtgggcgtcagcggctcagcctctccaggctgctgctggtggtcgcgctgctgctgctgcatccggtgtttctgtacttctgcatacaagctgtctctctgcttttttgacattcggccaaattttacagctggaagaaaaaagccaaaccatactacatacaatgcgcttttcttcaatattctctcctgcgagctttggggtttcctttgaagtctcacacaatctcaatccaaaactgcatgaccacaaaataaggacatattcagaggtgaaaacagttccaacccacacagactcgctccagctccccaacagcaaacacacatcccagagaaactcatgtttcagaaagaggcctggtgcaggtaggaggggcccagagagatgccacttctgtttccctgctgtcacatcccccgtttccactgcgccccactgataacttaatgggcttgttcactctccccccgtgcagctggcttaggctacctctttctctcccacgttcagaccaaggcacagggaagcaaagactcacagggttcatcaaggaataagcagtcaaacctcagcgttcattcagttcaccgtcttgtacgctccgacagttctccctgatcaaatggccacttctgcagcttcattgtgaggtctgaatgaactggatgaggcctctgtaattctttgaattacatcagagtacctgacctaagaagccccctcctccagtcatgggtcatgggtcatggcagcccctgtggaaccctgagacccatctttatttttatttatttagttagttattttgagacagagtcttgctctctgtcacccaggctgaagtgcagtgatgtgaacatggctcactgcagcctcaacctcctaaggtttgagcgatcctcccgccttggcctcctacgtagctgggaccacgtgtgtacaccaccacacccagctaattttttcactttatgtagagatggagtttcgctatgttgccctggcttgaggtctggaactccagggctcaagcaatcctccagcctcatcctcccaaagtgctgggattacaagtgtgagctaccactcccagtaggacccatctttaaacactttctgctgttcccatttagcctcaagtaatcacagcatcaggatttggaaaggacaaatatggtattataatataagatccttataatgtatgatccttgttgggcagatttctgtttgtaatgcttctctttgggatgtgtccccatatttaaagtggagcagtcactataatgaataactttccaattcattcagaatatcaaatgaattcttgtgaaacaccaagataactgaaaacaaaaacacacaaacaaaaaaccctatgatttcctggtctgaattcttccatgaactcacttatttttcagctagactcagtctttgctggagggacttagttctcctaattgattgtggttaaatttatagctgatggggtggatgcattcacccatttgactatgatcgtagttataagagtctagggcaggaggcaggatagatggacacgaagttgggaaccaaggccctcacagtggccaggtggtgaattcttttcttgccaaagaggacgcgctgtccttgttcacagaggaaacaggtgagctggaatactggtcactttccagtttccacaactcagataagaaacttgggtggggctgctcaggcagcaaccaggctgatgtgggatctgaatttcagaaccataatttcttaacctccagaattctttctatgcctacaacaacttgtgctatttcttatatgcaaaattttcagaaggcatactgaaggtgcttaatttttttgaaaaaaattttctaggacactcaaggggcctaatacccacaggtgaaactttctgctgtgactccgcaattatgatttaacttttgtattaatattaacgacagtaattatatcctgtaagtgaaataaagggaccagctcttgagaaaatgcacacacaacttgtgatttaaacttacaaattgatgagatatacctaactttgtcagtttagtaccatcggaagatgaaatctgcagagttgcatgtcacaggaatttctgagaatatggtggaagttctgtgatttgtatcttccaatgtcaaaagcttcacttttgtagtggtgcacagagtgcctcttagaatacgcaggaacaaaagtgaactcgtgcctatgtagatctacaggcgctaagaacatcagattatggggaaggcagactgttggaaagcctgctccgcattctgaagtatttttccacaggctgaaattccactggaggagacattttccttcaaagggatctcttaagagagccagctggtatatttggaaaaatccttaaaatggacccgctgtgctttctgcccagtttccacgtataagcataactgtcttgaaatctggtgttgattattcagtgcacttaagatagttttccaggaagatcttgaaatgttttgtacttgaatggtagacggtctctattccttaaagtagcttcatttaatgaaaagaacacttgtcattgagccatgctttgcactattttcacacattctgtatgtacaaatatttggctttggcatgtgattcaaaatatccagttagcataaaagcggcttcatcccaacctccaatagacttactagtgtaaagcaagtaacagttgtggttcacatttcctgcaggggaaaatgcctagaggagacatctttattaaggccttcagatgacacttaccgtcagtcaatcgacccacctataatggctgaaatatcaaaaatctgaaggtgttctgagcacaagacacttctcctccacaccacccccacccatcagccagccagctgactctgaggatgaggaggaggaggaagcagctgctgtgagttccatgtagctgccagaggagcatggggggcggggcgtaaggtggaataatgaggagggggcaggcggggcagatattggcagatctgagtccaggtttcagaaggcactttcacaaccccgtgcaactgtacaactcaagctgtgagagctcaccatctcgagacatccctacggcaaggcatttctgtaatcgacagtgttggcagcggtttctactggttcgatcaatcaaacagttcttctgacgaggacaggagtaggtggcattgctttgctgacttctcctgaaaaagccctgtgatatggttataaaatataaaacaggttagtgtcagaatgagtggtatgatactaaaggcaggatgctaagcactgagtggcattaatatttaatggagaattaaacttgtagcagaatcatccaggagaccattaatgaaattaaagtcacttctttttccttgagtaaaattgatccccagagcctaatcctccatcccttatacctgcaaaactttctttaacttcaacagacagttgcccatgtaaaaaggcacaggaccaggtccttgttcttggcttctgatgatcaaaagcaatgtgcctgatggaatgatacaaaaggacttacctttagcctttatctctaagagattgtttgtaaaataaatacaaaacacttccctggaatatccaagttaaggaaaatgcagccacaccacaacctagggcactgtgaacctggtgaaccatggtaatcttcactagcccacttcaacacacggccctttaggcgtttctcactccccaagtctgaatctgctatcgcaagcattagataacacttggagggattattttggcagatcagattgggaatattccctcatccctggcagtttagaaataccacatgttcagaaccatggcctttaaagatggaacaaatccagtccaatgctcatcaagttcctctcgtgtcaagtgctgtttgggaaatgagaggggatacaaagatgtataaggagctactgacctcaataactttatttttgtttgtttttgctaacttcctgagctgtattcttagctgattttcactgtttattcttagagtgtcaagttttccttttagtgatgttttaacagcaacccaaaagctttactacgtagtattttcattctcattcagtgaaaaacatgttctaactttcaatagatttcttcttcaatccagatgtgatttagaggcatatttcttaatttccaaacacatgggggctttttttcgggggagggggcagggtcttgctctgtcacccaggccagactcctcggctcaagccatcctcctgcctcagcctcctgagtagctgggactgtaggtgcacaccaccatgcctggctaattatacatacatacatacatatatatatttatatatattgtatttatatatatatttatatatatatttatatatatttatatatttatatttatatatatttatatatttatatatatttatatatatttatatatatttatatatatttatatatttatatatatttatatatttatatatatttatatatatttatatatatttatttatatatatttatatatatttatatattatattatatatattatattaaatatatttatatatatttatatatatatatttatatatatatttatatatatatttatatatatatttatatatatatttatatatatatatttatatatatatttatatatatatatttatatatatatatttatatattttttttggtcgagatgggggtctcgctgtgttgtccaggcctgtcttgaactcctggccttaagtgattctcccaccttggagtcccaaagtgttgggattacaggcatgatccacctttttatctttttattgctcatttatctttcagtggctttgcaagctagggatgtatgcagaaaaaaaataaggtaagtagagtcatttccatgaagcaaagccatgaagggtacaaaagagaattattaccttcaaagctttagttgtgaagatagatgaccccaatgagggcgacactagtggggagaggtaaaatcctaaagaattaacagagtggtaggcaaactgataagggtgctctcccactgaacgatttttctggaggtcaatttggcagttgtatcaaaaatttttaaaaagcctacccactgagctaggcttttaaggaatacacgttaaagaaatatttagaatgctacaaagattttcctacaagggtgttcttcacagtactatctataatatagagaatgtagaaagatcctaactgtccaacattactgaattaaaagagtcatattgtatactcatacaatgggattcaaccactacaaatggtatttcagaaatataattattgatataaaaggtgataaaaatataccattgaatgtttaaaaaaggaactaaagagctaaacatagtataatccaagttttgtggaaaaaaaggacacccatatatttactataaaagaagatttggaaaattatgccccaaattgttggcagtagttggtggggccaatcagattttatttttctttttgttcatctgtgctttttttttttttcccccctacaataggcagatgggaagttatggtgggcagcttgagaagaagtgcacctgccttcctttgtaatggctgggggcctttgtcaaccaagttgatgtatatgacctcagtttccagttctttggaaaatccaacctgggatgggacagggcaggaccctgacttctcactcctcttgctttcagccaaggtgcttgctaaccttgacatgggcaaggctgggggcctcatgtctcagactgtctctctgttgtactttaactctacccttgatcaagtcccgcctcttctgtaaagcaatctctctcttctgaaaaatatctaaagctatgttttttattttattttattttattgtttgtgtgtgtctgtttcccctgtgaaaaggaagtaagaagaagtaaggctttctttgggggcttactagagagaattcaagaaaatataaatggtcacagaggcagataatccttagaaagagataccaagaggtcagctgtctaggtattcattttcccctgagacacataatctctgtccaagctgaaaggtgtttatctctttcttgagactctcccaccgttcatacccttgtgtaaaggcatcactgtggatgcttaaaatcaggaatgtatttgtttttgctttagctgaagttgagttttgtttgcttcacattaagcctgctacagtttcttgtgtgatcaccgaatatgaggaatgtctgaatgatctcttctttttttctttaagtggagctagtacttgagggctgccatgctatttcctagatatctcttctgacgaccaaatcccagcatctgtcacctttctttctaggctcttttccaccttgcatatttcttctcagaatcctttccaatttcttcactacttctttttttcttttttaaaactgaggcagggtttcgctatgttgcccaggctggtctcgaactcctgggctcaagcggtcctcccacctcggtcccccaagtagctgggattccaagtgcgagcccatgtatctggcattatttcttcatttctttcaaaagtctgaagtccctaactagacatagctcttgaataatggttgggtcattaatgaaaaggatgccactttttagtttgcatacatacattaagttaacttccacccaccattaataaagtccaagactgttaacatagaagcatatattaatcatcagttagctctgctttaagggcatgaggatgatgatgacagattatcagtcttactgagtacttgtagtaaccatatctttttattctgtattttggatgcagacatcttcgggctttgcagacactggagggactgcccttgcagggctggataactcctacatacagcaaacaacctgctgtcagccacctctcacacaaaaccaagtgggctagagcccacacccagcacaccttcttcatcaggcccttacgcttctcgccatgattcccctgccctggtcaccctagggctaggtacaagacaattagggacagcccctacctcctagcgccgtctgtaatgattcagactagctacttatcctaatcctgctcatcctgctgcaccttccttcctgtggaaaacaccatggaggctcttggcagtgtttccccacatccctctccccttcactgaccctggcgcttccccatgtgtcccctgtatggtgtggcatgggccctgtctctagggatttgtgagtccagcactccctccttaatcgtcgttttgctttcctcgtttcagttacttgcgtcaactgcagtaaaagaatattaagatattttgagagagagaagggaagcaaagagagaccacattcacataacttttattacagtatattttaataattgttctgtattattattattgttgttaatctctcattgtgcctaatttataagttcaactttatcacaggtctggatgtatgggagaaaacagtatctaaaaggttcgcagtttcaggcatccccatgaggctaaggggggactactgtgtaacaaacttcttccttcatgacagtcatttccagatctgtgtgtcttatggtacctgattaaaacaaatcccaaataccattaaaacagcactgacttcatactaggcactctatgctttatgtggattgtgtcattcacttgtgacaagggcaatattgggcaaatcctatcattcccctggttttaaggctgaaaaaacagaggcttagagaggtgtagtgacttgctcagagtcctcgctgtagcatggggtaaagccaggatatgacttcacatagtttaactccagaacttacactgtcatcttgttttgtttttctgcttctcttgtgtgtcaaaagaattcctccttagttgttctcatatggggcaaccattaaattaggcagtgtaaaaaacaagttatgcagaataaagtagcaagagcaatctactctgaaattagtgttttccctcactttagcacctttagctgacccagcttcctaccgcccagacattttacaaaaatctctctctggagttgcctcctgatctggattaggagtcacataagaaaatcagtctcatgagtccatcatttttcctcatttctgaccagaagtattctgccccatttgcttcaccttatttctaaatcactctagctcatttaaacaaacaaacaaacaaacaaacaaacaatgaaacttactgcaagggcacagaataactatcattaaagatgtctgtgtaattatgccataagttgcaaggcaaactcatgaagcattccgtatgttctttgagcagtggcactgtggctcgaaccaatgtccagcttccacactctctgcttggaagaggattacccttatttggaagtctcagttttgaggatttggggaaagcaggcacgcaagcagacacaccttattctctacagcatcatttatacctcaactaagtcagctgaacaaatgcctgctgaaaagttctgggagtggcatagctaagaaccagaaaggcgatctttcttttggattaagtcaacagagtcatacccacaaggagaactatcaaatatcagatgcgagaggtgaagtggggttataaggtgagagctgagaagggagaaacagggtgagtaaacctccatgactcagacgaatactgaactttgcatttcaggaagaatgagggtttgggttgcttctttttctttttaaaaacctcttcttttcagtattccttggggggcggggttctcagaggattaagggtttggaaaattaaacagataagatactaagagttaaataacacataagaggaagaaggattagaaagaggaagaagaaaagtagaaagtgtggtaggtaccttcctacctcaaggtagaagtagtgtgtttctaagtacagagatagattttgtctgattggggagaaatcctgcaaaaggattaggaagtgagtgagctgagagatgaattccagggattggaggtcatacagagagcaggggaagcacaaaactagggcatggagttttgggtggaactgaggaggcgtaaaaaaaaagtgctgaagttgtgagctgggaaaggtatcaagtacataatttggcaattttgttatttctaaaagataagctaacaaattacttggctgtcataaaagttcactttttatggatgttaaaatacatggagatgttcatttacaaacatggtgagcttgagccagagagccaccatgatacatttcaggtagtatacgtttagtgtgactgtggcgcactaccaccacctagtggcagcagattaccatgcagctattgcaaatagaaaattagaataaaacaaacaggcctttggtgctgaaagactttgagagattatcaggtacagcagttgacatataggtgatgcatcagaaacacccacagagcttttaaaagatacaccttagatatatcaaaccagaactatatatcaaaccagaaacttttggcgatgtcgtccaggcatacatagtagtttgaacaatgagaaattcccatttttataagtcaaaaaagaaaaaaattgtcatttttttttttttgagacggagtcttggtccgtcaccaggctggagtgcagtggcattacctcgggtcactgcaacctctgcctcctgggttcaagtgattctcctgcctcagcctcccgagtagctgggactacaggcgtgcaccaccacaccgagctaatttttgtatttttagtagagacagggtttcaccatgttggctagcatggtctagatctcttgaccccgtgattcgcctgcctcggcctcccaaagtgctcggatttacaggcgtgagccaccgtacctggccacaattgtcatttttatagtaaatattttttaaaagctccccgaagactttgacttccttttgttaagaaccagagattgattcgagttttctgatttgccaaaaacaaaaatgaagtttagaatgttaaatgacttgtccaaggtcccatggctgggactcaatctcttgtcctgattttaagtccagtgccctcttacttatatgtatcttcttcattgtgggacaaacaaaacaatgtcacacattctcgatttcctgacacagagtccctacatatccaccttttgtttcaattcctactgtctcaaagacatctctccagtgttcctcccttatttcacctagcttttcaaaacgccttgtgcttttatttctgatacgtgtcttaccttctctggaaattctattccctaatactttttctttaaaaaaaatgactgtatactatgaatttttcactgatcccattagatgggcgcttggcaaactgggacagaggccatggtgtttaggagaaggctcataccaggttgcaagagctgagtgctaaaatgtcaggaattttgttattaaggctagttattaaatctgttattacacattaactgatgcattcctgacataaaaaattaactactttttaatgattattttactgttatcaatgttcttcaggttgtctacatcaattatccttatatctgaaggtggaaatactataccatgctgtgcatcccttccctactctgtattctgtgaaagagcgggtcgggtggcttgaaaatggccattggtgggattatttacaccacagaaattggcaaatgttacagatcagggtttgatttattattttgctttattgtctagatttaaaaagtgatggcccaatgcagtggctcatgcctgtaatcccaatactttgagaggctgaggcaggaaggtgatggcccaatgcagtggctcatgcctgtaatcccaatactttgagaggctgaggcaggaggatcacttgaggccaggtgttcgagaccagcctgggcaacatagaccctgtctctacaggaaataaaacaattagccaggtgtagtggcatgtgcttgtagtcccagctacttgggaaggtgaggtgggaagattgttggagccaggagtttgagggtgcagtgagctatgattgtaccactgcattccagcctggacaacagagtgagaccctgtgtcttaaaaaaaaaaaaaaaaaaagaccaggtgtggtggctcacacctgtaatcccagcgctttgggaggccgaggtgggcagatcacgaggtcaggagttcgagaccagcctgaccaacatggtgaaaccctgtctctactaaaaacacaaaaattagccaagcttggtgacaggtgcctgtaatcctagctacccaggaggcggaggttgcagtgagccgagatcacaccactgcactccagcctgggcaacagggcgagactctgcctcaaaaaaaaaacacaaaaaaaaaaactgatgaaaattataataatgcagattaaacttaacagtacatcatatccagtgctcccattgtgaataacataaaaagtggaagaaatgttcttctggtatttgaaaactattaactgagtcagcaaggaagtggttcatgtcattgttggcgaatgaatgaagttccaaaatgtcttcgttgtttcactcccttcttagtcattaatgtaaacaaaatatcaaccaacattcatgttggaactagtctttcctcagttgtaaccatgcagatagatgtaggagttcagcaaaaatcatgagagcattcagtgagaatcatttgtctatatgaaatttaaaataaagaatattgtatattttattattgtttgaaaattatgtgaaattatatcaatgagatagataccaaagttatctacatacagatagacactttttgctttccagagagccagttgttcacagcttaccagcatgtggctggcctgagcctcatccttgctgtgtcaccagctctccatcacgttgtttcaatgcttccccctgactttggataggcattcacccaaagttgtggtttggccttctagagcccccattgactttctggaacagaatatatatatttagagatacggtctctgtcactcaggctggagtgcaatggagtgaccacggctcactgcagcttcaacttcctggactcaagtgatcctcccacttcagccttctcagcagctgggaccacaggtgtatgccatcatgcctggctaatttttaaattttttgtagaggagacagggtctcgctttgttgcccagactggtcttgaactcttggctttaagtgatccttctgcctaggcctcccacaatgccgggattacaggcatgagccactgcacccgacctagaagagaatgacccacagcctgtttcccagctgtcctctccagtgttttcttgctcagtgacaggcatcatctttccctcagttactcaaggcagaaagatgggcttcacttaatctctgcctcctccccacccatattcaagcatcaccaagttaggctgcttcttggcaccttcctatttctcagatccatctacttgtctccatctttactgcagttttcttaagtttccatgtctttcacttcttgagttggttattatacaaccttccaattgggacccctgcttccattctcattccctccaatccatttcacacagttactaaagatatctttctaaaacatcaaactgatcaagtcacttctctgctgatgagcccttaatggctccctgctgatgaccaggcaatgaccacatgtccgggcagctcttctcaaagtcatagaatgaccaagcgtaaacttctatctccacagttccccaaagaaactctctccttcccttcaggattcactgagaagacattcggttgctctgggaacctctctgacctgggccctctcaaagctggttgaggggcccctcccatgtgcacctttaagagtcctgtatttatccccctcctagcccttaccttgttgtattattaatgtctaccttttccagggcctgactgccttgtttctttgtttccagtagctaacccaatacttagagaagtcaataaatacttgttgaacaaccagaggaaaaaatggtggcagtgataaaaacagtggtgacgatatgctgagcacctgctccctactaggcaccatgttggacactttgccatcattatttgcaatccgcaacaacctacaattggcaaagtagggatatgtatatctgctttacaaatgagaaagttaaacttaagagaggttaagccgtgtgcccaaagtcacagagcaggtaaggggagggcccaggatttgaattcctgaatcctaggtgtatcttattccaaaggccatagacttcttaatacaccacctaaaaagcaccaagacaaacatgtagggccgactgaataacaacaacaacaacaaaagatgaacaaacaacaaaacaaacacgcaaaaaaacacttttcaatttctgtagtccgagttccctacaatggttcagatgagggagatggcattttatagggtatcaaataccaggtttccatacaggtaggaaagcactcatttgtcagataaattttaaaagcctggaaatatgcctggcacttcctactggagttttaatagttttgtctaagttcatgggctggctggacgctgcactgtgggtgtggctgggaaggtgaacgggggtctgattctgagttgtcccctcctgtgtggggctccttctcagtgaaacagaggctgaaatgctgatctgatgtttggtcttttgacaattttcacttaatgaattgattcctacagttcattaacatacccacttccacttctgtatacacatatgtcttaattagctgctcattggctgtttaattacaagaaaacagctgacagctgccttgctgaattctaatggcagacgctttggaacggctacacacttgcttttgacaaccaagatttattcataactctgcgatttattgtgaatgctcgtatgcctgcccaaattattgtattttccagtacaactaaaaatttggaatttgggggactgctgaagtgggtgtatgtctacctttcattttacgtctgagactaagaaaagtagagatgagaaaagcagagaatcttctatgtagaagcatgtactgtgttgcaattttatttatcttggcaactttctgttgagaatgttcagaagcatgggggtgagaaggaagaaatatctctggatcagtgtgggccaaaagttaattatctggctagagggggaaaaagaggataacttcattttattgaggggtaaacataaagggcatgcatggattaaaatcaagcagatgaaattataaaattaaagttgggtgggggtcagaaataagagtcctcaaagaagcatatgaggaaaaaaagttgttctttagaaagagcaggcggcctcattcacgaaagttagctggtccagccctatactcatacatctggcagcaataaatcacagaaattcagatttcctgagctacgtttttgttcagtagtgactggcctccctgtagaattgtatgcgcaagtggtctctgattaaagctgcccacgtgtcatatttggtaagtgtcgatatctgcttttgactgtgctttgccatactcagatccaatacaagtgaagacattcagcaatggttattcccaagcacgcacgagggacctgccccaagccaggtgctgtgtcagggccctatctacaacatggcttcgagccaggcgttttctgtgagctgaggaagggcagcagttactgggacatgattaagatctaaacaaacaaataaaaaaaaatctgaatcatcttgatgcaaattgggttttaacacagccctaccacttgcgcatttcatcacaggactggaagatttagctaaacaaaaattttcgcttactgcctgtgtataacagaaccgaaactcaggcatcgtaaggatgcaataacagcttgtcctcccccaggtggaattttcattttaaatgcccagctctaatactggggccacgtattaaaataaaaatgagcatgaatgtatcaatggtgaaaagtggacagaattagttcacgactagcaacatttcacaactgagataataatattagaatcctctaaaagataatttgagcctaaaaggaacattcatataaagctgctttttaacctaaacataaaaagctccagaaatggctttaactacttcagtgggggaaggtgtcacttatatactctagatatttttgaaaagccttttttattgtttaagaaaatatatttgttaacgcagagacattgtctcaaattatctttagtgggtagaagaggaagctttgaataagacatcatcttaaatgtattgattggtaagtgtatattggacaaatgaatgccagtttgttcttagtgttatcaagaggaaaaggttttaaatgtaatcagaaaccaattcactaaccccaatactggatcgtgcattatcattaaaaaacttgcagttaaaattgtgtagccaaaatatctaaaaggatatggattaaaaaatgtatgtgtgtcttgagatcaaatgttcaccctcatcatctgagcagccactgtatctcatgatgaaattaggaacagaagttgaatggcaaacaagatgatttctcaaaagcaaaccttaaccaatgattattttcctcctaacacttcatatttttattcactttgaagattgaactttaacatctacagcctctagtgttaccatggccttttcttgtgctggcatggggcacgacctgcccctccttcctggcaggcctgccccagctcacgttatgccccctcatcatgctcacccaaggctgaaactaaattcttttccaagagctcagaaatgtctgtatgaacagaactaaaaaccttgcaggcctggattctaacatatgttcttccgaaatgcaatattcaggctgaagcagtgccaatacattgttccctgattctttcaagagaacaagtaaaatacgtttataataaaaaccttggcataatggagtccttaaaaatttgaggatggtgtgcctgtctaccctcatcttccactagccacagaaagtgaccctttgcttcaatcaaactgagttatgtgctgtcccctaaatacaaccaagactgccctttttctgggcttttgcctctgccattccttgttctccttcttcctcagcacagaatgccctcccagccaccttgactgggaaaatccttcctcagctccagcccacggttggttcctcctcaatgaaaccttgctaggccaactctcctttagaccacctaggtatgctgtctagtggatatgtgcttcttttttctttttttttgagacaggggtcttgctctgttgccaggctggaatgcagtggcaccatcatagctcaccaggagccttgaactcctgggctcaagcaatcctcctgcttcagccttccgagtagttgggacttcaggcaaacaccaccatgcctagccagttttttttatttttaatttttttgtagagacagagtcttgctgtgttgctcaggctggtcttgaactcttgtgctcacatcttcctctcagctcagcctcccaaactgctggggctacaggtgtgagccactgtgcccagcctatatgtgcttcttatgtatatcatagattgtggccttactctatattagttcttgcattgctatttagctttccctacacaggcctcatctctacaactagaccataaactgcttgagggaaagatgtggtcttctatgtctttggatcccttacagtgcttacatagtgcttggtcccaagggagtgctcatagtattcttttttattggcagattctacataacacattgcaaatggtcacaacaatcaagactatatccatagatgtcccagaaataatatctgactatacagagcagcattaccaagccaccaagaagtctgcctagtaatgacaatgataacaacagctaacacttagtaagtgcttgtgatgcatctggcattcttccaggtactttccttaaatgcatgtgacaaccctatgaagttattacaattacagtcctcattttacagatgggggaactgaggcacagagcagtggtataggtgctcaagctggtaaatagcagagctgggatttcaactcggacagtctggttccagagtcagagcagaagcatggcacctgctgtctctctacagacagcaaaggggttggggagaggatgaactaggaagagccagaaatgacagaaagagctactaaagcttctaccatttttgctgttcatgtgcaatgcttagcaactatgtgccaaaataattatttcagcaattaaacaggtcctctagtttcttatggtgtcagcttgttaatttaaaaatgcaatttaaaatacgttcacaaaatgattagctcagaagatgactgatcacctttcttctctcattagatatctatttgatatgtctaatgtgaaatttttcttatgtttaattacactatctcagcaaagttatttacaattgatcatgatagaaccacctttacctggttagaacatgataaataattaacataaaatggcaaaaatagaagtcttttgacttctatttttataactaggaataaaagtgttagttatagcagagagaaattataatggagaacaaagagtatatgtatcaaatataaacatgaaacattgttcaagtccctggctaggcataggcccaatctgttaataaaattatgttttatttattttgtggttttcattggataaagtcaacagagcagaggaacagagccacagataactgaaaaccactttggcactgaggaggtatgcagacaagatctggaagggaatctagaaaaatggcaactttggaataatagataccttttgttttcttatcgcttttatttttgtcatgataaatattaagagtaaaaagaaaattcacattgtttgtgccatggtactcagtcaacttaggttttactcaatagcatgttgttaattaatcttccaaattgttggggtatttcatatgaagtagcccctacccccaccttgtcctttccccagactccattcctagataatcacttctgtcaattcctagataatcacttgccttactgacagattcagaggaagccatcagttttttgggcagaatgaagggacaaatggtgaactggtatccgggatgctgcctagaaccctgtccatttaagaagacacccaggtgatacgcaatgcacaaaaagcactggaactcccagcaggcaagcactgcagtctataaaccctctattgagaaaggccatgacatgtctaccagggacacagatttgggaggcagaacacaagacagggtgagggtgaaaagcaatggctacctggccacgtcagccaaatcagctccaaaaatcaatgcgatgacagtggtcacaggcagatcactctcaccttataacctgggatggcacagaccagacagattatttcattttgttttttcattatttttatttacttttttggagagagggtctcactccattgcccaggctggagtccagtggtgtgatcatagctcactgtaaccttgaactcctggactcaagtgataaacctgcagctgtcttccctgagtagctgggactacaggtacacaccactacaccgggcctctcattttgcttaatttatttaattagtcaactaattttgagggagggcagattttggaagtaaagggcatagatggttctgtagtatgcggaaatctgaagctttgctaagatgggatcaacatgaagcatctgtacatgtacaaattagcaaatgttaccatgactaacagtaaaatgaagaattaaggaaattataaggttaatttccttgaagtctctcagtagtcatttgtgtctataggtgattttgtattttacaacattgtattttctaatttcatgaaaggaaagctaaccaaattcgtggattttattttttgcctcagcctcaaaaagccttagggctgattcaggcctggttgtagcaatcggctgtctcaaaggcctcctgcatgtttaaatagcttctctcctgtttattttgcactgttttatcctgtaagctgtctcgaggcccttccaatataagcatgaggatttaaatcttaataaattgagatttgaataacagaggtaatctgggcttggggggtcttgaattattgggataaacatctctgtttctcatctgcacattatgcatgtgctgtacacattgccccatgaccaaggtcagaaataataaaatagtcatagcagaaataatactgataatatttagagttaaatagcacttttctgtttgtaaggacttttttatgtacaggttctccttctattcttggaatagtcctaaccagtagaaagatcaggtgttatacccactttaaaaatgaagcaactgagtgacaaagagattaagacacattcaaaacaatatggacaagtggaggcaataggactggaactcaggtcttcctgatagctttcccacaattttgccagatgtgttaacattatgtgtgctaacaataagactcaactcagtgacattccaattaaacttactggagatgtctttttataagcttatgacagggacattgtagaagtctggagttagctcttttttaaaaaagattgccacagagattgctcatgagttcaactctggggttgaaagtgataaacaagcaatgctcaaatacctttttgtaatctcctattattttgaaggaaggagtaaaaatatatataacttctttaattgtaatttaacaccaaaatatttcttctatcctgtaatttcttatcattcaaaattctaaggagttgaattttaagacataagtggagacatacaaatcacaaagatatattctaacaaacattaatagaaacaacaacaattaaaaaggcttaccttgcagccttcacatgtaatgacaccataatggattcctgatgatttgtctccacagatcttgcatggaataatttcaatttgagctgcaacagaagcacgcaaccagttaattacattttcttttaaacaccttataaaagtgttccctgatcagcatttgtatagtgaaaactaataacctgctaaacattatactgcattaactattcattgctgaactgtgagggtccccctagagccctggactaaattatggctgctcgttatataatagctttcgggttattaaaatgggtcatttgagaaggtgtttaagaacccacaagaagactggaatcagcatttcaaagccttcaagaactggagagttcgcagtttaggcctcagagcaaagcagatactgaaatgtttcctccaatctcattttctatcattatttttaaaagatcataaatctgtcttggctgagcattacagcttgactgctagagaaaaatacactctaaaaagtcaggtctagttaggaaaatgattcaattcaaaatattaatcagttacatatgataagaattccttgtcttttaaaaaattaacgcagttgccatgtgttaaaaattagtccatttgtgtacaatcagaacctttcaaccatagagttaatatcttgtttgaatttaataatgatgaatcctgacaaataggatgtgttgcttctgagttctttacactggaaatttagttcctggtacagagggcatgtgtttctacccaactgattacttaaagatgcctcatgctggaagacccacaaataacatgtatcacaccaaagttctcaaataaggcaaagcacatttctaagcaaacacattatacctcagagttaaaaagagcataattaaggataaaaaataaggaataattaggcaaaagaaaatccttagatcaactattaaatagaatttatatgtgaaataaagaccaatgctgagctgtatagacaggatgggaacagtcaccagtttacctggaatgtgtcattacgctaaattcattttccatggttttcactactgggtatcatgttagattacctactgagttacacacacaaacacaactgcaagtgcccaagtctatttcatttctgtacagcccttacctagccccagaccttacacagagtaatttctttgtccaaagaatatgtcacatagtgtaagtaccacacagagacacacagcccactctttcttctaatgtaatcccatatcctgggatgatttcacaaccacttactttggatttaaggtgatgttgcattcgatacttagagcacacatgaaactattggatttaacctcattataaaccatgtgtactggtaactccctttctcagggcctaatacaagtactgtggtgacttttagggagtgcaagctattctaaaagctatccatcatttttttagtgcttgcatactgagtttctttgctgtccaaatttagagattgttccagatctcacatccagtgtattttctatactctggaggctttctaataccccaataatggtgactttggacactaataggtatagtttgagttaagcaacttaagcaagttaatatgtttaaggttgcattcaacaaaagttgtcatttgcaagtctgcctcatgttaacacttggcttgacttcttcaagaaaaattctttatgaaatatggtatctaataatgtctcatactgcacagtccttccattatgtttaatatagtcaaggcaaaggtttgtgccacagatctgcaactctagagaaagcgagttacgcctaacatttttcagagacgtggaaaagccaagtggaagtagagaaatcctgaaaggtgctatcagctgagagttattgcctgcttttccctacatgaattgagtaggctagaatgagaaccagcctccttaccctgattcctaggaatgtaataattaggcaccatgaagtccttgaaccacctgttaaacagaatttatacatgaaatgaagaagacctacttggagctgcttctgtccatgtctcacctcaaggtgtaatgacagaaattagggatgaacaaaaacctctttaggtcctagcatttaagtcagcatcaaaactacctgacgctaaacttgggcctttcaagagttatcttcattccatcttaacaatgagggagatcaagcatgtctatttagtcctttacaagaatatgaaggccctgggcagggcatattgagaacaatgagtagaactgcatctggacaaactgaaaatgatatgcagtattcctgtacagtcggcctggactcacagtggattactaattagaagtgaagcaacgatgtttaaggctgtgaccaagatgcctgcctggcacggaggtctgctcatgatgggggtggccttgggagtactatactggccccagcacttccacccttggaatggctcatgtcctggcaggggtgagggtaggggtgcgggtggggagcagttgtagtacagaccccagagtttggtgccactgtgacacaggactgatggcctgagtcaggcttcagcttgcaggggttttcagatctggaggatatttgagcggagacagtcacgagatctgtggaggccaagacgcttaggataaatggactcactgtagattgacttgtatttccaaacaggggggccattcacttagatctttgtccccatgtgtctgtgcttagttccagtgggctaaagaatcagatttaattgaaacaggcttcaccgggaatctctcggtaaggtggtagaagggtttctggatagcaagttgaggtattctgattggttaaactattctcctaggcttcctcctgcttggttctcttatctcagatgacaatttcagttgcaaatgcactttaggaaatgactaaaatcctcctactccaaaagcaaaccctctgaatgtgatctgatcacacgtgttgatattcccagaaagcgagcatttgcagattggagcagggcacttgctcagcccttcatttaacccaacaatgcacaaaagccctctccatcccccattttagtcaatttccagaattcaaatgaatccatgagaaaaaaatgcagtcaatgccttgcaaatttttcaaaaggaggcagtttagttttgtcaatttgagttttcagtccaacaagaaggaggaagacaaaaatccctctgccctttgcctttcatcgtgtaggcttttcagtttcccaccaggtagtgtggtgtcttctcaaaacaatcttcttttaacacaaattatgaatcttggcccatatatatactgcacacattaactcagccagcatttcaaaggatgagttctgtcagacagcactactgtcaacgttcacaagtatattgattaaattagcccacatacatattcatcccagcaaagaggtttattgtgtagtggaatatctggagcaagatgcgcacatataatcatgaattggcttcacaatgaacaatcttgctatgaaaaattctaatttgcccacattttcagccctattgcctaaataatttgctctctcatgcaccctgtgtaattcaagcaggctctccacacctgcagaggcaaatgcagtttcaaggagctgacaacaagtggcagcgggcatcaggaaatcctggaatgcaagggtgctaattaaccaagtggtccttggggctaggctgtcatttagcactgcacttctagaagaagtttgctttgaatttttaattataaaaggaacaagaacttgggcactagcattcttaagatgacatttattcctcaggacctatcttaggagataacatggtccagagaacaatgcccattttcccaaagaattaaaaaaataaaaattgtatgacaggcacccagtacttcattctgtgggtgagtagtgatctctcaataataatctaatttataataataatatctacatgtatttgtgctaataatgtgtcacgcattatatctcactcactcctccaataccctatgcggtaggcatcacttacttaattgttactgtcatcattgtcatcatcatcattgcactcttattaagcaatcactaaccagggctcaaaagacatcccctaagtagtttgtttaaacttaacacactactcaggaattgatgtcaacatctcttgctgggagttatccccgtagtttataactaaaaataaccatcaaccttctaggccactgatctcagtttcacaaaattctggttagaattttaaccctaaaatgaccaatgtcaacgtttgacagttcttaaggccgggcagattacttaacctctctgagcctcagtttcatacttgaagattcaaggatgtgatacataaatgacataccatatatatgatatctgtatgagcattttatatatgtattctctatatatgcccatcacatagttcttagaaatagctggcactcagtaaatagtagttattattattgttgttgttgataagaaatcctgccttatagtgaaatgaaattctttcctccagactttaagctctttccgaggtggggatagagaaaagctgcttatcctccaaataacatgacaggcagttcctaccagctaccacagcaatccttcacaacattgctgcttaactgtttgccacaacacagtggtatgttgcaataagttgcaggagtgtcacagggaattggttactaataaaagttttacaaaattaaagttttttattggttcacataaaaactaaactaatatagacccaaggttaccccaataatatcgttcactctagctcaattgcacaaccaaatattttcttgaattggactgaatggggtggggttactgctggcttgccaggaaacggccaatggccgaaccttgggtacacctatgagaacatgtctgtcatacttatgaatgtcaaccaattttgtgtgtcttgcaaaaacggtcaaaaactagtgctttaaaaagcctatctatcttttacacagatctgttgatggtgtttttttctggagtgcagagaatatggaggacttttcacttgctatgttagatatttctctaatgtttgaattttttacaaccagcatgtattacttttctaagcagaaaaaccaataaagattaaaaagaaaaaccctaaggcatttgattttattttcagtaaaatggcttgagtcctttatggattagtcactttattttatcccctgtttaaaactgccagggtattaaaggcttctgcagctgcctgaatggcggcctggcttgcgtgtcaaggttagccgggggagagctgcagagtcttcaccttattccctggagggacttcaggagcaccaggcttctagaattttgtggcccccttgtttcagggcttctaaagatggtcatgcaggttgtgctctgcccagtgcggcctagctgaggggtcaaaagtagaggttgaaatgcacctggctgtgagccttgctgcagagtgactgcaacagcctggagagaggaaacctttcttcaatctgtctacccagacaagctcccttttttcaaaccctccttccaggggtagtgccccttctctacagtgctaggagtggacagttcagggagcaacatgctttctctccactctgccatgggaggccccaggacaccataagggtttgcagagagctctcattacatctccatgtggaaggggaacagaccatcgacctggacctgtggcttggaatagagtatgggtatgttccatagcacaggcatgttcaatggccatcagggatgagtagagccgagttatagctgcatcctatgcaaactaacgatgaacttgtttggccacttggtctgctaagttcattttaaatataacactaatatgtttccctagtacattattttcttctcttgattttggattctttcatgacagtatttcatccttgctgaacctcaccaaaacaattagatctccaaatagaaagccctactccttcagtaagcagtctcgcagtcatttttggcaaaaatagtaatgcctgagtttttgcagaattctatatagttttcaaagtttttatccttgttagcttgctttgattttggtgctttcaacatccctaaaggaggcagataggtattatcatccccattttacagatacggaaaatgagcctcaggagggttaaatggcttcttctctatgtccagatttcccagggttttgatgtagacatagccacaagaaagagagacttggtgtctctttcctattcaagattatttgatgtgtttagatttatgccatcactgatctggggctctcaagaggacatgacaccaaaaagaaagcactgggagtcaattcagctaagaggtggagttggcccttccaggtctccctctgagactgaactccctgggtggcctcaagcaattcacttacacctccacttcctccatccataaaaatgggaataattcttacctcccaggcaggtggtggtaaatgagtgctcacaaagctctttgaagatgaaaaacctatataaatgggaagcttcaggaagcttgccacatcattcatggcaaagattgcgatgctgtgtcctattacccatatccagctatgccacaaagagaataaaaattacacagtaccataattctcatctgctagctagacttacttaaatgttttttaatcattggtttccaagatgctttcccaagggactgatgggtccagatgttactatcttattcacaacttagaagaaaaagagcacttagatggagaggtcgcctctctatgcaaagtccttgacctagctttatctagggcttgtacggtcttgtcggggcatcatggaaatggcacgattcccacttgttaacataataaacatatatgtcaccctctgacagacatcccaagccttattattaagttgacatctgactcaaatgagtctatcaaattatagccattaaaaaaaatgttctgcatcttactaaacaagccacttctcaaaaacttcaactggattgtaatttctccggaaaacttaatggctttaaaaaaaacatttttcaataaaaagtgttgagtatacctgccaaatgcacacacacacacacacacacacacactcctcaaaccatcaagagatcaaacatttgtgaactaaatttaaaataagacaaaattgaagttttggaactttgacgatttttcttcagtcttttaaagacttagttgtgtaagagttaaaatactgcgccagaatgtcccatctgaattaagagaaagctgagctgtgtgtgcaggaaatctctgaagaataaggaagccaggcacatcttctcatgtggctttctgtgaatatgcaggtggttctgacaatgggaactgaatattaatcctttgtaatatatttccatccctactagattaagctttctagagaaactgactcacattccctgatgcatatgtatctctgctaaaagccaaatccaaatgagcacttttatccctagacagggaaattctgtcaaatcagagaggaaacagatttttcatctagaagaacagtgggtggcttttttagatccagttctctctagaattctcctatcacatagtagtgcacaaactgtttaaggcagttgactctataccttttttggtatctacctggtaaccagtttaaaccttgagtgaaagacctgaacagcaagagaataagcttcctaatacttcatcctactcatccagtgggtcagatactaaataagtaagttctcacccaataaatgataccaccaggatcagcaatacaatccttttttttttctttttgtttttcctctcttttgcctttgtaaacaacagaacgtatttgttgttaaggatttatggggttatgtgatatcaagggctaagataaaggtaattggctatttaaccaatggttctcagttggcgtaaggtccctctaagattctagaattaactacattttaaaatataaagtccttgaagattttctaggaccctgggatcagtaacatttaacaaaagtcctctttctctagaatctctcggggtgggttaaatgtcatttcatatcagcaggaaagagaacccatttattttgctaagtgattagactatgctcaagggaaattcctaataacgttgtttccaacaatggtgtcccttacataattctggataatactagacaaaaaaagtcatctgactcacagaactgcatacgtattttcttgcgatcaacctcactctagataccaattcctttttttctccttaacaggaacaattacgctacatttaggtgaaatcctccttacagctgagagcactggggtcaactctttgctttcattgctcaaggtctgtttttcacaacagaaaagaacatctttaaaaccataccaaatctggtgatctagtttctgctcaaccgaaaacatcagaattacacttactgcattttatgaaacaatcttactttaaccaattacccccaacattctcacacctaagcctacgagaaaaccactccactttgcagctgtcttaacttcacaccaaatttcacataaccccacaaattcttaacaaccattgattactaattccacctgcacaatttccatgaccccccccccccaaaactgtgcggtcacaaaacccagctgcatgaagtaagatgtgcagaaatgggtcaaaataacaagaatccagattaagtcataaaagcttaccaggcaaaggaacccatcatttctttccatgagctccgatggcattctgaagatctgctactgctcattgaatagatgtcactcaagaaatattccccaactaaataaactggattcatggtaaaagattggaaataacttagaacattaaaccttgaaaatgcatttacatccctctatagcaagcccagaacactaaaaagacaacatatttatagtcacaggaacatggtgtcatgacaccaaaacttccttggtccacagatcattttagtgggtgaggactgttaagagaattagcccacagcctgtatttctgctccacctctgtgctgttttccatttcaaaaaagtgtccttagaattaataagaggatgaagctttggatgagagatgagggaaggatccggtttttattaaaaatcacaggcaaattatttaggcttgccagaagcggaagtgtaaatgttttcatattaaccactttaagattgtaagatcttgaagaattagaactcctagaaattcaactagttccttcacctccagtttccaggacatggtcattaacatctaaacaaaaaatatggcaagttctaagcctttcaaatacatcacagatgtatttctgaactgtggctcaatggtatttcaaaaaattctcttttgtaatgcttttctaagacaaccagttcagccaggcatactaatgaccaaacaacgtgaggacttgtttctgactttccctaaatgcatggtctttaaacttgctgattaaagaaacatttccattcttaattacaacatataagctcaacctgagaatggatagcaatatttgtggatagctgaagcacagttatttctgtgcctattcccaaggggaagtggcaggagctggtggctatttcttagtaggaaagggaaatacagaaagaggcagcagagctttggggatttaagtagttgcgagacataaggagaagaaatgctctggactaagctaagagattgtcagatttattttaagaaggtctgacatctgagcatcaatgcacacactataacacctcataaatgtcatttttttccccaagaaaacgaaatgtatagcctctgtatttatcttgaagccacttatttttatgtaagtcatgcactagaggcaaagtaagaacacaacagccatgtaaagatatcaaaacgaggcccgcaccactgtccttcctattccattttcagtttctgctcctctagtccaaggtgcttcttttgcctacagagacaaacatttcagatgacattctatgactgtcctgaaaacactgctatcagctatccactgtttggcaatgtgtgtctctgtcacttaagatagcttgagtgagtgagtgtgacattatcactgcaataagtgaatctttctaatttgcagtaaaagtataccattcacacactttggtacttcagtacggcaaggttttgaaatccatttcacaagtggtggcagcacatttcacatcggatggaaacacactctgattgctaacagctgctgtgggcacagcttactgtcaaagccagagctcagaatagcaggtcctttttaatgccaatagctgctaccatcttaaatggtaacacaggcacacacacaccacacatacacacacataccacacatgcacaccgtatgctcacatgtaccacacatacgtacactacacacatataccatgctcacacacaccacagatgcacacctcacagcacagcacacaggcacacctcacacacacggcacacaggcgcacctcacacggcacacaggcacatctcacacatggcacacatgcacacctcacacagatggcacacatgcacacctcacacacacggcacgcatgcacacctcacacacacggcacgcatgcacacctcacacacggcacacatgcacacctcacacacgacacacgggcacacctcacacacatggcacacgggcacacctcccacacacggcacacgggcacacctcccacacacggcacacaggcacacctcaaacgacacacgggcacacctcacacacaagtctattcagctgcaagtcctgcctccacttgctgagaacctgcatgactgggcaccaaggatacggcacacacacgcacccaccccacatacatacagtccacacacacacaacacatatacaccacacgcaccacagatgcacaccacacatgccacacacacatacactgcacacgcaccctacacacaccccccacatgcttacacatacacctcaccccccacccccaacatgtgggcctacacacgagtccatccagctgcatgtcctgccaccacttgctgagaacctgcgtgactgggcaccaaggacacggaaaggatacacagaacccaccagcgcacctcgtcttgttacgttagcttcactgcataggaattaaggatgaaagtgaaaacttttttttttttttttttttttttttttttttttttttttttaaggaaaaaggagagagttgattatgaccttgaagacaaagtgtagagatttgatttgcaaaatctagagtctggggttgaatctctaccctgacatttgttagctatgagaacttggacactttcttaatctctctgtgcctcagtttcctcacctttaaaacgagccctatctcattattacagggtacacaagtaaagtgcctgtagcatcagtgcccaccacatagtaagggctccataaatgttagctataatcatcatcactgtcttttttttttctttagacagggtctcactctgtcacccaggctggagtgcagtggtgcgatcacagctcactgcaacctccacttcctggcctgaagcaatcctaccacctcagcctcctgagtagctgggactacaggcacacaccaccacacctggcttttttttatatttttttcagtagagatggggtttcaccatgttgcccaggctggtcttgaactcccggactcaagtgatctagctgccttggcctcccacagtgctgggatcactgtctatcttttaaggatgatagtatttggcaggggctgcagctggagttgagggaactatcagaagaatgaaggataggtcactgtattccttttgttgtgtaacgacatggagtttagcagctttatttctaacacagaggcctaatgtgagaaacaacactaaccagggcacgatagaaagaaaccagtgtttctttctagggaaagcccacagtgaggctggcatcttggagaggtggtaagtggaggaagtgggagagaggcctcacacactggtaaagtggggaaaagactgaactacagggttcggaggctctcacaactgcctgtgcagtgagcaaaattcaccaaatgcctgtaacgctttgtgaccctctttctccagagctcagcctcctcttctgttcttaggcatagtgctgcactacataatcttccagagccagtcctgctgtattacactgtgatgtgaagagtgagctgaactctcatttccccaacagggacctctttttatggcaaaacccagcaggtttcatctcgtcagggaaaagggatagaaagtggaagagaattctacctagtaactaatttttcattttcattggtttaggaaaggaaatacaatgaactgttctcttcgagatccagaataaaagttctggcagctagaacaccgtttttatacaccgaacccctcgtgctctccctgcttttttttgttgttgttgttgtgcttaatgttagaaaataacattactactatgaaacgaagagaattttttttcaaaaccatgtcttgccattagagatgagacaaggcaacaccatgctaatacgctgttgatgtaaaaataaaagttttttttcccttcaaagtaaacaagttaattgaacgtgctaggacagagttaggttatttttttttcccctctctttgaaggccactaattgtgcccttttgctttaaatcaatagaggcaaagcccacagcagatagtgtcagtaatgcaaatccatttcctattgtaattcacttttcagaacaaaaccttttccatcagcaaagcattttagaacctcaagctacactgttcccacctgcaactgtctaaggtattggaggtcaaggacagtccaaggccaagtcaaggaccatcaggacacagaggagtaacttctgaggcagcccccggtggtaacataaaagcttaatatgcatcagacaagtgccttcgctgtgagatgttggggaaccaagcccagtggggtggctggcgtcagctcagtgttccagaaaagccaaactgttcaccacgacttgccctgattttgccttcactgctattcaaagaggcctgaagcagttactgaaagcaattccaagaaattgagttaaaaaaagaaaattaaagtttagaaaaaaatcatttgaataagtgcgtagacttacaaataaattctgaatggaacagaatatttggggggttcataacctttggtatatttgttttaaaaaccagccgcacctcaaacacacccaccaacaatgagacgaatggctagcacttatgaggaattattattcatttaaaataccctttaaactatgtcacaaagataaatttgtttagtccttacctgtccccacgcttcaaaataaaccataatatttctattgaagccagtttcttgttcttggaatcagctttttgagttgtcagttaggctagatgagctgattagtatggaacttaacactgtcagtagcaaaacaggtgctctatcagagaaatatcaatccattttaggaatgtttttgagagtgaactgtggtatctatgagagaaaaatcaagccttttccctcttctggtctgctacggtaaatggtgtgacacaaggatgtttcactgcccaattagcgtggtccattttaaagtgaatctgttattttcctttccttcctcattcttgacttttagacactgcaagttaacctcaaagaatgtcttctttgggcataattttacaaatattctttaagatcctttatcacatttcaaagcactttgcgaaaacaaaatgtcctcagtggggcaggcgagatctcaggaatagtgatagaattcattttaaataagtctgtgtgatttttctactgtatcatttcagggactttgcttaaagaggctttaaggaagaacttaaaatggagaaagccaacttttgaacgtggtgatcaggttgccttcagtctcttctacgtcagggagtcaaggggctgtggaaccatccgttccacctgctacatgctttctcacccttcttctaacctgacaaatactatgtggcatctccatcatggttgacattgctaggccctaccttattcaactctaactgaaaaatggggagcaagaagggattatgtaagaaaaaatgaaaaactttgagggccaactaacagatttcctaaactaatgatgtattttaatattccagggatttgatttaggacaaattgttatttggatggatgcttgtctattgagagagtaattgttaaactaaaggaaactggtcacaaatactttagcagtggctataaatgaccagtgggccaaggattttgagatcgtgagagacttctccgggaatgttgtcattcatttcactccagtgtggctcttttcctccatctgcggtaagccaaaacagttcccaggagaaacagatagagacaggaaaataggtagcagttctgtatagtcttcactaacagctcataaaccttaaaaaaatgggattttaataaagcccatttttatatttttaaacataaaatggaataaaatgatagttccaaaggacttcctgtggggaaagcttcaatgtcacaactaaaatttacatccaattccccagcacacccttgtcctcaacccgagtttgcgtaacagaggtttgctgagcctggaaacagggaattctgtgtgactgcagtaaaagcaccaagcggcctcatgatcaaactctcctgcctcttagtgatttctgaactggtggctgaagtcagaattgtccgtgattactatcagattatgacaatgaaagtcaccattctgtgttcttttgagcaggattttccctcgtgttgtccctcccttcagcttcccacactcactgcttgcgtagcattttgttaggggagtagcagttctgacacaaccaaagatgtgtacgatcaacagtggggtaatgtggataactgacacgtactgtgggcgtggagatgctcctatgttgtggtggatgatagccttcgaatgctctttgttgtcttcattgtcatccactctattaatgttctagaagaaagctagtggccaatattttcttccaacaaattcactggctccaggaaccttgacaccaaaatgaggattgagcgtcaaagttcttatgttgtcattgccccaaactacttggagctacttcttatgcagctgctctcagtgccaatgagataagacacagctgtactttatagtccctctcctccttttttttttttttttaaagatagggtctcgctctgtcacccaggctggagtgcagcggcgtgatctcggctcactgcaacctccacctcccccagggttcaaaggattctcctgcctcagcctcccgagtagctgggattacaggcgcccaccaccacgtctgggtaatttttgtatttttagtagagacgggtttctccatgttggccaggctggtcttgatctcctgacctcaggtgatccacccactttggcatcccaaagtgctgggattacaggtgtaagccaccatgactggccttttttttttttttttaaggaaaatggcctggtttggtttcttcacttacctttttcagcatattaactattggttgttttcaaatatcaagctcacttttctaggagaactatggccactatggagaatatgaaaacattgctgaaggaggtgaaagccatttcagaagaagagttatatattagcttttggcagtgacagcgttatgggcacggacattcagcctttccagttgactgctttgaaggggcaatgttcacgtggaagtatacctcctagtatgtttgctaaaataaaatcagcttcattacctaataacataaatgactttgggagaaaactctgagtctcatgttttatttttcctgataatgctgttcaattagggcagactttgtggaaattctgatttcattacccatcactgctgcatgaaaatacgctttctgaagtcacgctctgaaagaaactaagttgtttgctacaactacccctacacagaaattagaaaattatatgagaagaagtttacttcagcctgcagttgggacacaggttattactgaaagtagtcgtcggcatggtttctggtttcacagtaaaagaagacgacttgaaaggactcagtggttttgatgctcttctgaaatgaaaacactcagtgagcacatagcattgggttgtcattaatgtcagccaagcgaaaacactgtctccatgaacactgcagtcatttccccgccgagaccatgactttccactccctggcatttcgggcactgtgctagtacttttccaaaagagactcttaaggcaattcattctagataatcaaacacacacaacagtcttaaatgaataggtggcctgaatttgctaaagtcagccaacaatttccaggggagaatgtgttattttctgagaaatactgtaaggcaatgatgaaaccctcaagtgctgggaggcacgaagtataactactacacttcacggtaaatagcattagtgtatttatttatttatttatttgagacagagtctcgctctgttccccaggctggagtgcagtggcgcgatctcggctcactgcaacctccacctcccaggttcacaccattctcctgcctcagcctcccgagtagctgggactacaggcgcccaccaccatgcctggctaattttttgtatttttagtagagacagggtttcaccgtggtctcgatctcctgacctcatgatccgcccgccttggcctcccaaagtgctgggattacaggcatgagccaccgcgcctggccaatagcattagtttaaaatcatgttgtggataaaaatgtaatcaagtagctttacattgctcttattaaacttgatacacacagtttaacatggtcttgtggaagaaaacaggaaaaatctctggcattctcgatatgttctatgatatgtagcagctcttatgttctgtgtctgtcgcctattttgtaaacaggcaacaaaacaccatacttcatcccaaagttacgagaaacaaggaattaagcatgttgtgttggatggagttaatgatataacgttaaaaaataaccccacagtttccatctactctcttgctctctgcaatcaagctgggcatgagagaagaaaataaagtgattttcttaggtagcgagcaagtgttggaaagtggcatttactatatcaccagggcatatttgttgttgttatttttcctcccccattcattgcccatgaattaatttaagaaacaaggcatcacggaataggctaaatataaaagagtatttgctatgttttttagtgtcaaacactataagaccaaggtactaaactttgaatgagaaaatattctgcagtttctcaggatctcacatgtttgtcatacttcttacagtggtagtatactatttttaatatcacttttatattgccgtgatttttaaacaccaaggtaaattctcacagaaagattgcctggggataggtatgtgtgtgtgggagggaggatctggtgatactcatatggtaatctttttatttcatccattttctctgctttcaaattataaattcaaactataacgtcactctccaccccctcccatctccttcccaatcaacaaaacaaacaataaaattcatattttactatgtgtattgtgaaacagcctacaataggacaccagtgctttttaaagtcctactttttataaagggtctgattttcttctggccatcaactgaattgtaaggacaacatagctcattttatgaaacgaaagtgatattaaaaaactaagtggctgaagatgtaattgtctatatgtgagctgcttccgaccttgaaaaaagtgtagaagaggggccgggcgcggtggctcacgcctgtaatcccagcactttgaaagaccgtggtaggtggatcatgaggtcaggagttcaagaccagcctggccaagatggtgaaatcccatctctactaaaaatacaaaaattagccaggtgtgatggcacacgcctataatcccagctactcgggaggctgaggcagagaatttcttgaacctgggggatggaggttgcagtgaaccaagatcgtgccattgcactccagcctgggcagcagagtgagactccgtctcaaaaacaaacaaacaaacaaacaaaaaaccaagaggcacatttaagacttgaaatttagatggaaattttaaagttttaagttgttcatattctaccccaaacacattcatctcaaaaaataatatttaaagccatagaatttataatttatgcgtcaatagtttctcctttaagtggtcaccaaaaagatatcaaactttttttgctataagagcatatttaaaaaatatcaatgaaagtgttaccagttttcaatcctcctcacttggacattaaagggattaaagttattgtcagcacacacatggatcagctttcaatggaaaaaaattaatgttttttgatgttgtttcttttccttaaggcttaaggacactaggagaaagacataaatagaagtatatattatcatctagatggtgactctccaaggggatgatgagggaaaagaagtaatgctaccctaattctgaaataataaaagctcaagcaatgaatggctgaattcacacctcaaaatttcatggaagacaggcatacaaagataagctttcaaaattgaatgaactcattaccacaattaaagaaaacaaaaagaaacattttgcataactgctggttttgctgctccttctgctaatttagtttgtctggaagagccactgtgtggaccacccatgcttcaatgcacttaaccaatacctttagaagaaaacaggatagctacaaagtcataaaaagtggtatctttttatgtttcagatttccataaggcgatttcacagtattgcagagtgaaatcaattaagaaataactatagctatatagggaatatgcaacacattaatatatttatggagactatatctaggcacatttattttcagcatttgaaaattactggtgagagtgagtaacgtcccttccctgttgttttgataatctcatgtcttttaagcaaaaggaaatgtatactgcaaaatagctttaccactctgacctcaatatggagtaaaatgacagataacaagcagaagccggtcagtttcacaagtaagtgattctgatgctttggctcatcctggtccctgctcggttcccacatcctcatctggctgacttagttaaaacctgccatttctaaagtttaagaaattaaacatagtttgggagtacaaagagccatctttgctctgatctcattaacaacctcataagagttcatttccctcactaactgtcctcaggaatgaaagttaaaagaccttgaataatttttcctaccgccccacaatgatactgtactactgtcctctttcctggtctgaaactcctctggaaagagatgcacagcctctagtaaatcatagtttttgttttgtttagtgtactctaaagagctacatggaaccttttaaatcattcaatgccaggtccataaagacctctgtgattaacaaatcaaacccctttcttttcagtcaaggcacctgagactgagaggtaaagtgactgtcctaaggttaccaagcttgggcaagaccaaggtgatactgccaccatctgttcattctcctgccaccttttcaactggggtttatcccaacctcctcatttcacagagaaaaacagaaccagtgtgaacagaaacaattcacttgggaagagtgagccgaggctcttttatcagtgtaggtggttgaacttcggtagccacaggggacctgactttgaggacacaaaacacaggatccttcgtggttcacagtggtggtgttagggagaggcagtgagccttgcatcataggtagaacacgatgcagctgcaggtgcagagagttatcagggagagaagggcccagaagactgggaaaatgatagtggtgtcaaacaggaaaattacactgaaattacaccatgtctttttacattttcctcagtctccgtctgagccacaagtgcactgcagtcatttcagagatacagaagcttatcttgctttttgaaaagtttttcttaatatttgtcctagggtccacaggaaatgaaaaacccaaggcatccctcgccctctccccgcaagtcacctgctatgaatacctgcattcattctacaaagcctttatcagtccctggaatgccacgtatttattagctgtctccacacattaagaataagatgtatagagcaggaacctgtcattcttctccatcctgtcttcccagtgcctgcctcagtgcctgacacatagcaggtgctccaaaggaataaataaattaggaaatcctaccacctgcttctagcatgtaatatctactaccctggagtggaatgaaagggttattaaaatacccaatgacagcctcaggtctttccttctagtgtggaaactacagcaagaaccaacacaaattaaagtgtctaaaaaaatcaattggggcaggcatcttcttctgaactacatttactagagcctgccacccacagatgtcaaaggaattcacaggattaaaagaaaaggctggaggtgagaaagttaataactactcttgtgacatctagggctgggctacaagtggtcagcacatggacctctccatatatgttgtcagatgtcaaggagtggctttacagatagacagccttggaccccaatgctaaatcttccacttattagcactgtgatcatgggcaagttatttaacctctccaaacctctatttcctaatctctaccacagagataacagtacctacttcacagggctgttatgaggctcaaatgcaagaatatatgtaagcaactagctcaatgcctggcatacaattgtaactgctattactattgttatatgagctattgatatttttatctgatcccagataatactcaataatcaaagttaatctccatctgcttttctgaaccaggaattactgctttatcctgggattactataaggtcaagatggcaagtgagtttcagctcatattccgagtcacatggatttcaagtgaatgcttgggggctggttgagatgcactgtgctgtgattgattgtgacatgtgccaagggtgtggagccaggcttgttggttggttctaatattagaattggtaagcctcttgtagtagtatcacagagactaacagctattttaatattatataataaagcatagagaaatcaaaagaatgggctaagagtcagatggtctaagttctaattttagctctgcaactaactggtgagaagatcagaatatgccaccccaaattatgacactttggcatgaagattattttgagctgaaagcaactgagaaacagcagaaaaagctctctaccctacccctatctgcctataggcagggcatacatttccccttgtaaaggtgccctctgccccaaccccataccaggaagaggagacaacccttatcactacagatgggcactgacttaaatctgctaaaacaaaccttattgaagtaacccttgtcttccattagttcccacatatatttaccttcccacaatatatggcccctagaagcctcaaaccattttcctttatcttgtcacttctccataagtttattgccctttgttaaaatggtatataagcctccagatctgatgaccttcttgggggtattcacttaatttctgtgaggcctcctcacatacatataaaataatcctttttctcccgttaacctgtcttttgtaagtttattttgtggggccccagacactgaatataagcgggtagaggaagaagttgggttttttcctctctaacactgagtaagtgattttaatccagtcacttctctttctctgtgaagttatttcccattgaagtactgtgatttgctgataattgattttttaaaatgtaagtaaagtgaaacacatatagctatgacagggcctggggtacaggatgggtatttgttatgattatttgaaagaaaaataaaagcacaaggctattatatggaagtgtaacagttaaatattttctgtcctcattcaaaaagattgactcttcctatcaatgaggaatatattcacaatgagataaaattgcaatatttttggcactaaaaaaaaatcagcaaatgcttagtaattctccaagaaagacaagactgttgtgaatatgggggctctttaataaccaaggcaccatttaaaaatagctagaattaattacagggctaatgacccattgaaaggcttatttaaataccaaagccagcactgaacaatcatggaaaatatgacttaaaagggctttagagagcagaaaccaggaaccgcagttcaaacaaaaaacacattatcctagaactctagctactttggtgagaaacattcaggatgcgaaaaatctcaggggagttctcaggctgggtaagagaagccactaggatcaacagaaagacaagaagatgacacatacggtcacctgtttggaaaagaaggactgccatttagcattcacccaaagagaagagagaagagcccttcaaaaaccattctcccccaatcatcaaggctttctttcccccacgctcaccccctggttttctgatgtacccacccatttttaatgtaccataggataaaattaaaatttccacagagaggaaaaaatatattgtaataagtctctgtggccactttagagctgcattatctccaagagcttcctgtgtcttggtcctctgtgccctgcatccatgccatcataagccaaagaagaggtgataatcttcagcgtgccctacttgccaggcaaaaatgatgccactgcagttcttagcttctctctgtaccaaaatggcctttctgtatgtcagtatcctgggagcacaccaggtggccagagctgaaacagtttcattacttcattcatgcccattgattaaatgcattactcttacccttatttactgtggcctagacatgccttgtagttgccttgctaagttaaaagtgtcataaaatcaaaaggttccaaagcccttgagagctcaaggtggggaggtaggagagggagtggggcactctcgacatatattggtttcaaggagcaaatataaattttagtataaattgctgttcacaataacgcttttaaaccagcaattgtttacactgtactactcgaggaaccctataattattctgaaagcacttgccaacgtctaccctgtttcataattgccaacacagccttgttcaaaagaattagtggcaatgttaaaattctgtttggtactaggttactgtttgaaacaattagtgattgcacgatgctgggatatgcaagcagaatggggccaataaagtaccctaagaatgaagtggtcttgtgttcatattcacaggtgggaagaaaaggaaggtggtggctgaaacggaaaaaaaactgcttgaatttttttttccttttttcttactactttcccaagaaatactgtcatctgttgagcaaaatgactttaagaaaatgttttttcaaatgctggaaatggtagtgatttgaaggaaaaaagataacccacttctccctcttccccactccttcttgcctggaaaatatgtttctatttccggcctttactcctgatatttgtaagtgaatctgggtagtgattgtggaacctcggcttacacatctcaaaacacccatctgtgcaggtcactggactttgctgacctattttctgctgtttctttctgttacacaaatctcccccacttgaaagagcaatagtccctctactttccaatgaagcacagacagcagagagatttctcactctctgtaaatgcaaaagcttttggaatgtctggcatttcaggtgagtgtttaggaaaaaacggatctcatcctgggtgtctctcccatctttatttcatgctttctcttcttataaacccacaactgtggacaaggggatctgtgttccccatcgccaagtgaaaatacattctaaatctaccctcaaaattgagggtgctgtgcaaagtttcataaatagaaacagggaggagaaaaatctggcatgacaacttctgaatttaagccatttattctcacctccaccccacttctatcccgccttttctcttttatgaacaggtgatataaaagcagagaactaaggcagttacctaaataaattttgtattacctgtctaaatattttagggaagtgttttttctattctgagtgtccaggctattttcttagttctcgtgttcactctgcaggtgaagatattgtcactgactggggaatgtgcctgtggaccataacccaaaggtggcatcttttgtgataaaacaggtataaccctgtttcatgagtctattggccacgaaagagatcctctatgcctggaagttcacggcttcccctttctcttcatcattttctggttctgcgggaggctccatctttgattcaaacctcacttcttcctaaaagccttcgtaaatgaagaaaccttgcaaattacagtggatgtttcccctcaccattcatgtatccagtttgtacttccttatcttccttttgtgaatatggtggcttgccattctgcctccaggaacacttgtttgtccaccccaatccaatgataaaggacaaagaaaagatttatcagagcatgtatttatgcatagcacatccccaaatgcttgaacagcaataagtacccaaaaaagtactgtttaggtagccaactcccactgtctaatttaatcccactgaaactggatgtgtctttttctccttttgttctaaagaaacttgttctactactatttgctggcaggaataattttctgccacctgtagtactctctgcttctgtgaaggctgaacttcaagttgctgtgaaagaatttgcattatccctctatagtcatacctaaaattaacccactgtcttaagttaaataagatatagaatgctcacaactgttatggttatcggagaactagagagtgaggctttctggcactacgagaggatgtagaagatgacacatgtggtttggcctttatttggaagcagcaaaaatcacagaggtggtggttacaagacaaaaaaggccaggggagtgaacacaaagttttggctgagttactttgtactattatgtaatgagatacaagctcggccttgcttgagtttaaataaccataatgaactgttataaactctgggatggaggcattataaacataggaaattctgtacttggtcctccagttggtcaagtctacttgtattcataaggaacacattcccttgggctacaagagaaacattctgcaaactggaaatagaagttactttctggatagttctctcaaagaatataatgaagtaaacccgaacttcagacatctctgtgatcatgtattttagaacatcaccagagcaaacagcaatgaatctcagctgattagagctttagtaagtaattgggatagctgaatatccaaataactggagtgttatccaagtaaacacatgaaaacaaagagggcagttatcataaatatttttaaagaaatatttctaaattatgacctatttcttttctctgtagagaattttgaatcgaatttactttcttgatgataaacagtcatcagaaattttattttaaaatttattagaaatttggagagcaggatgtttggcctctgaatgggaaccttagtagtgccaatgacgaaagagagaattaaatatgggtgatgttgagaaaaccaagatttttgtctagaagtaagcccagtgccacaccgggggaaagggaggcaaacacaagactgggccacatctccatggtctctggatggaggacaggtcaggaggcctttggattcacttacacagacgccagtaagaacaaaagcatcacctgaagacaggatacactgatggagtatttggagaatcccaaaaagttcatccctggaacgaaaatgatagcctatctcaaaaaagctactaatgggcattaattagttggccactgccttgtttattacaaaacaggaacatctcatgacttttttgtgtgtaccataatttaatagatctcatacaccagaattcagatcattaatgtctgactgaatatttttgttgggcagtcctgttaactaagactggattgtggttaaatgcgtatgtttgatgtttctttgaattttaatagtaatttcgattcagtaaatgctatcactgtttcccccttctaaagatatggttggacttcattagtaatgttcaacttttcataaagatggtgaataccaccttaaaacctattggagattggttttatgtttagatttatataactggttatgtgaatatatttaaatacttgggaatttccttcactgtctcagaaccaagcaagagtcacctgtattttgtgttctgttgcctcttaaaggcaaggtctgaagatcaggtagcaatgtctactttatatttttggctttgactgtgccaatctcattagaattccctgtatctaaaacggttccctttacttacagaaaggcattttagtgtaggctttagaaaagtgtgcaatatttagagtgatattatacactaaagtgtaatagttgagaagagttaaatattttttatttgatattacactttggtgtgtagtgtaatatcaaatatactttataaataataaaaatcttataaacaacaaaatctaataaaaatcaaataaagaacatttaatattacacatcaaagtgtaatacgaaataaagagtattttactcttctcgaaaaaatttattagacacttatgaaaaaagtataaaattattgtatatgctgtaatgctctgaaggccttctaagatttatatgacattttgccccaacactaaatggccctggtttttatcctttttatgttttttcttcctccttcatctgtagttttccttccttctgtagtcatatgctagatcttatgaggccctccctctacttgtaattaatattttgtcttagaattagctatgtcttggaacccaaccagataactaagcttgtgtaaaaaccaattataaataggatgtactgggtctaaagagatttcctctgaaatcaagtgcattcactgtagtgcttgaactttgggtctctgttttggcaacctaaaggcctatttgcttacttcctaacttctcagatggtttgtgacagagaaggttgccagaggacagattcatcacaggtgaggtattgctgtagtaggaaggcaaaaaaggtaattgaaagaccctgttcttcaaattaccaagagaaagatgtcgtgcaaggaataggacaatgacctttctgttatttgcattacggcttgataattatcacaagtacattcagtttgagagtttctcgatctcttctcaatgccttcaaatagatatgttacaagacatggcaaattgattctttacctaagcgaggccagtttcatgttccaaaaatatttcaaagccaaatacacataactttataaatttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaacatttgactcccttcttaaggagatttatgttgaaaattctcacatagccacaaaacgcagtccattttatattaaaatgtgagtgtatttctaaaattttttcttttgttttgtttgtgttctcaagaatgctttctaaaacaaactcatgtgacataaacagggccagcttgccctagttacacccttactatttcattaacaaaggaactgggctgccattctgtttttgttatgcttatgctgaataactgtactcagccagctgccatgacttgtctgtaatcccagcactttgggaagccaaggtgagaggatcacttgagctcaggagttcaagaccagcctggacaatatagtgagaccctgcctcaaaaaaaaaaaattagccgagtgtggtggtgccagtctgtgcctgcctgtagtctcggctactggtcggggagaggggcctgaggtgggagggatcacttgagcctgggtcacggctgcagtaagctgtggcaacagagcaaaaccctgggtgacacagcaagatgtgtctcaataaaaataagtatataactgtattcaaatgactttcttcttctaatgtggctgcctgggcaatttgtccattttttcccagcagcagctgctaatgtttaagtgtaattttacgctaaattttttttaattaaaaaaattaaaagttacaccagcttattgaagcaaatatagaaaatacagagaagtatatggaataaaaaataaaacatattgtcttcactgcagagacaaccaagtctttaaaaatgtacatgtctgtatatacacatctgtactcccacatgagcacacacacgttggcagtgatgttttaaaatgtaagtgtttttatacatgggaagttttaacttgtgttttttttttttttgttttgtttttgtttttttttttgtttttgagacggagtctcgctctgtcgcccaggctggagtgcagtggcgcgatctcggctcactgcaagcgccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccaacttgtgtttttttaaatatggagaatgcaaaataataataaataatgaggcataattataattgtgatgacaagaaagtaataaaaaaaagttaaactctttaactctgaaactaacattaagaattttatcccgtgttgtagatccaggaacacatgaggaagatgctttaacatctttatgttaaagctttaacaacatggctctcaaggtttttggacccccttccataatgtaatagattctgaattgcaaaataccaatacattttgttaaagggtcaagaactatagaaggaaagtacatctcaatccaaaactatatccattgagaaaagaaaaatagctcagaaccatatgagctatataagtgatgcaaaatttatcacgccctgagagacataatatgggacttcagtgacactccccccatgcaggggtggtggtgggggactatttaaagccattttgttcctgactagatgctgcctccattatcttcatgttactggaatctgtgatacacagaacaatagcttatgggtttaacaaaaaaaaaaattttttttctttttttttgagacggagttttgctcttgatgcccaggctggagtacagtggcgcgatctcggatcaccgcaacctctgcctcccaggttcaagcgattctcctgcctcagcctcctgagtagctgggattacaggcgcctgccaccaccacatccggctaattttgtatttttagtttcaccatgttggtcaggctggtctcgaactcccgacctcaggtgatctgcccgccttgacctcccaaagtgctgggattataggcatgagccactgcgccctgccagtttacaaaaattttgttgagacagagtctgactctgtcacccaggctggagtgcgatggcacgatcatagctaactgcagccttgacctcctgggctcagacaatcctcttgcctcagcttcctgagtaactgggatgacaggcatgtgccaatatgcccagctagtttttacattttttttttgaggcggggttgggggggggttgcttttgttttgagacagagtcttgctctgtcgcccaggctggagtgcagtggctctatctcggcccactgcaacctctgcctcccgggttcaggcgattctcctgcctcagcgtcccaagtagctgggactataggcccgtgctaccacgcccagctaactttctgtattttttttttttttttagtagagatggggtttcaccatgttagccaggatggtctcgatctcctgacctcgtgatccacccgccttggcctcccaaagtgctgggattacatgcatgagccactgtgcctggctttgaattttttgtagagataggggtcttgctatgttgcccaggctgctctcaaactcctgggcttaagtaattgtcctgcctcagactcccaaagtgctgacattacaggcatgagccaccatgcctggccaatagcttatgttatttaaatataaattcttggtaaacaatttagaaactgcctcttatttcttcctttaaaaattcacttgtaactgctgttaatccgagtgtacaaggcaacttcaatctattctcccaggtggctatcctcaagtttgggctcaaataaatgctatacttaatcatattttctgaatcttgttacttaaggcggacacgtataagttgaaattctcccaaagtgaacacggagtcagtctaccaaagtaaaatcaaactaaggtgaatatttaaatattcagacaaacatccctgctattgaaaaaaatcacaaatatttgcttagcatccactaagtgcaagatgctgatggtgcaaataccaggtgtgccagacaactgctcagccttttatacctcttggcctaactagacacacctgcagttttccacatggaattcctcttcttgcactttggcctaagcacgcattttttctaatggtggaaaatattaaacagacttttgctttagaaggtatctcacttcacttcaaagcaaagtctaccttgtgaatttaattagggaaccttcatgagattttaccccttatgtatatttccaactattttagtcatcaagaacacttactgttccaattctgccacggatgtggtcaatcttagggaaatttctttgagcctcagtttcttcatttgtagcatggggatcttacccacctaaaaccaaactgagacagcacagtgcttgggggacaggagactctcagtaaacagcagctcttattgttgtgccccagagagtctcttaggaaacgggctccccagagcttcaaaccatggcttttcctgtgtggctacatcacagacattgtttatcagaggacacatcttctagttcactgtggttcattcttggtggtcattggaagtttgctccattacagcaagtacacacacaggtagcgatggcctacatatttattttcaagcaatgttttccagcagacatggcattcagtgttgtatgaaacatccccatacaattccacagacctgcatgcggctttcactttgccctctattgtacagcctttcatgggctgcttgacttgagcacacttctcactacatacttcattttattaggatatgaattttatatccagataatgaatccaaagtctgagaaagatgcatgcttacaattggtatacagcacggctgtggagacatgttgagaagctctgggatgagacacctaaattcaaatcccagctcacacttctgtgtgaacttatgcaaaaattttaacctttttgattctcagttcccctcatctgtagaatggttatccccattatgggttatccccagagttgttgaaagttaaaagtgatcatgcttgttcagtgtttagcccagtgtttggcatagagaaaaaaatgcaataaatggcatcttataatgcaattgttactgattttatcttaacataatgctctttacatttggcccaccaaataagatcatcttttggaaccattttttactgccagtgagaaccatttggtcagaatgatccacactctcatctagttgcttttaacttcacttatgagagagctgactagggataggggtaaactgagggtgacaaaagactattttcctgtgttctaagtctgctgggctatattaaatctgatcttttggtctcatcaggacaatcctttaaccaggaaaggtgggggcctgggaagactacagcttgctagagcaagtcatccttgacatgttgaactttcaacaagtttatcactcagatatatttgggggatagggaatctgagaaaaccctagattaaaagtattttatcagcgcaaaacagtgattattctaagacaattatatgacagcataaaagtattgatatttaaatatctcaataccccaatggcacccgaacgaaaaccctgcaaccagtacaataatagcattattatacatttttgcttcactttgtgggactttaaatttaatgccagaaccaacagcttacaaactgctgtggacaagcagtgacccccttgtgagctcggtaaatgttatctattgtattctaccaatatctcagcaaaaagacagagtgttcctgaaacagtctctaaagtcgtccatcagagctttgaagaagaacactgtcttcttttcatgtgggctgattttaagggacaatagaggtttaacagaggacaacacaattggattgagataaaactgctatattcccaagaattctcccataaaggtaaattccacagataagacatttacttttttctttttacattttttggttttaatttttaaagttgctttttcttgcaactagaagctcaagtaccattgctattcagtgttggtttcagatagtgctagaggtggcaaaaataattctgcaaatgcgactcacagtgtgcacattatatgtaatctgttttcatgtattcattagcagagacatttggaataccttgttgctgaataatgaaataaattgcatttgtccaatatcgtcccatctatatcacatttattccagacttgagcctacaccaatgttattcaacagccaactctgtctcattcataatggatttttctccaaatggatctgtttcatgttaaaattagtgataaagttagtttttaatggaataggcagcaggcaacagcagcttccgaaagtataacctaatggggataacttaattattagccatatcaccctcagagaaccaggattatattaaaactcaatttggtacaaacatatatagataccacccctgttttttctttaaattagctaattatgatgtggcctgaattgataaagtcaacacatcctctcaaagaaccacttaaacacttaaggaaaatgaatagtccttggatgcaaggccaggtatttgacggatttatgaatgtcactcacctcctggcttgaacagaagtgaattctgatacaagtttcttgcccacctacactcttgatgctggtaaactgttaattaagcatttcggtaatataatgcaaagttaataacagagacctataattaacatacactcatatgtgcactctaaaaatagggtatcaaggaaagtcttcctattaggtgatgtgatcaagattaattggttaatgtctatatagcccacctatacataaataagcttatgattattataattatggagagcagagttcaaaatccacttcaagttcaaagaatagtattttatacatctaagtatagacgcaaatatttaactctgtaaaaatacttattttaatgctattccaaatgtttaataagtattactcatcactcaagttttcctttttcttagtaaaaaatcatagatgtttcaaaaaataattcccttttgccgttaataacattttaatgttattttaattttttttgaaaacttggtcataggcagggaagagggaaagtttggtgttaatgcagaaactgccttgttaattaatcacagtgcatactggtggatggataagcagaaggtgatttaaatttactgaaagctaggtttatatgaaaaatagagcaataaagttggcttcccaataaagttgggttcctagcctccaagtcttacacattacttgaggttggggagatgactagatgaatacatggtagcaacttataaagatcataataacagaatataccaaaccagatttcttttagggaattcgggaagattatttgtcatttgatttgggccacagagaatgaatatcgcacttccctaggcagtgaaagttgcgatgggagtgaagaaaagccaaggagaggtcccagcatgaacatgcgtgatgtgttcaaagagaggctcactgtgtctcaagggcagggtagagtggagcaaatggctcaatataaggatggaaagtgggtagccaggttggcgggacctaatcctaaagggccttgaatactctgttaaggagtttggacttattttctaggtgacttaagccttcagaacagaaaggagtctgtttagattacgtgtgagagctcatctgtccaatgttcaaccacacaatctcaataatgataaagatactaacaaagatgaactagccaaaaccattaatctgcttccataacgagctagcctatgagtttttaaaatatgtttctagccattaataaccagggaatttcacattaaagttcagatttatagattctcttaaaaaaaaaaaaaagacctggtgatgacagaccagttattccaaacggcgacagagccaagggaggtgctccctttccaaagcatatgtgccgtccagcggtccaagtgcctcctctacctgccacactcacaccacctgcctaggggcactaaatgtttgggtttgcaccttttcttttagagagatgccctcttttattatcattattattattattattattatttttttttttctgagactgagtcttggtctgttacccaggctggcgtgcagtggtgtgatctcagctcatgcaacctccatctcccaggttcaagtgattctcctgcctcagcctcccgaatagctgggactacaggcatgcaccaccacacccaactaatttttgtatttttagtggagacagggttttaccatgttggccaggctggtctggaactcttggccttaagtgatccgcctgccttggcctctcaaagtgcagggattacaggtgtgagccaccaggcccagccgataccctcttttattagcaagaataattctaccattgcatgagttcatacatactgattatctccggcttcttttggtaatgcattactttccctttttttctttctcatgccaataaagttttccatttattcctttacttaaaattgaagttatacggtgttaaataaaatgtgtttgggttgaaaatgaaaatgaagatgtcatatgtaaggggcctatgatgaacagaaggtagaaagcatgctctgtggcagggtttctcagccttggcactactgacattttgtgtgagataattctttgttgtggctagatgctaatagcactctcgaattgtattaatcaaaaaatctctctagacactgataaatgttccctgggggtcaaaagtgcccccagttgagaaccactgttttatggagagaatggtttccaggaaaataagctctggataggacagtggtgctctgctggaaaatggataggacaatgcttatgtctcctgctgttacctctgcccctgtgcacctttctgttctgccagagacaagggttgccccacccacagaaaggtggaacagccaggcatcctgagggtagtgatgccaaaagaagcccaaagtcctctcctacctgggagaaacttcagcacctccatgaggcagcatggcagtgaaggctttctctgctctctactgctgatgtagttaagggaaacaagaaagaaatttgcatgatctattctcaagacccaaacctccctgtttgcataccccggctcagtgtggtgtcagaatgattctaaggaaggaagaagccccttttctctgacaaggcactggggaagtctagtcgagatctcactggggaaagcaggacttgctgctgctatgggaggcaggaagcaggccaggcacagatcctggaacacatcagaccaaagtccaggacctcctctcctttggctcgaagggccttgacccagagctcactcacctgagagcttctttcacttttcttgtaatatacatttatcttgaatctaagcactgttgttgtattatcaaactgtcaggatggttttatatgttttcctagtacaagtaaaaaagattagttgctttgcaaggacggaacagggagttgttgatgacaaagtgaagtaggtaaaagttgactgaatagttttgatatttttcatatggatttcagtttagatggttttgcgctaaaaaaaaaaaaaaaaaaactcaatattatggcatttcctggagtttaaaatacgctgacaatacaatttacaaaaggcctttttgtggttagtgtcttttcacacctctatcttctggcatttagaatctaatcatttctttgtggtaagaggtattatatatagaaaattggttgaattaaattaatcaacgaaagtgccttgttcattttgcactccttctcaaaagaaaccactgaggtgggaggactgcttgaacctaagagttcgagactagcctaggccacatggagagactccatctctttaaaaaattaaaaaaaaaaaaaaaaaaaaagccatgtgtggtgtcacatgcctgtagccccagctactggcgaggctgaggcagaaggatcacttgagcctaggagttccaggttacagtgagctatgatggcaacactgcactccagcctgtgagaccctgtctctttaaaaagaaaaagaaaagaaaaaacccaaaggattcatttttacaaaattcaagtcttctgaatgatgcttagtaaatatgtagtagatgctcaatacaggctagctaatgacaacagtgattttggtcctcaccataaaggggcggaagggtggtggttaaaagggggaaacagggcaacagcaaagaaaaatgacaattagtctcctcattcagtaaataatgagtaaatgaaatagcagtcactcccttacagtaacgacagctcaaaagggtgaatggcttgaacaggggaggatgaacaatacaagggtaaaagagggatgcagacaaggaaggttttgagtaagttaaacctactggcgacaaagaacgtacagagagcagggccaagcagctgaagcattcttttattcacaaatcaatggaagctattcaagccaatatggtttgatttagcagatattaactgcagctaaagtgatgcaaatacgtcagcaaaaggagagcaagataaacatgagaaacccacactcgttaaaaaggaagatgagaacagagactgacatttaaagatcagattaaaaggataggaaaaacgagagaaaagtaagacaatgtgagcgtgagatccttcgacagaagggaggtgaaggggacagatccaacaatccccctgcttatttgactccgagacaagagagaagatagccgatcacgggccatcagtaacacaaacacagcccgggcacttcataaatatttgttgagtaactaaatgtgcatgaaaaatgccttcctttctggatgtgaagataaactgagattttatatggtaccgtattaacaagtttttgtcttcaggagaatgcttaaaaccatggacagtattatttttgttttgtgtgggtgtatgtgtttgtttttcagacgaggtcttgctctgtcacccaggctggagggtagtggtatgatcacagctcactgcagacttgacttccccagcctcgggttatcctcctacctcagtctcctgagtagctgggactataatgcgtgccaccatacccagtttattattattattatcatcattattttgtgttttttgtagagacagtgtttcaccatgttgcccatgatggtcttgaactcctgggcttaggaaatctgcccaccttggcctcccaaagtgctgcgattacaggtgtgagctactgcgcctggcccatggacagttttaatgatgattttaaaacagctattcatttggataaatttccatgagcctcatcttgtacccctgacacaggtgccgtcatagattcaattagagggtcacagtacagtagttggagcactagactgagagtcaagagactaaggttccaaaattggctttgctgctaagtgtgtgatgctgggcagccacttaacctttccgagtttctgttttctctggggtaacaggagtggcttggaccaggtaactctcaggcctctctcatgatcctacatgtgcaataaagtacattaccatattaatcggctattttgccctgtctgtatcctgccttgtatgcccagtgttgaatggcagataaaagttctttttttttctctcctcattttgcctgctagtggcttgtcaacagtagtttctataatcaattctggaaatgtttacccatctgtattatctgaaggctgttatttactgttcttgctattttttttttcccggggagtgtagtaatttcgatgtgcctcccacaggagaccacagcaaacaacaaggatacattttcacaatactcagcatgaagggacactgttttgctgatgtccctgacacagtttgaattcatcgtaatggtatatttgaagtggtttcctgtgtttttgtgtgtgtgtgtgtgcctgtaaagactaaattaaagctccagtgcatatgagtcctactgtgtgctgttactcttaactagaattagttttttctcttttctgtgaaaacacaaataattgtgcaggccaattaaaccttttgatagaaatgaatagcctagtttttaaaagagttaaagaggcctaagacatcacttacagcactttttggtatcataatattacatctgagctctctgtggcagtcttagatgaagcatgaactatggaaagatcatgaagaggcatgaggggtccctgattttagtccctgccactaacttatcctggcatggtgtttaatctcccaaccacccgattataaagttagcagattgcactagatgactgctaaggtctcttgcaggtctaatagtctataaaatgcccagctagctatgggactgttgtatttagctatgtcaccttctacgatgaaaattttctttcctgctgggaagttatcaaaattcactttttagaatgttaggccaacacataaattgacctcactgcatttctgttacctcattaaaaaagtaataatccatgaaaaagtacaagatgtcagggtgatttatgtaaacagaataataccttaccttaaacacaccagaacgtactgcagagcacataggagtagctcatgaatcccagcactcccagatgaggacagggaggcctgatatctaaattccatgcatgagattccataagtctatggaaaaaatactaggtataccctcatccattgctcactagccatgctttgaatttgggagccttacaattacatagcaaagttgagtagctttaaatgtagaaagcaggtcagtgagtggctttaatgtggattcatctgttggagaagatgtggtcctgcatttcacatggccagcaaagggcaaagaggggacaatcactgagaaatgtgtatgttgggggaaagaaccccataagaaacctaccagaaaatgggcatcatccctcatatttgcaaagcctttcacaactttactaaacacttgaatgctctgggcatagtgaaccataagaaacagaggggttataacccacagggtttaataaatgcatggctattatagacaactggatcatccggcttttaccattggtagcaagaaaaaaaaaagaggggctttttagtcatactccctcctaccatttaaaaacaaatctatacataatatagataacaaaactatatttaggaagaagcgcttattgatgggccaaccacctgaaatgtattacctcatttaacaacctcaaaataatccaatgtggttgatgctgttttcatcctgggtaggagatgagagctgagtgagttaagccactggtcctgtggcaaggaagtcagatcaccactattctggatcaatttgtcaagtttcaagtgtttaccttgaatacaaaaacaacctgagaggcagctggcaacgaatacttcttcacagtttgggcatgagtcctgactaacatgtactaaattaccaagcatatctttaaataaacgtgtaccacagcaactctaattcaaacaacaatctttaatgtaataattacactggctgtgacacgagctcagccgagagtgtatttttattttaacaaggctgagtaagtacatgagtgtgggctgagctttttgctcgatagtcaatacttgaaagctggctccaacctttaatttaagcattcgcttgtagcaccaacagggctacagggtttctagtatcaaagacacaatcctccgtcctttcatggccctacttctgtaagcagcatgattgaaccgcggcaccacagaaacttgttttccctccttctggcagcgttaagccaaaacactactgccccattcatcttagcgacatcataatgaagtccctgaatcaatttatatcaagcaaagtgcagaaatccattgaagactcgtggcggatgcctttcatacatctctcaacaccatacaagaggcagagcggccgcacagaaacccaaatcataacacagaagagacctttgccgcatccaaaaagcttttttatctcttgaaataattaagggaaaggaagatactgagaatatctgattgtttctcgtgtttcttcatgtgccttaaaaatatctggcagcctccctccgtggcctcccggcaccttcagtagaaagaacaactcccgtagaatgagggtgagagcctgtcatagttcagaccccaccggtctcctctacatgccttgtctcctgcagtccccgacttgccttgctcactgtctagctttcaaggattttcacaaactaccatttgttggcaataaccttcctttgcttcaaagctcagctaagccttcacttcttccaaaaagctgttcctaacccctcagtctgatttgtgctcctcctctgtgctcctatcgtctcctgcattcctctgctctagcatttacactatgtcatgattttatttccaccttgggccctccctggcctgtgagctccttgaaggcagggaccacttcttttcatctttctggttccagcactttttatagtgcctggcacacatcagatgctcaatccatttctatgtgtattttgtctacttccattctactgcagtgttcagaaaaagcccctaacctcaatttgcatgatgacctaatctcggaatctggaacaatgtgagtttctgagactccggtggtgctggggctgttgggtcagaacagagcagggttagcccagccctgcgagtctggcagactcagcccccaattggagctatgtgctagccctgtgatcctagacaggttgctctgcgtctctgagtctccgcttcctcctctgtaaaaaggaggatgaaaggctaatgtaagtattaaatgtggtaatccatttcatggtgcttggcacacaggaagcgctttataaatgataggcttagaacatatattactggttacaaatagcagggcttggaaaatgcagaattagaagcctcttatgttatatgatgagaaatttcatgcaagttcttcttccatcagcccccatctgaccagaccacataactcatatgcttgggcactggcaaaggcccctgttaaaatgcaatgtgtaccggctaaggctggatgaactcattaccctaacttcaaacttgaatacgtgatgtgtaccatttaccacgtgtacaagaggatgagaggatggggatgttaataacaacacttcttcagtgcctgccatatgctaagtgcttgtcacatgtgagacattgcattaagtaccttccatgtgttacttccttcttcccaaaaatccctatgaggtagatgttattatcatctttatttgatagatgataaaactgaggtttagtgaggttacatgacttgcccaagatccatcagctaatacgtggcatttctgggacttaagccttatatttggaaaaatttccagatccatgcttgctcttatgcctatgccaactttctgagagtctttcttatttctgtatcttgtgtcacccggaagagccaggagagaacgggacagaagatcaaactactgagtcaggggcaggagaagaagaggaggtctggagattgtactactcgattttttatgtggtgattaggcaactctgccttcagctaaaccagaaggccaccgagagccctaagagaggagatgataaagtttgaaaacatagctccgtttgtctaatgccagccttaacctagggccagaaccttcagcaaagagctagaatgtacacagacagtattaagtcttagaagaccttcctattcctatagcaacgtcaccacatcgtctgattcactttttccttcccatttgactagcaggtcattcaaaagccaatggctataaagcaagaaaacaatcctgtaaaggctgatacttggccttcatgatacggagttacagctttgtacgtgtacttgaagtataaatgccttcagtttccctactgtaaggtcataggtccagtttacctctgtgaagtggtggtacaaaggaactgagaataaacaaaatgtttagtaaatgacagagtggaaaattccaaagtcgagtctagagaatattttcagtactgagagtatatgatttacaaaaaaaaaattactggaatcctcctgccctttggtaagctttttattgaagtgcaacatgcaaagagaaacagacacaaatgataaatgtaagctttatgaattttcacaggcaatactcccagatcaagaaaaaaaaatgtccctttggttttttaaaatagttttccatgcctgggtcaaaatcaccgaataatgcaaaacttagcttataaaatttattgtttaaagttcagttagccagaaaatgctaaaagtttaataaaatacaatgcctaaacatgagccattttattttacttcaaagagaataattatcttacacttctgtttcccaaattggaaagttagaagttttgttttctttttaaccacgaatgggcatgtagttatttctctcaccctttaaacggccagggtttcctcagctgcaccttcccaacaccctctccaagaacagagcgtggcttgccttgctttccttcctcttcactcccatccttcccccacatcaccactgtgagttgttctgaaatggggccatctcattctcctcagccctcctaattttgggtagatccatagaagacaggaggtgctttttctcatgggcagcgtggctgtgggccattgcacaacctctgtttatacagtgagtatgcttcagcctatccctttaactggctaataaaactatgctgggagcaacgtatcccagtgttctgagactgatttggctctgggggcaccaacttctctcttagttataacagtcagaagcaagaccctggaaatgcagaatgtgccaaaacacatttgctcccactcaatggacagccttttgataggaaaccaaatggaatgcaagacctgaatgccccctatttgataataacaaagaggcagatggcccagccacaaagggcaatgtgaatgtctatatgttagatgccaacaaagtgattataaaattaaggacaagtatttgggcattgctttctaactgcatgttatttttcacaagaaatttcagggaaggttgggctttcacatatttaattagtgtaatggaactgattctgccaagtgtatctgttagtcgagggcttagcctccttgtcacactcaggtgctgacagctatctgggcagaactcttcccccttggagaaggtctgagggggagtgaatggtgtatgtgttaaggtgcccatcacttgcatggtcgcaggcctgcaagggctttccatctctacacacagtgataaaattctccaaggtgcctacattcatgacaaaagtttcacatctttcaggagctgggatagctctggaagtggtactaattgtataaaagctttttcctccacaccagcccaaaacaaaaagaaaaacagccatcatttactagtactatttttgctaatataggttgcagatgattaaagataaactgtaaagcctctgtaaaccacaaattttatgcccaggtctttgctatattaataaaaaaaacaaaaacaaaaatctctgaaaatagaatatcaccaaagattctggtcttccactgttatgaaagatgaagacattataaagaaaacgaggattacaaaatttgctcttgaattcatgtttgaaagtgctttctttaatataatttatagctcatctgataaatctgtctgaatttaaagccccttctattgttaccttgtgctttgtcatacaattttcagactatgtctcctacagtaaattgtagagcaagagctctcaaactttttggtctctgtatacttttatgcttctaaaaactgcaaagaggcctggtgtggtggctcacgcctgtaatcccagtactttgggagtctgagacaggcggatcacctgaggtcaggagttcgagaccagcctggccaacatggtaaaaccctgtctctactaaaaatacaaaaattagccgggtgtggtggtgcgtgtctgtaatgtcagctactcgggaggctgaggcaggagaatcacttgaacctgggaggtggaggttgcagcaagccgagatcgcgccactgtactccagcctgggtgacagagtgagactctgtttccaaaaaaaaaaaaaaaaaagctgcaaacagcttttgtttttgtaggttatacatcagtcattgccatattagaagttaaaactgggaacatttacacaatttacttataattcaacttaaaataatagtaataaacacattgcatattaacatataaaaataagtatattttataagacaaaaagttagcatgaagaataccattattttacatttttgtgaatctttttatatctggctattaaaagaagacaagtagattctcatagctgcttctgcattcaatctgttgtgttatgctcttatggttgatgtatgtgaagaaaatctggcctcacaaagatatgtagctagaaaaaggagaggtattataatagccttttcagataattttggatattcttctgtggtactacactaaaactcaacaagtggtagtttcttaaagattagttagaatatggaacctgaagccatatcactgactttttgtactttgttaaattaaaatacaccggtatattttgcactttgagtggatcatttacctacatatatttttataatatcatccatgggtcacttggaaactactggttcactgggttttgtatatcttccagattttgacacatttcattattagatgtggttatatcaaggaattatgttgattaatatcactacccataccatcagaaaagtttttaagtattgggaagctgtcagattcctggggttggatacaagttttccaaaattcagatttttgcctgaatgtatgggcagtaaatactgtgaactgtttttcaggagataacagactcaaagttcatttttgagaaaatatatgaaacatatccacatctgaataattatagtctgttattctattaagtggcattccattcaaaaaacagctagttcagctcttaactcaaacaatgacacaagtacttttccctggagacaaacatggtacttagtagtataaagcagaagtgctttatgcaaacttccaattttgtcataaagaacattaaaaaggtatggacttgagggtcaaaatttaataaagttaataaatttttctgcttcatcaagcacattcttaaatgaaacttttttttttttttttgagacagagtctcgctctgttgcccaggctggagttaagtggcacaatctcggctcactgcaagctccacctcccaggttcaagccattctcctgcctcagcctcctgagtagctgggactacaggcgcccgccaccatgcccagctaattttttgtattttcagtagggatggggtttcaccatgttagccaagatggtctcgatctcctgatcttgtgatcgatccgcctgcctcggcctctcaaagtgctgggattacaggtgtgagccaccgcgcccggttttttttttttttttttttttaacagcaactgcacagtaatgaagaataccatgactgctggtacagcttggcattaccgtcctgcttcctgctaaggtgccagcagttttacccaccaatgctttgcaccattaatacaaatggtcaccgtagtaaaaaggggaaacaatgcctcagtattgttatggaactggtttttatctcttggagcttctgagagggccttggggccccgcagggggtccctggatcacacattgaagaccactactgtagaggatagtatctataaatccaaacgctctctaatctgctaaatgcttatgtccttgtggggttcacgtaaagaagatttaaaaggtttatttctgtctccactctcctgcccttcctgcttaaaaaaaaaaattccattgtggtagttcaacataaactgtgtgtatagaacaaagaaattacagtactgttgatttcatcagcattttctcctaacaaagaaaactagctattctaacatgctattgagaaaactattgaactaccatgagttataggaaatatgacatgctcagtgccccctccatctcacctaagtcccaactctttcccaaacctttcactttgggggtattttggatgagctcttagtagtgtcctcagaaataattggttgtcctaattcagccccatgcaaattaatgctcccctaaagaggccttattataattttcaacccttgatgtctacataatcccctatagttctttaacttcttgctttctaacttctgtttaccgatgcactacttttgtcagctcagtatagcatcaattagtaacacagttgtgtttattaggtctccctagagccttgagaaagctgctttgtatttattaatgactacacagagcactactatttttcaatagcacttaaaaatgagtaaattactgaagatgaactataaaagaactttaaatttcaaaggcaagcaaaaaaaaaagcacattatttaaaaccactcataatacttgcatggttaattttattttcaatgtaatatcaagagagagggaagaaagtcaaacccagactcttcttcctgttctacttttggcattttggagtacacatgatttgagttagagaactgaagcatagatctggtgattaattaagagctggtttaacaggtctaaatttcattatgtcacacacctgttaagtaatgcacacctgattcagcagacatccacccacaaggttaatctcaaaaaattaagcaatcaacaggaaagaaaaaagaggcatactgcactaacttaggtccagttttatgttctcaagcataattccaatccaccaatttgaaatgtatccactttgttttctcttattttgtgaataattccctgtactacattaggtgaagttagagttgcccacactggtatagaattcactactcaaggaaaccagagagaccaatcgctcctgtgatgaatctttccgaaccaaacttaaagtgatgccagcaattatggcgttcatttgccctgcttttatattcctggtcatttatgaaatgaagacgctgatctgcaaaaatcactatgcattcatgaaaggagctctgggagctccccctgaggatctggctatgaggcagaaacatacctcagtgcacttcctttgtcttgtgctccctctttgatgtgcaagtcactggtggagtaagctgtgatcgctttgatgttgaacttctagactttattgttactagcatgcctacaaagagagctgtcagtcatttcttacatctgaacaaccatgtttctttacagcgcctcttttacaagcatcaatccttaaatacatgttttcacattcctgctgattaccacactatctttgttgggggagggctgtgctcaaatataactacagcacccacattttctgtaaacaccctgaggcatcttcagatggctggtaaccaaccttcttcaacaagagaagccccagtgcaaaacatatttctagcaaacgaaaacattctgaaaacactcgatccatcttaacagtcgaaatgagcagtttagccaatatttcccctaagcagccactgaaattgcatagaaacttccaggccacttcaaaagggattctgaacgtaacagcagcagggggcttagaaagactgccaaaaccctgagacatcttaactcatcttaaacaactttgtttctctgcaatagtggaaacaaaatgcttctgttttacgagattttgcttgtggtagaaacattgcttttgaaatggatttctatcaaaccaattgttttgttaaacaatatcattttcaaaagttgcttgatgttacggatgcaacttaagaggaggaggatttttcataatcttgtgtctagggcaaacgtggctgtgaatgcaatggaggtacaatttcttagatatatacaaaataggcggtatgcaaatctttaaagatctctgttgaaaaagatatggctctaatttcatttaccagctcccatcagattttcttttcaaactcctttatcgcttctgaaactgctgaatattatcaaaccccactgggaaattccacacaaggaaataaacttaaggtgcttacatcacaccatgctggtttataatgaactgctgtctttttgaataaatgtttcaatgaaatccaagtttttaaagatgccaggtctcaaattaggaagttaaatgatattttttcatgctggagcttagttctgtttttcttttttataaaataagatggcatcacaagagatacattgtttctgcttgctaataaactgcagacgatacattgggagagactcaatttctttgggttcctggcttggaatatttggtaaagaataaaattactgtggtacgcaatggttaaggctactccatggtttccatttttaaacaactgcccccgccccttggttttaaatcaaccatcaaaaacggaaaaagctttaggctacaatttgataaataaggtatgactgtaatttactagaactaaatctgggcatatttattattaatattaatgaaaacttgcttgttcttaaatttatttaaatagcataaagtaattacctctttctgtcttaaattttcacttccaaaaggaactgattagctgatagaaggacctatagcaattaagggtagagacagggaataaggaaagtaggaggcatttgtttgcctctcccaagtctcaaacaagaaactagagcatgtttctgttttaatagaaacactttcatagaacggtagagatggaaaagatcttggtgactaccaagtccaaccctttaactttaaaaacagggaaagtgaacaactgaggtttaacctgacaattattgcatcgcagatctgggacaataacccatatcttcatcttcccccaccctatgtaggggggtttccactactcaacattgttttgctacactgcggacagggtgactcatgtacaaagtgagggtgttgggcttcagaggtttctcaaccagaattatctgagttatctttaaaaatgtagcaatacttgagctctacaccttgggaccagtaaaatcagaaatctgtaagagcacagcctgggcttatatatcttttaaaaactctttagatagattaatacgcagaccaggttgggagcagatgacctgtgaggtctattgcaaaatgttcaccatcagttgggaaaattttttgattcagttccctgatgttgacccatgaggccataagcatttctaaaccattatactgtttttacattggcctagctgttgttattatctgcatttatctagttcattgatatgtttacttaagtattacctacctctcccaccagaatgtacactcacagagaccagagactgacatgatcactgctgtcccctcggccgccagcatcacatctgccacaataatgagatagatactacaccagcattttcaaaagaaaaagggggctggtgtcgcagtgtggaagcaggcaggtagtccttctccacaccagccagaggaagtctactttcatctatcccaccagactagaatctaagctgcacgaaggcagcatttggtctcccctgtttggatgtcacctccagagcctggacactggcagatacacaccagatgctcagtgcctgagaaaggccatgtgctaaacaggaagcactgatcagcttccagggcactgaaacctttactttgtcgctgaataaagcaaccttgaaaagacatcactgtttccactgagttggccttgacttctgcagtaagactcttagcctgctcctgctaagtggtcacagtattggcaagacccagcccaggcacacagtgaaggctaaaatacattgtgtctatgtcacatgcagaggctggggcttctggacaaggctttatgacgaaaaggagtacagtatttgaaaagtctcacagcagcctccagcaccaaaacagcctcagggttctctcctgtttgggccacttggggtaagagatttgagggaacagtctgcccacttgcttctgcatgctggttgatagcaaggccaaagttaacagaaaaatatttcaagtgtgttaataacaatgccagaaattgctcacatctggcacctcttccatgctgaagggagtgaactaaagagaagtgaatggttaccttaatataatttacctttctgagattccctttcctcgtgagtaagaggaaagggttagccccgagcagtggttcccaaacctgtcttatcctcacaagaggatcttttacaaaagaagattccttggcctcccctcctaggcttttggaagcaggatctgtgcaggtgttgctggagaaaggcatttattttttaaatgcttcccagatgactgtgaagatcaatgacatttgggaaccactagaggactggaggactctgcggtccacctggctctgacaggctagaacagagagcttcacaaagtgaggcctaaggaccagttgcatcagaaacatctgagatgctgtgtaaatacatgccttcgtgggcctcaccccagactgacagaatcaaactctgtgtgagacccagggatccgccttcttaagactctctggagtatgggttctactctacagtttcagaaccactgtttcaggcaggattttagagctaacttatggcttatgtggaagcaaatcatgttcatccataagtatagggtttgactttatccagttacattaacatttcattgcattgtttggcatgtcacagaaatctcctttgttttaaatggcatgtagcttatagcaaatgcaaatgtgtaagtccaacagccataaagcagccttctctgactaagtgtggctgccaacttctcagtgcattttttaaatgctgattcatggcttaagacacttgattgggaggaaggtgtctcagctcctattataaaagcacaaaggtggtacctgaattacctagcacacaataggcacttaagtatttgctgaaacaaatttatttacttattttcacccactgttctacagaagatttgaagtgagatgaacaaataaaaagaaggagaaaaaaaacctttccaacaaccgaaaaatgaaaataacattctgtgaaaaagagaatacttctcatgtggtgaaaaaaaatcacacttctgggtggcgcagtttgtaaaacggttggcttcaataactgatctgaaacttaaccacaagtcttcacttctgaaccactgccttatttctatgatagaaaggtttaaacagcagtttttccttgctttttattttttttcttctttttcatgaaacgctgcaatttcatctttctaataggaacacgtaagcactattatcctttacaagcctggtgattatttgtcattattattaccctggttattctagctcagatcagctttgacttcttcagcaatgcaaaattcatataaacgtgcattcttatacctctgtgtagcaccaggaacaaataacatttaagcaaataggaagatctatattcattcctcagattccgacacagaaatcagattgttttaccattgtttcacacttgttataacaccaaaatccaaatccacaatccacttgtattatctatttatcctaaaaaatatgcaaatgaatgcttgtcgctacctcatgcagagtttctgacatatcctctatcttattttttaggcaaactgtatatacttaagtgaaccaaatgatctaaccataaatcttcagaaaccaaggggttaatagtttttttcatccatgtttaaaattgttttattaccccccaaaagctactgtagtttacttttttactaaatgtttatcatttttgaaaaagaaaagctctagatttaaaaaggggaaacgctgaatttagctcatcaaatgacgacctctttttaaaagatattcaagggttgggaattagaatggagtttgaaacttaaaaaaatacgaggattactaaaaatgtcataacaattgttgactcacaaaccaaatttcacttaaatttaatattgagccaaacagcaaataaatcagctttaagttaaaaattttttttcctttacttcctgccaagcaaacttttaaaattcagtatcccttccacagttacatttctgataaccatgaagaacaacgagttaaacttttgaatctggaatagaaatgtctcattccaattaagaaaataactacaacctttgaccttcccactagcctgatgggaaattcactggcaccattatgggtttagccgtccatgtgcaagtaaccactagagggcagccttatctcatatctgacatgcggcagaaaaatacctgaaatgcttctaatgttcctttaattatttttgtagtatctttgattttcctggatacttaataatcaacttcaaatggaactaaaagtattcctaaacagttcaaaagtccactttcacaaacaatgatatcacaaagactggtggtgagaggtgctagagatacagctagctgatgttatctttaaaattttaaaacaaaagtttttcatctttaagtcatggctgcctctttactatgtgctgggttaagtgccaagtcaattatatcacaactggcacttggggtccatctttggcattaaaatttcaagtggttctaggcaaactgaagtgtgtttgaggaagaaactgaccaagattgtgggaaggcagaaccacacttacagcaaaaaggactggagagggacagcagatattacgtattagaggggtgtgtgtgtgtgtgtgcgtgtgcatgtgtgtgttacagtactagtcttcaaatgacttacagtctttcatttgaaagatggattaaatgtgttctgcacagccccaaaggaaaggatcagaattaagggattaaaagtacaaaggagagagttatgcttgatataaaaagacttttctaattcaagatggagtaacctacctttaaagatagtgagttccccatcgttggaggtgttccagcataaccagataactacttggcagaaatattgtgggcagggtccaaatcccagtgagacattcatctgagtgactttaaaggtttcgtctgagactgaaataatccttatttgctttcagacaaacacaccttaatccagcagtcattaaggccattccccactaagtgagaaatgagatttttcagatctacttgaaaacttttagacttcacgtgattttctaaaagacaaacgatttctcaagaatagatctacaatcatgcccctaagctgtcatgaaaacaaacacgacagcactcacaagcacgagaattcgtaagctttatactacacaaagtcatattaaaattagaagatgcatttgtgaatgttccctttgcctaaggataagtggaacatatagatatatctctcaattctatcataatggcgattggttacacaggttagctgtacttcatggtattctgtattcttggggaaaataatgcttatatttcactcatatcctcttaaaacaagcagacttaatgaaaatcatggttgaagagagctaatgataagcaaataagaataaccccatttgtaccaaactgattttattaaatagtaatttaaagatattaggctcagcaaagcattacataattggatctatttttttcccatataaatgccagagttataatttccactaactagagacaaagttatatccaggacgtttttcacagcttcctccaggggaggcatgaagatagaaattagggttgtagttcttgtttcacgttatcagatggaaaagctaggctataacgcaacctctgtgagcctcagtttcttcatcagtcactgatgggactatcagtgactctctatggaggattaaatgatgtaagagtgtttgtaaaccataaagcacaaaataaatatagattagcatcatctccctatttgtttatgaaatgcctagtaaacttcagaagcagtaacattttaaaaaatgaaataactggaaaacctagggaataatcttgacattattttttatacccacaggagcaaagatttttaaagttatcgtattatctcctgaaaatatgatgagggctaacaaatttcattccaaaaagaaaatccagaaacaaaagatttcagctgcttccttgcattttgcccattggatagtatatgctattatccatctatttagacctcctatctcttgacaattaacagaaaaatcatgttctatcatgtcacacaaaatactgacggatagaaaaagctctgactacgactctctcagttcatgaatcaaaaggttgggatggaagggagttatcttcagtagaatagctagatgggggagacagaacttgtaaatcattcctcagagggtctgtatgtggtctttgagatactatcaaatgtcaattcacacctgacttgtcactggtggatggctccaaaaaaactgttttttaagtagagaaacataaaagtggtgtagctgctgactctgagtgtctaattatggctttaaaattattaaatatgaaatacataaaggcagccttgatttcttactaataagtgctgtaaatagtaaaaatgaatgcagaaaacatttccatgacagagtattcttaggaaatttgttccacataaggggttttgttgatccctataataatttaagagatttttaagaaaactgaaccctacatctacctctgcaaatctattcatccatccatccatccatccatccatccatccagtaacttttctccagtaagtggccatttataaatattattttcctagataccccagagcaaataagaaagtggttgggtgctattgtaggtgctttgcaattatcaccttgctgatctcatccacttttattgtgtctcacttgagtgggagggaaagataggagaaaaaggagactaatgagaattattaatatatttacaagtgtatctactacatattaaagagctaaggtttagatgacatactgtatatttctaaatgactatttctgtttagaaattacattatttcatgactgggcagcattaaataaattatatggttctcaattcaaatcgtgggcaaaagggtttacttgtgcatgctgctgctttgtatctcaagtaacgtgattgaaatatataaaatcaagaggctgcccatgaaaatggtgcttttaaaatactctctacttcatggagggtccaggcttctccctcctcccatggacaaatggattcagaaatcctctttgtctttaaaagaactgatcccttcttgccagataagcattctgctcagtagtggcaaccatttgggttttctcttttcaagatccagccatcaccttctcccaatccttcccatcacaagtaacaaaaatggtacaaaaatcccagtgaagggataccaggcaatgggtccttacagtgagatcagagatcgaattctaatttcatttcgtagaaagaaaggccaagttcttcaaaactacagaatcgtatttattacagttggacatactaccaacacatacagtattttcaaagtggtgaggagtcttgcatttgcacatgaatcaggccggacgaagaatctacgggccagaaattccctttaagcctccctgtgctcttataactccatttgcacaaacacaggctgagcactcatatgaagcaaaggggtatatcatctactgaaactgatgaacgtcttacatttcctttcagtactccgctgccgcgtgacatctggccaatgcacttttatgatgagcagaacaagtgctcccccgattataaatgttatagctggctctctccctttgcccaagaagcaatccaaatggtattggaattttgttgttaattaaacaaaagcaaaattgaaggatgagactagagttactcaaatgaagatttattacatttgagcatgaaactaagcctaaacttatttgacaactaatgcagaggaaggattttcttctttggtgagttcaaagggcctgatttactgatgtttaaaaaacatcagtaaatcagccaacaaagagaatctttcttttatggtggcttgttctctcctcccttgtccacatgcatccacataccaaaaagctatattgtaaacagtatttctgttttgcacgaaaaatctagttatacaaactgtcttacacatggaaccaatttaactattaaaactgagaagcaatagggaagtatttaataagattctaagccagttttttcctctaaatctgatatggaaacatttacagcattcctcacttccccacaaactattttctctttcagcttaagtttgcaccaaagcaagataatcccattaaaattcaggatattatgatattgggagtgaaatattctaattgttcagatgcattctctctccctcttcctctatctctctctctctctctctctctctttcaggcagctgagtttatagaaaaattgcattgccagtacttctgaggcacttttttcaaagcacaatactatgaaactattattttatggcagacagaggtcactccaagtgtgggggtagcgtgtgtgattcttattattctattagcaagggacagtatggaacttcactttgtagaattacaaaagcaaaagcctatgtactaggaaacatcaactttaaatcaaaatattaaaacgtactttccttttttttggtgggtcgttactgttcattaggggagaaagcagtttaaaatgtctcagcctctcgcctttcctccaatcaacacaaagtatattagacaaagtggataaagactggcattgacatcttccaaatagcaaaatcaattttataatttaaagacaaaaaatgctttaactgcagagggcatttaagacgtttcacacttacagggctaatgaaatgcaggactagcataaaagttttttgggggggtgggggagaatagattttttaacataagaagtcgataagaaatcttaataatttttcctcccaaataattttaagtgcttaagagcgcggatcacgggaggtttcctctcttttacttatatgaattacatattctaaaaatgattaaatcccattcccctcaagccacaggggaaaagagaaaatttgctgtgggcacattatatagaaagatttcatctcaagcagctcatcttaacgtccagtacgtttcggcctgttaataattaataaaagagatgccacccaatctctagtgaagaaaggcaaagctcggtgatccgaaagtaaacccagcgcagataccgaactggtgtccttcattccagattgcaacacaaccccaaactagcaaacgtttaacaggcgcttggcacccgcaccggtggctaggacccgcaggacagtctgggtctgcacaattgctgcgcattagggaagccgcgtccgccgcaaacagatggggctctaaatccccaagcctggcggccgggcctgcgaagcagctcgggcagattatccacggcgaggaacctgcgggcgcacaagcgggcggcgggcggcgggcggcgtgctgcgggctgagtttctccggagctgtttgcaaccgtcccaagagcgagtctcggtttctccggcagcacgggcgacttcctgaacacctccaaactttagctttcccatcagaaagttccctgacttgccacggtttctctccttctcacctgagaggacctagagccagtcctccctccaaccaaatccccctcccctcccgcccccggcccggctacggagtcctgatgagggcggaaggccgggccgcccggcaggattggccgcgactaacccgcgcccgtcggccctcaccacggtctaacctccgcccctgcccgcggatcccgtgggctgccgagttcctccccacctccatccaccagccaaagtgtcaagcggggtgcgccgcggctccctgggccgcccagagcgtcttggcacgctcgaggcgcccgtctcgctccggcccgcgcgctttcggaagtggccgcggcgggacacagcgcgggacacagcgcggacctgcggcacttgcccggccggcggccgctgaggcgctcggggacgcaggggcagggcgcaaggcctggggcgctgaccagtccccggggatgacatcgcgacaacgcgcacgcacggccctgcccggccgcggcgcctccccgacctaggccggagctgtcccgggtgcgggccctggggaccggccgcgggcgtccccggcttcctctgaactccgcagaccctccccttcctttccgaagcgcggcgactcccggcaaactttcttttgggagacccgcccggtgccaagcggacccaagagactgacaggagccggagggggcagcagagggggatccaccccgtgcgcctttgccccccaatcggaggcaggccgatcccgtggccgggctcaggtggcgccgcggcggtggcccagaaggccctggcagggcccccgcgccgagccccgggcagtacgtgcgttcgggcaggcgcgcccacccctccccctgcgcgccctcctccccgccccccggagccgccagcccacccggccccggcggggcgcccgggctcacctttcatcgctgcgatcacaaaatacatcatttaagccgcggtgcggagagcgcagggagagcggatggtccgaccccggagccccctctgccgccgccgcgccgccgccgcccgagccacagcagcagctgccgcagctgcccgcccgccgagagccatcccgagccataagaggctccatgtgaccggctgacatcacggccgccgctctgtttacaccgcgcccctccgcttcctcccggggcgggaggcgggaggcgggaggcgggaggcaggcgcgccccagcgccgcgccccgccccgcccccgcgggcaggtgagtagcagcggcggctctgctggcccaccccggccgggcctgccctcccgcgccccgggccctcgcccgggcgcccgccttcccctcgccttcgggatcacctgtggccgccggtcgcttttctgcacgcagcgccccgcggaacgcgcctctgaccactttctgcccccactcggtggggcaagaggctcgcaacccgacgccactctcccgctggcttgccggagcactcgggggcgataaatgcgccagctcgttggtggaaaagacaggtttggtctggggagctacggtcacccgcatttcctagagtgccccagctctaatcggaaggtacggcccacttctgggccgtggagaacgaagccactgggaccgtccggggagtggagtaagctcctccgaagtctttctggagagactcggcctgggcgggggaactccgcccacccaacccttggcaacccttggatattggcagttataccaataaccaaggtcctggtctacacctgtcccccccaacccccttccccgcgtccaagaccactgatacctgcaaggaaagccggaaattgtatgtgaatcacctaaatgaactccagttgccagctgatttgagccgctaaattcccaggctcttccatatctctccagagaacccatctacaagtaggaaaagctatcgttttcataccctaaaaatgaaacactgtggtaattctgacagaaaataaagacctctgaaggtgaactttgtacattttaacatgcgactaagacttaattccctctaaactttgaagcttaattcttcttactgtccttacggaactgtaaatcatgacgttattattttacaggtcaatctctttacaatgaatttcagatgctacatacccagagtctgcattgtttaaaactttggtcagggtgtctatagtaccgagcataacagaaaaaaattctgaaaagccaagtttgcgtacctattgcggttccttcacgaaatttcattctgcttgcttttctgttggtctgttgccacgcacaacttaaaatatcagatggctattagctgttgcattcatgatgattaagcaaggataattctagcatatttttttctccatgtaagtgagttgctcttgcccctgagttgggccacaatttaaaacacaagcaaataatcagcaccgtagaaaacaaggattcatacactccctccccagccccctttcaaggcaaaattgagtcttccaaacatttatacagcgctctgatttagaaggtcaataaagttcgttgtccttcagtcaagccatggctttataaaagtttgatttcagataaattcattctaatacagctttttttcttaaagatttttcccccaaaaaaaactacaaagaaaagaaattataaaaatgtgaacccaagacctacccatgttaactcagctgtccagccatagcaaagtggacaagagtttcaaatgaatcagccatacccactgtaatgtttacaattatgaaattaaatcacaccacgttcctatgatgcaactatatctcccaatgaggcaacgcccctcagttacactgacaccatcattcacatttggttattgatttcccttgtgctaacgactaatgccaagctatcctataagcaggtcccaggtacaattttctttcttttgtatcgttaaaggatggaaaaccatcggagactgcatcctcggaagtatgttcttccctactcaatgcaagtgaacccagatatacaactcggatgattcacaatgctactttaaaacagtatcctgctttagaaaacaatgttttcaaaagaaccaaatctattagctctagcgtgccttgtgagacatctgactccaaggtgaataatctgacatcactagtaatcagtatttatttccagatcatttcaaatgaaatcagtcattgggaacaacatgtaacatgacatctgctcctgcagttataagtagaatcattcattctatagatatgtccccaatagaaatataatctcaagtacttatctgaaatatttacacatttattcaacaaagacatttccagaataatgtaatactgaccttgccctttggagatgtacttcattcacttcctacaactaatgagcaacagaatttcagatatgaagtcctaaccttccaatgtagctagatgctatttgtaatacatgcctctattaaatgtcttcagcttttaacccaggttatattactgttctttatattaacacaaagctctttgagagtaaaaactataggctgttttttttttttaaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcaggagttcaagaccaacctgggcaacatggtgaaaccccatctctacaaaaatacaaaaattagccaggcgtggtggtgcttgcctgtaatcccagctactactcgcgaggctgaggcataagaattacttgaacccaggaagttgaggttgcagtgagctgagatcacaccactgcactccagcctgggcgacagagcaataatctgtctcaaggaaaaaaaaaaatacaatcaagtagaaatacaataaaatattaaaatgcaataaatatgtaggaataatcgtttggattttattaaataaatgcttatgagtaccgactgagggagaacacagtgctaaggaacatattctttctttttctttttaccaagtgttctgaaaaaaaaaaaaaagtaaagtaatattgcttacatgaagataattaaacagaatgggacttctttaccaggaatgggagtttgttatatattaatttgcagctcaaaggtttctgttgactaatctcagaaaaagaaggcacacaacatacttataaacacatgtaactcatctcagagtctcccaggatggtcacagccccacgtggtgttcctgtgtgctgggttccacactgagtctgccacacagtaagaaagtagagagacacttctaatgccaagttgttcccaaaaacacctaggggaaaagatgggtgcatttttgcaggagtctagacggtagtatcactagtaaattggtgccagtcttcctatgttacagtttaaataaatgatacttgactttatgagcgtatattttgtttttcaccacacaagttctgatctcataatttgccaccccaaatcacagatataatgctattggggagaatgacaaaccagtggactggcaaacttatcccgaatctgcaagtggctcctaggacaaaggtgatttcaaagtttgctgatgcatgtgaggcacagcattttggttttgtctcacccaggccctgcgtctctctctccagtgtgcgtctgcttgctaattcaattaattttgttatagctgaacaagaaagggatcagtgaaaggttaatgtggtcctaggcagcttgattcaatggaatccttagccaccactgcactgtgacctttaggagttgagccattctggttgacatagagccaggggaccaagtttcctataaacacaatagggtcagacccagagagttctaaagcaaggatacttgggaagctatggacacatcacaaactaacctagaagagatcacagccttgcttaaatatgagtccagaaggagccagtttctcataaaggaacacttacaaatggagtaacactggtgagacccagaagccaacagtaagacaaggaactctgctgtttatgagtataaagggggacgggacaagtggattaatgtggtttatctgccttattcatgattttaaaatgaatatagatgtagattgaaatatgcatgtatgtatacatatgcatagttcatgaaatatcgtgaaatagactacatttgggtggcaagagacacctacacttttacacactcacacccacccacacacacatacacatatttctcataatcagccacacttactgagtaggtattatgctgacactgtgatggataatcaaacaagaataagacagtagccctgattttgagaaggtcacaaatcagctgacctgtgctctgaaaactgtagagttccgtgagtcggtccaaacattcctaaaggtgtaacatgtctggttgcccattgaaaagatgtttgcgcagcactgtgccactcactaacagttgatagatgactgcaaatcattagtgtggctattagtgtaatgggatgttggaggtgaaagatttgactaaatggagacaatggtgcagggcttctgggatttctggaaccatatatttcatacacctattaggaaattcagaggactggcttatgttttgtaatcaccacaataaggaaaagggtaaagttcacaggcatacagagctgagcaacctccacagaataggtgggtggcaggtgcctcactacacacacaccagtcaaggcaggaaggggagaaatgcaaaccaaggccaagagggacctccattcctttatgtccccatgctgtgtcctcaccccattcctatacctggcagtggtacaggagatacacacacacacacacacacacacacacacacacacaacatatatatatatatatatatatacacatatatatatatatatacacatatatatatatatatatatacatacatatatatacatatatatatatatatgtaagcaaacacaagaaatacaagtgaactcagaatctggaatcctgggtccaggatagtttcacacttgtcattagctttctacatcacatcgggcaagccattttacctttcaggacaccaggcccctcaactgtagcctgatggagtaggaactgactgcaacgggcccctaccactcgaacatcctgtgactgctttcagaatcattccccatccacttttcgggaacactttcttccctttctctatgctgtgccgtatctgcttacttctccaagaagccttctttgtttgcttgaactccatggtatggtggaatgggctttggcattagatgaagttgggctcaaaaccaacctacatcccactcactagctgtatgagcttgagcaaacctttgtttcaccatacgtcaaataaggagagtagagccttgtagggccactaggaggattaaacagtatacagaaaggaaaaagtgatatctctcagtagagcttacaagtggaactgccatcaccaccccatcagcccttacattgttacacacacagcacctgtgcctgacataaaatgttaacccttaatcaaaatttgttgaaatgtttctccgcatgcacttttgctgagcgttctacaattttgaaactcgtgtgtgtgtgtcatgtatataaaacaagtatagttgacccttgaacaacacagatttgacatgtgtaggttcacttatgtgagaattttcttccgcttctgccacccctgagacagtaagactaacccttttttcctcctcagcctactcactgtgaagacaataaggatgaagacctttatgacaatccacttccacttaatgaatagtaagcataatttctcttccttatgattttcttcataacattttattttttctacgttactttattgtaagaatacaatatataatacatataacatacaaaatatatgttaattgattgcctattttattggcaaggcttctagtcaacagtaggctattagtagttaagttatgggggattcaaaagttatatgcagattttttactacaagggggtcagcacttttaaaccctacattgttcagggatcaactgtatttattaagcacctgctaagtattgaggacacaaagatggataagaattaaattgtccattggcctaagaggccctgtggtctagcaggctttttatgtcttatttcctataggagagaaagttctcatccaatgagcaatgactaaacaccttctgtgtgcattacactgtgctagtatgtcgagaggaaaggacaaaaatcaaggtatcagtctatcctccaaggagcttgcaatctagtaggaaaataaacgcaatgcttataatgtaaggcagaatgtgtggcacatactcgaagtgttccagaaataaagtgccatgtaagtcaagaataagagtggttactatgtgcggggttcatctgaaactttaagagaaggaggacttcatgaaggatatttgagctagaccttgaaggccaaatcacatcttggtggatagaagtaaaaatgaagagcctcttagaaggacgatagaacacagttgtaaaagtacaggctgggtgctgtggctcacgcctgtaatcccagcactttgggaggccaaggtgggcagatcacctgaggtcaggagattgagaccagcctggccaacatggcgaaaccccatctctactaaaaatacaaaaattagccagctgtggtggcaggtgcctgtaatctcagctacttgggaggctgaggcaggagaatcacttgaatccgggaggcggaggctgcagtgagctgagatcgtgtcactgcactccagcctgggcgacagagcaagactctgtcttaaaaaagtaaagaaaataaaagaacacagttgtaaaagtacgagacagaaaatgcatttctcactcaaggaaactaataacgagcatttaccagagataaaatacacacagataagaaggggagaaagcccagaatgtaggttgtagctatttcttctgccttccctcacagtgcccaggacagagctctgcaaactatacactttcagagaatgatttttgaaaaaataattggaggtagaagaagggaattgtgcttcagaaaataaatctctttgcagcttgcctatttcatagtcttattgtaaggattaatcgttggtttgatagtcataaagttaaattacacttaataaaacacatagagcaaaagagttccacatcacagcacaccaaggaagaataaaactggaaatggatgttatttcatcagagtgaaaagctaagcagagcattttaggatgaacaagataaatggaatgttatttgattttgtatctcatccatttcagttctgaaaattatctgagacagttctattaatatagatgcttcatatataggccatattttattttttaaagaactatcttaaaaatatattttcaaataatggagaaaagataagcggttacagatggttttccctatttttgtcatgcatgatcaaggactgcagagtaacgtgggcttcattgggaaatccaaatctcgcagctaggagcgttccaggagcaaatgctggcattattttgctttcacagggaaaatatgttcctgttcagtcaagcaaagtaatcaattattctgcattatgaaatactcattttataactattgacatttcagacagttgtgccacatgtcaatagtggttttgatgctcacatttaagctccagcttataggatgggattcatctgggctgacagtgtctgaccagaagtctattctctgctctcagaagtccatctattatttatgtccagtcctacactgtggaagtctgttgtgagcgctaaaacaagaatagatttgggtattttttgttttaataaaaaggttaaaattttctcaatatgttagatccacattttaaaaaatcactcttctcttaaaatctcttcctacattttgtaagatggaggtagattaaattaggcattccagtcagaagttccaaaattcctgttagatttttagtatctagtaaagccttgtgtcctcaaaaataattttgtgaaatcaaaatgggtttccaatcattatataatactgttactgttgctgctactacctctcctactggttaactattccttggaacttcctgtgtggcaagcattgattttatgctctttttaaaaatcatttcatttatggaaaaacattctgtacttttattacattcattttacagatgaggaaactggggcacagagaaattaagtgacttgtccaggaggacagggccaataaccggtggaaccataagaaaaaaatccaggtacactgattctagcatgtgcactcctaaacattatgctgcaactctcaaaaattgaattaatttttccttcaattcagcattacttagtatttcaaaaatagcaagctgacttctccagaaatcaagaagtactaccctcataacatctaggcatgtgtgcaagaaattcttttatcactggcttctataattgagcaaggttagcatgtgtcattatgaattattgcacaatgtagtaaattatttaattactactaatgaggaaacatactgtacatggttgtaattattctgttggaaaacaatgttgccatttgtacatttaagaaacacttgctacataccaaattaactcttgagggaagtttattttgtatttcggaataatcaaacaactctaaatgttgttaatggatgttagataggattacaaggaaactaaaaaatacacaaatcaaagctgacgttcctaaaagactccaaaccaaaaacatctgttaaaaaggtaaaaaaataatgatttcatagttcatgatattctacagaaaaagcacaagatatatttactgtttttacttttccaaattgtttcactgctgctcttttcacagtttttgcaacatatataatatagcagtttgttcacctactttaatcacccaacaaatggctttgatagcttaataatcttaagcagagccatttattttcaatgtactttgagtaaactgttatctacgtttattaagtgactgtagttatgcatagtcttgttatttataaaagaacacagtacatacatagccctgggatgttttgacaacacatcttaagtaaaatattagtaaaataattttcaaaatataataaaagtgagaaagagtgacttgtttgtgttagctacagtatacattattgagaaactactgatatgcattattgaatttgttgtaaagccttaagtacgtaatagtcttggaaagcccaactcgcccattatttcaaaggttaggtacatgttatatggtgaaactgactttcatagaccagaatgtaacggtgatttgatttacaacatctttgctccttgaaatataacagaggtaatgtagcaaagccattataaacagggaagaataaaaaagggaaatatcagagttcaagacactcaaagagggcatttggtaagtctctctgcttccaaggacacgaacagttaactgtctgtttctgacagttgcctatcattaaataatcatattcaagcaagataagtgatattatcatatttgctctgttgtcttgtttgttatattatcccaaggtcagctgccattaaactgggtaatccaaatcaaacaaaagttttgtcctcttatgaataatgcatatattggaatcatattatgatttgcagatttcagcacttgtcaaaaaactagtaagaaactgtttcctgtcaccatgttagatttaggcgtaacaaaacaagagaaaagaaaacatgttttatatgttcagagagatcgctgctcagtttgcagtataacataaattactacatagtggttattttacactaacagtattttatcaactagaactactgtaaaacatatagagtgctctctattttaatggtattttctgatgtcaccgtgtcaaactagaagaattgcactttgattcgtctttcagatctcagctttttaatcttattaaaatataatttacatgttggaaaactcaccctttttaggatacagttctttgagttgtgactaaggcatttaattgtttaaccacaattaaattaaaagacacagaacagttctattcccctctcccccaatattcctctgtgcccctttatagccaaccctccaccccaaatcctggcaaccagagatgttttgtgtccctacagctttgcctttaaagaatattatttcagtggaatagtatattatgcagcctgttgactggtttcttctacttagcataaagcatttgagattcatcccgtgttgttgagtacaataatttgctctgttttattgttgagtaatattccattccacagtttgtttattcattcctcaattgaaggacagttgggttgtttccattttatggcaatcaaaaataaagctggtataaatattcatggtacaggctgtggtgtgaacctaaatttacatttatattggtaaatacctaggaatgggactgttagatcatatgggatggatatatacatttaattataagaaatgcttgatggtttccagagtagctgtgccattttgcattcctatcagcaatgtatgagagttccagttgctccatatcctctccagcacatggtgttgttgaatatttatccattcattgctgattttagttcttcaaagtagttaagttctataaagttcccaggaacactgaattttaaaagacaaaattattcgtcctagaggaaatagagggttaagtttctgtgagtctgtgctcataacttttttgtcaactgatcaatacctaactttgttttatgtgtgtttctgtttaaagacatcttatttagtatgtattgttgattcaataacattgcactggcagccaacagcagtataactcatggctagagacagcttatgtaacacattgtattttctccattaagacatatcacaatcttctcgcgcttgaacactagacagcacttcagcaagcactgtgcttggggatcattttaaacagtgagacttatcaacaaaaagcacaaacagggcggggcatggtggctcacgcctgtaatcccagcactttgggaggctgaggtgggtggatcacctgaggtcgggagtttgagaccagcccggccaacatggtgaaaccccgtctctactgaaaatacaaaagaaattagccgggcatggtggtgcgtgcctgtaatctacgcaggaggctgaggcaggagaatcgcttgaccctgggaggcgtaggttgcagagagccgagatcgcaccactgcactccagcctgggtgacagagcgagactctgtctcaaaaaaaaaaaaaaaaaaaaaagcacgaacattagaaaaatatggcattgaatagactttaaaaaggacacctgtttataatatgacagctgaaacaagagggcagaacatcacctcaatggacctcagtggggaacctgttctaggacgctgtgtgcacatacttgtctgccaatgaccgcatacccagtgttgattttggggttataaataaattttagtgagtatgcaaatttgtaaacacaaaatcctccagtaatgcgaatggactgaccttgtttatctgctttttttgccattctatggtctaagtttaaatgtcactgccctatagacatcttgttcttctctttttgtaaacctgattcgtcactctcttttcaaatcatttattatcttttctgccttcttctttagactctccacactagagtcaggaaacatacctgtcttactcgccattgtattccttatatcattaaggcttaccatagtgcctggcatacatagatgttgagtaaatatttgttgaatcagtgaatacttctttgaaagtagcatgtatggaagaaaaagcactggaattggagttggaaaatctggttttccattctagttccaacagtggctttgtgattggtgacaagttacttatattctttgagcttcaatttcctctcctgtacaactgaaaaactaacacctatctttagagatgtttttaagatcttaaaagtcaggcaataaacatgaaacccattagtatctggcacactgttgatacccaataatcactggattggagtggtttatgacctaccactagacatttataactgtatgagcaatataaaatatactaacaaacagtgtgaacagggagtttatttggacatacagatagtgctaactctccatgtatttggcattatatactcagagctcccaaataattaagataatttttcactttagaagtggatcttttgttattctgtcaacctagctatgttcttcagagtcaaaggttctacacacgatatactatgtacatgtcaccatgaaaactgataatttgtctactccatttcaaaaaaaaaaattcctgaatgtttaaaagcaattcttcgtaatgtagttagagtttgtactctctggaaacaagatttttttttctttcaaacactcctagacaaacaaggacatttagttaagaagcttattatgattctgtctgaaatgctttcttaccaaaacctattgtatcccttaggatttcaaggcaataaaaaccaataattttaataaaattatgtcaatcttcccgcatacaactaaggctaacaacataatctaaatgttaaactatagtggaaaagaaactacgtaaacaatgcataaggttacttcactcaaaatttatacagatggttttcttacaaaattacgatgatcagatatgattaatgatacgatttaagattattggtctttaatagaggcaaaacatgatgactcactgacaaagcaagctaatagcagggagggagagaaggtaagtttgtatatttgattacaaagcaaaacagataagtaaaaccacagagtaaataatgattatattatatgaaactttcattgtttcctaacttacatttatattaacttttctggagatgacgttttttaaacatataaatcgtcattaggaacctgacaacagttctaaatcaaacctagggtttaaaacatcatttgccgacagacatcctccaagtgttttccgcagaggcacatcacttctgattattcccaggctattttaaatgatcttggacagggctactgaatgacttgtcagcgaacaggaaaacattatgacaccacttctccagatttcttcccagaacacgaaatatttgggatcgttctaattgaatcaaggctagcttgaaaaaacaagttaagcttcactttaaagctttcagttttaactggaggaatgcttctaacatatggcagctgggctctgactcacagcaaccttcaaattctggccaaaatgtctgtttcctgagattgtgtctgatatgcctgtgtatccctggtggggcccagcaagcattcagtaaatgctattgttggaacgaatgaatgaattaaagggctcctaattaggagctacaaattcttccagcaacaaaataatcccataggaaagctgcaatgtacttggaattggtatctacgaagagttctattttcagctcctttacaaattatttttatcatttatgctcaacttggtctttcttgttgttgttttttttaaaccaagatgtgaaaagcacagaagcattttctagaacatgaaagaccagtatactttgtagaaagtttcatttgtatgtagcttgtgtgtgataattatttttaaatctcagttaatcatcatatattttctcggagcagactttgggtgaggcactacgtgaaatgtttgaaaaagatagttaaaaggaaaaagtcctattcttgactatgcaccaaaaattgtaactaacactagtagaaggtaagcagtttccagtaaggcaagtggttatctaaagaaatactaaattagaactgctatctcagaagtataaacaattgctataatacttttcaatcagacatctctcacatgaaagccttgtgaaataaatggaagacagaagccgaaaaaacagaaaagaaaaaagaaaagaaagaaacaaagatcagcagagataccactaaaactccaagaaccaaaagtttgtatatgtgctttaaaaagcatccctttgatatttactccgaggcttttttctcttatgtaagacataattctgacaaccttgatgtctgaacttccagtataccggagatattttggaagcacaacagagacttgtgctcataggcgcaaagagagacaataaatattgaaggaagagatttaaaaaatgataaaaagttagacctaagaactcaaaaagtatggcagcatggagccatttagcataggggcaaagagccaaccacacctgccgagtttctgagtgcatcctgtattacagcatactgtacacaccataataattaatggttataatgactttgaatcactaaggacgtattaacccatgaactctaagaagacagggacttacataatatattttgaaagctccccttccccctataaagtgatttagtttaggcacttatagaaatacgctgcagaaaattaattttttatgatgtacctcattttctgatactgccttgaatgtgacatggtatacatacctaaaataataaccctaactatttaagaccttacactcaaggacttaggtgttcttgtttcagtaagctgtgttctgaagcatactggaaaaataaagcgtgttccataggaagctacctgcattatacacaggcattttatttaactctaatattagccaaatatcaataaagtaaaaactcttcaaacacaaccctttccccctatttaaagctagaatgtttttgtaaatatttactggagtgatgagtgttcagggctcaagtttatttatacatcattctgtgaaggtatttgttgcaattgctatttatataataatgtttaacctgccagaattctggagaaagaaagattagcagttaaagcaagttcaatgggaaaaaaagaagaaagccatagacacaacttggcgttgtttccattcagtgcaggtgaagtgacaggtttctaaaagtatgctttatccatgcacacacatgataccgatacctttttcttggctgcaacgattctttttcaaaactgctagcctgtttccaaggcagctgcaaaacgtccgtgaaaactagttaatttgtaagaggcatggaaactgctgcctctccacctgccaggctagatccacatcgtacagactctacaatggcaggagctgagggtcctgagataaattttctcggctcctgcatagacggaggaaagggaagtgattgctgagaatgtcctagacatggacgcggagctcagatgcttttgggtgttctgtctctttcactccacatattgtcctggatgcagaataatactttttgtattaaagtcaccgtggccacctccaaattgcttttacattttattgttattatcattatgttgttgttaatgagaatgcagctgaaaggctaagtttgacacttaaaaacgaccaaaaatccagcaggcaggaatcatccccactcacagatagggtaagtgaagctcaaagaggcctctggttcagcagatcacaccgctgatggtagagctgggacttgaacgggggtttctgactcccactctagtgctcactacatgttgcaagatgctaagtattgaaaactgatttcctgttcctgaagagtttatattttgagaaacacaggttggcaagtgtaaggaaagttttccatggtaggactttgaaaaggaaacaggaggctgttttttatttcttcttcagaagattttttgtcaccacttctatctttctttctgttcatacactttttatattatctaatcattcctgccacgagagataatttacatggctcttcaacaacatgtcaccaataaatcaccaaacacattttaataaatcaggccttataacaatctacagtaaaccggatcatatgatgttgagcatataccaagcctggtcatctgatgggggttttacagtctctggtcctttctgtgtgaccgagaaacacacacagtttacaaagggcccccgtgtctatcatgacattggccttagaagttaagaatatacttgcagttatgtctcttcatttttatggccctgtatttcattaatttcattaagtcttccttgtacattttaatatttcatccattcacatggtcaggaggtctaggcaggctgattcatatttgcttaccaatagcagaaaggaagggttcctatgattaagtctaaaactgacctcctttccacatttaagggattatcatttggcatctctgctccacagacctttgctcttaacaccatttgcttggtatgaaatactgaattcatttagaaaagaaccatgattaggtactagggcttttgaattaaaacgtgaaatacttaattaggcaaaataacatggaacattaatggcagggattttagaggaaacaaaaatgtggcagccttagggttaaatgacttttaaaagtctcaggtatagggaatgacagacccagaaataaaaccctcaacatctcatacctgctcaatgttctgatcatttgtcacactctaggaagagacaataaatatatatctgtggaaagtccataagatggaaatgaggtggcctacctttcatcatttgcaatgatcacagacaaagccatttataaaaatacctgccataacagaagccgccgcatctcaacccaaaatgggaagacacagaagaggttgataaaaatgaaatcatgatacacgaatcctcatcctatcaccaaagtggttgcccaaagaggggtctccacggttgcctgatgaaaagcacaaatcatggactacccactgggaaagtggggacagagaagtgagggaatggcctcttcttcagaaggctgaatggctggactctgtcgaatgaatagataacaccattgcagaacagacagtggagatgaaagtaggagccaatgaaaacagaagcagggaggaaaaccatcaaaggcgtgaaaaaataacaaaagtccagggactgatgtgatcagcacccacatgctaaaattgcagctcgagagagccgtttgaagctgctaaagagatttaatacaatctggaatgaacagaaattgccatcaaatagaacagaagggccaccaagagaccttaaggaagggcaacctaatggaatgtgagccctgcaaagagctcacgtggcaatgtccttttgaacatctcaatcattctaaagtgtcgtgtaagtcacacacacacacacacacacacactacacacacacagtccagggtctgtggggaattttgatgggaggtgctcatcaaaagtcttaaataatgcaaggcaatggcaatccatccgatcttccactctgaggaccaggagcaaagaacagacgcaggtttcatcaaagcagcctctcatctttctagcacatctgcaatgtccatctcaccaggggtgaccttctgagtgaactttgggagagacgtgctctttggttttgtctgggttgcagtttaattcagcaggaagcgggctgtggctgggaaccacagcacaaagaaaatcacggtaaggaggtgaaaaatgcgggactgatcgacaataagtgagatgaaataaatgactggtagttttttatgagaccagcagaagaaaaatatataggtatatatgataggtgatcacttttaaggcttgttccccattgctgttactaagtaggcagtgatagaaacagcacaattgagcaataacactgagatcagagagagagagagagaaggaaaaaaaaccccaaaaaccaaaaggatcagagaggctctttaggactgtgtccaatccagggcgaccatccaaatacaaactttgaatttcattcaagtgccatgtggataaattgcattgtggagataaaatatagagactttagaaaatgattctgttttcatgcagatcattgtcgataactcctcaggactgagagtgttttggtttgtgcaaggtagaaaaatcagaagataataaaaagttcgtagtagataaagctaagaagtcatgtcacctaaagtgtatgggccagtggtctttcctaatttcaaacaaagggagaaagaacgtattctaagtagggacaagttaaagggaatttgcatttggaggtaaataaaatttctattgccgctcaattatcttcactctgccaggctgggtattattacatagacagtggggaatggaaaattctttcctcttgaatgggttcaatctctcagacctcagaagatctccaagggaatctccatagcaggagtggctagacccttgtttcaatatcttctgtctctaacccttggttgttcatttcatatcctaccatgtttccagcactgaatcagccccagaataggacatgagtagaatgaaaaagggattcgatttgccatagctttaaccttcctcaaagtcttctgtgtttatgtactacgagttttctagtgatatgaaaatgcatctttttaataattctattctgcattttctttgtcttggtagaaagcaaaatcaacatgtatctttacctcaaacaatcttgagttttgcaaaaaaaaaaaaaaaaaaaaaaaaaaaaaaggtggagtcttctttgcacgaggagtctagagaactcttagcacctagtaggtgctcaataaataccagccaataggcagggctcctttcctctgacagctggccatagacacaagctgctttgggaaacctgatggagagacccgcctttctggcagagccatcctcactctttcatcactgcactcaaagatattactgatgttggtcctctggttttgctgcttttttcctctgactggactaactgagtctactctgctcactagctgccacttcagaatcctgtcacgcagcggaaggccaaaggacattttcccctaagtccttttaacttcctggcattccgtttttcaaccccacattaaaggtgctgatgtttcatcctagtcctaccagccaatgggtggcctcaagttagactaggcagggcttctatcggctctttccctgttgggcacagggagaaggaacccagagaaatgtttcctcaagctcattttctaatttttccttggatgctatcactgaagttctgagatcatgtattaagaaacagacacattggaaactaacatacaacagatgtcaacctagggccaggactggccagcaagactgattttttgcaagttctcaaaaataatttttttctttttgcttgccttttttcccctgtgcccttgtccaatgcccagtcatcttataatccattaaagctggtataccaattctgtttccttcccaagacaagacctgccaacttgaaaaataaaaatgaacctcccctctttttggcatgttcctccaagcctcaactaaccccgggcagaaactagtggatgtatgcccagttgaagcctgaggttagagtcataatttttacctcctttagcgaacaattccctggtatgttcctgaattgtcattcttagtatattgctagaccaggcattagcaaacccagcagactggcattctctgcagtttggtagaacaagcctgctgtcatacggaagctgaaatccgagacacctctgtacctagaagaatctctctctctctctctctgttttttttttttttttttttttttctctctctctgttttactctgtccccaggggtaaagtattttctgcaaacatgaaattagtttatattttaagggctttggatttactaattttgactaagttaaaaagggcagagcagtctcctagtactctcctgagtgactcaatctgtgattcttgggaagggtttaatggacatattttattttcgttcagggtgacctcactgatcattgtgcaaaatgccttttcttttttttcctccttaaaacaaaataactgcaattttctaggcatttcctagagaaggaaactgtatttttttttttacttatctttaaggccactgttcaggaatttttttttttaattctatttaaagtgtaggtgaaggtgattatatctttccaaagtcagtaaaacaaatgtgttgcataagtcatttcaattcaattaagagaaacaggtcagatgctaaaatattagtaaaatcaattatgagtaataggtctcctgtataacatgtatcactacaaccgcctctctcataatatttgaataaatttacatttgtttcgtatctctgtgtgcctgtaatatacaggggcgtcacttgaccataaaaccttctctatttccttctctttgttacattttctctggtgtgccttggaaatgacatgtagactaaccctttagagtgaaggtttttctaaggagagaaagcccggtgacaaattaaaaagagctctggagtcagatccagctttgaatcttgtcctgtcgcttgtcagttgggcagggaacttcatccttgggagccttgatttcctcacctgtgagggtaatagtacctttccacggggttgttctacgattcaaatacaacaacttgctgtaacatgcccaccagattgccaggcacgtctggcattcattaaatgaatgtctctttgtgaactcttttgaaaatcctaaaaattactaatatataagagaaaataataatcacaaaatctcaatttgatatctgtgtgtgtgtgtgtgtgtgtgtgtgtgtgtgtgtgtgtgtgtgttaggattacagccacaaagtcacctgaaaaaaaaaaaaggtgtcaaagggaaagactttcttcttactatttggtaaaagggcaccctcaaaatctcaggtagacagttcatgggaaggccttatgggacaataaatttctgctgcaacctcagtagcctttctttcagacaaacaactgatatctcatatggggaaattatgtgaaaaaaaaaagaatacaacattgagtctatgccataattggaaaaacatgaaaatgacatacatatatgataaaaaatgaaaaaggaaaactggaaattttttggtaggttagtaaaaaaatggtcattttttttcctttgtaaaatcctttattcttacaggacttttgaacatttaagtgaaaaatagagaattgtgtgattagaaattcatccttttaggctgacaggctacaatgcctgtcggttgaaaaagataatatctcaggaagttaagtacagtttggcttaatggagtactttcctcctaatcgcacagaggaaatgcaagcattggcattgactgctggggaggaggaaggaaggacaattttggagcatgggccatcagctgaggggagcagacctggagatagtagaccctaaatcgaaataaaaaaattggagcagcaaggcaaatcagtacaaatgcaacctctggaaggttctagttgtgtaggaaagagcattaaggttgattcttttggagtgtttctgtgtatttttgaggaaaagaggcattcatagggcgcattgatgagaaagtcccaagaaaagcattcaagggtttggaatgcagttcacggacaatctggcttataaagacatggcttctgtgtcggttctatgaccctttgtggggagggggcagcatggcacaggagaaagaacaaggtcttcagggcttgacagaataaggttcaagcccatctctgccacccactagccatgtgtgctgggcaaatggcttaatatctaaaactcagttttctcaagaaataggatacttaatatttatagtaatcataaggtttaaatgagattatacacacgcacatgcagacagacactgacatgcttacatacatatagctgcctggagcatagtaagctctcaaataacgcaccttttctcaatgcagggagcagaaaagagaagaactcccttaaattaataaagttcttggctgtggctccatcccagtttatgtgctcaagttgagaccagaacagcctgctcagggagctacaggttgaagagctgtcagggaaaacagaacagcgtcaacccacacacagccccctttctgcttcctagaacctggtggtggatcagctgccactatccacagccacccaagtcctaatgctctctcgtgtttcctcatcttagtgctagtgcacttggcagagctgatggctctgattcctgtattttgaatcctgtaatagcccatgctgaccacacttggggtcaggggatatagataaaggggcactgggtggcttctcttctccacggagccttgagatcgagtgcttctaagtcctgaaggtttgcctatcttatctgggaaaccagtaataggaaagaataacaccccagccggtatctctaaccctcaccttgcaacaagtgtaaaatgagaaggggagggaagattcgccccaaagtctcacgagatggggcctccaaggacttatcaggagcttgctaagcaggtaactctgtaccgggggctccagcagcagccggggaggagaaggctgataatgggatttgcgtttacccagcaaaaccaacagggagcaatcttcagtgggtggaggaagaatgtgagctcacgatagcccaggtccggggaagctgctccctgccagcctagctcataaggaagttgtttatgttttctgtttgccaaaaaacctttgtgcgctgctgaaacctgtttatcctgaactcctaacaatcaacgcatggcaaccagttcttcagatgacaagtccttttgttaatgagcaaggaatgactgacgaggccctgctgcctgaaaccccttagctgcatggagttctgtggatggaggttgagagggctgcttcgaaaataactctgctttctcactctccattcacccatgtgccccagctcttgacatgtgagcaacctataagcatgattgttatgagcatgtctcatttggggggtgctgaatttagttcctctaaaaagtgccattgctccaggagaagcaaatgcacctctattggactcttataaaactcaatgtgaagagcattataaaatacctcaaattttgtccacatatatacactcacatgcataaaacactttatgtcctgtttaatgtatgcatgcacaaacttaggcacacatatgtatttgtggtttggggatcaaccgagagcaaggtaaattagggaacatgtgaattggcagtgttaagcaatttgataaaagtgttgatcaaatcccataagggtgtgtgtgctcagggtggtgctatgacgcgtcttcagtgtgtgtgagactaatgccagcgcatgcgtctgccctctcatctctcaccttgttgtctgttaaaatctcatctcccacacctgccaggcaacctcccagttgcacgagggctgtcattggttggtgaggattgagaaattttgatttgtttgttgttttactggtatctgttgtgaaccaaaagttagaaaatattccttgagtccttgtgaaggctcagaaagaaacaagagccgggaagagcagcagaggggtgtttgggggaagttgtgaagaattccaggggtcatggggtttaagaaattctgatcttggaacagaaacagaccccaaacatgtcagaactgcatttcaggaaaagagcttaggaaagaaagtttctcaggtacaaatgaactgattttccctgagtaatcttgtgcgttgcacaaataagaatgatcatacctgcgttctgtggttgaggtacatccaggttcagctcgactagctgcaaggtttgctgagtcaggggaaaggctgtaggaaaccccctggtcctcaaaaccccccttgttctcagaccagcctcacgtctacctctataagtaacaggttgagttctcagagaaaatacattgaagaagacttgatgtacatgcttttactatgatgggcaagattcatataaaagacaatgcatttgggggaagacttgcacaatatagaattgcttctgaaatcaatcaaacaaaaaagcccacaacaacacaatcgccccaagctttctctcctttctgtcctagcacaacttatcagaggcaggggtgatatgatgatatgtattctttactagtgagtacagtaggacagggagtgtatctgtctggctcagtgttatagtcacagaacccatcacagtgcctggtatacagtaggtgccattttattgctcatatttgttgaatcaatcaatcactcatacaagggagagcacccagccccagtcttcattaagtgcttgtccactaattgaggcaaagaaatcatacctggtccattgaaatttgggggccctatttttaccacagaaacacaggagcaaagggtgaactctgtactgagttttgaaggcagcaaggtctgaggaagcaactgcgcaaaaggcagaacgtgacagtgagaattcctcttggagaacatcctatccatagactcccccggagggactgcctgcagaactgtcattggccaatttcaatgcgtgttacagattcatagcacagtggatgatgagctatattaatcaggaaggaaggaagaaagagtaaagaaaaaatacacacacacacgcacatacacacatacagacagagagagagagagagagagagagagagagagaaagagggagagagagagaaacctaaaactgtgagcttcttctcagcctggtcttcattaagaacttcaaacctggcgatgggcagatttgccctgtggtgggaaggaggcctcagttcatccagttcttgataacagttgctaagcccaagtttgggcaggactgttccagaggctgggcctggctatgtcagggtgttgctgtgggtatgggggaaaaatagagaggcagctagggataagaggtgctcaagaagtctgctgtactcttggcaagccaaactctggttcttaaaactaagaagtcatagagaagtgaatggggcttgtaaccgagggcaatttttaattatcagttaggaatagactactacaggccacagataaggtgttaaacagatgttcttttaatagttatccatatctttcttttcttggccagtaacacttagcttggctggttttcttctcctgtgttgctggaggtggggcagaggtgactggggactctaagaatctgacagtaacaccatcctcagaaacagtgatggagtaatgcttgggtaccagcattcaagactcaatcaactttggccaaggccaagggcaacctctgctacattgctctctgctctgacccctgcctacccacacagcccctacagatacatgtagcaggtggtgacacagatcccatacacgcacatcttgaagcccgtcctttgtgttcagtattgcaccccaggcacctggcacacagcagtgccccaaaaatgtgtcaaatgttggatgactggattaaaatattaggaggcaggatacctactttatgttatagttgcccctaccaaatttcaactcactataaaatatgtgaacacaacttaaaaaaaaagtatttattctccaggagctttataagaggcaggatacataggtaacatgttctttatactttgatgacaaaaagaaaaatgaatgtattttctcatttcaggataggagaaagtcatccttcttttgagttttacctcttaaagataatccccttctcactctccaaatgtcactttccaacatttctatgttatgggaataggtgatttctttgtaacttttcctgccttgccatttctccaaatcttgctaatctgctgggtttgaagctcatgcatttgtttttcccatctgccttaacacctccttgctgacacatgcccaaaggtgctcagcataaaaagggagtggtcttcacaaacataaactaggtgttccctgttcaaatgcaaacttgacaggtattctcacagggaatactggcacctttccctcaacagctgtacaaaaggttaaaacttgttcctggcaaacacagttacactaatgcatcctacatggattgtcccttcttgtgcttcactaagctctaattgcaatcatgttggacatcaactgcttactgtaatgtttcataatgtaaagtgcactccaggattcagtggtgctttcttcgagttaaagcatgatcgtggtaacgaaatgactacaaaaattgacacacattcttcaatggatcatctttctttggagacaaagacaagttgtgactcctcctattattgaggattgaatttagttttatgcactgtcagcagccacctcagctgcatttgaacaatttggggacaaactatcttggggctacaaatatggcaacccatagtcacagatgatgtatcatgatgatgccttttacgtcagttcataatcatcagggctgaggaaattttgttttgctttgtttcctaaaatcttttaaaattttattgcataagaatatcataacatataagtcaactgagaaatttagtagtaatcctgtaacactaaacacattagctgcttccctccttcccctcatctcatagcattgaaatctgtctgcatacaagcgggagttctgcctacaagttggtccccacattttctgtattgccactttatcataatgagtcataatgtattatcacacaaggatcatccatcttgaccacttcactgtggctcaggagctgtgaggtccaccaaaccactcaagatttcagggctttatgcttttaagatccagaaccacaggcattgtttgaggcactttctgcagaaggtgtaccgcatctttgcctgcttttgcaggcctcaatggacagacagccgtagttcactaggctgattctctctgttcatttattcaggtttccaagagctccatccaccttctctgacgtcttccccagtcattcctgcccctaagattcttcctgtcccttcaactcctgaaggtcccacggtcagcatctctcactatctccttttgtagctaaagtatagatgcttcgttaccctaaccaaactctgttgctttagagtgaggaatctactttagacttctttggagtcccaggatatctggtgcacagtaagtattaatgcatatttacagatggatctgaataatatttttgagataaccatcaaatggaaagtaagtgaaaataacatagaaaatgtgaaagggaaaaagacctcatggtattagctcaaataaggacagggaccacatctcatcccttaagtgacttaatctctctgtgcttcagtttccacatccaaaaaattgaaatcataatagaacctacttcataggccgtcatgaggatcaaatgagttcttatgtgttaagtggttagaacagtgtctggcatgcagcaaatggtacgtatttttaaatgaaaataaaaattaagtaacatggtaatgtccaaatctagggtagtacctgccacagagtagctgctcaataaaggctgaactcaattactgtctgttttgtgacacttgcaccagcatggacctgggagggagcagcagctgggaccaaggggctggctggtgacagtatcttccaggagaagtgtttgggaaagcagtaagctccacactccagttcaaaggctctggaagttaccaggttctgccacaaactcgtttggctggagtgctcccaggtctgggatgtgtggcttttcgggttagtccaaggcacagttgccgggcaccctggcgctgatggctgctggggagagggggacagcccggagctccgcctcccactagcagctcagagccggcacggaaagttactgcatgtgaacgtggcaggaatgatggaaagcccagggctgccaagtgctgcaatcccgggctgcgtttcttatgctcacaggcaccagctcttcagggagtctagtctatacacgcttcctgcgcataactgtattctttcagcagttactatgctttggcgtagagggaggagacaaaagtttgagggagtggcagtgaggcatgagccaagatcccatacacaatgtcttccttgccctaagatgttcctaagaagaacttataatttcacccactgtattgtgtatctctgaactttcatcgaatatatatatatatattttttaagaaaatacctctttatcaagttcagcccaccagaggcttccatttgtctatttgcccatccattttttaacaaacatctcctaagcatcaattatctgtcagctacccaactaggccctggaaacccagagaagctcatagtccactgcggagccagagagtaaattgttgctatataacatgaagggctataaccggggcacacacagagagctacctggcagagaattatttctgccaggtggggacagcagcctgcacaggcttgcaggggtgccttgttagagctgggctttgaagaatgactccagtggggaggtcaccaggtgaacaagtggcctaattaggctatgatgtacatttatcatctttgtcccacacctgctttttaagcgaggctttaaaaatacaaaaacagattgtgggttggggaacagtattgtatcaatgttacattccctgattatgatcattgtactgtggtcatggaagagaaagactatgttcctaggaaatctacactgaaaaagagtaaagggtgggggccgggcgcagtaactcacacctgtaatcccagcactttgggagggcgaggcaagcagatcacctgaggtcaggagttcgagaccagcctggccaatacggtgaaaactcatctctactaaaaatacaaaaattagccgggcgtggtggcaggcacctgtaatcccagctactcaggaggctgaggcaggagaattgcttgaatccgggaggcggaggtcgtggtgagccaaggttgcaccgttgcactccagcctgggcaacaggagtgaaactgtgactcaaaaaaaaggaaagcggaatgttccctccatgtagtacccatagtatgtgtatactccctctataatagtatatataacagtatttatacatggggatgagaatgataagcaagtagagcacaaggttaataattagtgaatctggataaagggtgggtgggagttagttatgctacacttgcaacttttctataagtttgaaattatactaacacaaaatgttaacaaaaatgtataaaatacaaaagatactaaatcagcttctaaaataccaagatgcaggctgggcgtgatggctaacacctgtaatcccagcactttgggaggctgaggtgggcagattgcttgagctcgggaatttgagaccagcctggggaacatgtgaaaccccgtctttactaaaaatacaaaaattagctgggcatggtgatgtgtgcctgtagtcccagctactcaggaggctgagataggagaaccacctgagcctgggaggtggaggttgcagtgaggcggaggtttcagggagacaagactgcatcactgcactccagcctgggtgatgagccagacccggtctcaaacaaacagaaagaaatacaataccaagataccaatgccttttattaccatcattctgaaaaggatcagcaattttaaaacataattttaaaacaattattttttgaggtgcagtctcgctgtgtcacccaggctggggtgcagtggcaaaatcttggctcacggccacctccacctcctgggctcaggtgattcttccatctcagccacctgagtagctgggagtacaggcatgcaccaccacacctggctaatttttgtatttttagtagagatggggtttcaccatattggccaggctggtctcgaactcctgacctcaggtgatccacccgcctcagtctcccaaagtgctgggattacaggcatgagccactatgcccggccatgtcataatctttgattgcaaggttgcagctacccagtgagaccctggaaaccctgaggaatgccgtgtcttccctgtgtcttgcctcacttattcactcccttctttttttccctgaaaccttgaaatttacagtgtaaaagagccaggatagcagtgaagcccaccacaggtgtgctctgcaaagtccctgaaagaggagggcccaaaagatgttgcttgcctctctgcagtgtagggacccccaggaatctggagaggggtcagtctaaaatatttaaaattctttagtaatgcccaggagggggcagtcagcttagcaaggatttgggatctatcagcaactacaattctattgcacttgcttatgatacatttttaaaagcagaaagcaaaaattaaaaataataacagcagcagctaatatttacccagggctgatataccctaggcacttgtctaactacttaacatggacatctcattgattcccccatgaaagcaccatgaggtaggtactgctaatgttcccatttaacagacaagggaactaaggcccagctagtcaatggtggaattggatataagcacaagtggcctggctccagagccaggctgttgcccataacattatgttgctgtgggctctggttaccgctttatgtgaatatggacaaaggatacagagggggatgaaagcagtatgattagttggggtggcaggaccccagtaagtttacttttattttgatgttcagtgttatttaggtattaaataattttttaaaatcaaaactattggttgatcatttttgacccaggagacgcagtttgagatatgtgtgcctaacatagaatctttatcactaaataagttatagcttctctgtgacttgttttctgtatctgaaatatgagatgatagttgccaacattttcccactaaaattcttgctcgaaggttggaattctgtgtatggtatgtggaggacatggagcaggtggagagtagggggtgggaaagggtggggaggcctatggtggggtgactgcagaaatactctataggacaattactcactggtggaatcaaacattatgcatgaggccaggctgtgctttctatttataaggtattgttcaacattggaaagaaacatcagatctgaattagggtttttattttttccacctttccttccttctttttttctctacatccctctcttcttcccttcctgtcttccttctttcttttcctggaccactggaagcaatgtttggtcatagttatatattttatctgatagaagagactagcagagacttagaccatagagagtcaagaggcctaaagaccttagcatatcttcctttgaatccagggacacgacccgctgatataagttaacctcattaccacatgtatggaagaggtcctcttccatttgctgcatatatatatatatatatatatatatttgctgtatgtgtgtgtatatatatatatagtatatatatatttgctgtatatatatatatttgctgcacatatatattatatatacacacacacacaaacacacacaattattcattggaaatgtatctacaaaaggtaaattgtttgaggtaaataaagggacatgctactatggctacaaactatgttggttagttggtattttcttcctggtcacctttcaggcaatttggatagaaagcacagctttcatttctgtgtaacatccatctgtgttcaaagatgcttttgagagggccaagggaacaatgatttaatgctgtcaagtgctttgagatctcagacaaagaagctctgtaaatactgagcattagcaaccccagtatcattcccctcagtattatcaaggctttggaaaaattaaccaagaaatgggccctggcatattgagagcagcaatcgtttctggaaagctttaaagaccctctacattgggaaatgtagggcttagtgaaaacacttgcccaagaactacttttcttcgtttgcaaattcaaaccaccaaagactaaaacccgctacaatgtggaaaagaaataattagattaaagcttttcaaccaagctccaatggagagagggcaagggattgtgggtgtgcatgtacttaagagacacagacatacagaaagacacagaccgggcttcagaaaaacaacaacaacaacagaaaaaaggcttttgtccatgtttagatttaccacaaaaacaaatctttttttttgttttgttaagtaaaaaacttattcattatgtttggtgaggttgtagggcaacaggcactcacatacattattggtggccacataaactggcaaagtctccatgaaggaccactttgcaacgtccattaatattacaaatgcatttaccattgtcctactattccgcatctaggaatttatcctgtacctctatttgcatatgtacaaaatggttcatgtttgaggatattcactgtagctttgtttgtatttgcaaagcctgaaaacaaattaaaaatttattaggggattaaataacgtctggtgtatcattaaaatggaatatcatacagttgttaaaaagaacaaggaaattgtgtacgaaattgctatggaattatctctaaagatgtggcgtgaattgaaaaaatcaagatgcagacagtgtgtacaaacagatatatttgaatatgtatgtttgaattcatcatgctaacatatttatagaatggattttcggaaggctgcataagaaattggtaactgtggctaaggcataaggcttacacctctaactttacatcctttcgtaccttttgaatattgtatcatgtacctatgtgtcctattcagaaaacaaaataatgctaatggtgtatgaaaccactgattaaacaacaaagtgaaaatatgagctttgtaacattttctagggatgggggtcgacaagttgtgtcttcagagctcccacgttcttccttcctcagcagggacaggcttctcagcacgctgctgcctcagggagcccaaagggacaccaggaatgctcagcctgtgttagctcacgactatttccctgcctctaacttctctagttccccacagttcaacccagggtgggtagcctggtgtctgtttgagctcaacctccccaaaccaggaagcccacaagctgcaccagtcactgtcaaacagctagctgagcatacagggaattcccctcttggaactgacagggaaaatgatccctagggattagggcctccactgggctgtgtcaaacatatttcatagttcctgcaactctgaccagggatcgttttgaaattcgggttttgttgttgttgttgtcgttgttgttgttgttgcaaggaacaaagactcaccaaactaaagggtgattcttgcaagaatgcacatggagtaatatgagtagccgcgttctcatggaatttaataagaattataaaacaacaacctcaaaaatatcattgatgaactacttagctgcccagcatggtgctcagtgctttgcgtggattgtctcctgtcaaccccatcataaacccatgaggctgtcgctgttattacccccatttgataggacatttgggcttgtagaggtcactgtcaccagagtgggtgggccgcacagaaacaggatcgggaaaatctgctgctctcttgctgtccctctcgtgggcagaacagtttctctgccttaaggttactgcctttccctggatgtttgcctctcagttctgatagtaactgactcactcactcactcaccaccattgggctcattcatagactttgcttacttataacagcaccttctacagagggattcacgaccttctccacctcaaatctctgtgcttcagctgctgcctacctgcctcctcctgttcagatttccccaagagaggacttgagagatcacccttctgttggaggccagccacttcactggtcacctcctgacctttggcttgggcatcccacctcgggttcccattttgattcattcctctgtggctgaagggtaacagtcctcatgggcttcatcttttccttcactcgtcagatattcttggagaactgactttaagccagacattgggttgtgggtggtggggggagggtacacagtgatcagcagagcaaagaacttgctctcagtggctcttaccttctggctccttcacctgcaggtgtgggtgtggcagacattctggcctgtccagttcgaagacaatgacccatgattgaccacggcactcttgcctcagtctctaagtcactgtctcctggggccccctcattcatgccttttcctggttacccatctgcctccagaaactggggctgtgctttgccccagtgtactatggagtccaaggtgatcagacagatggctccaacagctgggtggagaatgatggggaggagtatgggggataatgctcagaggccctgtgaatctgctgccatgggcagtggaatcccagccacaaagaatgaggtacttacaattctcccataattgttgactaaattccaaagctgggctcctctcttttcttttctttcttcccttttttcaataccaaatagtttgaaaaaattccaggctttgtcaaatgccctttcctaggctcaaattaaccttttccaagcgtctttcacattcttcaaactcttattaatccctcaaaacccagctccaggcattgccctcctcagtgatttcttctctaaatttgagataatcatgccttcatatggactacttttgtacttggcatacatttttattgttacccttatcatactgagttgcaaatatttgtttagatgtgtgtctcctctcctggagtataagcttatagagagcagggaacatgtcttaattatttatttattttttaatttaaataaactattttaggatagttttagagctacagaaatttgtaaaaatagtacagataatgcctgtatactttattatctggttaacgtattgctttactatggtgtgtttgttacaactaaggaatcaacattggtatgttactgattatttcgctagtttttacctggtgtcctcttcctgttgcaggatcccatccgatctcacattatgtttagctgtcatgtctcttttgcctcctctggtctgtgacagtttctcgaactttccttgtttttgatgatcttgccagttttgaggagtactggtcagcagtgttgtagaatatcccttaatgggtttgtgtgatgtttttctcatggttagactggggtttgtttattttatgtatttattcttttggagatggggtcttgctttgtcacccaggctgcagcgctgtggcactgtcataaatcgctgctgcctcaaactcctgggctcaagggatcctcctgcctcagcctctgaagtagctaggaccataggtatgtttactgcacccagctaatttttacatttttttaaatacagacagggtcttgccatcttgccaggcttggttatttttaaacaccagcactgaattaaatacccagcaggtaccacctagcacagaccaggcatttaattaatgtttattgaactgaatagaattcaagtatttcttcagcatcttccacataaatagaagcctgactgatgcccttggagaggtgaagaaaggaactcaagtcccgtaaagatcttccacacagctgaataataaaagacggtatgcacccaaatgtcaagtaaggagaacccagagaatgacctattgcagctcaagagatgaattaatcagaatgagcaggtgaagtcagcatctgtgtgaaagaggtgtctggaaagggggtgggtttagagaggcccgttttagttctcaagcacaaggagcttttccctgagctaggatctgctcacatgctgagcctgaagtccacaggtatttctacccctcttctctcatggctggcaggcttctcattcttgaggccttggcttaaatgtgacctctgcagacctacactatctaagataggctccacctgccactctgtctcacagcactccgattgttttcttcatagcttttcgatgtttataaggattgactgtttattcttttttttttttttttttgaaacagagtcttgctctgttgccaggctggagtgcagtggtgtgatctcggctcactgcaacctccgcctcctgggttcaagcgattctcctgcctcagtctcccaagtagctgggattataggcatgcaccaccacgcccagctaatttttgcatttttagtagatacgaggttttgccatgttggccaggatgactgtttattctttattgtctgtctttctcattagagtctaagctccttgagggcaagtactgcgttttgttattcactctggcagagcacatagtggttctcaaattgtcttgctgtatcaatgaatgggctgatgttagctgagactgagaaggcatgagacagtgacaagaagatatgtgaggagttgctgtaagaggccctgaaatggagcaagagtgaactgggtaggcagatgggatgctgccaggtcatcagactgatcacaatggtgtcaggtcataccaaatggggtggcataatttgggcaaaggccagcaatgtactaggtgtgggctgcacagatgtacgggtcatccagtgattttccatcttggaaaggccagccagcattcacaggacaaagatggggggattaggaataactgaggtcaagggaggggcaagggctataggagcgtctacataaatcaacactgagaatgtattccatgaatgaaagtaacacaaaagctgttggcaggcaagggtggaacccagcctaacttccatggtgttgtcacaagcccaagaagaaaaagggaactctggtgaatacttctgaatgacaaagataaaatggaagacctatgatttggctattgggctataaaaatggacagccatcacatgaggaaacctagaaaaatgagataatgagcttcagggctcagaatggaaagaaccccatagaaatctttgatcttttccaccatgagttctacactgatgcaaaggacagaatcagaatatacattccctgatttggaaagtatatattttcccatccaagttcattgtgaactgctgaccaaaagggcagtgttttatacagattctgtctagaactagcccagtgggaaaagcctcggaaagcatatggcaaagaaactcagactccagagtatgatttagtaacagaaagagtggtgtgtcttgtctttgtatgcccgtataaataatcacgatggctgaactctgctatttttcatccaacctaagtaacagctttgaaaaaggaagataacaatgacctgtgtgtacagcgtccaagggaaccattagcagtggagctccccaggctcctgggacgaccaagcacatggtccaaccaaccatcttctgacaaggtaggggtgggcagtggaaggcaaaaagaatggctgcacttgtgtttctgaaggtcagaccaagaaaccaaggagcgtgtctttgttatttcaaatctatagcctttgaagtcccagcaggtaagtgggtgagtctcatatacagctcaggaactcctttctcctctgtacctccttagagatatagggctaagacagcccaggtgttagcctgtccaagcccttcatttgcaaaggaggaaactgatgggcagaggacaacacaaactgcccaaagtcacactggtagatggcatttgggccaggatgagactttctttttttttttttttttgagacggagtctcgctctgtcaccaagctggagtacagtggcacaatctcggctcactgcaacctcctccacctcctgggttcaagcgattctcctgcctcagcctcccgagtagctgggattacaggcacccaccaccacacccagctaatttttgtatttttagtagagacggggttttaccatgttggccaggatggtctctatctcctgacctcaggtgatccacccgcctcggcctcccaaagtttgggattacaggcgtgagccattgcacccggccagcagcatgagactttctaacccagctttcttttcccaatcttaagcagcccatctggggctatgtgactgaccgctaaaactgcctctgattccacattttgatttttgctcccataagcactgttcacagttttccccctcatattacttctgtaacaaccttgaggtggtcaaggaaaagaaaaaacaccatccacattcctaggcattttaaggaaatgcacaccaggtatctgacccagactcctacttccctgccaatctccagctcatatcaattcatttccctaacagaaaataggtgtcaactttgtaggtggaaagtaatttccctgcaaatattaccggagaggttgctgacactacttgacagttttattattacttttgttttgcagtaaggtgggggaactctacctttgccaggtagaatactgaaaaaaaaaatgtagagcttttaactttgtattagttttaacatcggaggggaaaacaagaaacaaagaatatgtgtgctgtccgcatgcccagtacggctaagggcaacctcacaggctcctggcttacctcacttctcacccgcgaactttcagatcctggagcttcagtgtgggttagagggaattactccgcagcatctgaaaagccagctcacaggtgggccgctggggcgatttggcagggcctgcttgtaaacactggctatcaactcctttacaaggtaagccaaccaggggcaagttaactcgctttactcttctccgggtttaatagaaggtgggtatacttttataagaacccaataatctaaatatttcacacgtagacaagaaaactagaaagccccaagagaaccgaaagagtattttattaataactatttatgtgtagtagctacttaaattcatgtttcactacctattttttttttttttagacggagtctcactctgttgtccaggctggagtgcagtggcgcatcctggctcactgcaagctccacctcccggattcacgccattctcctgcctcagcctcccaagtagctgggactacaggaacctgccactacacccaggtaatttttttctatttttagtagagacgggggtttcaccgtgttagccaggatggtctcgatctcctgacctcgtgatctgcccgcctcggcctcccaaagtgctgggattacatgcatgagccactgcgcccggcctcactacctatgtattttctaaagggtcagatagacttaggtgtaggttggcccgagaaaatgcagggttcccagttaaatttgaatttcaaatacacaatgaataattttttagtatattccaaataatgatagggcatacttttattcattgttcatcgacactgagtccattaaccagctggtttatttatttattattatttttccccttgcttcattcttttctgaccttctgtggcttaattttaggactcctattagagggtggagggagaaatacaactcacacgcatcgggtgtcctacttatcattagctgaggcacaagttttgggaggggagggatttgctactttgagctaaaaatggtgattatctgcattctctctattaccatatggacagaattagccatagactgatattttccagagactggattttgcaggccagtaaaatccaaaaagaaaagaaaagaaaaggaaattgggaaattgtgagaagatcaatatactgttgccaagtttaaatttgatcaaaaaagggtgtttaaaaaaaccccacagctaccatcttcaattaccattaattcataaaagaaagcaacatttcaataccccaaaagtaggaaggacactctcttctttatttcttaaataaagttggcagctttacaatggattgccctcatttttgtggaaacttcatcacaatctggtgctggctctgagatctgagaatatgcagaccaggtcatgccacagcagcacctataaagtgacagcagcaatgctgcacttttcacaggtttgtgttggtagcagataaccacagagcaccttgcagtaaaggaaggagaaggtgaacgtgtgccagttcgaattctgatgatcttaaattaatatttaatttaagcattttatttctgagatgtatattatttgtgtggaagcatagtgtgatttttctcaaaccacaaagcatttctttaacttataatatatagaaaacgtttttccaaacttcctttggagcacagctcaatctctgaacttttcttccctatctctataaaatgaatgcttcaggaactggataatgtgacgctgaacttaaatagcccccttcctaagagagttcagaggtctttgaaaatacaggtaattgagcctcctggttcctgagagctggcagaatgtgtgacctcagctgagaagagttgggtatttgccaaaaggcaggtgtagttggtagcagtgctcagagaccaagtccccaagttcagattttctatccctcttcccattgtatacaagggaaaactatggtgtgaaagtggatgattgcctgaaattgctgagtaattaaaaggaaccatgatgaaaataaactgcccagcccaaatatcatatgtagtttcttttatcttcctccaacctgagaaatgtatataaaggtatttttaccagggaaatccttctttaaatagggttgaaactcaatttcatatgctgcagagagatgcaaggtattatgtaccaatgatccctaaatattcttttcttcttcacatggctgtgaagttacaaactgagtatccttttcaacggcttgttgaagcaaagaattaaatatacatgtacagactaaaatatatgttagtatattctttagaaatatgaagaatacccccagcttttcacagtgataatctctgggtggggtctttttaatattatgtttttctgtaatgatggagttttaaaataattgtaattgtctattacttttagaatacgtaaaaaagatacacagcatgcacattctcattaaaaatcacttcaacctggacttttgggatgtcctttaaagtcacctagtacttgcactttcccacagtcctctgtccagcctctctcagtgacctgagacattcagtgccacttgtgtattccagacatttgtctttctgagagaagcagtgctaccactttttttttttttttcttttttttgagccagagtctcgctctgttgccaggctggagcactgagacacaatctcggctcactgcaacctccccctcccgggttcaagcgattctcctgcctcagcctctggagtagctgggactacaggcgcccgccaccacgcccggctaatttttgtgtttttagtagagacagggtttcaccatgttggccaggctggtctcaatctcttgagctcgtgatccacctgccttggcgttccaaagtgctgggattacaagcttgagccaccgcacctggcccacttttttaccttctcaaaaccccaactctcctgtaattcctgaagcccaggtaattttccccctagccccattgaatactggcttgttttcatttctctctctttgtcttttgccttactaattctgatgtgattgttttttcagcctcaactgaatagcagagagattttggctttcattccagaatgatgtctcacagaaagtcaactcgtgttccaggtatgtgataaacatctcactagtgaacttcttgctgtttctaagcgattaacggtttggttagcaagcccagagccctgcagataccttttgcctcctacacaagaagtaagctaatgaaacccacggagcacggcctgcccctctgcttccctttaatggtttctgtcacccaggccaggctgccgccaccatgactctgcacatcgatgtgccgcctcagggcaagcagaatgcaaatgacggtggccctcaaattgcaatttaaggatagctgttatatcttcccatatatttctcttcctaacctccaaatttgaggataatgtgctgttttaacttattcttagtaggaagaatgttaaaccttagggtgatggtagtgtattgctgaattctgtgttttggaataaattagatttttttgatgtggagaagggagaaagggggagaactaaatgcaaagataatttgattttaaaagctggagtttcctggttcctgggttctagatatttaaaaaatagccacaattaattatgtaataaattgtaggaggttgtcaagttgtcatctttattaaggtgtttcttgccagacatattcaaaatctgtgtactcagatgttaactgcatttgactctattgattaaaatatactttctgccatcaaaatggaactccaagatgtaaagggaaagaacactttaaaaggcgtttccaaagtcgtcttggatagaggagctttcatccaagggtgctatgtggcattccggaaatgaatcagagacttgggccctccacttccttagaaacagagacacgctgaagatcgttagggtaaatgagtgggacaaagtacactctgcattttctttttaatttcaactaaaaaaaatgctgcactcttgtcttggctggagaaacatcctcagcctgttcatctcctatcctctgcccaaatcaactccaaatttgactgactgaattttcagttcctatattttcagatcagttcctgtattttcagatctggctctctctgtggttgtggtggtagcagtggtagtggttatggagtctgtaagacttgccatttttaaaatgccgaaagctctcttcaggttaaatagtctctctgtgtgattctcaaatgaactccttgaggaagaatgttctgtgtgtatctagaaaccttagttctacaagaatgagagctaaagaagctcacccatgtcccacagaaaccacttcttccctttcctgaacaagaaaccgatgttcttcatctactgtctgtccacccaggcttggaagacaggtgaaaacaatcccatctttctattcctagaaagaggtagggatgtgatgcttacattcccctggcttttacttgcatcaaatgtgggaggaaggaataaaagagaagaggaaactaaaacctgagaaagggcaagaagagaaagtattaggttgatgcaaaagtaattgtggtttttgcaattacttttaatagcgaatccccgccccccaaaatcatctagcaatctgccctctggagtgaacttgaataaaagtaggtaatagtaccactcttggcttagaagtatctgattatccctactaaccagtacaagacatagatttctgaaggaaaaggatgcctaccattggctcttttttgtttttgtagtttgatttttcttattttttaaaaggttctaaaaataatacatatatacctggtagaaaatttgaaacttagaaagaagttaaaagaagcctacaaaatatcaccgcatcatattatcttattagccaaatgcaaccaccactaccatccagggagggttcttgccagtattttctctattttttcgtatgcttttaaaaatcttcacaactaaaatcattctgtgcacagaatttcacatactactttttattcaatcaaaaatattttctcatgtgtttattaattctttaaatattattttaatggcagtataatttgccatcatatgactatattataatttattaataattttcctaataaaggacattcagagtgtttagaattttagccattataaatagtattaaataaacatggtttttgtgtgcattaatctttactttttaaattatttccttagaataatctactggaagtaggattaccaaatcaaagagtatcatcattttcaagactttagtacctatcgccaagaaagctgtatcaatttatattcacagtatattaatgtctttctgaaactgactgaattgattaatgtcatttaaaaatcatgctatcttgttaggcctctgatactttgtatttactggtaaggctgaaaattgtttacagactaatgaaacacattatatattaaggttatttattttgtgccttaatatttgaaaaaatacatcttcttatcagtttgctttttgtcctttttgctgattgtttatgatcttttttgacatacaaaaattttatttttctctatatttcaatgtattgaactttgtattctgtaatttcttctattactgtaaagtagagaaaatctgcctgtatctagataaatatgcagaaatacattctcgttatttaattaatttttcaaaaatatttcttgaatttatctaggatttgttatacggcgtgaaaaaaatttatttttctctgataagctaaaaatcatcatgcacaatttattactttttccccacagcttatatatgtattctattgacacatatgcaagattctttttacatatgcgagattatgttttggggttttctttcagcactttactgatctctttgcctattcatttatcagtagtttctccatccctagtccttttctttctttttttctttcttttttttctaaagttcttttaactattcttatttctttcaacttaaaaggtggccaagatgacataccagaaggctgtctaaaattattggagaaagagaatctttgcctttaaagttttaggtcttaggtgaaaacgatgcagtgttagctcttgtgtctataaagggtggggttcatgctatgacacagaaaatcagaaaggactttcttgacatttgtagaaacagtaatataaagaagaattaggtaccttttggttcatcttaagtaaagaaaatttccagtgaggagattgagacatttaatgttaaaaagatcctctctcttctagggcacgagtaaagatatcaacccatctatctgtagaaaattgccagaaactgtcacaaaataaaaaatgagagaaggcctgaattacgacagtcctggtggggttctacaaggtgtgtgccaaataattttgttttctttttaaggcttgttaacagtggatagcttaaggtgatggggttataggtgatttttttcttgtccttatttaactgtattttcttttcttttttttttttttttgtcaaatggtataaaagctttttttcttaataatggcctgttaattaacatctagaacccagtactggaagcattagtcccaagaagtgcaaagttacaaaaagtggattttctatttcttcacctcttaccttaatagacacagaaacactaaaactcatctcattagaagaggttttgtgaaaatgagacaggacatagctaaaccaagtgcttttcctccgaataagatttcacccaaaatgaggttggggactggatgaagttatgaaaaaactactccttaaaactgctatttctaaagctaataggaattcttttgtagtgggcttttttcccttgacaaccaacgactgatacatcttgcatgttaaaaagcagagggctataagtaagttttcagtggaaataattttttttccctgcaccttccctttttgtgatacagttggcactattttactgtcttaaagattcccattttactttaatggtctctactttccccttttcttagctcttcttaatttttatgcttttcattagtagataattctctctggctgaccaacggggatgagggtcagagtcacgggcaatatactatatctgcgttagtctggcttgagaacagcgaaaccgtgcctccttctctaattagtcactttaagtatcagtgatgggcagtctctgtgacaatgattttgtcatagtaagcacttgaaatacctgctgcagttttttcaccacccccctcctccccgtttcaatcaggcaagtttatctttgttctttaaaccataagcaggtttttgtattttttttttttttttttttgcatgccacattgaaaagaaataaaaaccaagtgccatacatgtcaattaaaggcataaacaattaagagatagtccatttcccccttgaatctttcatgcttattttcccttcttagaataacacttaaaagccatcgaagcttcaacgggaccagtgtctccccgtttcgtggggtgtagagcaaggtgtgggaggagcgtttggcatgtcaagtctctgctctacagtggatctccacgtcccggcttccagtggacagccctgtgagatggggaaaatttccttccgctcagatactgtcaaggccaatgtgcctttcaggagattgtctgagagatttcgaacattgaaactgtaaaaaaaattgagctggacagatccttgccaccactttttctgctaaatatagaaaagttgtcatcgggttgcacaagcaatttccagctacagcacctcaggaggggaggcgggctcctgtctctcatagttaaagtgcatagagctgagccgaccctgactcacgggttgtgaggaacatgggaaggtggtagaagagtaatgagagaaaggcgtccttgttttggttaaatataatgacatgggaagatgtgcagttgatgatggtatttgcttacaatgtcataaagcatcaataatttgcaagaaaagggtagaaggagccctaccccaggagtctgtgctcagagtttctcccctatcattgctttggaaaacactgttgtatcgtggagggagactgtgagatatggagccaaacaggcatgggttggcatcccagctttatcacttaccctttgtttgatttggagttaattacttaacttctctgagcctgagagtcctcatatagaagatgtgggtaaaataatattcctctcgcagcatcactaggattcatgtgaggagtaaagtacatggcactactaagtgctcagcatttgttggcgcccttccccttctccccttttaggcaaatcatttaagccccctggacatcagttgcatctctcttagcaagtcctattggttctacctccggaatatatttagaatttatccacttctctctattgtcattgctgccatgtcagtccaacgtgtaggccgttgcgatgccttcctaactggttttcctccttctgtttttaaacccagtgcaatccatctccacatagcaggcagagagggcattttaaaaatgtaaatcacatcatgcccctaccctgcctaaaaccctcccgtggctgaacttagagtaaaatccaagctcctcaccacagccttcaaaggcccatgtgatcaagcccctgcctaccgctttccttttagactccacttgctactgcttttttcttctataaaattttttttttccggttgtactggcccttttcagtttccagaacactccaagtttatttctaccgcagggccttttaatttgctgtttccatggcttggaagatgcttcttctagattctcctgtgcttgaaaccttctcctaggtcaaatgttccctcctaaaatttgtcatccttgacctagtcactctctatcacagccctaatttattttcttcatagcacttgtcactatgtgaaagtatcttaaatactgtttatctgtttattttctgttttcccccatgagaatgtgagctccaggaaaaaaggggactatgcttttctcttcttttaattttttttgagacagaatctcgctctattgcccaggtggtagttcagtggcgtgatctcagctcactgtagccttgacctcctgggctcaagccatcctcccaccttaacctcctgagtagctggactacaggtgtgtacaaccatgcccagctaattttttgtatttttgtagagatggggtctcgccacattgcccaggatggtctcgaactcctggcctcaagtgactcgtctgcctcagcctcccaaagtgctgggattacaggcaagagccaccacacctggtgtgggactatgcttttcattgctgagtaaacctagaacaatgcctgtacctaggaggcccttgggaagcatgtgaagaatggattctgaataaatacgtataatgggataaaaatatcgtcctgaaagttggtgactggatttgaaaaatctatgtcctttccatttctttttttttaagatggagtcttgctctgttgcccagactggagtgcaatggcacaatctcagctccctgcaacctccgcgtcctgggttcaagtgattctcctgcctcagcctctcgagtagctgggattacaggcatgtgccactatgcctggctaattttttgtatttttagtagagacggggtttcaccatgttggccgggctggtctcgaactcctgacctcaggtgatccgcccgcctcagcctcccaaagtgctgggattacaggcatgaaccaccacgcccagcttcctttccatttctaaagattctatgattccttggacagaaagactaaatcctgggataattttaaagaaacacaattagaaaattttcaaacactcaacatacagtaactcatattaagtttaccaagtagaggcacttcgggtatctgctttaataaaaaaaaaataaggacttatattttgcatgtcaagtatttgtatgtcaaaggatccttctaacccatttaaaaatttggtacctttaagtagcattgcgattctctgagcaaacctatttagagtttgcttagcatgccctttcttcacagatcttgaaaaggaaagtgaccccacaatataacacatctgctgaaagaagtggctcaggtgagctcgggctgtgtgaatagtatgtcctttagctcagggagtcattctttccactgtgctctgtgcacgtgagaccactgctggggccgtgctttaagagggacacggtaaagtggatcacatcccagggaagtaagtagaaaccaagtgaggagaaaaaaaaaagaagaaaatgggaatgcctaacttaaaaaggaggggatggtagagacctgatagttgtcaattactgggaccaaatctgaaaagacagatttggtgccattccgtgggacaaatttggaaccggtgagtagaagctactgaaaggcagagttggtccagtcagtgtaggacatttccaacagtctggcctcatacctaagtaaagccctgcttagaaatataatgagcagctgccttttctggatgttaaaatttcaggcaagtaaactgctagtcagctatgtccttcctacaaggattcctcttactgtagatgggtaacatgcacacttccgggaagctctcagtgaaatctcttcacactgctcggcatagtggttcacacctgtagtcccagtgctttgggaggctgaggtaggagaatcacttgagcccggaagttcaagaccagcctaggcaacaaaaaatttacaaaaaaaatttaaaaattagccaagtgtggtagtggcatgccagtagtccttgctactctaggtgctgaggtgagaggattgcttaagcctaggcattcagtgagctatgatcacgccattgcactccagcctgggcaacagagagagacactgtctttaaaaaataaatacaggctgggcccggtggcagccatttgggaggttgaggtcagtggattgcttgagcccaggagtttgagaccagcctgagcaacatggcgaaaccccacctcttttaaaaacgcaaaaattagttgggcctggtgaagtgcacctgtaatcccagctactcgggaggctgaggcatgagaattgcttgaatccggaaggcgaaggttgcagtgagccaagattgcgccactgcactccatcagcctgggcgacagagcgaaacttggtctcaaaacaaatacatacatacatacatgcacacattaagttaaattaaaaagaaatctttttatgtattctatgttggttaatattctttggtttgcatcaatagtgttctttctactctgtcatgtgtggaatatgataagtctgctattgctaatgacctaggcccagagaactttgaatttcaaaagttaacctagaatctcagagatccatggttttatattctgacttggaagcaagtcactggctatttcctattcgagagatttctaatctggaaggctgaaggaggctaccactcttcttggtgaacaatagtttgtgttccaagaataaccctgggtttgaggatagaagataagaagataaggctggagagtttaagagttgtattagatctccttttaatctgcagcctaggcactatgttattttctacctatgccttccagcaggggtggcttataactccaggcagaagctgaacctccttggcgacaccccctagcctgacccctcttttctccttccttctttccttcctttgcctttcattagaattcctatgagcctttgaatgcttagcatgaaaatgagcccattttatttttggaacccacagaggcagccctgaggggagttattgtgttgcttttagcagctaaacaaaaaggtgtgaaatcatttgctggctgttctagaatgggaaaaaataaataaaaaactgagaaggaaggttcaggacagtgtgtggcagcttggacagaacctcgtgatgagggcttctctgagacttattagtaaccaaagtgactttgggaatgtctgtgcatttctctcaccttcccaggaagttactagaatagcacaggaagccactgggattaaaaaaaaaagattgattttgcaatactatttccatgttgccttgaaaaagacttgaggaggggactaatttgagaaaattccttaaagctctttgtaacatttcttatacaggcagcatgagggagaggagagaggactattttaccaagattttaagactttcaaacaaccagggaaggcttctgtggacaggtatgtgagtctttgacacaggcccctaattatttaaacacattaacagtggtaagagacaaaggcctcaaagaactcaagcaacaagaacttcttgtgaaacttgaggtttttgccccatgctaataacattcattgaaagtcgtctcctgttttggggggctgacggccccagatacgtctcttcttggaagaagattatattttgaaatgtctcttcattagaagggcaacttcattttcaattggaatctttgacatgggatttctctttttaaaaattatggaatatttttaaaacggcaaagtattaacgtgtaaacatgcagagacatggtaaactcatgtccttattcccaaattttcacatctgttttacatttagaccaatctatttgagctcatttcaaaagaaatgaaaggttatggttgtatccttcacatttccatgcctccttctctctcttcccaaagagacaaaccgtgttctgtggctggtgtgtgtcctccttcctggacttttaggaagtcctgaccaagtagccacttggcctaatgaacatgacctttggagtatttagggagcctgatttcagtggctggaggatctctccttgcgggggccaatcactgggcccgtcttatgaaggtggctaagccttctttttttcagtattcaaggccagaattacagtatagtaaaacaataggaaaaggcaatcctcctcaaagtactatttcgttaactgagtcatctatagaataaataatattgattttccctttattgccaggaagtatgccatgtgctgatatataatgagtcacagatgaacaagtagaaattaaaaacactgtaattccaaaatctctcttagggaaggaactgtcccggtttacaaaaattccatgataagctatgaccttgaggatatgagtggcaggaatcaagagactgttgggcgaggaggatcgtggcatgagggagggggaaggagagaaggaaggaggagaggaggaagtaggaatctcagggtgggagagagagaagatggatgagagtggcaaaaaggacaaaggagggagatgaaagggcatgtggcaaaatggctatgatgaaaaaaaaatctacagtggctcagctgctagaagattctaacaacaaggtcttgacagataaatttttttttttttttttttgaggcagagtctcactctgctggctcactgcaacctctgcctcctgggttcaagcaattctcctgcttctgcctcctgaatagctgggactacaggcatgcgccatcacgcctggctaatttttgtatttttttgtaaagacggggtttcaccgtgttgcccaggctggtctcgaactcctggcctcaagtgatccacccgcctcagcctcccaaagtgctgggattataggcatcagccaaggtgaccaatttccttacagatcaattagaagtcatttgtgttaatgtgaaggaagcccattatttactacccatcctcttcttcccactgcagtaaaatgttcagtgaaatagggtttttttttttttttaaaaaattaaggggctgatttcgttatatgttatcatacatatatacagcatatacatatacgtgccatatacacacagacgcatatacacacttctctatgtaaaagatatctggataaactgaaacaaatcagtaaaaagcagaaattccgcaccatatgtgagcatgaaaacacaacttcggggcctcgcccgtatgctctgaaagctaggaattctcagacaccctggcaaagtcttgaccttcatttggcattggaaaagtacattgagggacatctcaaaggacagggagagtttatttgtcaccagagttgagggccaagcttattgtttcatagttttccactgtaagttatagggaacatgatttgaatatgggggtaaactctgaagtcataatttatcaaacctctaccatagctgcccaaatgctctttttccttgcttccaactcgcaaactcttaattcatcttttcagattctatttaaatgtcaccttatctatggaaccttccctgattccccagggagggtaatttcctctcctgaacttctatatttctccagatatctctctattacagcctgtatcacataggatcacatgactttgaaccttaatacaaggtggacctcatggtatcacttttgaattcccattgcctagtgagacatgtgtcacttttgctgaataaaacccgggtatgtgaacaataaagagaaacttaaaagtgaatgcactgcttcagaaagaccagacttccaagcccccgaatggtggcaccactgtcccccaatacttttgttactacttgccatttgttttgccccttgttcctattttgaataagaacccattgctctccagaagtaaaagcaatgtgaccatttgtttatttactccctgcaccaagacccagggtgatgaggctggattgcacatggggcgtgggcatcagaaactggaaagtctcaccctgcccagcctgtctggctcgtatgcttgggcaagtcacatagctcctgtgggactccgtttcctcacccagtgataatgaccggcttcacagggtggctgcggagcttaattaaggattgagaaggaggcagaaaatacaaagtgcagcatacacgcaaatttcccatatttatttttgggctcagtaacctgttggtaggaggtgtttatgacctggaagaggagtctagcaagagatgtaactagctattctcattccaaaatggttcacttggtattgactgggaaatgggccatgtcattcttgcttttgttcgagtacattctgtggcccttcctgctaactttctgggtatagcttgccaactctaggcctcagttttcttgtataaggactttatctatctttcctttatgctcagatatgctgtgatggcttaagctttttccttagtgcttatacccttaagccgcactcagatagaagacagagggaaggcatacacgtttgtgagtgaccccatggggtagttccctgagccagaaaagacagagacttatgaagccctgcataggtgacacccgaaatctgcctggctttgcggatcctggcctttcttctaagtgcttggaagaccttggcagattcagccagcgttttgatcactgccagagcctgcagctttgttgctaattgtttgctgaatgaattgagcaaaagcacaactggtcccaaggcaggagtgaggaggtgagggaaagacagaaaaacaaaccagaagagaggactgggtgactgccttggaaaatcttattattactagtacatttttttgtcttttaatcacaaaggctgtctctgcactaggactaaagaaccagaactgttcagaaagagagaagagcccagcaccttatactcaggagatactgaaaaacatcatataaggtgtttactgttgagagaaaagtacacatcagaggatgcccattattgatatagagccttctctgtatctggatgaacgtgaccaggaagccaccctcagcctgctgcagctgttttcagaatctgtgggatcacaccccagaggcagttgggtcagccgcaggcatcaggtgaggaggaggaagagtgagacagctattacaggctgccggaccaggtggctgtgaagaggtgtggggacaccaaggcttatataaggaggatggagaacacaggccaaaggggaggctgtaatgctgacttcgattggctaacttaatataaggcagactgagggaggaggaggagggcaggagagaacacgctttagaaagcatgacggtgtctcattctgtttgcaagtgagcacgtaggtgccttccaaatatgatcctgaagaaggtgcagataaatgaaaaattggatatacaataaaccacatacctctttatgtttatatatgaacatattaaagaaggttggctttagtagagtatgatgcatattctaattatatcaatattggatgcattgttagtaccatttctcaacttcatttaaaaatcactttcagaaaatacaaaaaataattctgaagattttaaccttaggtgcccgtagatcattttcttaggaaactgcagcttttagaaatgctggacatactttatccaaagcgttataactggtcttccacaagcctaggataaagttttccacagaaacactactacagaaaaatgccacatgccatggattaaacactgaaaccagctaatcacaacacatgagagcaaatgtagcatgttcagagaagtacaaatatgttgaaacatgtctgtcatgaaatctgatcttaacaatcctctgaagactagcctttttgcaaagagaacttatgactaatatacctcacggagggggtctcagtttctaatagagttaattttatctgctttgatgatggaaacgaaagacaccctggaaacatcctcttaattctaagcaccatccactctttttgaggggggagagggaagctttcagtaattcccagtgtgtcttatactgaatatatagaagatggtaaagcagggccaggtaattccaacacttaaactgctacttaaccatccacatattaaaggagtttacatggattgtcagctatgaaagaggtttctcaatctatatcccactccacagtcaactctcctcacaggtgctcttggctgtggggcactcataatctcagaagccgataaggctgccaagttcaagttgccgtgactctgaacacagtataatattcccattccaagccatagcccgtcacttttgtggctgttcagatgagggcccttcttggtaccactctgactcacatacactggctgaagtcatgtagcaggtgaaggacttaagtgtcactaagttggtttccagttgcttccaggaaaaaaaaaaaaaatccccggcatataagattcttgctcctgacacctggcactttctccttgtgttcatggctgcagacagaagatctggccattactgttttggcttcaagtgctgcctcccacacacatattgaggggctctgcaacaaacagaaacctagggacactgacattttggaggcagggtgtagaaaaaaacactgtatgtgtatctgaaaactctgccatgcatgtcagccctgacacgccacttcctagctcttctaacgtcagaacattctgtgttaggagttgctaatcagtccaatatcatatgtagtttaacggtgttgaaacacatttgccagaaaggaggccaaaaggaagggcccctctactgctatcttctgcaaaagatctgatcacttgtgactgcagcccctcactttgcccccaggtgttttctccctgtgttgttcttgggcgtgtttaatttggattgagcatccatggagctgtgtaaacattgaggtcccatgaatattgcaatattaaacagcagtggtaattaccaatagacccctcaaaaagcaatcgaatagcaaactcaccttaacttggcctttgtatctctggcaacggaaagctcaaaatgcagttctgtcatttttgcacagtcatttaccttgacaccctccctctgccgtggaatcaaatctccatgtataaaaataaacctagaaactttctgttcacacgttttgaggtatgtgcaccaaatgacacactttgggaggtaagcacgagtcatggtaactgaccacatcctttatcttttcatcctaagacttagcagaactttatctttacaataaaatggcctttagaagtgggtatcaccaacttcagaatgtgaacatcgttactgagaaaaagcattttccttttaaacagaaaccaacagccatgcattaaaaggcctgaggaaaaaaaaaaaagtggagctaccacaaaacaaacaaatattcagcttggtttcaggaagcttagagaggatcaaacaaggctttctctattgaagttgttcgagaacatttatggttatttcagcttcagtttctatttacgctgctggcttttatgcctcgacctcaggagggcattccaacttcaggttaactcacaagtagcttcagaaaagttggcctgaaaatcccacccccagagtgggggaggggaaagcacgatggttcacattggtttccaaacacctttcaaaccactgctttggccttgagtcgaggatatctcaaaaattggggagagaaattccacggagagagggtgagaaaggtttctcatggtgtgaacattcatatagggagactgtctcttcctgcgggatgaaaccaggagaagagagcaccaatttgcggagccctcgtgaaggtttccactcaggagtttgcaattttctgttggtccctagggaggaagatttagtacatggttgaatttccaagcaaattaacttccagaataaaggaggaactatgccaaccctttgcaaacaatatttttgttttataaatctatttagttttcaattcttcgtgccatttatcctcataaccatgttttggttggtatttttaatccccttttgatggattaggaaattgaggtttagagattaagaaacaagcccaaagttatacaataaatacatagaaaagctaagattcaaacccgggtccttttgcctctaatgtccgagtcccttccaatacgccacacagcccctgaccactcccttccgttaacaatgcatattgtcagcggtggaaagaggaagaaacttttggagtagaatactgaacagttttgattagggagcggatgtgaggcagaggaaatattatcactttggtggttgttactatgtccccatcctttcatggaaacatatggaagttttctcttaaacgtacatgtcagaacttgccggtgaaatttaagtgacaccctgcatatggtgcaagttcatctccgagaagcaagagatgaaaaagccgctgtttccagatgtatcaaatctcatataaataccacacgttgcttgcctctggagaaggtctcagtaaggtttgtccagatttcaacatagagtattcctatttacatatgtcccgctgcatacatacttagctatgtcaatatccacttggcatactctggagcttagaaaaagtttcctgccgaagctgaacagcttcccttgattgctcctttgcaaaccttcatggttttttcattgtaacagatttttgattacacaaaacatgccactattctatggaacaaaatcaagctacatccctttacccaaccgcccttcccccataacatcaataccaaaaaggcttccactccagggggcttctgggagcattcccacaaaccacacagctttctgcaccctccttcagccccagtctttttaaaagttagtacaacatgtccataaaggccactctcccttgcagagttttgaacagccactttagccacctaaatctgagagagataaatttacaatccactttaggtttatgtggggaaccataaatatcaggcttgagccctgagggctagaatttcatgggccgttaagcatgtcaccaggtggaaagctgtcaatagctggatgtgagctacactgagataaccacaggggcctggcttaagaaagtgtagccctgatcaaagaggggtgtccttttaccttgttccatcactccactcaccaattctcccttcccgcctctgatctcaacctctccttcacttcctgttaggtgtcctctgtgctaggtagcagactgcctttttttttttttcctctagagtgaaaggttgggtgacatatggaaagaacaagagacgtgcagttctggcagaccttgatttaaatcctcgccctgctatttagtagctatgtaataatgcacaagttacttaacccaacttagctcatttttccaactgtgaaattattaaagataattaaaagcataagaaaggcataagtagggccaatgggtagagactgtaaaaaaacagattgcctacttagtagacagaagaactttctaaaagccagattggctcgaaaatagaatgggctgccttgaaaagaaatgaagaagtgaatattctctgtgacaggttttgcgcataagccggatgcagggtggtagatcccgagaatagacaggagtttagactggccactgcaaaggatttctaatcttgaaattccatggttctatgatttgcatatgtgtccttccagaaaagctaagataaatcttctcaaatcccctatgcggaagaaaagtaaattggcatcatattttttcattttcattttccttctagaaaactaatcccttccatgttttcccccttccctcaattagttggtagagaatcccatttccatcaagtgcacagaacacatttaaccattttgaaacacttaacatttaacacaaaccacatggccgtaagttttaattagttcccgctatacaaataggtccatttttagaaaaatcaaaatgctcaatgctggtgcttgctctcttcctctccattgtttctctgtttgactagctcagtggcactttcccatcctgccctcttgctgtctgagcccatggcacctgccaataaaagtgatgacaggctttgatgctcacacaggtttgcaacaacagagttcacttcataatcaccagacttcagcccgtaagcgtgatctgagtgacactggattttttacctgagatgttacgctgtgggctttcgtttctacaggttatgaaccactttgaaagtgatttttttagcttgctagggggaatgacctatgagcctgcagacaaatctcaactgattgggcaaagcccaaacccttattagagtgcttgagtttgctgggaaaactggctgccacatatgagccacagatacaaggtcgtcctttggcataatgtgtacaggtgcatgcgtgtgtgtgtgtgtgtgtgtgtgtgtgtgtgcgtatttgaacatgttcaggtcatgaagcaaatcagaagtacaaaccagtgtcttctgtttggccaaagtgaatatcaagggaaaccacagaagacaaagtgcactcgtacaacaaggagtgatgggagggctaagcctagggctcccgtcctcaccctcatcacaaagtgactgctatgaatgactgcatgttgattggccaggcatggaggaagcacatacttataccaacatgttatttattcggccagatattattatcttacttttacggataagactcaaaaagattaaataacctgcccacagccacattacttgtaggtggttgtgatggaagttgagcccatggtaatggacttttcatggcactgtctactttcagaggctttctcagctcagagtccgactgtgtctgcctctcaagccctgtttcagccaccttgtctcattttttttttactctgatatcatatttcctacaaatagtggccaaattcttccttctccatgttggctgtcttatttgcctaatgttatgatttgtgtttcagataccctagggtatcatgtttttcatcttttgagtgtccaaaactacaaacagctttagggtcaattaaaatctcaacaggagcaaggattctatcaggagaccctgacctttgcagccaacactttacatgaagaagcagcttctcttcttctcccgtgaaggccgcctctttagatagctgggatttagcatgcctgtcattttagtcaaaggagctgctgaataaagacttgttgaccaaagcttctcaccggctaaggacagagaagtcttatttcttctctttgcaaatgaagattccaatcttctcatcctgagacaggggtaatgcaactgttttgatttgtaccctaaaatgttccatggtacactgaactgttttcaaggtagagttttagaagaggccgatttatttttgaccttgacacaatttgaatttaacaaacatttttcccatatttcactttacacatttgtttgcactgaaactgcatgactagaataaagcattcaaaacaaagcaggcaagcaagcaagcaaacagaaacccatcccacttctcccttgctatgcaactaggcaagtagacccgaggctctctgagatttgaaatgctgtgttccttaacgcagtaaactgagtaatgtgtccccacccccactccccaatgtccacatcttaattcccggaacctacaaatatgttattttaggcaaaagggactttgcagctgtgattaaattaaggatctggagatggggagattattctggattatctgggtgggctcaatgtaatcacagggtccttataagaagtagacaagagggtgaaacacagaaggtgatgtgaccatggaagcagagggacagaagtagactggacgatgctacgtcgctgactttggagacagaggaaggagccatgagacaaggaatccaggtagcctctaaaactggaagtcgggaagcagatattcccctagagcctcctgaaggaactggctgagtgttagctcaataaaactgggtttgtacttctgatctctggaactttaagagaatagttttgcattgttttaagtcccgagtttgtggtattttgttataaaagccataggaaacgaatacacttgtttaccacttactgcatctcttatgtctagtattgggcttggtatatgagatggactcgtaaagtaatatttgttggatgcactgaaaatataagggaaagatgtcatgagaatggaatgtaccaaattcatggcaactttttaaatttttatttatttatttatttatttttgagacagagtctcactctgtcgccctcatggaaacttttctgatttaaaaaattctctctttcttaggatgaaagaaacattcctttaaggctcagaagggtgtacagttacccagatatccatggcaaggccccagcggttacagagttgtgtttgagcccttcaggcctagcaagctctttcctgggagcaagtaaaggagacataggccatgataaacagcacttagcggccaattgctttaagaatacctgtttagtgtttccagggactcaaagctccagggggacaagcaggaaggagaggcagtgtcaattactgtacaatacaattagcaaataccagcaccttgaggaatgtttggtatacagtaggcagtcaggaagcaaatgctagaatgaatgtcattcagagcgtgtgacccctttctcctaaagcttcctacagtagaagtcagtctcctactacttctaccttctctgtctctttggatgttcattttcgtcggattttactcatacctgctgaagaagggcaaaggggagtacctttcaacctcagacacagacacatgtatttgtcaacaggccacacatattctgggcacagggactgcagaccatagcaacgtacctcaccttttctgagaccctcatccttgttcagtatttgtaagccttttaatttaaagaaaaataaattaagccatgctagctgattaaagaataatttcaaggaatttaacacttagtgattatattagcgatgtacaataacttctcactttggattctttttgatgtattatggaggtaaaaatcaatattttctaccaaactggagaaatttagatgatctatttttgagatataggttcagagaaaaattgatgataaagactggaataactctagttcccccaagtcaacatctgattggcccttagaatcagaatttaggaagagagaggtttgggagaccacgcagtcctgcttcctcacttcgcagatacggaaaccaggcctagctggaatttccccagatcacacagccaggaaacagcaggctcaaaactagggccttctgagtccccagtgcagcatgcatatgtgtctgccttgtttcattatgtaatggtacagcgagtttggaggcatacaaaaacagacagacaccaatcttgccttcaaggcgtttacaatttagcaggggagataacacatgtatataaaaaacttactagacaaagtaaacagcagtatgctctataagacaggtatggattaaaaaggaatctttaagtcattgaaccctgagattctttttttttcattttttaaaacaatagtaatcaaacttgtgaaatagtgaacttcctccattttgcaagattcctcgaaaccaagtacttggaatataacttagttaaggattgcacaacacacaccatttgagtatctgatttggaaaactaagccacagagccagaccacacaatgcacactggttggaatctgctgggcaggtatctccccgtctgtccaggcaagccaaatcaaataaggccctgagttaaaaaggaaggaaaagtaacagataaatctgttgaccaccactctaggaggccaaggcctctttcctccccattagtggtggcttgctctaagataaaaataccacacttaagctgtgatagaggaaagcccgtggtttgggacccaactacaaagtaacagcaaaagagagattattactccctagtgactctctttttggtataattagaagaatagaaagaccactgaagagtgggatttgtgagaaatatgggtcatgtgtctgcagcactagttgcttgcagaattggctatgtgggttggcacacagcaccgtgaatattagaaaccacaaatctccagggtttcttgaacaaagtaaaaggccttgtcttcagattgccaggttggaggctggcttgtggaagaagcccctgggtgagctccaaagctacctacgcatttctgccttctccgtctctttcttctcctcctcctctccctctccccatccctctcctcttattttggatattgcatcttggtgggtctaactgtagctttgcttatgccaatacccccctgccccaccccctggggaagcaggccctctccatgacaactgccgacgcagaatccacagagctctggacaatgggacaaaccatatttctatgaacaaagccaaggtaagtggattcctttgcccctggaggactaaaggagttactccccagtcagattatgctgtaattgagggtccagaaaaggaatgaacttccctgtgtagacaacagagccagttcttaaaaagctatgccagcgtgcagaccctttagaatctcctccttgggagcctgaaatggaaacaaagtacttccctgtgttcacctgtccaatcgttgactcctctgcagaattattctcttgggttgtaagtaagctaagtcttctataaggcatacttcaagaaaaaaaggaaaacataaaatgagtttataaaatcctaaggattaactataccttggacacagataaattgccacgtttatcactgcacttccctttatctcctcctgagatgctctctcggttcctccttcactgctcttcaggttctggaatatttcttagccaacacttcatccacggtgacttccaggacccccagtgaggggtggggattcctatgttgtctcttttcttggcctctccatccaaaatatttagatggtgcattcgtggcctttctctctctctaccactgcctcctccaaaaaaaggaaaagcggggagtggcgggtggaaggagattacatttttctttctttttttcttttttttttggagatggagtcttgctctgttgtccaggctggagtgcagtggcgtgatctcggatcactgcagcctctgcctcctgggttccagtgattctcctgcctcagcctcctgagtaggtgggatcacaggtgtgcaccatcacgcccagctagtttcatcatgttggccaggctggtctcaaactcctgacctcaagtgatccgcccacctcagcctctgaaagtgctgggattacaggcatgagccactgtgcctggcccattttcttctcttatccttggtgctttccatatagtaggaggtcagggagatcaaggggattcctggatgcataaataaaatctgcatttcttaggaatctgatggacaagagaatccagaatctctgcaatgggcagaagagaggaccagacttcatggttgatctccccacagaccataccaacagggcaaagcccttctgtatgtatttctgttttcacatgtatctgcacaaccacgtgtttagaaatcagagggttgctatttgtaaaactcttgaaaacctctcttttaaattgtaaaaattatttaataaatgccaacccaatctactttatctcagtgagctgctattaagtgcaaagaagataacatgttacaggtaagtctgtgcttaaagagctttggccacaaagactaaacagggtccgttctcccatgtgaaggaaaatgtttctatttcaattgtgatgtttggaatttcaccttaaagtagaaaaaaggcactgtttctgtagtgccttttggaaaggcactgtagaagtggctgatggtccttgtggaatcagctggccaagtgtttcctcctttctacctagactgtcattggagtatattgacccatccctgacagaaagtctgtgtaagcccgaggaggaggaacatgccgcaaacctgctgcagagcattaacaagaacagaattaaaaaggatcacttctgggactcatcacacaacttggaaatcatgttcaataaaagaaaagataatttggggccacactacctgaaatgaacatctgacactcagtcactggtctggatttagaaaactgctttgatccccggagggaagattgttaatgagtattttaaaggacaagattggcgaagcatgatagagtggaaaagggtactgattttgaagggtcccagtcttgcttccacttctgtaagcaagtagaactgactttgaacaagacacattacactgccctgagaaaacgtcctcatctctaacatgggaggtgaagttaaccctctagtccatccaacaatcaaatctaggccttaatgactatgaaaacatgggaaaaaatttaaaacaagagcaggtaatgcttgcaccttttcgctacctgaaaggaaggtcagacaaccttagtataaaaggtaacttttcttacttgcatgctaacaatcaatgcataatttacatagcaatgcatacactttatatagttcaagagatcatcgttgactgcctgaacttgatatgcttcatccttgtcatgtcctcctcactaaatactaactacccaaagtgatcaaaccccaaatgtaaaaataatcatctgataaatcacagacaacaaggaggtgaaaaaaagaactcagtcaaacatttttgagttcataaaaaaattgaatagcataatctaccactatgttcccatccccctgctaaaacaatattttatcactctggctttatttattcccagtcctccccaacatacttattttctggagcattttaaagtaaatcttggatatcttgtcatttcatccacaactacttcagtcttcatctcaactaataaggattttttaaaaaccactaccacgacagtattatgcctgacaatattaaaaaattatttactatcatctaaagaaccaatcaatattcaaatttcatcaatcatctaaaaatttttttttctttcagtttttggcttgaattagcatctaaacaagctaagaggtgaaactgatttcacccaattcacaatcctttgtcttttaaatatttcttttagacgctgacattacttagacacaatgtatctggaacacagataatgtgaaggtcagcttcatcgcaatattatttgaaatgtcttattctatgaatcagatataaatgtagttaaaggctcagaactggaaaaatctcaagtaattctcagttttcccaaatgcataaatgatttaggcaaccttaatggaatgctttaaagatattttgctaaatcttacaccattcctaggaagaatacctctgacagactttagcagcttttattttgcccatataaaagctggatttcttagaccgtggagcagcctaacagcacagatagtattttcagttgtagtttcacctgcaccttaaaaagaaatctacctgcatatgctggcaacgaggacatctttgaaaacagagctaagagcctcaaactgtcaactccgacttttgggaagaagggaggtgaacagtttctccattcagcttccatgaggcctctctggtaacacacaggcactgctgtgactcataaccagaaatactgttttataacaccagtctgtgttttgtaacacacactgaaagaaaaaaaaaactatttagaaaccaaaaccaagccctacatctgggcattggtatcaagatctcaagatgtcagagtggctatttaattcagataaagtaggcaagtccttatccctttccttggcaagaaagtggaggcttcctgcctgctgcacatgcccacaggaggagcaaccatgaatttaattttcttaaaacagaagcattttcagacttgtgttttcctggacagctgcctagtggctgtaatccataataagggcgtgtaattgacagtaatgtgaatcactcactgaaattctggcaaaaaaaaaaaatagaggagttattttttttttttttcaggaaaaaattaaagagcagattcatcctgtccattgaaaatagcaattactttacatttcagctcattagctacctttatataaaaaaatcactgtaatttgtactaactatcagcaagtgttgtaaagaagtggtgcagttgcacaaggcatgcaatcggatgtgctgggccaggcacaatctgtaaaatggcaaatgtagatgagttacttgatatagcatacatgggattcctggcccaagagtgagttacaggacactgtcctaacagtgattttgccacttaaaaagctgctatctgcctgggaccttgtaattattatggtaatacccagggcagactgatcaagctgccattgatgtctatgggcagtttcagaattcctttcactcagacacagggatctccaaaagaatggttggggattttcccaggtagaagctgttggaaccatggaaactttgagaccaggtaaagggtttctcccatctattaattctctttgaataaggggaagaataatctcaattaacttcactatcaacctgaaagggccccctcttttccaaggcagaggcacgggaactaaacactggaaagctacggaagatttaattccatttagataaaccctgactccatcagaacccgagaggttcagatatttttctgaaacttcagcacctgtgaaactagcagcccttgtccagaactacctggtatctcaagcttctggtcccagagggaacaggggtattttgacttgtgaaaatcccacgaatgcatggagaaaaacttgggactttagaatgctgaggtctgtgttaggaagatgtatattgaaccaaagagtggaaacacttaacctctttttctcagtcaaccacactctatgaagaaggcttggatttattttctcctattgggatctcccattcttagaagaaaaatggaagtcagatttcattaaaatagaggtaatgttgggattttgatgaatgaaactaaaattcattttgtgctttatcattaattatttctgagaagctttttctcatatgacaacagttgggggatggtattattagcttatgatggttcccatctttgatagccaccactaatctcctacttaattctggcttaatttgcaagtagttgctaacaggcaaaatgagggtggagtctcataaaccactaaaaagagagacttgctatgcatataaataggccctgcaaaaatatttcagatactgtatctcaattattagacagtagcaaactgtcaaaatctaaaaagtaacatggaatatgtataactagttctttgcaggcattctttttgttcctatatgaatacattttatgtgagcccaaatggttggaaatgtattattcatttttataattgagaaaaatgtgttaacgctctggaatgtccatgtgtggaaaaataaaacgttatatggaattgcacacacatatgatttataatgcatgcttccaggaccagaaatcctaacgaagaaccttattcaacagaaaaaaacatttttttttcttcagtatgtgcaattctggtatactgtaatgctgaggccaagcatatattttattagtttaaatcctagctaagcaataaaatatgtgtcattttaaataaaagaaaacatgtttttcacaaaagctagatttcttgtccatttttgtccccctgtagtggatgctgtggtgtgctgcataggtccctccctttaggatggaggccctcattcccctggggccctgagtgttgactgccagtggctcatagctgaattgcttcctgagatttgtccttagctaaagtggagctgccttgcccaaggttatgcccttaggtgcagctggcacccaatggctgcctgatgcagagtaaaagatgcagcccccttgcttcaatttggtacatcactgaagggccacccccactctgatctccctgtggcatctgctgaagcctatattgcaactgttcaagttttccttctgcccagtccagcttccctcactctctataggcattgtccctataagcacactcccataaactttctgtatgacaatttcagaatctgagcatctattctctggggaattcaatctaagataccttcgtttatttaaggatactttagtggagtgattagctgggcgtaatgatgaattttagatcagaatatggtagaacttcactttcttcaatgtgagatagacccaacttagcctttatgccaagagggttagttccagaagtttttaaaaaactctagcattgcaaggtgagctaaattaatggtaatggtacaaaatgagactttttttgttgttgctgttacggagtttcactcttgttgcccaggctggagtgcaatgacgcgatgttggctcactgcaacctctgcctcccaggttcgagtgattatcttgcctcagccccccaagtagttgggatcacaggcatacgccaccatacccggctaattttgtgtttttagtagagatggggtttcaccatgttggtcaggctgatcttgacctcctgacctcaggtgattcacccacctcagcctcccaaagtgctgggattacagacatgagccaccacacctggccacaatatgagaaattttataatgaggctttgctattgaaaataatagaagaatcatgtacgatatgtagatgattggtcacacacagaatgtgagaagttggctcttctacatttcagtggcataattaacccaactctccagaattcttgtaagtaagactctgggatagaacgaggaagaactcactgaccactaaagagtaggtaaagcactaggaaaatctgtgagaatgagtcccatattggtcattttgttcattagaaatctaacctaagagaaacgtatcaacagaatctcaggtgaagcaatttagggcaataaaaacatattctcctaaatgatactgtccctgagtggctcccctagtgaaaatgagaacatcttcctgtctctcaaatcaccccaattatacacaggattaggtaacttccacaaatcaggccatggaaagttctttgatttagagataccaggcaggactcttttttgaggggtgtgggagcaggaggagaggaggatggtggtgaggatgtgtgtgtgatagtaacagtttttccttttccaacatcaaaaaccataggccttctaggacagcttctactttgattgcacttggctgtgtgaaagagcagcacaaaatgaagatagctcctctcactgtgctattaaagactcccatctgagaaagaaaatgggtgaaggaggctataagagatggcctttctatcaaaaaatcaacttcagaagcctaaaagatcttcttccttcatcctgttctcatttagcttgctaatagacgcctcatgagaaaagaattattgtgaagctgagaaagtaagatttaaatttcctaagaagagatggactttacgttacaggcaagggacatttttttctctttttacaataattccaaagtgctttttgaccttggaagaagaaaatcagtgttaagatagaattggttaggtcatcgcctaaggaggcataaaaggccaccaggaaataaattaaaattaaaatagattcttttattgggtcacatctcatcctctcatttatgagcaaggcttccactcaagcaattgatactgcaggggataattttgctcctcttgttttgactcaagaaaaagttacaaacaaaagtagggaggaagctgcatatgaaggctaaaggacatttttaaaagaattccaaggaaaagagcacagaaactgtggttgtgtgcagccactgatgaggtggacaatagttttgaaattattggttcctgctaaactaaggaaacatacttacattctagaccagacaaacatagcaagtcacgtgttctgaccttgaacaaataaatgtcatttctttccagaatttaccttaaaattcaataagtaatctgggattatcaggacatctacttcagaaactgttaaacattttaggattactttttcttctctagactggacaaatacaggatatttcccttgataggatacacccttcattcttggaaaggtcagccaattctcttttctagtaggtagtttcctactttgcataaatgtagatgccaatggtaactgaaaatggtccctttaccttttactctatagattcgatcatctgatttacatggataatgcaaacaaatggtgttcaagaggtcactcagaaaattaacacattcttcatatctagaaagataggcaagtatttttaaacctctcgataagattctgacttaaatcttacaaactgcagaaagaaactttaaagctatcagccctaaaatttagccctaatactgagactcaaaatgcatatggtaaattgccagatgtcaagcagccctttgaattatagtatcagtttccaaactattataatgcaaatctcacaatataatttcaagtaataaatacctattctttctttcttttcttttttttgagactgagtctcgctgtgcagtggtgtgatctcagctcactgcaacctccatctcccgggttcaagcaattctcgtgcctcagcctccctagtagctgagattacaggcgcctgtcaccatgcccggctaatttttgtatttttagtaaagacggggtttccccatgttggccgggctggtctcgaactcctgacctccagtgatctgtgtgccttggcctcgccaagtgctaggattacaggtgtgagccactgtacccagcctattctttcttatagctgttaacaatgaaaatatcattatttttggccaaactgaaatgagcaacaagagtggtcataaaattgtgtatgtatacacacacatacagacacacttatttaaaatctacgggtattaattgagcacatagtagatactgatcactctgttaagcccaagggatacaaagataatttttttttttttttttttgaaacagggtcttgctctgtagtctagtctagagtgcagtggtgcactctctgctaactgtagtcttgacttcctgggctcaagcaatcctcccagctcagtctcccaagtagctggaactataggtgtgtgccagcatgcatagctacttaatttctttcttttttttttttttttttttgtagatacctggtctccctatgttttccaggctgttcttgaactcctggactcagcaatcccccctcctcagcctcccaaagtgctgggactacaggcatgagccaccacacccggccaaaaaaattaaagaatatctagtaggacaaagctacataaacagcaactattctgcaatacattttatactgtcaccttaagaatgtactgtgggggctgcagcaattaacaaggtggaattggagaaggctttgcacggcagatgctacttgtgttggcctttgatggagcaataagactttataggtgcagaagatgatgaaggacattccaggacaaacaagatactacagatacaaaggcaccgaggtatgcccatgcatggaatctcctgggaacagatcactgaggatggcaaacactgcctgcatgggagaagtcctgaaaagagcagtggaaagattaagaccagattgtaaaaggcctcgaatgccatacttagaatttagactcctcaggtgacagaaaaccttacaggaggttgaatgagaagattccaccttgtttctaaggaggtagaatcagaagattctagagaaggccacagtcaaattctagagaaagccacagtttttctttttccttacttttcttttttattgtgcaggagcaggaattaccgaatgtaaggctggtgttttctaatatacctcatctcagagaatagaatttagccaagacagatttttatcacactcttagcacacagtgagtcttggtaccactagacaagactgggctctcttccctaaaagattcacaatcgtccctcttactgttggtgttctgttgtattcacactgcaaagcaaaacaagtgccaagccacaccttgagttctctgctctgcaggtttactgcctgacaagccttaaagttagaaaaatatttcaagctgaatctgtcactaacaactttatatggtttgttgtttcctgtgttgcttgttgagaatgcctggccactgagaaacgaaatcggaggcagatatttctgacagcgagcctccctgccgggtgctttatcattctttatgttaaatacatcaccacatctaagcccttgcaagccgagaagttaaggttatggtgtggacaataaaaaaccgatttttctcctaattgcctacatgtattagaagtttttgaatttatacaggccattggtagcagagagtatagttcgttttttgtttctttttgtttttgtttttgagacagggtctcactctgtcacccaggctggagtgcagtggtgtgatcatagcttgcggcagctttaaactcctgggctcaagcaatctttccacctcagcatcctgagtagctgggactataggcatgcacccccatacccagctaattttctttttattttttggtggagatggggttttgccacgtgcccaggctggttttgaactctgtggctcaagtgctctacctgcctcagcctcccaaagtgctgggtttacaggcatgagccactgcacccagcccaaagagtatgattctattttttttttttaaatttaattcctcttcatgacagtctcttgtggcaggaaagtggttagtttatagatagaagaaatctaggaccaaagagatgaaataattggaaatcattgttttgatagagtcaggggcagagtttgtgacagcatgacagcagcattccttggctgctgctctcagggggaagccctacagccttgtttccactgcagacttaactgtcctcactccacgtagatcagttcgattcctgagcccgaatgacaagttgaactaccaataatgccttgcacaatgtttgaagcgacataatcagccggagagggacttgtgtcagttagattttgtctccttaaaaatcaagagcaagagtggtaagagagaagttttttaacaaggaggaaaaccctagacagttgtctctaaggttcttcaccacagcttcaaggacaaccaggaaaagagctgctatttgaggcaacttcattataaaatcatttttaataagcaatcttaacaaagagagggaatactcttgtggagaaaccctccagggacccagaggctgcccagttaagttattaggaagtttcacacaagggaccaaacagctatttcattggcctcgggggacagagtttagttttcacctgttctctagaggcactggtgttatcctgtctactaacagcagagactggtaacaatcaattatcccgacgccccaacctggtgagggaaagtgaattttcagttttgtcgacacaaaaagacatggtgtaagagaaagagagataaattaactcaatatgattcattatactggagactaagaacacgcagccaatgaaaatgcctcatcaggaccttggtattctttaagtaaaacgacagaaacatattctaaggaaattaagaaatatccataatgagaaaaggatgcttagttgtcctcttaccataattgtccagctacatgagggaaataattctttgtgctgatgaaaaagtaatagtcactgcagttgactttgcctacctaaggagtgagcaaggtttggaatttggggtttaaatttttataaagctatttgtagctgagtttaaaagggttggaaagacagaggctcccagggtagcagagtagcctgcagccaattagcagctcgaatgaaagaaagcaaggagaaccattagccgcaaaattcaaagtgcttatgtatttttcaagtttcactgcacattccatgcctctgattttaatgaaatggcaagaacgggtcttacaattagaccttaacaccgtggagttagagaaaaagtgaacatcctttttctttaataatcagaagagccttctcttttcggaccagatctctccttcccaataagcgtttttttgtttgtttgtttgtttgtttgtttgtttgtttttttaacgtagttggtcacaggagcacacacagaagtagttctaactaaggataaaaatgtcacctgggttcagagaagggactggagcagggaacatctgattcacataaccctaactaaatgactgtggcagaaaaacattgtttataggtcactgctttttttcacacacattctgtggctccacattggttatgagagaaagccaaaacctgctctctgttcttactggtctcccttttccttgttaatactctactccagtcagaccgatctacacaatcatccctgatcacacctaattcttgctacccttccagagcaagctcagctcaccacacatgttcccaactcatacagcatttaaacacatattctattaggttggtgcaaaagtaattgtggtttttgccattgaaatggcaaaatttcatagccctgcattttcctgcaattctttcattactgaaagttcctcaaatgtgtgtgtcctttctcctagatacagactaaactattagacagggaggaatataagttagattacctatactgcaatgtgccttacacaatgttaggcacagagcaggggttaaaaaatatcaagctaagaaaatctgcctggctccctgccctatctttccataggtatgaactgcagtctactttccagcctctgttcctcagaccccgatattacaggtgtctggattgcctagcatataatttccttcccctttcctctaagaagaaaatgtaaaataaaagatttatagattaaggcctttccactgaatccaaaccttaatctagtatatcctacctcttttttttttttctttttttttttttgagatggagtcccactacattgcccaggttggggtgcagtgctgtgatctcagcttactgccgcttcggcatcccaggttcaagcgattatcctgcctcagcctccctagtagctgggattacaggtgcacagtaccacactcagctactttttgtatttttagttaagatggggtttcaccatgttggccaggctagtctcaaactcttgaccttcagtgatccgcccgtctcggcctcccaaagtgctgggattacaagcgtgagccaccatgcccggccactcctcaatatgccttctaatcagtatccttggctattaactatttaagacagtaggagctggagttgatgcctaggagacatacaaaatcaagaagggaaagagctatcactcctacatagaaaaacatgttttcccagaagtggaagtggattgggtggagaacattccattgcaagggattttggcagtcaaaggaaaatatttaattgaatagcttaaaaatcttcatccttataatgtatagatgtggatgtcaattataatccaaagggccatgtgactacaaatgcactaacttcctggccacagaattgataaagaaatcagtgtaaaaaatttagtgtcatcactgaaagtgaatgtagagtgatcactctcttcttgttttaaacacattggcatctctgtttcttctacgtttttattcctctgcgtacagattgcaataaaaagagaagctgatataagtgtaaatccagtcctaagttcagatatgcttaaacatcctcaaaatctagatgttaattttcttatatctcctatatatcccattgatatatatatatatatatatatatatatatctgtttcctgagcgttctgttagcttccagggtttttttgggtttggataggtttcaaagaaaccactgtgtccggaatcatagtactgctttgtggcaatgaaagttataaatgaattactaagttggtctaacaaaaaagtataaatttattataaatgtcattaatgtccgttaaaggctttgtttcagaggaagatgggtttgtgctgtacgaaatatatgtcattactggtgtggggtacatagctgtcctagaagcagaagtaaccactttgaacaattgttttattatggaatcagttgtgttgtatgacattaagtagacatcagttctttgatgaactaagttaaattgttaaaaagataagtaatggtcatttaaagtaagaaggttggctaggcgcagtggctcacgcctgtaatcccagcactttgggaggctgaggcaggaggatctcttgagctaaagagttcagagaccagcctgggcaacatagcaagactctgtctctctcttttttttctttttgagacagactctcactccatcacccaggctggagtgcagtggcgtgatctcggctcactgcaacctctgcctcccgggttcaagtgattctcatgcctcagcctcccaagtagctgagattacaggcgtgtgccaccactcctgactaatttttgtatttttagtagcgatggagtttcaccatgttggccaggctggtctcaaactcctgacctcaggtgatctgcctgcctcggcctcccaaagtgctgggattacaggggtgagccaccaagcccagccagcaagaccctgtctctacaaaaaactaaaaataaaaaacaaattagctgagcaagtcccagctacttgggaagctgaggcaggaggatctcctgagaccaagaggttgaggctgcagtgagccacgcgcatgccactacactcccgcttggccaacagagcgagtccccttctaaaaaaaataataaagtaagaacgctgtacagtttccagtagactactttgtttaaatactttttttcacatagtgggaataacattcccctttcttacaatcagtttgttcttcaagcttagaagcctatggaggtagcatagttgtaaggtaaaaggaaaccttggtcaattgtaagaatgactatgttgcacttggctttcttcctatactttagagtggaagaaccactctgaaaaatgaagctcttcattttaaaagcatttaaactggggattgcctttacatcctggctccaccacatactagctagttgtaggaccctggacctcggttttcatctgtaaagtggggatagtagcaacacctacctcacaaagttgcagtaaagataaataaatgaacacttagaaagtgcttagagaagtgcctagcactcagtgccccacaagtattagttaatgttgatactggagataacggtgtggctcttatgtgtgcacaagggggcaatctactctgttttgactccaggctttgcccagctgggtgagctaacgaggtttttcacttctctaagctacttgtctctcatgtacattttcttatttaaaatgcgggtgcaagcagtacaaagctcctaaagctgatgagcagattaaatgaaataatgcacgtaaagcattaaacacaatgcttcgaatattcagattgcttggtaggtggtgttcctgctattgctgctgctgctactacaagtaatggtactactgctattacttctgccattattactgtcaatatgaaactaagcatattgcaaacttatgtcatagacatctagcgctttttaaaaaatcaatctaatcatgtctaactaagcatttatcaagtatgtaataagtctatcaagtccacaccaatccctcgtaggctaggcatgtttgttttctccctggtagtgattatggattttaaagagccaatcaccatctcaacacaccctttggaacgtatgttatgaagtgggaatacaaatactttttgtccaaatgcaattcatgaacctcaagtctactaactgggcaaacttgaatcaactggatgttgggatggaaatgctcaggtaactattcagtttttctatggagttcacaggtcctcgccatgaactgtgggctttaagactatgcaaatcttctactttggaagaactgactggcagggccaagtgcaatccatttatttttaatatgatgagacagagaaatcctgttaagcttaggagggcttggctgtagctgagcaggctgactctaaacaaggcaaacgcttccagacagtacagagggatttttactttctcagactggctgatttgaagaaactaaatagatgttactctgtaagaatgggtggagatgagcagcggggataggttttagcacccagggttaaatttttgccttttgctttattgctattttatgcttggatcacaatatgagaatcctcgatgttttctctagttttcttttcctctcccatacttccagcttagtttgttttccagttatgagcgacttatggaactggtacacctggcatttgtgttttcagattgttttatgtgattatgcacttctatcccaccctatcccctatcttgtctccctctagtctttacttacaactagtctgtaaacgcctggaaggtaaaaagcctatcagcgcagagtaggtcctcaatgaatagttgtcccttaattagcccttaagaggccagcacctgtattttagtcatgacccactgccaacaagcttgctgtctgagatagctggtagccttggtaagctaagcaatgaatcttccagttactttgtgagtactaggttatcccttttcctgactatttgtcaatgggcagacaggatctggatgaaggcctactaaaagaacttcagcgtggcttcttctcacatctgtcctaatggaacaccctgccagcaacagaaattataactgccgtgagtcactgtgagtcacatgggttgccacggaaacctactaactatatcaccaaagcaccttccattagctttgccaagaatggttcctgagttttcctggactgtgaaaacaatgtgggtgagccccaagtttggggttgctaagagtctacaataaaaaagtatggcctcaaggataggaaaaaaaatgagaaaataaggttattctagtttttggatctcctgagtaaatggcaacaattgtgacaacttgttgggttcattttgtgatatcaatgaatgcctatggagaggaggttgaggcctcaaaactaattttctctaagtcaaattcaaagccaagtctctggggtgaaaagtgaatacattaacctattccattttaaatgattgcaataaacactttttaaaatggatgcaaaagattagttctcaaagaaatattttgatttgtgctaaaatattttactattgagaactaaatctttttataaataacacagtgctttaattttatattgtaggtattagcctgctacaatcaaacatttgaaaatgtactagattaccttttaatggctattcacgttaactgaaaatatttccgaagattcagaggcgtatcttgtttgggtttttattggggaaaattaacaactcaagttgggagtaaactgacacattttcctgactgcttccactgagtaacctgcacctttcagaagcctgtatctgtccctcagtgtgggagaaagcaggcagggcaggctaggacaagaggtacaaggactgtaaacaaggatgagaacagaaggaagcagcaatggtctgatgcctctggaaacggttcaggggcctaccagatatcttttgggtctgtgttgtggtggctgtctgatatatgtcctctgaggttaggactccatgatgctaaactttccagtagctggaaagagctaggatgatttgttgcatcttttcacctccatatttatcctcttgtaacgttgtagcaaatgcagaactatccaagaagaattagactaagaattcaggagtgaatgactcgttgtccttggcaaataataaaaaccaacacagcagctgattccgaaaatgatacttatctgcatggtggctatttcagcaggaaagagaccagaacaaacttgtgaaacaccaaagcaaagcaatcttgaaggggtccaaccaaatacatgtgctatataatccccaggaaaattaaattgcaattccacaccacagtgtaaaattgatctaatattaaaaactctcttttatgtttgcacaccaaaaaccaacagcaacatttcctatcaacaattgaagaacatcacaaatataagaattccttgaacaatttgggcacgagaaacactagaaattccaaagcttgtcttctcccactggccaactaaacagaaaacaaacacttaaggtacccttctcagaagcttaggagaaactgagttctccaaagactatgtccatgggctcctctgaagcttaacagtcaaatttcccttcatgggaatttctgcctcaagtcacccaaaacatttattttttttaaaagaaacaatacctgtgctttccagataacaaggtggactaaaatactatctggtgtcacaactattcaggctcattttgcagtatgtgcacctctgtcttgtgtacctgtgagctgacactctggtctgataatatattctgcagctgtacatattaatttgtaagttgaacaatctctccgtgagggcagttaggaaaccaagattgaaattgctaatgtcgggtgacttcagctgtcgatgattatgtagtcaagtcttgactaaggtttccagaaccctggctaaaaatggaagttttgagacggtacaaaaatgaattcatacacttcactgatagtgaaactttttgaagaacagatgtcaagatgatttaagaggagctggaatttaacatcttaaaaaaaaacgtataggcaagttaggacagttcagttttcaagaaaaatccaacaaatgctaaagaagaagtaatttgggtgactgttattagagaaaaaactgactgattgtctttctcctcacaagctgtgggccctgtggagatgctaagatcagaaatacgatgggctgtctgctgagctgggtgacaaaaacaatctccatgttcaagtggcatggaggacttccactaacatgtaacttggacaattcaatttctccttggcatatgtaaagttttgtgtcaactgtgttttcaggtgctattctttccaattttgtcattcggccattttttattctgggccctctcccccaatcatgaaagtaaacatcaaccaaaacaatatcatttctgatccaaatctttctgtccattatataaaaggagctttaagtctttctacattgacttcaagcttaatgcctaagaattttcttgctgattttcacagttagaaaggcactcaaagtccaccctgtgtggctatatcttgattttgcattaaagccagtatagctgatgaaattctttaagcctttgtggaaagacccacctggttcaagtgtctgtttttagaacaccaatttttcctctctagccaccactctcatgctgtcatctaagtccctccatgaatttaaactcaaccacaggttattgtttctgcaatagcccaagaaaattattctcagggatgacagttcctcgaatgtctctctttatatggactgtctgtatactaggtaacatctagatttctgtctatgttatcttattagttgggatgtactcttcatgtccagtggagctgaagtagtggttttgttcacttatctaagagccaagtcataatgcaaacagtcagtagctttctgtacattgccaggtggccaggagtccataccccaaaccaccataaacagtaggcacaatcatcagcccctgttggggagaggcccaggactgagctagcagaaagactgaattacttaccacctctagagtgggtccctccgggccagggacgagctcatgggcaaggctgtgcaaggaagcgctctgtaccatgcctgccctgcggatatacagaggacttcagtctcctgcactgtcaatctctcagtcatcatgagctcaattatgcaccgacaacagcaagaacaagaacaacaacaacgacaaaacaacccccaaaaagctaagggtcacagactaccctgatggagggacagccaactggaactgtgcattgagagatggaggtgccatccggatcatgtgtctagtacgggcctgaccttttcattgttcctcaagcaaacattccattgaaggccatgagagagccacgtggagagactgcaggacagggccctcagagtcaggcaacttctcatccaatttgacgttttttggttttttcttttttttttttttcatttttgttttctacaaatacagatagacagacagacaaacccaagagcagatttcaagaatcaactgaggcacaagataaactactttgatgtaatacagatgttttcccccaaacgtttcacatgaaataaaaaaatttaaagtgtaattaggaaaaattgggggatacatccttgttgtccctgtattgtgccataaatatctccactgcttgccttagaagaatgcccaaacatatctcataggtagcacgtatccgtggtctaaaatagtcatcaaattctaatgacaccattaattcaaagcctaaataatatgctggtcaattacagtgaaagttgactgcctgcatcaatgatgtcttgtttcatcctgaggttcaaggcacagtcaaacatcattgctcagattgcaaatcacaacaccttacattgacgtgagtttgtaacttatggtgtagttcaaatgaaggcaattgatgaaagcagttgaacctgagaagtgggatgaatacagagcataaatccagcacacgtttccacatcaaactaccgatgccatttatcagggccctcgcaggccatgcccgtggtcgagcgacagcgcctctattcccagtcagcatctctgctccacagacatgagtacgaaacggcctaatttgtgaactagtggtgaggaaaaggagaccaaagcttaaaagaaatcaaggtgatgtttcctagaaacataccagctcttctaagaaggatctaggataagggtgatcagtaagtaattgatcctcctggctagatttcatgatttttctaaagcttcatggctggaaacactggaattcatcagaatatgtctctagcctctctcttcaacacacactcagtacaaacaggtggagatgtgccacttccgaccactacagattgaaaaaaaatgacctctgttgaccatggatcacagctgaaacattagtatatacttgaagggtcacagcagccagacatatgcgaattccaactcttcagaaaactttggacagaaaaaaaatgcattacttacatgtatgtgtcttcttcgttactgagatacctggaagagaagaaacaataacataggttagaaagtgccctgtgtgtgctgctttgaatgtccgtcattcccagtgtgctcaggaaggcgtttagttcagatggggaagtggaagcaagaccagttttaacattgcacaggagtgtcactagacctaccccaaaggcatgcaaccgtgactgatgaggcagcgaccatcacctcctggtttaagaggttctgtggtaaaagtggggagcatggacaataactaaacagggttaaacaggacgcgaggagactcttattttttattttaagtaggggagacaatcatgtttataggcagagtgggaaagatgtaaggcacaagagagcaatgccagcctactcagaccagggtaagatgagcaacacggcaattaatttgctatggccattggttctgtgtttactctttaatgaaaacgacccttcctcctcccatgaagcacaacttttaatggtgagggggaaatacatccaccaaatgtacctatgtgtctgtactcattaaggtcagaaagggaatcactgctacttctctaaaaatggcccccaaatgtttcatacagttgaaacacaactgaatgaaatgtatgaacacaaactacgaaaacacgagcgattcatgagtcagcacccttgatatttcaggatgatttataggtagcaggtgacaaatagaactaagcaacatttggcacagaagtcctgataaagatagcataaatgtatgctttgatgcaaacaacactatctccatttcagaattactacattttgaatcctttatgctgcattcttcttgggagacgttcttgagactaagtaggctcaaagtcataaaactgttgaaaacatttagcctgtgactaagaactgtggtaaaccttgaaatttttttttctttcaagttattaagggaactatttaaccctcctttggaaagtaaaagttgttgaaaaatttggcagccacatcagacctattacttagctagggaacatgtcgtacggggaagaaatctgttgtgaaaatccacggcagacattttttaaaaagttggttccgaagttgtgagccaagaccaaaatcacacacttgctccccccaacactttccaaaggacttatttagggaagttgaaattacatagcccaactcaaattcttctccccgaccccgcaacttttattgaggaaaactattgttttgtttgtttgtttgtttgtttgtttgttttaaatcatgtttgagttggcttcacaaagtgaagttagaaccttctaaaaaaatccttgaagactgtctcacatgaaaactacaaaagtgttctagaattttttgaaataacctttatcgtgggaagggaacttcccccagcagcagcagggagtaaagtttaaaatctgaatacaatttgcaactccagctcatgacaccagcaccaataaattgatacattagtgcactttcagcattatgagagatatatgtgtattttccttaggaaatagtgctttctgtaaaatcactttgaagagaaagtgcttaggctgtctctcctgattattcaaaacctccacacaattggatttaatacagcccaaaacgacctatctatattcgctgagtgtggaactattttctcttgacatccaaaggcctgatgaaaataccactgctttgacttttctacttaaatttattatacagcgtgatgcagtgttctcatcaaatattttcatgacgattacattgataatagattttgaaaatcttcccaagaaagctgcttgatctcggaggtcgcagtagctggcatggagctaaaacttttcattatctgtctccaggaggaagcatgactttggcaacaacacaatctctcggtccctcagttttgtttaactgtcaattaataatcaatataaataactgggagctacacttatattggagttgccagatttagtagataaaatacaggctacccagtgaaatttgaatttctgatactaatttgtagtttatcttacattcaaatttaactgtgcattctgtattttatatggcagccttaacctatacaagaagaatgtaaattatatttattatagccaatgaagatataccaatcaattaataaacacatttttatggagaaaagcttagaagacacactcctgacacaagagcaatatttgttaaaattgcattacaactgcttaattatggagatacgactgtgcatgatatttaattttttttaacctagccattctgaagacagaagtctatttccctagagaaagtgaacaaacaaaaacaatacaaacacacaaaaggcaaatttaatgaaaaaaatcagaaaatgtattggaattctctttgatcctctgaaacctaatttctccatagaagctctagtacttcatagtaaatgattccatagaagtaccaaaaaaagcagaaaacatccttttcatttcacagatggggaaactgaggctcaggaaagtttaattggcataataagacatttctctgtggaaagttatattaaactggaagtacactcatggcaaatctttaaaaacactagtgtagatgtaccctcaaaagagtaaatactcaaaaaagttttactccttggagcataccactcagcagtcagctctgtaaataatttaaacctatgggagtgccctcagccatatttaaaccaggaagactcatcctgagtttgggtgaaagatgtactcagatgctgatgcaaacacacagaaaccacagtccctactactagaagagcatattgaattgaatctagaatgttccggaatattctagaacatagtattctgccaggaatccagctgaccgaattacccacacttgcccaccttaggccttcattcgcagcaggcatgtgtgcctgggtttgttaccagcagccattttctcacccttaaatgagggatgggtctccccttttctttttctcattttcctagaggttacaagattcctgtttttctcaccaggaggagaggtcagcctcagtgagctcatagcagtcatacattgccagtgtttttcctcaagtggaaggagaaaggccttcagaaaaaaaatcgtatgcaaacctagtgctaccaccagcagtagctctgaatcgagatttttgggagaattaggcttactaaagataaactacaataagtctcaaggaagcaaataattctgattctaatgaggaatccaagaataaaggcagctcttaaggtaactagatctggagtcaagctgacctgagcttgcgtgtatagcccattttcctgcttctaggttgagagaccttgaacaagttacttaacttttctagtcctgaatttcttggtttttaaaattgtatacaatcatgatgacacttaaaagactgttgtgaaaattaaaggaaataaggatgtatgaagagctttacaaattgggaagtgtgacacaaatgactttggtaaggggtgagcaactcacatagtattagtttaaccaaactgaattaccatgtgatagtgaaagctatgccattgctactcatgatgtccctcagtttcatactgactcatggcctaggactctggttttcagaccaagtactctgactagaaaatatcctcatatttgatggaagacagcatgagacggagaaccaagttccttaaagtaagtgtactctattctagatcccaagctccattcgctttactctctaaagtctagagaaagagcctggtatggtggtgggtacccgtaatcccagctactcgggtgactgaggcaggaggatagcttgagcccaagagttcaagtccagcctgggcaacacagtgacacccagtcttaaatttaaaaaaataaacaaaaggaagctgcctactcactagcaagtggctgcattatccaagtgggctgctgatcagcacaggcaaggactttggtccccactaccgaagggcatcgaaccaagtccagctgttgtgcaggttttgattcacttccaaatgactgggaagaacaccaagatccttccccagagattcacaaacagaccacgagcagggtaatgctctctacagagatagggacttgatagaattgtggtgaatgacggggtggaaccaagtttctaaacctaaaatacacatacaccctgcgcccaaagtgaacacggtggatgacttgggcaaataatttagcttctctgggtcttagttttcttatatgcagaatgaggtagtcagtgacattttttttcttccagacaggttctcagtgtgttgcctgaactggagtgcagcggcaccatcatagctcgctgcagccttgacctcccaggctcaagccatcctctcacctcagcctccctagtagctggaactacaggcatgtggcaccatgcccagagaatttttactttttttgtagagatgggggtcttgccatgttgttcaggctgatcttgaatgcctggcctcaagcaatcctcctgcatcagcctctcaaagtgctggattaaaggcgtaagccaccttgcccagccaacatgatttcttaatttcccttccagttcatcaaccaatggctccttgccctgcttctaagctatcaagccaaaccacatctttccaagcaacaggctgtcagatctatttctcactgtaagaaatccaatgtggctcataatcaaaggtaaccccctgaaacttttttcttcttgcctttaacaaccaaagaagaaaaaagacagtgcccacaaaaggttatataagtaaaagatgcacttttcttgggagatctttaaaaattatctgggctagagaaaaatggcaccttttgataaagctgtaagactccttctattttacccagatacacatacacacacacacacacacacacacacacggcaggtgtatttccagatttccaggtaatgcttgagcacaatttctaacttaacaatatgacagaagttttaaattgccaattaaacccctaaaactaagagggctaaaaggccccaaaatattcggtccaaagcaaagttgagcttctaatacagcaaaaatgcttgactctctttaactggccatgcttcaaagtaaagcaaaggaaatgtcatgaaaatatcacagatttagccctgccatggttatcagtagggaagtttcattatagtcatcccagaacagagcacttcaggaatgtaagctggtatttcccgtcagtgccaaatcttggaccagttaactttcttgactgacttctaattgtctcttggtttttaggaaattgtctgggtatccagttaattttacttttttttcttttttttttagtaagaggtggcatttttcctcttcccaaattttgcaattaccaaaccagcatttccagaggccttgtatcctggacaaggccctagacttgatgccactctgccactttgccagtattcagcctgtgtgtcttcttttgtcctcttttgcaacgagaaaacaacttttgagatagagatattataaacatgaaaaaattctgtgttagcattaaaaaacgaacaggctggtcatggtggctcacgcctgtaatcccagaactttgggaggccgagatgggtggatcatgacgtcaggcatttgagaccagcctggccaacatagtgaaacccacagtctctactaaaaatacaaaaaattagccaagtgtggtggtgggtgcctgtaatcccagctactcgggagactgaggcaggagaatcacttgaacctgggaggtggaggttgcagtgagttgagatcacgccactgcactccagcctgggcgacagtgcgagactccatctcaaacaaacaaacaaaccactcaaaaccatgccatgtagatttccttttattttaaaaatatgtcaatatttttactttgcaagtgaatgtggcagggaggaagagatgtgttgagtgataatgaacaaagtcttgaattggcccaactcatgtctctacaccaggcttgcacattgactcctcctttaattcctagaaaagcagggctccaaatctgaaggctttcacaagatttattctccctccctgcaagatgtctgagttaaagaagacacctattatttaagctatgagcgcttgggcaaatatagcttaacttctctgagcctttcttttcttattccataaaatgggaataaaattcttaggactaggtttatagtaaaatgtaagataattcacgtggggcacaggatatagtacctctttcctactaaagtatgtttcttattgcatacaccttgtgaatccactttatattagacaaacagagagacaacccttgactggacataggcaaaacccattaatcctgttattaaacgggataatccgggaaggcagcattggagagctaaggaaagaattttccaaataaaacccaaacacttaacccactccctgccacattctcaacaagcatgctgcaaaggctgtggtctcctggatccgctgtgctctccttacttctttttgacttcctcattgtgaggcgctagcagttaaaacggcaaatttacacgcagtgcatgaacactagctaagaaacgaggcctagaatttaggcttcttttttgaatagctaataattgttttctaaagaaaaaatatcactttgtgctggccttatgtccccctcctcctcaatcctgagttgtcccaggagactgctccattctacacatagtcaaaaagaaaatctatgcacgaggcggatccggaacacagcccgagtagggcctcgccaaacaaaatgatgttacaaaacaatgtccttgtctaggacaaaagaactattaatgataatcagtacatattactgaaagtgctccaagtaatctttggactttgtttcaaaaattcttaatggacactaatgcttagagttcactcaaaagagaaataaattatgtgccagggttgcagggaccaaggacaacacgtggaaggcatcaaagcattagcaatgttacgacaatcaaacattttgtaattgcataaaaagcctttaaaaatcatttagatatactaattatgaacattaataatactataatgggaggtttcttttatgttcgatttgagcctaggttgagctgtttcggcaataatatttcagctcttttaccaaccaaggtgctttggacgccatgaaaaatattccattttagtttgaaaaatggttatgggaatggataagaggaatttttcctgttttttgaattcaaaaaaaaaatttgtgattgctctccatctctaggtcatatttcctgacattagtgcccagaaatatcttttaattttggacaggcagaccagaagtatgccctctttcaagtcctgcctttatctttaacaaaacagttccaaggacaaagcctcattccgggttccccagcaaaggcaacataaagagaccatcagtctatcagagaaagaaatcttcagacaaaacttatttgggaaacatccctcttctcagagattactattcaatgcactacgaaaagtccatatgtaaggagggcaatttctcttgttatttactcgtcccaaagtatgattagtacttatgtatagtaagaatcataagaagccttattttttcaaattgatttccttttattgagtgtctgtatggaagatgatgctatccattcgatattacctggttgatttaaatttgatcttggagctctgagggcagaggtgtgaactgatatcaacactttcagcttagccttctagaattgagcagttttatcttctaagtgaataattcagctcaggtaaacatcagcagcttacaccatgcttttccagaaatgctttactttatgtgcctctgcaatctgttaaatctgtttatctttgtcactcatatgggcaggtacggaagtgaactgtctgtgggtgacttgcctggatgccggctatagctgcagcccccaaagtcgaagctaccagaacaggttggatgaggatggcccaaagattatggagttgctggccccaaagcaagtcagacactatgggaagtttgcatgaatcatgcccttggatagacaacctaaatcatacctcatcgagcatggatcctggtcagcataccaagtcaaggcaagtaaagactgaagaaatatcacctggtctgcagctccccccagaacgaagtctgctactgatggcagaagcatagatagaccaagggtatcactatgtaatgatggaagaaggaaaaaccccatgcattcactcatgtcttgaatcacctagagaagagagggaatctgccaaagtggacacaatagaaattcagttctaaatttggaggaaatgaggcccactctcagataagatgaaaagtaaaagccctaggatccaatggggtattaaacaaatatttaaaagtagagaggtggtgaccagttatttcctgatatatagaataccatgggtccataaagaattttttagagtatcaatattattaacactttgaagaagacatatgaaaaactgattaaattataaattaggaaatcatagatcattactatttgtagcctctctactcccctctgattacagaactttaggcagtttgtctggattggtgattgctggataaaagctcaagaaaagaaagtagccatcaagatacttctcttgggaggccgaggcgggcagatcacttgaggtcaggagtttgagaccagcctggccaacatggtgaaaccccatctctgccaaaaaataccaaaaacattagctagccatggtggcgcatgcctgaagtcccagctgctcaggaggctgaggcacaagaatcacttgaacccaggaagtagaggttgcagtgagcagagattgtgccactgaactccagcctgtgtgacagaatgagactccgtctccaaaacaacaacaacaaaatacttaccttgcattcacagattttatgaagaaaagtttggtattgttagattagatgtacaagctatgttcccatatgggattttagaatcaggaaatctggattcttttcccagctctgccacttaccagctatataatttggggcaagatactctctccgatcctcagtttcctcatcactaaaaggagaggaaaaagatttcttctttcattctaaaattccaccactagaaattttaggaattaatcatgaatatacacaagagttatcataatattatttatatcagcaaaacattcaagggaacacccaaatattagcagtagaggatggcaaataaagcatgatatgtttaccaaatggaaggcgctaccatcattaaaataaagaaaaataaatcagagacaatgatgttccagctgcattatgagaaacaaaaaaattcaaagtcccaaagcatagtatatcattttgtcaaaaaaggaaaaaaaaatgtatagaaaaaagacaaaaaatacatacaccaaattaatgagagtgattatgtttgggtggaggaattatgactgatttttctttgtctatgttttctaaaatttctataaaacacctgtacaaataaaattataataataagaaagaaaagttaatattaaataactattccacaaggttactgtgaagataaaatgaaataaagcaaggcaatgttgacctaatattagtttttaatattgcaaacatctctctgtgactgttaggagacccagtttcctatggcaagtactaattgcattatcctttctagagaaccctatgtgaagtctgaagtgaaagtgtgatagcatagctggctactttcaggagtgccctatggtgatggataatctgataatacttgccaaaatggtaatcataaccaatatgctgataaaggtctgaaaaataaggcttgcttagtaccatgtattttacacagtgctcgagaatgcagtgagagacccaggggctgacttgggacaacttttgactcctaggaaaaccaccaccctttagctaccacacaggtgtttgcctaagccaatgactatagggcatatgactacagtgtcaacacataccagcaaccaaaggcctgtggagacctctgcagtacaggtgctacctcagagactgatcacaaaatcctcaaggcaggagtgagccctttcatcaggacctcctgataaatctccaggagttagtgccctgtaatacaaagaggatgacctctggagtcagaaagacccaggttgcaagcccagtttcacctaccaactagtcgtttcacttgaggcaagctacttagcttgagcctcagtttcaatatctgtaggatggaagtaaggatacctttttcatgaggctgttgtgattatcaaaaggtataggcagtgcaaagctgaaagtggtcagctgtcagtgaattctattatctaagcaatgttatctgatggcaatgcatcttacaggaatgcattggaatgttccatagagaaaggaaggaaaaaaggcccatatgtccttgggatgagacactaaggtggccccgagcttcagaataaactatgggttcttttggagattgacataccttgttatattttgattgatttcaactagcacagttcttctcttttaaattattctttttccatttgtctttttttaaattttagttttaaaaaggttgtaacgggttgagttgcatcccccagaaagacatattcaagtcctaactcctgatacctgcgaatgtgacctcatttggaaatcatatctttatagatataattaagatgaggcaatactggtccagggaccagtcatctgaatacttagactaagtatttagatttagtctaaatttaattactactatctgtgtaagaggaaggagagggagatgtgcattcagggacacagacaacacatagagaaaaaggccacatgcagatggaggagggattggagtgacatagctataagctcaagaatgccaaggatttctagcaactaccagaagctaggagagaggcttcaggaacttcttccctaaagccttcagagggagcaaggctctgctgccaccttgattttgggacttctagcatccagaactgtgagagaacaccaccatcctttagctaccacacaggtgtttgcctgtgccaacgacaattggcgtaaaacaatttctgttgttttaagccacccagtttgtggcactttgttaccacagttccatgaaattactacaaaggtccaggaaatgttatgagtgtaaggtgtctggcaataatactctggggtcctccaaaaacagagtgcagttgttttcttgctgccccaccaaatccattctcccattcctccagggcagtcaagttttagatggacacatagccatccagttagaggctgtaattcccagagtcccttgcagctgggtatggccaaaagactagattcttaccaagacatgtgaccaggaggggtgtgtgtaacttccatgtcacttaaaaggaagctgttcactctggatatcctttctctctctcttcccatggactggaacttgcataaggccatgacccagctccagccatgtgggcaaggccacctttggagacaggagagagcacccagacaggacctgtgagcagagcttccttggcagcctccactggcttcaataccacaggagagagaagccagcttctacctcatataagtcactgtgttcttgagtctctttgctacaatagttttcaacctttaccctaacaaaaacacagggttaggaaataactagtttatagattaaaatccccaaatgttagatctggaatagactaaagaaattgtacctttccctgaaaaaggacagcaaactgggactcagagggattaggcaactgttttcaagtcagccagccaattaggagcagagcaaaaagtagcaccctacacaggagtggctctgtgggctctgaggcctggacgcgttgaagtcttcctgttaccatacaggacacctcaactggacccaggaacaatttcactagccttacttagaagctccatgtaagccagagtgactttttgaactataaatccgatcacatcagtcccctgctcaaactccttccacagttaagagggtcctacatgatccggcctgcctggttctccgacctagtgtctccctctctctctgtctcacccatctcattcttccacactagccatcttaaattttctctaaagctctaagcttgctccagactcacatcctttctgtttgtagttccctctgcctgtatcactttccctccacttctccgcaggtctccttcacatccattcagatctttgctcagctctcatctcctgctagaatgcttcccagccggcttatccacattcgctctccctgcccccctctccattttgctttactttgtatcttcacaatagttccctcctcctgacattctatgatacagttgtatgtcttcccaacaatttcaattcttgaagcagggacttcccatccttggtataccactgtatttgtgatgcctagaatggtgcctggcatatagatactcacaaaaaattgttaactgaggatcagaaaaacttgttaagtgaatgaagttgactccccaaagccacacatctagtttaccaatagtgactccaaagctcctggaagtgtgtagagaagacaagaggagcatagagggtgagacaagtgctaactgagaaggtcggggacatctaaagagaggtttgcacagctgaagagaaactggaaggctacatacaaagagtgagaggggagagaacacacgctaaccccaggacccaaagcaaaggtcaggcaatcaatagaaaagttaaaatggcactgttaaacacttgtgataaaattgatttggtcattaccagagctgaacacagggcatgcatgcctcatctgttagaaagatctttatgatcttgttagcagatccccaacccagaagctgtaaaggttataacccaacttgtaaaactaatctcatattggctctgggataataaagaatctgcagaaaactttttagttaaccatatgctacatacagcaagaagccaggcttgtgtggctggcttctcctacatggcaattcaggataactctctcatttctgagattgagaaaactattttggaaacagtgatttcaatatgcatagttcttagatacaacagcttagaggttaacttgagtttaacaatttctctcctattcaaagtgattttataataaaaagtcagcatgccattcccattgaattaagctgggatcagttggaatagtagtttggcaaaactgtttttgccagatttttaaaaaaatacactttatttttaaagatagctctgttttatatttgcataatcccaattgtaaatatttagtttattattattattacttaatctgtgaattttgggtcattcttcctaaataaaacaatgcagcatcatttcttgactaatactcttttggaccacatggcaggtctgtggggtagtacagaaaggaaaaatgagttcacgctacatagcaggtccagaaaacagaacacaatagcaatcacaaaacatttctaagcagccttgtaaaggaaacaagggagaatgtgagagcactgggcatttacttttgagcaggatgcatgctaaaatatgtaaagatgaaatgatatgatgtctgggatttgctttaaaatgctttagcaaagggaaacagggatagataaagcaagtgtgacaaaatgttggtaaggctgaatctgggtgttgggtatagggcagttcattccactgttgcccctctttgcattcatgtttgaaattttcataataaaaaattcaagccagtaagggctggctggaaaactttaaaaagaggttcaatctctctaaaactgtgtgactgatcccaaccaaaagaaagcccaggaccagatggatttacagctgaattctaccagagctacaaagaggagctggtactatttcttctgaaactattttaaacaattgaaaaagagggactcctccctaacacattctatgaggccagcatcatcctgataccgaaacctggcaaaaatacaacaaaaaaagaaaacttcaggccaatatccctgatgaacattgatgcaaaaatcctcaataaaataccagcaaactgaatccagcagcacatcaaaaaacaaatccaccatgatcaaattggcttcatccccgggatgcaaggctggttcaacatgtgcaaatcaataaatgtaattcatcacataaacagaactaaagacaaaaccacatgattatctcagcagatgcagaaaaggccttcaataaaagtcaacatcccttcaggttaaaaactctcaattaactaggtgttcatgggacatacctcaaaataataagagccatttatgacaaacccacagacaatatcatgctgaatgggcaaaagctggaagcattccccttgaaaactggcacaagacaaggatgccctctctcaccactcctattcaacatagtattggaaattctggccaaggcagtcaggcaagagaaagaaagaaatattctttcaaataggaagagaggaagtcaaactgtttgcagatgacatgatcctatatctagaaaaccccactgtgttagcccaaaagcttcttaagctgataagcaacctcagcagtctcaggatacaaaatcaatatgcaaaaatcacaaacattcctattcaccaacagtagacaagcagagagccaaatcatgaatgaactcccatgcagaagtgctacaaagagaataaaatacctaggaatacatctaagaaggggagtgaagggcctcttcaaggagaactacaaaccactgcccaaggaaataagagaggacacaaacaaatggagaaacattccatcctcatggataggaagaatcaatatcatgaaaatggccatactacccaaagtaatttatagattgaatgctattcccattaaactatcattgatttttttttcacagaattagaaaaaactactttaaaattcatatggaacctaataggagcccgtatagccaagaccatcctaagcaaaaaagaacaaagcaggaggcatcacgctgcttgacttcaaattatactacaaggctacagtaaccaaaacagttggcagcatgttttcaatctactttctgatttcctcatctccctctgtgaagtaagtagtgaagatactgttggatccattttgcagtgaggaaattgagtgtcagaaaggtggaggggcatgtttaaggtcaaatggtccctgtaaggcagagctgggccagagctcagtcaaaggtttttgtttcagtggccattaaacttatttcctcctcctcctgacactggcccagtgatttaaatgctcctcccatgcccacatcaaaagtcaaaggtacccggcaaaaagcacggaagatgagcatctgaattctggctcaagagctccctgtggtctccatgccttgcagcgttaactctttcaccaataggctctcctagctttacattctggttgtcccttctcatttcgtacagtttggatttgacaaatgagagtttcgatggtgtattgttgtgcacataactgcccctccgttctacccaccttgtatttgtgagcaagagatataaccaggactggaggggcctcgcccaaacctcgaggacactcctcactgccagggtgacagactggacccttatgttattgtattatccaaatgcatgtggatcaatcctgccacacacagccaagtgttcccttgtctttgcttttccccacataatgtaaaaccagcactctcaaggcctttacaaattggtaaatcaacccatatgcagcgaggtcactttagttacctctaatttcagagctgtcactaattggtcccagaatctctttaaattcaggtctacagggccagaaagaagcttgaaattatttgaatacctcattaatggacaacgtatgaacaatttgatctttcagcgcaaagtgggatttatttgtctatgaaatctcaggcttgccatctacccccggttgactgcataattgttcttgctctgccccacgttagtcaggcactatgttaggtgacagggaaacaacggcagacaagatagtaatgatccctgtgcccatggtgcttaggaggaaaggcctatgtatgtattctagtaccagccaaagcctctgcttagtgacccaaattccactctgcccatacatgttgcatcagccccacccacgttcctagaagccatctcttctcccaacactgctcttcatatccacaactttaaggagcaaaaagtattttagggacactgaaaaaattcaggctacactaacttagcccaacccttagcatgttctcttttcgtctttgtcacttgagaccctgttgacttttttttgagggtgccaatatccatccgagtatgtacatgccagggacctcttcttggcttatacatttccttctacaaacatcttgatttttttttttcacttgcatttcaccagatcctgttacaggatctaaatattccaaataattcttacaattgctatatgatgaagagaacggatcctgttactctttatttacgtacataaaacccgtgcctcagtttccaaggtaacagaacaaagaaaacaagtcatcaccctgatgccaatacggacgaaggtcagacagctttgatctcagacaccaggcacttttcagccagcgcaacattctcatttttcatgattcctgcctcgcgcccccacgtccccacagctatgcttcctgtggcttactgaagggtgctttaaatatggctcgagaaagtacacggaggaagcaagtaaactttcaggattttagttccagcaaatgaaggcaaaagtgactaatcagagtgaagaggactcagtcaggagcatcagtcgcagaatgaatcagcctcagccggcaagtaatggcacaaagcactgttcccgcgaccaccaagccacagataaaccaccggcgcttcaaagaactcctacatcacttataagctgacagaagtcttattattattatatattatgctgaaactctgagccttactgtaagtcatcattttatatagttttcacaatgacagtaaaatcctgccacaagtggcactgtcaacttttctatgagcactttcttttcctcacggtgacattcaaagttcagagtctccttcatctaaaggagctgtcctatcagctcgctaatgggaacaattcatttaacctgcactccaagtacagccacggagccgagtaaaatatgtataggatccagggggaatcggtcctcccagctggcccctcctgccatttgattcattgacgagagtcccactttctttccacttaggctgatttacagaaaaaaaaaagacattccagaaaaattaagttaactattagccaaatcccctctagctgctggcttggattatataacaactccctaattccagaagctaaggaacagaaggccagcattttctctgatttcctatagttttaaagcctttccactctaccctccttttctcccagcccaccgcaccaccacatcaccacatacgcctttgacagtctacatggctcatattcctcatttactttaattatattgggtgcttctgcttacacactgcaatgtatcctggcttcataaaatactcactttatatgacccttgcttgctgcctttgacccactcaccgtgaaacacttgcggagccaaaattctaggaaaagcacctgcagttattaatgcattaaaccagtgttctgaaatgactaaatgcattatttctgctgtagaagaaaacgctgaggtgaggccagagcaaaggtaaaagacctggttttcctaaaatggatatagccttagaggcatttatattctcggaggacacagtcctgattcttctgatcatttttcaaatcgacttaatgagtgtgagatggcctgctcattaaactgatataataggtaaatatcacctgcatttagggtgggcaacagaaagagggcaactgttttctgggattgtaaaggatttgcaaatggagcaaaaatgcgggcctggtttctgaacgaggtttatgttctgctctcacttttgactggctgccacaatacacagggcgagagatttttaagctttcatgaactaaaagcaacgccaattgctatggattgctttttatagaatttcaagtaatttcacattacaaatgttacctctgcttatgacttccttaaaagataaccaaatgccaagcccattggaataaacatctagagcaaagagctacatgtaccccaacaaactgttttttcaaaagccacaagcctaggttagatgctttgtctaccacactgccgctcaagtgaagcctcccttcttccatcttccaagtacagccaaaaccctaaacacaacctttttaaggatcctttacaaagtggatgttaaaagtgaacaaaacctcattgaaccatctattcttcttgctttaacctgcagagtcatctacatttgctatttccttcaagtctacttttttttttttttccaaacactggaaacttcagagccactcacacattgcagtaattctgcctgcttgctctacataaaataaggcctgctcttgggttcacacaatcaggccggttactcagtagaatccgtggtctagggtaactctgaagagacgtaaatttctaatttttatactttcctcaaatttcatatgttatttttgttatttcaaaatccagtgctttataataaatttatagggtgcctaagggggtctccattcatattacatggtatctcattcacggctcctctgggagagaaacacagagttatacctctcagtcagccaacaacacttccgcttgtgaagttcctatataataatgagaaacgaggctcctgtgggtatcccacacatgtgtgtaaaataaacgcctacaaagtgaaaatgatgccatgctacacttaaagcaggatcatgtgggtaagctggaaaaaacacttccgtgtctgtagtcgtgaagtgattctgtattttattgtagacattgtatcaagtctcagtttcaagtgatttttatatatactccatgcttcagctgagatgtcttctgttcctccttctttccaggagcgtcagtagctatagtcaagtttcaagaatggggaatgctgtgggagtgtgcaggcaatggcctaaaaacaataaaaaagccccactaaaagctggcttgcttttgattattactctgtcctgacaattcttagtaatgtcagtgataaaataaattactgggccgaccactccctagcctgcccctcgttgacatggcactgtgaaagcactccaatatctttcttaagaaggatacattatgatttaaatactgaaaatactatatattcactgtaggacatgtagaaaaaaattttaaatgttttaatggagaattaaaatttacattaactctaccacttattgataatcatagccctttatgtcataattacttttttggttattaaaagtaattctactataaatatccttgttacatagatttcttttggcatttgtgtttttttttttttttttggaagtacattcttgaaagtttaacttttaaaaagcattgaatagatatcatcgtgtcctgtaaaaagtgtttaccaatttataattcctagattagtgtacacctgtcccaatgcagaactttatcatgaaaaataaatcctgataatttaactggctaaaaaggtgtccctttaaaattgacatttctttgttcatttatgatgttgttttgtctgcatttttaaaaaattttgtttttgttgtctaagtttcttgacttttgtatttcctcttttgttaatcgcctgttcataatctttgctcacttttgtattgtggtattagtcctttactacttactaatttataagacttctgtatagttaatcatatgttgcttgtctccccagtttttcttttaaattttgtttagtttgtttcttgtatatgtaaactagctctaccacttattgataatcatagccctttatgtaatttctacctttttggttattaaaaataattctactataaatatcctctttaaaatatccaatctagtaatcttttatttatggtttctgcctttccttgcatgcctataaggactttatttattgcaaaaatatattcacctatacttaaaatatttttatgattttactttttatgtttaatttaaaaattcaaataaaattatctaaatatacttttttcttgctctagtttagcttgcacagaaattgtttcactccacttctcaagatttgaatctaaacaacacaccaactatcttatgtctttctttgttctcccgagaggtatgtcactgtgtctgttgtgtcagaaaaaaaatcaggatatcaaaaaggcttagagccaaattctagcccaaaacatttacatgtagaatctgagttagctcacctcttctttagaaaataaggccaaccattgagatttggggcatctacttcttaaatttgtttttactgagtaaacctgggcaagtttcctgacttctttgtaaaatggggattctaataagagaagcacagtactgtagcatctatatttaacactttctgtaacagattactggtataacaggaagtttcacttttatctttattgtatttagtttttgcctgccacaataactacttatgatattttaatatttaccaagagttttccaaatagggctgattctattaaaaaaaaaaagaccccttgtgctatttatacaagcttgtttagattaggattatattcctgaagctaagagggcttcatttgctgatttcagacaaagtacgcataaagaacatgaaatgacactgctgagactgttccactagttttctgttttttgtccggaaggaaagccagggaggtcagagagacagaaatttctttgcagagaagtccaccctgcccagatatgggaattgtgctcattaggagaagtagtgggggagaggacgcacatattttctgaaaaaactggagcatgggaagaataatgtgcacactggccatcaaatgagatttgaataacaatttaccactctattcaaaagtgtctaaaatataacaacccctctttattactcccttttgccaggacatttgccatcccagaggtactaagggacaaaattttcagcagcaatgcattccttaaagagaaggacagcagggtagttgaccttcgatcctgtctgaccataccccaaatccttgacatccttagctttgcagaaactggaggaagcagagccaatgtgatgatgcttaagggaaatctttcatgccactgataggaaacaggaatccaaaggacatttttaactcattcctcaaagatatggggatgagtataatttacattcatcctctacttcatgacggggaaagaacagcccagtagtcaaagcaagaaagaagtcaggaatcttttcactggtgtatttcatcagcaataaacgtttccccaacaaaatgctgtattcaaggcatcaaggaagttacttaatgaagaaaggcacctggcttctcagcctttatagctctccaaatgttccatgtttttaaagacctccaagcttttttctgttccttcttctagggatgctctttcctttttcttgactgagctaattcccatttatccttcaagatccaaagcagggcttcactttgccatcacacccagagtatattggttgtctctccctagcacatccttaatccagcctgctgtggtctgttgtgcaggttggtcacagtccaaggtcatgggtgaagggatgggtggggacatgtttcattcgccgactgccaagccatgtgccctggtttgggtttgcctccaccccgaggaaggaggcaccttttaaaaatcacccaaaggcggcctactcttctctgcacttaccattctcttgtttacttgtctgtctgttcactactcccaccacgtacattcatccctcactatcttccctctcaaagaatatagaacatcactccttccaattaagtacacggacaatatcttttatctcttgatcctaagcccctgccattgtgtctggcacataatagcttcttggaaaatatctcttgaatatttgctgaatgaatcaaatgtgccttcaggaaaggtacagctttatgcaaacaccttagcttcctagaagtagtgtaaaaaaagcttcacatgggcaagaaccaccatggatcaaaggggactgaagaagttaggagaagtttatggaggaagtgagtcagtatctcacaggatctcacagagaaacttctaactggggattcagtttctctcaatttagtgtccggtgaacaaaggatttggaactcaccgacgtactgcctctgctctcccctgtaactgtgagaatgcattcactagctcaatcactcaccgcaatatttatccatcacctaccacatgcagaactctgacaatgcccaggccctccacccgcagcacaggctccggggagtgccctgtccccgactcggtctgctgtgatttttcctgcccttgtccttgcgggcccatgctgtttctataggagagagaggaacggtgctcctctccttccgtattgcaaacatgctcaccagtgacctcagaagtctggagggaagagtgatgaggcagtgttttaaaagggctgtgaggttatcagagcctgttacatcagtctttgactcttcaaaggcctggaatactgtaagacaacagcaacttctcataaaggtcacatttctgtaattccctcttagaccctcccgaggaacgcttaattgatcaactaacatgcaggaaatgctctaaaaggcagttttcacaaactggtggaggataaagacaagatctttctgagagaggtagtttaggattatagctgagagcacaggcagatgatggagtttgaggctgggatcagtgcttaccagcggtggaacattgggcaagtcacttaccctctcaaagcctcggctttctcttctgtgaaactgaaataatgatggtactcttctcatagggttgtaattcggcttcaatgatcttttctttttttgagacagagtctcgctctgtcacccaggctggagtgcagtggtgcgatctaggctctctgcaacctcaacctctgcctcctgggttgatgcgattctcctgcctcagcctcccgagtagctgggattacaggcacgagccaccatgcctggctaatttttgtattttcagtagagatggggttttgccgtgttggccaggctggactggaactcctgacctcaagtgatccgcccgcctcggcctcccaaagtgctgggattacaggcgtgagccaccgcgcctggccagtttcaaggatcttatgtctgcaaaccatcaagcaatgaccagtgtggaatgaactccttcaagggtatgtgaataaccttaggaagtcacatcacttataagccagtattaatattaatgttacctagcttggaaaattttacaaggattaactgaaacaatgcatgtgcaagtggttgtcacatggtaggtcctaaaaacggtagttccttaagattactggcatgagatttttctatgatgctatgtttaaaacttcattcttgaaggctgactttaactcggtttgtttgggaggaagccctctccttccatggtcaccttgtgtggaatgggccttttccctcttgccattttcattcaaaatatctgtggcagtgctgcggaatattccaatacgtccccttgacctctatccataaacagcctttctcacaatgagatgttccgagtttaggagccttgctattttcaacaaagaattaattgcaaagtaattaagtttagagcaagggaatagatgaaccctgtctatcataaaggaacagtgtggatggtgacataatggagcaaggagacgatgcttcagattaacacacacacacacacacacacacacacacacacacaatctcttttctaaagcacacaaagaaacctcccatcacatatattgacaagataaatctaagctgcttaaagaagcacttaattttgttctcattaagtcgcagggttaagggctttaccctcaacgcccatggaagcaatgttaggttttcaccttggaaagttctctgaggccctaagtccattgacaaatatagcactaagatgtgttacagaaaattgcatctgaaagccagttgctttgctggcctcattcccacttggctctgtgttcttcaatgaacatagaacgcacagagaacaccagaggggcacacgtgttcatccctctgccttaatgcacacaaattatgatcatcccactgtctgatcagcagtggatctaaggtgggagggtgtgcagcttagatggggacagtcacaagccggttttactactagagctaggaggcttaatcttcttaatagcgattaagttgatgccaccctaacattttctctggttatttcagggactgagaaggtgccagctcacatcacacatcctttctgatgatatgaatggagaagtctatgtcataatttaaggtgcattcttacacatcctgtgttctgattagagcaatatattgccagatacctcatctttgcacctgaaaacacagtacctgggatttaagaaatatttgagcacttgaaaggaagaaagaaaaaaaaaaaggaaagaagggaaggaagaaggtctagaaggacacataccaaaaatttaactgtgattgtatctagtaattttcttcctttctacttttatgtcttttccataattgttatagtgagtattgttttacttttatgacgggtacaataaaatgaacttgattttgatcatttactaaaactgctttcaaaaaacatcaattctaatacaacgtgctttaaaagtcttcattaccctcaaggaattttacctctgactctaggcaacacagccgtgacaaaaatgcgccactccaagcttcaatagacgaagtctaaagttaaggtttctcccgaggtgtttacatctcggctcttctctggtgctttttcatggtttggtttggaggtgagttgtaggaggggccacaccggcatgcggttgcaaggagagaagggtgttgctgccctcccggcatcacacccatcctaagagcaaacacaacccacaaacttgggtgtcatactgcctgggtggctccccaaaggtgctggaggcacactcctagagggtggggccgaggaagctgagatgcaaaaaaaataaaaacaatggccagggctctgttgggcaaggttttctgttgtcttctttcttcttgcccctactgttcacagtatttggctaggttttgcttaaatctttcagagaggagtgttaacctcccaaaatgaaataaaatataaaaggaaataaaataaaagcttgaaaaagatgaccaggaatgccatagaaagaacgtagagatagaactaaagtttagggtacttcaaatgcgtaatctaggtcggacgggcactgattcacagaatactatattagagaccctcacagcaagccttgttggttattgattcagttccagaccatggttacctttcggtattgtacaatattggcttgaagtgctccacgtttgcacccctgactcatattgctctggatggtaaatgagcttgcacacgacatcacattgctccccactctgacctacattatgttttgctgtgaatgagtttaatggattaacatctgattggcatgagcttccacgtgtgactgccgagggttggcaatgcttttcgtgagcccacagaggcattgcagacgtttgctctgagttttcgtctcgaaaattttgctttgtgttttgttttgctttcctcctagtaagagtatcgttctcattatgacatttttgtgccagaaaaaaaaaaagaaagaaaaagtgagcagttccctacctacacaatgaaaaacctaggtggtttttattgttatccaaaacacagggcatgctgaactggtttcatttgaaggcagggcttgtattaaatgccaaataaggaatttttacacaatgtggaaaatgaggcaaatacaaaatgaatattgggttgagttttccctgaaatttctgtggactggagtttggatttaaaattttccactcataacttacattatcaatttgtagactatcaccacaagtatgtgcataatgatgaccctgtgatttctgaacagttacttaactacaatgggatttaatcaaaggattcaacaattgtaggggcaaaaggccgtaaaatgaacaaacttagaactgtagagctgtctttactatgcaattatgataaaggtcgagacaaggccattttctaaaagcagagaggtgattgtagtgtctattttctttggtaactaagaccttaaaaacaagcttctgaagttatggttagaattagaaatccatcccattcccttcaccaaccaaccaactgacatttttttattattaaaattttttaaaatatatattctgttctatagactgtaagaattaggaaaactgggagataatttctctaaagggaagtataatctatttgcttaatgatcctacaaggagctaataagtatcatctctcttagaaataataatactttgcttttatatagaatctttctccaaggagtgcaaagtatattacagataatatctaattaatcctcttagggtccccaggtgaaagggaagtggcaggtattatgaaggttcattggcaccatcagcatgtctcaggtgaggaaatggagctatagaaagcacggtaaaaagggcacacgcatagttatttaggctagatctgcgtgacctcaaagcaccgaatccacccattgacaagaagaatcaattgagtttgagcaaaaaaacaggatcgtttgactgaatgctttgccttttccaccagctgggctcatgtagcatgagttttagtaggtttgccagtgaaagaacccacattacctgacttccagcctggtggcttcttcagaaggacagcatgggtagtacggattgcttcagtttcccatttgctgcttgacacagcaccctcaagcagcacatcagccatgtggctgtggtttggtttctcattgtccttttacgtttggttgcctggagtctgtccattgttctctgcaaagtgggtctgtatggggtattttgggggtggggcatgaaggaaggtagtatggtaagaaaggggcaggggattgaataatctgttttggtagcttctatctgttgaagcaataggagatacactacaagtctacatcttttgtatcaagataaatcacaacctgagtcttgagagagggaagtatttgtcctgctgcaagtgctgctccatttcacttttaaacattccatgggccaaattcagcttcccattgtcacaaatcctctctggagacagaagcccataccactgtcttgatcaatacctgatgaacaggaagagagtgcttctgcaaagagggagcaaaccttaaaataaaagccgaagtagcacttcctaagcttgaaactcttccactgacaagctctctgcagagttggggctcagctaaaattacctcccaaaaaggaaaaagcctccaagagaaaattcagtcaaattaacaaactagttgcctctgatgtgaactacatttttgacaggttgagataataaatagtttctgattcttacttacctagctcaggagaagttgatagtggttttacaagagaaagacactaataatgtcacttgttgtgcaaatggaggcatacaacatgctctgagggaagataccactttttccaatgttggaactcaacaagtccatccgatggccctcaattggccactggaatctgtaaccgttggtttgccactagacaggtgagcatctactgaagcttctcagaatggaaaagcttccattctggctgttgcgaagagaagaaatctcacccagtcccctgaattcactctagcctgctctctgactctagcttgcccctcatacaagtacgaatatttccctttaagcatccatggtcatctatttctttattttatttatttatttatttatttatttatttatttatttatttatttgagatggagtcttgctctgtcacccaggctggagtgcaatggcgtgatctcggctcactgcaagctccgcctcccgggttcacgccattctcctgcctcagcctcccgagtagctgggtctacaggtgcccgccaccacgcctggctaattttttgtatttttagtagagatggggtttcaccgtgttagccaggatggtctcgatctcctgacctcgtgatctgtccgcctcggcctcccaaagtgctgggattacaggcgtgagccaccgcacctggcccacggtcatctatttcttgaagccactcaactggtccttaagtccacccactgacataaatcctcttttaataacctcgttgacctcttcctctcccacagctcttctctgtttccatgaagttcccatttgtgtccagttcttggctggtacactggccatcctccagcctggaatatcaccctactctctaagtttagcctctccccttatttaatactggggcacatactaagttcttccagatctgcttctcatcctgttcctctcagccaccctgtaggatttgtatagaacacattgtatacatacttgagttcatgtttaccacccatttgcaggccttttttgtggatgtatgctcagcctctccttccaaactaactgtcacctccttggactgaggcttagagtttagggttttcaggatagagagcttatctgttaggtcctttgaaccgctccctagcattctggcaatagaggagccctctgtattattcgtgttgatagcccaactaggactctcctaggtacctatcttcttttttaaaacaaaatgtagcctgaccaacatggtgaaaccctgtctctactaaaaatacaaaaattagctgggcttggtggtgtgtgcctgtagtcccacctacttgggaggctgagacaggagaatcgcttgaatccaggaggcggaggttgcaatgagccgagatggcaccaccgcactccagcctgggcaacagagactccgtctcaaaaaaaaaaaaaaaggaaaaaaaaatgttaccaacatcacatccaagtggcattcaactctggcttgcattagaagttgagttctttgtcattttatgcctgtatgtgtgtcccagggtgggtgggagaaacacttacaaatagcttctattgaataaagggctatgaaggaattttccataacacttgcacaaaaattattgcatttaactccccaggctcttcatagaaatcctaacatcttcccctccctcccaagccttttcagttccctacactttccccccaaccctgttcccagggtatagcggcaatagagcagctaagtctgtttggtattcagttagaattatttatatatcagagctcaggcttgtttatgcagtagaatgctgaaaaggaagtgaatcagatctattccctaacagagcatccaggggtcagggtgaaaacaaatactgatgataaggtaaaatccatgttctacagtcagctttattatgaacctcaaataccacagccacgcaggaccaaggccttgatgtagtgcctgcatagctagcaaagaatacgtgagcagctagtcattcctatcctagggaagctcctgagcccatgagcatggggaaaatcccagaggccttcaggaaaccattgattttccatcccttcctccaggcctacacatcccaaaacttatatcagaaagatccgtggtgggattctacaatataacacaccctagcttgattaactttatgtaaacatatctttgaagtgactacatttaagtttttcagcagcagtaattaacagctactaccattcactgagtttctactatgtgcctggtattattatacagctctcatttaattctacaacaactctgagaaaccattagcattactctcattttattgattaagaaactcaaagatgcaaaatctgatatctatgaagtaacagactgaggattaacactcgagctcctttgattctaaagcccattgttttcctttagatcaggggtccttaacccctggtactggtcctgttaggaactggaccgcacagcaggaggtgagccgagggtgaaccagcatttccacctgagctccagattctgtcagatgagcagcagcatgagattctcaaagaagcatgaaccctgttgtgaagtgcacacgtgagggatctaggttgtgcgctcgtcatgacaatctaatgcttgatgatctgtcactgtctcccatcacccccatatgggaccatctagttgcaggaaaacaagcttagggctcccactgagtctacaatgtggtgaattgtataattatttcattatatattacaatgtaataataatagcaataaagtacacaataaatataatgtgcttgaattgtcctgaaaccatcccccaacactcctgccccactctgtggaaaaattgtcttccatgaaactggtctctggtgccaaaaaggttggggactgttgctttagaccaccctgcctctgtatgccacatgtgaggcagtggctgcatttagaaggtgggggctgaaagttctgctgaggagggaagtagtaacttgaatatcatgtgtctggtctgtcaggagtttttaccttggtttcactgcctcagaaacactcagggctggaggcccgataggagagagactggattcttatccagtttatgccactctggacaaagccctatcttgccttgcacttagacttgggaagacaggtttctccttatgttaaaaattagttggccaggtgcagtggctcacgcttgtaattccagcactttgggaggccgaggtgggtggatcacctgaggtcaggagttcgagaccagcctgaccaacatggagaaaccccatctctactaaaaatacaaaatcagttgggcctggtggtgcatgactgtaatctcagctacttgggcagctgaggcaggagaatcgcttgaacccgagaggcggaggttgcagtgagccgagatggcgccattgcactccagcctgggcaacaagagcgaaactccatctcaaaaaaataaaaaacagaattagttatattaaaaaatagaacagacaatgctgccactgtaagtcttcaatcagagtgcagataagtaacccgtctaagatgtggtgcaggatatgttcaagtctcaacccaggcaagagctctgtgatgagaagttgactattaatggctgggtggccttcacctggcatgcatttactcacattctcatggctgcaacccaatttccttcctgagcagtgggatgatgttggtgggctttctggacagctcctgtggtgcctctgaaaagcagggctctgcttactacactggtcccagggcacagaagagggagggagggccccgcatgaagaatcccaggcaaacctccaatcctctatgctccagagcacacaaacaatcaggacctgtaggtctttcagcagaaggggcctcagagatgatccctccaactccagcacttagaggtgggcagacaaggcaatgagaaaggaagctccatgcttaacactgctgggaagtggtgtgctgagactagaattctgggctttttaaactccacatcatcagagcttctccagccttgctctgcccctgcagcccaatttgggcacatttatcccaaaagaggttttgcctctgtacggcctcataaggacgggtcactcctgtccctgctttgagtaactcccaacacagtctccgtgccctcaaggctatgtgtatttctcactttccctggaactagtcactcatggacactctgcactcctacttctaaactgcatacttctgcaggcccaggcctacatatctttctttcttagctgccaacttctttttgtccaagtagctgccagcatagaacaggtaatcaatacatatttattaaataaatgaatgtataatgaataaatatcaaaaagttgcctacagtactcaagaagatggacagtttcaggcagcagttgattagaagacaacttcagtaaggggtaataaaaggtggctcttcttccccatttttgcatccttccttcctcgcactcacactgtgaaccagaagggtttacctttagagtgctattctatggttgaagaggaggctaggctgagggtctccttcctctgtcttgtcagaagcacccctaatggtggctaataaattcgattgcatctatccttcagttttctaaccttctgtctcttttggtcctaccttcagctcaagggcttaagaaagaagatatttcttttggggaagatgatttaacctttgattggacctccaggtttctcaaaccctgtcagcaacccacctttgcatccaagacttactaggaaaatccaacatttaaaataccgctactgaaacaaattatatgataataaaacagcaaattccttagccttcccacagtcaccctcaagatgttataaattataatagaagtggtttcaattctttttttctgcaacagtataataaaactattttgtgatacgtagtctaataatacacagatttttttaaacaaatgaaatctgaattgtcagtgacagtgtatttttcttctatgaatattagaaatcttagcaagtgtggctgatactttcaaatgggactcatatcctacataggacatgttgataatatcattgcattaatttggggatgatgaagacttattccagaggtggtataccagttgttccctacatattctatttggattacaagtgattgtctaacatttttaaaaaagttgaagtatattccaacatttaaacatctagatgttttctttaaaaaggtgtgttttgttgaatatagaaaataggcaatacaaggtctttgttcctgcattatacaactaaatttggtctaaatgagtgactgccatctttagccaggacacaaactctctggtcaacataacccacagcactctctattgtctagtggaactaaggtcatgtgtcagttgccatttatcactgggtttgcatgatggtttggatttattttggcttatccttttgatatgtacccagacagcttaaggtatccacctaacttctgcagtcatctgcgataggacccagtgtattgcaaggcattacatgacggactggacccaattcaagctctggtacttgttcccgaggccagaagacaagcctttcttgcaaactgcacaagactcaacacagtcctactgcttccaggaaggcttttgtgactgctggtgctcagcttttctttatttccctgacgcggggttccccagcagccagaaccaatgacaccacttggtgagaattcacattgttgttcagttgcttgacttagaacagatttgtctttctatgggagaaaaaccctgaagatgaaaatactatctcttggacaagagagcctgacctctctctgctcacagctattggacacatatcctattcaacagagcgaatactttgaacctgggttaagcagggaaaaaaaaacaacaatttaggttaccttaatcagcaaggcaaacagacttttcatttcctttactttttttcagactgtggccagggcttccctggcaataaaagatcataccaaattgttctaaattatgtagatgatagttattaatataatcttcttccaaaagaaaacaaatgtcataaagccagcaatccatgccagagaagcccaggaatgttcccccttagtagggtgtccggctaacctgggcgctggcaagtcattcctcccttcacagtctgaggctgaagaggtcacttggtttgaggaaatggctcctcagctcctcctacccccactttacccactaagaaaaccaatggcgccttttatcagtttggcaaaaagacaaagggaatgtttaattctgtacttaaaattcttggttcctactgtcagcattcccagttctcagagaacactgaatggatatttgaagagttttgtgaaactgagactgaacagtggcaacgaggaggaaaagatccaaaattaaaagaacatttaaaaatacacgcccccgtacattccactctcctcacttttctctcctcctcaaccaagtcatattcagcccttaggaatattcccacaggagggaggtgatgtaatatcctcagactgtctgtgttccagtcccaattcaccctacctagccatgaggacttgggtaaggaagtgaacgtctccatgccacagtccccatgacagtaaagtgaagttaacaacagtgccaagttctggaacctgtcatctatgaagggctcaatacatataaactactatcatcattttaattttctaaggaaagcacctgattacaacaggatctgcaacgcagagtaacagctgccaactggcagactgctgaccctagcctttcaagctaagactttgcagggtaataaagtgaagctctctagtcatttcaaatgagtgaactgttctcacttggcaaaaccggggcctctagaaatccagaagaaattgaattagcaccttcttcattatctctctctctctctctcttttttttttttcgagacagagtctcactccgtcgcccaggatggagtgcaatggcgtggtctcagctcactgcaacctccgcctcccggattcaagcaattctcctgcctcagcctcccaagtagctgagattacaggtgcatgccaccatgcccagcaaatttcttttttgtatttttagtagagatggggtttcgccacattgaccagcctggtctccaactcctgaccccaggtgatccactggtctcggcctcccaaagtgctgggattacaggcgtgagccaccgcatctggccaattctttttatttatttattttttgagatggagtcttgctctgtcccccaggctagagtcaatggtgcaatcttggctcactgcaacctcaacctcctgggctcaagcgattctcctgcctcagcctccctagtagctgggattacaggcacctgccaacacacgtagctaatttttgtatttttagtagagatggggtttcaccatattggccaggctggtctcgaactcctgacctcaggtgatccacccgcctcagcctcccaaagtgctgggattacagttgtgagccaccgtgcctggtcaattatctcttttaaagaaggatttttcttcttacatagaaaatttgtgtttaagggggatcttgggatgtcaaaatgggctctgccttttcaatctgaaaatatactgatgtgatgtgtgaccatctaagaacattgctgcacttgaaatgtggtctataaattattttatagactgaataatgtaatcatcctcagattagaaggccagaagaggctgtatgaggccctcttttcacagaagagccatccaatccctgagagttgagagactatgaccaaaatcaagtgaggggtaaagatggggctggaattcaagtcttttggcttcccatcaaatgaatttttcatctcaccaagctaactctgatagctaggttggatgactatgctgttggaaagtgctgggccttgtaagactttctgattctagctctttttgtgagagaggatgagttttaataactacacaaacacccgatttattctcaagcagcctgtgatgcagggccttggccatacctcccaatgtgtcatcatttccatgggaagacctacaaggagcaggaatccaacatacaaggacatagtgagaagcaaagaggcatgaaagtggataagaatcttagtggtggaagttcgaaaccactgaataatgagaaacttttttgaacacaatgatgtggcacagtcagctgtaaaacatcttcttcctttgttagctttcttccaaagtgtcccagcgacaggctggtggtcaactttcatggtgtttctccaaagaccttcacgtggtgcctcatgacagacgttccttggagattgtctaaggagaatagaagaagcctggacaaacaaagctatgaaaaccacaacttcattcattcctgaaggtttgcattcacaaaaattgcacaaattgttctgcacattgaaaaataacaccaaaatcttatttttagaaagggaatataatgacacaattggggttcctttagctttccaaacagtgcccaacagtagtttccaagaaagtcatgagctagcttttttctaattgtgtacacagttgtgtttgtgtaaatgtacacaactgtatgcatgtacacaaacacactcaccatttaatagccaaaaatccctctaaaatgttaggggaaggaaagatccattttctagttcaagtcatcagtcttaaaattcacagttgggagaaattctgctacaatgaattatgtaaaaaaattatgattcttcctctcaacctaatgtaggagaattgccttcacccacaaatgatcttacgctacactagaactactcagtcagcatctttaattatcatttcccaccagcctctaggccagtgcttttcaaagtttaatgtgcatacgaattgcctggagatcttattaaatatgctaattctgattcagtaggtctggggtgggccctgagattctacacttcttatagttgccgagtgatgccacaacttccagcccatggactaaactttgagtagcaagattctagaccaagcccacttaacactgttctctcactagggcaagaagtgggctacagccaattttatggctaggatggtagacttctgtgaggtgccatattccctgtgaatcttcccctccttcagagataccgccttttgtatcatctttcttccttctcttctgaatgcacttgcagttgcaaacctaaaggagacagcctgttgcactggtccagggagaaaagcatgcaaacttgggtttgaatttcatcaataccacttacaggccaggtaattctctctgagccacatctgtaatatggagctaagatactgtggtgtgatcatatatattggttttcatccacagtccctggctcataactcccatatcctttgttacagtcttgttataatgttgattgtgtgaggcctcagggacaggtctctgatcttctcctgccctacagtcacctgccccaaagcaggactctactctttccccacctttctgattgtaggttttaagaccctcctcagagagagtcccaccctatactctgaagagagataatgctgatatcatgacgcttccataaaaacccaggagggctgggttcagagctgaatatgtggaggttcctggagaatggtgccccagggagggcatggaagctccgttccccttcccccatacttaaccctaaacatctcctcatctgtatcctttgcaatatcctctataataaactggtaaacatgttttcctgagttctttagactacttcagcaaattaattgaacccaaagagagggtggtgggaccctcaacttaaagctggttggccagacgttctggaggcctggacttgcaactcgtgtctgaaagcatggggggcagttgtgggaactgagccttcaacctgtgggatctgacaatatctccaggtaaacagtgttagaattgaatggaagggtacccagatggtgtctgttacttggtgtgtgggaaaaactcccacgcatgtggtcacagaagtcttctgtgttgattattgttgtggtggtatgtatgcagagggaaaactcagtttctgagaatttttcccaaagtggaaatccacccctgagcttgttatggtagataaatgagagaatgtacagcacccagaacagtgccttgtacgcaaccattcaacaaacagcagcaccctcttctctttcttttcaagtatcatgccccaagtcagttcttcatccatggtcccagcaggaaagacttgagggcatagcttgtaatacctatagcatgtaataaaagtcctatggcactggcagttagaaggcaaggtacaatcttcctttcttggcagtaagttataaaacctttatcatgtttttttgtcttctgtcatcactcctaaattggtatatttggcattgtcattaattaactaacacattttactgagcccctattatgtgccagacaataaataaaaaatacagatgaaatctccaaatgcaaccagctcccagattagctagagtttaggtagaaaaactctggataattgattaataaggtcacatcttcttctttcttttttctttttctctttttttttttttttttttttgagacattgtcttgttctgtcacccaggctggaatgcaaagatgtgaactctgctcactgcaacctccaccctcagggttcaagcgattgtcctgcctcagcctcctgagtagctggaattacaggcatgcagcaccatgccagctaatttttgtatttttagtagagacagggtttcaccatgttggccaggctagtctcgaactcccgacctcaagtgatccacccaccttggcctcgcactgggattacaggcacattgcattttcattctaagatttggtgttctacggataggaccttcgtaacagcaaagttatgtcactatggtacagttggcataataaaattagttcaacatataggcaaaagaaatgatggtctggacatcactgggcagagtttttattcttctaagttcatcagttactggtagaaggatcgtgctagaatgctcaagtttcccatctcatccctgatgctgcattcagaagcaaacaccacacctgccaacattctaaaggtggttttcttgttggggaattcaaagtgaaggtgacagcagagagttaaagacattcacttagaaaatggtcactcctcacttttaaaaatgagtccggtaaatgaaaaaacgttagatttacaaattgaatagaaaaaacactctataagaaggttttctggctaaatgaatgaaaggtatccgtctgtggtttaatcacattcgattgaataacggttgttagctaaatttgactttcctgtcaaaattgtcaccatgttgcaaactgactttaaaagactaactagagccagagtggagtagtgagaaattaatacacaaagctcgggtaacaaggaattcatctaaccatccatgtcttgacctctttctaacccaaagtacaaaacttggcaggaagcagatgaggaagtcattaatatgtggaaaaggatctctcaaaggcacatcaagaccctgtgcctttcactgatgaaaatcaaaaggaattgtacaaatatttaccacaagaaaataattctaaaaggtgaaggatttccacaattgacacagagctctgtattactacctaggcaaagtttctggttagtacaggctcccgtgccgttctgaaagtgaggtgtagaggtcagagttcaaggactggccttgagctctttaaaaagataatcaatcagctttgtgtgtgtgtgtggggggggtgtgtgtgtgtgtggcatttctagttaaagatgcaaaaggcctgatgaaaactgtttgggtctttacttgatcaaatcaactgtaaatttgaatatggactcaatattatataacattaaagaattattaattttcttttggtttgatcatggcattatagttatataaacatatttaaaaatatatacagtgaagtatttagtgttgagatgacatgatgtctgagattttcattaaaatacttcggcaaaataaaaaaatgtgtgtgtgtgtgttagcaggaggggtaagtgaaacaacgatggtaaaatgttgatggtcattgaagctgaatgatgggttcactggagcactgcactttctctcaacttgagtatttttggaaattttcacaataaaagattaaaaatccaaaaccacaaaatatagggtttcttaaaaagcactaaaaatagtttacacaacaatactgactcttgccgtgaaatgcagagaataggtgcaaaaacccgagagcagtaattaatggccaatcttatgtgcattcctttaagcacaagcagctgtcataaacatcttaatttaaagagttggggtttggggaatcatggcactgcaaaaagctacgtcctgctgctgctccacagaactggtacatatcagacccttaaatttttaaacacagctttcatgtttttgagagctgaaaaacctttgaaaagtcagcttgttaggaaattcaccttgcagactcctacttcaagggttggtggaggtgcttgggtaccggaaaaattgattttgggatgggggtggaggttcacaggtaaacatgttgtgtgcttcagaagaagctagcttgctctaaatatacggggcgtagctacattgcagtgttgcctttcagcaatgcaaaatataccacctggctagagaggtatttcaagtctacaaagccccacctcccagcctttattgttccttttccagtctttgtcataaaatagaaagaggcggcattttgaagacggaagaagcactaaacaggaagcaggagcctaaaatcgagtttctcatactgctgtgtgttactgtaaacactaggccatgacctgccctaggtgcttcttctgtgacataggatcagcatctcacacccatgaaggtctcttgagtcccttaaggcctaacacacctgaatacatgggctgtgatacgggagctagcctgatgcctccattcaccccacaagatgtagtcctcgccctgacggcaagacggcatgcgagagtcctatttgggttgtaaagtttaatgcgagcagaaagaggcagacgatagctaacataatctaagttaaccattgaaaaacccagactgtccaataaaaatactggaacgaacccagtcaccttttatcaagggtacatttaaccatcctcattggtggctacttccattcatggtcacgcccttccctcttgcctcaggaactcagtatttgtgtgtaaataaggacgtgttgtggtattctgggtgctgatggttccccaggaacttagggacacctgtgtgcagggctgcacttgacaagaaacaaagttgccggcagcacaggacaaggcctcctattaatttctcgaatcgatcctggcagtgattatctggtccaggaaagaacaggtctttgttcatagcaccagatttgaattttttaaaacaacactctctattgcccgtaagaatgactaataacgggcggctgtaatttcccagagtttgtgggtatgacttcttcagctttccttgcatttgaatttgccatatttcgactgggggcttcctagggctttcaagcacaatgtaaccaaaacccccagccagctctcggttcagcctggagaactttgtggtactctcgaacttactacttcctgcccccacacctgagagtctccccgcacactgttttccctgcatcatccaccatcaatcaaacaaacagagaaacacagaaacctcagttctcaagtgcaatcaatacaacctcctttcctggggtaacgatgccttcgttttaaaggtcatggaatgagtcaggggcagaagagagaaacagaggccgtgggttctttgactaaacatctcgcagagagatcggtggatccacaaaaatgacctcattaagctgcaccaattgccgggcggggagagcagtccaaattaacaaaaaatcagagtgatcagaaaacagttttgttattttacacatggtctcaagagctagacaaataaatttgcctagtgtatgttctaagtcacaaatagataagaggaaattgaaaccacaatagccaagcacctccctgaggagaccaaggctgggcttccattacaataatattcttatttatgttttctcatgcacattatttaagtatatatttatttactcatacagaccagatttgttgagtactgctatgtggaattcacagtatgaagtgccgtggggcaggcagacctgggtaccctcaaagaacttggtaaatagctatttcttaactgctagtaaacaagtttctcttctagtaagaaaaaataatggctggaaaacttatttacaccttcaatacacaaggctattttgcacaaaccagatataggaaacatttatatatggagcttttctaaaacagataaaatcagggctcagtcttctttatgaaaacaaaaagtaaaacactttgcaatttgagcaaagattatttctgcagagggtcatctctagtaagaggtgcctgctcctcagaccaagtctgtctctttcagggccattccttactggatggtgactcattttactcaaggactcgccctagacggcgtgcaaccaaccctttagaaacacatcaattgtttaaacaaactatgcctgtattcatttgcttagcaaatcattttgtcacagatttagcccagccagagtctaaatgatcacaattactgaaactataccaataccttttctactgaaaacctatcaaagaaataacatcagttcacattatcattattgattcctgcccttttctcccttaactccattctcttccctttcagtttgttatttattttcttatgttctgaatttcaagaagacttccatgtgttgtcaacatatggtacatcattcacataagtacataaaattctctatatgtcattaaagaactgagcttgtgttccagtgagtgaaactgaagaggaaataaaatcacaaagataaccccacaaattaaggtgcagctaaaatagcagcacccttcccccatcactcactgcactatttcttagaacttttatctttacatatgtacaaataaacagagtgtttctgttctgccttatttgtgtagaggacttacgtgcagctctctgaccttcctctggctctgattagcccctgagggacgtggatcacccacatgcaacaggctgctgacaccagcagaaagctgtctttcagaacaatcaagagtcccacctaaggacatcatgtccacctgctcttctctggttcagctgacttccctggacttgctttcttgttgccctgatctgtgctccgtgccagatctcacaaacaaggctggactctgcttattcctggccagtcttgtcctgtagtcatccaagaaaaatactggaaaggaggaccacaaccttggccagtggagaccctgtcattctgatgaacatttctaacacaagatgtgaagaccctccttcccatttctcatccttccctctccacgtctcacaaacaccaagtctatttcccagagaagtggtcagggtgcagtgagtcaggcagccaaagtaatcctgcaggtgagcatgttgccactgacccttgagtttaacttcttaccagatctctgcaaagatagaaaaaaactagcttgcaagaaaccccagctctctggatgatctgtccttaggctgctgagattttcaagggtgtgcagacagttgaacttcacttattttcaataattataaaaatacataagaattttatgtattatttaaatgatacatagggactccttatccaagaaagatattgtcaaaactagattttataaaaaggctaaccattatacataaataaatggcttaacatataaagttttattttagcaatagcagctacccttagtttcgatgcgcatataggttgaaaaaggtttgctgaaagagaaaaatagactgtttatcatctcaaaactggttgagattgacaaatgtgatcctatcaaaaccattcccccccccactcacataaaatggccatgttctttgaaaatttgtggaaaattacttttttttttgaaaattattcccctcagggcacataaggcgcagggaaaaagcaaaggagaaactaagttaaactagttgagtactttctcagtgtaatgatttgaaacatcaaatccccctaaataaaataaacaatagattatctgcaaataatcctccctggaggttttcacactaaaacaaatatggaataaactcatgagactttatcagagtcacagttaggactctagccaggagtacacacaactccatccatccatcctgccatccacacatccatttattcatctattcaaataacaaatcaagaagtatttattgagtgcttactacatgcaagatcttgctcttggggcttggaggctacaagaaggaccaaggcaagctctcaatccacaaggagggtgagagaaaggaaaaagtttggagtatgtgcagttgtgtagaggtttcttcagtgcaccagagacaagatggatctgtgtggcacggtcaacactgtagcccttgaccttatcttagagaaactaagtgcttgaggtaaagatgttaattcccttaaggcttagcaaatgtaccaaatctgatagtgtgcaatctgtatactgactttacctctggcttcatgttatgattcctacctttgttttctttccacccggatttattcatgaatttttatcttggatactctatgtggtattataagccacctcaaatcctcttgggaaataaaggggtctaaattcttaaaggataaatacaattaccctgctagatcactaacaatgataacaaggatggtaattcttattatcacaggtaactttcattgagggctcctatgtgttgagtactgttccaagcactttacatgtattttcttgtttattctttataataatcttttgagattgttacaattattatccctatcatagtaaaggaaaacgaagcacagagagcttatgtaatatgctagtatgtggtagaaccaagatttgaacccatacactttgaatgtggagcggctccttgtgttttatccaggtgttcgggctctccaggtctcctgatgggacagaagcccattgcttcctgctcggactcagtagctttccctattgtttgactttaggactccgatgctgtgtcctacctagtcttagggaacttcttgaatattggccccatcttctctgatgctgtggccggtttaataggagctcccatatctgagtactgtgtctctggagggcgagctccttaagaaaagagtgggtcttgctcactttctaattttgagtacctggaggcatacatgagccatagcaggtgtttaagaaaggctggtgtgggttgactgaatgaatgagggtcccaccactttccggtgaatactgtgcctgagatcttctggccaccctcccagagaggtgctcccaggtcctggctccctcctccccgctcctcacactgggcccttcatgatagctctgtagcttcatctgcctatgtttggtgagttctacctgtctaggtgacgcttctaaaattaaacaactattaatctgtgaatggtaaagcatatgcattcagattttatcaaagcagaaagcacattttacaaggaaaaaggtctttctgattagcgattataaaattgacttaatttcaatctagtttaccatattcagaagtgccacattcagaattggaatggacacttttaattatcttacgagtttaggcatttcaatgtcttcttttcccccgattcagcttagcacaatgccagcacccctctctttcccactctcacatgggtctttctctatattttctgcgctcttattacctggactatttacttgcttattaatcatgtgtaacttagtgatatgcatcatggtgctcaattgttatttaattcctgctttgttagttcatggcacccatgtttctatcgcccatggaaaaatttttttaatttttaatttttatgagtacatagtaggtgtttatatttagggggtagatgagatgctttgatacaggcatgcaataagtaataatcacattatggaaaatggggtgtccaccccctcaagcacgtatcctttgtgttacaaacaatccaattataatcttagttcttttaaaatatacaattaaattattttgaccttagtcaccctgctgtgctgtgaaatactgttttattctttttgttcttttttgtaccccctcccatggaaatttcttgacaagagatcattgtgacttgtgcctttcgggatctagtcacttgagaactggttccatggtgcttcagtaaaggccatgaaatttcatcaaagactatgtccctcaaataaatctaattaaatgtcctccactgggtcagtcatacgagtgaagtggaagggaggccatatagagcagtcttcaggcagaattctggtcagaattgtagaaattctggtcacaaggtaaaggcaagaaaggcaaggggtgaatggtagtggtggtggtttggggggcacacaacattttttgaatcaccacatcaactaggtaccaggctaaatgatttacacacctgatttcacttaacatctgcataaccctcagatgttgacataatgctgcctccccttctacccataattaaggccatatagctattaggtgatgaggttggggtgtgactccgggtttacctgactccaaaatgatactctttcccctatattgctttcagagtcaccttcacttttcactgcatgcactgtccagaatccccctttaagctcagaatgaaggaaatgaaggttaataagaggtcatgctggcaagtctaagaaatgaatggggtcaggaccaatggagaaggaaagtggaaatgtctgcgttctttgttgtctcgggattgcaaaaacaaaggaggcaaatggtcctaagcaggtcagtaaaggccagtattgagcacctactgtgtgcaaggcagtttgccacagcacagggcacaaacagaattgggacaaggttgtattacccaggctccagcttacgtgaaagccagctgggccagcaggactcatttccctttcgttgctgctggaaaatcagcatccaatcatctcttgaaagaccaaaccaaggtagttcctcagctttgctttgcgtaggccccgcctacagcctcgtctgcatgtgtctcccgtggggctgcagacgcgccactgtgtctaggggcgggtgggtatgcggggagactaaaccagacttcaggcaagcagggggttaatagctcataaaataaaaccctctaacagaaaaatgttattttaattgtattacattgaggagccctgagggtcgtggggtagataatcaaaaaggacaaggaggaaattaaaaaagggaagaaggcaatcaaaaaggccatttaggagaggcccttaatcctcaatagaaagaacactaattatactacagaatctccttataattaaccctgatataaagtgttttttgagcagtaataactttcacattcacaatcattttgatcgcaaactcctgtgaacacctcacaaacagcagctcacacaggtttgctggtttttgtccccagcaagcccagggattacactgctgttcataaccaaaaagacaaatatttctgccctcagctaagtccactgcttcattgaactcacccattgctttcattttttgttgttattgttttgttttgttttttggcaagaatagctcaaaagtcaaccattcttgtgcctccttccccttctttgcaattgcttccctgtgctcgtttttaacctttaatatgacttggaatatcccacggttgcaaaacccactgaattcccaacataccttccttagtgaacagacccctgcttagatttacctacactcctagggcacacattgctgtaatagttcttaacgtttccagacaaaagcaaggattcagatggactctgctcaaatcccatccacaataagagcctcacattcctctcgctgacagctgatcccttatgaaccaaagctctaaactgtcaactagaacattttaagcacagatcagaacaaggaaagaatgcagacagttatagatttcaggggtcccagggtatctggaggcaaagcaactgggaccagtgcacgaagggagaaggtcctggaacaggttgtttgggactttaaaaaaaaatggcgtgaaagtgaaaagaatctgtccctgtccttacatgaaccggccatcgctcttatcccacctagtaagagaaggagcaggatctcagatcccatgagatccctggggagatagtttcaatggggcacctgcctgccaagtgaaactctaggagaggttcacgggcactcactcctgacattcacagcgctctgaaggtattcgtctcctctgaatgcactcctggacctggcttcacctcctcctggcaaatacacagtggacgtatctgaaaggtctacctgctcacaatgggctacatccccactttaactcggagactgggacaccaaggtttgtgaaacactgagcctagtatttttcctctgtatcaaaagaacgaatgccaaaggattttttccatttttccttgcatgttattggaactgaaaaccttacttctacttcccatccgggtgactattcttcatgtagaatttaacaagataagaagatgcttcctttttgcttttttatttatttacctttttagaatcaggtctcattatgtcacccaggctaaaatacttttttgctttgtaaacagaatccataaccaagagacaaatattctcttaccgttcaacaatattaagtatctgcaatatacccatcctcccaactcacccttggacctagacaatacaggataggaattatattgaccctgcttgtgtagggactaggttgctcctcttcagttacctattcagttgaatagcaagttacagctcattaacacagaaaaacataggacattagttcatttccacttaaaaatatccctactaagtaaatcatcattcgtttcatccaaaatacctacagagacacacaattcacttataaagttgaatgaggggattaaaaatgaagaaaagattatgtctcccatttaaaaaatattataagtaaaatgcatttaccagtaaaacacactaaaaggatctgcagaaacatccctgctccattcattaatgcaacaagtatatgccaagtgctattcatttctcaacacctaaaggtgagccaggcacagatcctgccctaaaaaaaacttaaagtgtagtaggggaggtaactcacatttacatataattcaactgtaagtcagagtgcgaaaagtactataagaaaggtgcagatttttaaaaactttatacaataataaaattataatataaatgtaagatattattaattgcatctggtagaggtctccccttgagttatcccatctgaacacagagctaatacgttgttatatccataggcgggatatttacaactccctttgttggggttttattctaggtgtaattaccactagcaggacaggagctggaagccaataggaaaggccgaagctgatgctgatatttacctccccgtttttggtgtcccttgctttgagaaggcaggccccaacactgggttccctctcacatccccccaccccaccccatattctgagttcctcccacctctgttctgctccatcaaaacttcattgacaaagagcctcatggatgccactaaagaggacaacacattaactggaaatgctcagtctttcgatcactttccttactccaacctccagtgatacatattttaaaagagtgtcctggagatgagtctttagccaaaagaaactccaccttaggagaagtggggacaacagagtcaggagtcctggattctagtcccagattagtcactcaatgtagtaccctaggacaaatccatttatgtacctgagcctccattttctccattgttagaattcaccaatagcagactcccaatgtcctgagtatgtaatatgcaatataaagctctcatgaattatgcaaataaatttaaatacaatcatgagagggaattttagtgaggtgcaagggatctttctgacaggaaccctgtctgtattaccttgggtagggtaggtttgtcctgaggcaagacctgtgccaacaaatggcattgaatccaacccaactggattgtaatcatttatacagttgttagttgatttcttcttctgtgtattaaatctaaaatatgaagtctaatccaacttatactttatgtagtcagggttagggatggtattttctatgtaatatcttacctctctgctttaaggctagttgtggacaatagatttagtttttttaaaaattgctagattccttcttttctggttccatttctggaaatagcaacattagcagcactgaatcaaagtggttcttctcacgacttgtcccttgtccctttttacatttatctcctgttacgccagcacaaataaaaccatgaacaagagtaaacagcgaatgttggggaaggagttttcaaaagcagaccttggtatcacttttaaatagtccacagttctaaatgaggctgcaagcatcttgtcttccttcagttgactgcaggagaagatctgtactagatgatgctggaaggtcttcctctatacaggaagacggctttcctcccacacggtttcaggtgtgcacacatgacactcggatgtgactgttagcagctggaaactttgaggttaccaaggaccgtaggaaatgccattcttctcattctgaagaactgaatttggccaaatggtcttaacctttcatagcctgatttcttttgtggttgtcttatcgttcaattaatttaaaccaaccattccttctttaaaatacagaaataatacatgctggctggaaaaatcttaaaaaatgcagtagtatgtagaatacaaatcaaaggagcttttcacttcccctgcattccttaatccttctcttctcttttgaggtcaaacttttaaatataacattttctaggctactttctgtgctttaaatatatgcttaaatacagatgcatgtatgtgtgtgctcacttgtatttctctttgcatgttttcctgtgatcatttcattttacttaatactatatcatggattcatttccaagtcaatatatctatatttggttactttctaacactgtttagtatttacaaggaataaatagaaaggtatgttacaatatgaaaactttatgtctcaacaaaatctcagtgagctattcatataggaaaagaattttttttttttttgacagacaggacagtattttcattgtttctttttaaacatacttttattttaagtccaggggtacacctggtttgttacatatgtaaacatgtgtcggggggttgttgtacggaatatttcatcactcaggtattaagcctgatacccattagttattcttcctaatcttctccttcctcccaccttcactgcctcttaataataatctgtcatatattgaggctaacccagtaagcaggaaagcagcccagcatctttaactcaagaaacttgtgaactttggtgagccatatggagtaaacaactgtcagtgatggtggataaggtcatttaagcaggtgtgtctagaaaagaatgatgccccaaacccccaaacaatacacttgaatttcaccaataaaaattcattcctttggtctaaacatggccaatactaagccttctctttaaacatgcatatgtgtttgggattagcaaccatttagtttgtgggatgctttcctttccagaaaccatgcttccatctgaaaacactgagtgtttctggtgaaagaagattctgacactagggagaggcagacacaaaatagagaagatgtactgaaggaagaaaacagaaaaaagtcaaaacagcaaggattccaaattagccgaagaatcagtcccctgcctagagatggccccaactgctaagaggaaaagttaacttcaggtgaataacattatattttttagaaaggtaagtggtttctttggtgaactagaacagaggaagcaagtagagcaagcacaccaacactcccactccttgtttacagcagacatcactaatctattgtggcattcttggtactccaggcagccactaccagttgactgctgttagtgcccaaaatgaaatacagtttgttattcagtcatgggagtcatcatctccattattagcagccatgagtttgaatttcacaagtagacatgaattgcataagcttaaagttgctgtcagcgttctttttcagccaagtatctgcagaggaggacacgtcccagggaaaataggaggtctctattagctaatgaattaggatcctgccataccaggctagaagttccgaataggcgaagggagagcattgagtaaccagcctcttagaggctgagttgaatggtcatctaaatcaactgtgctatggaataggatgcatctctagcagatgctgggtacacagagttttcaagaatttaaaaaagacgttgccttaaaatgtcttgtttggatagggccatttctgcatatacacccccaaattagattatttttaaaaggttctattatctaaaaatactatgtaacattttaaaatatagtaaccatcaaggaaaacagagactgaatctaacaggaagaggatgtgagtgtcaaattgttggattatataagatggaaaggtaggtgcgggtgagccagcaccttccagattcctgagaggcagcaaagtcagggtgcctgtgcagaagtcaggccaaagcttttctctctgtgggaaatcttcagcaaacagccagttccctgagctcaggacacaccacatctaccaccacatttcaggaggcttacttggagtttcagtgtagaagttgtcctcaaaaaaattaagcaaattaatctagaaagccttaacctgatttggccagcttagttcaactgtgtcagagggaggttgagcaagcccttccagcttgtctgagatgtgataatcattctcattctctctctctctcttaatcactcgtacatatccacccgtggacaaacacacgtgtacacacacccccctttacataaccaacacatgaacacttacacaaccctacataccctgacacgtgaacagttaaacatacttacaatcacacacacacccacatacactcacatacttacagctacgcacacacacgtgcacttacatgcttctataaagactatcctgttatcacccttcagagatgcagattcaaatattgccccataccccatcatagtattttctttcaaaacaaaaactactttcttttgacagaaatctccgtctttgaaagggacactctcataaacattaggccttggggaccgtgtggaaaataagcacacacctgctctgcggccggcccctttattgccaagatggcattagcttgctcctctggaggaattctggctcagaactttcataagttggagactcaattatgcttcttatgagttccctaaatttggaaatggaggtaaataaggaaatgcattagtcaatgtccttctcaacctcctcccctactcatatttcaatcttctccccctgctttcttggggtgatttctttgaattagtaaaaactaccgactgtagaggccaaaaatgaggcacaatattgagatgggaataaggacagtggaggacacaaatgccaatcttacttatgagtatgaccagtctgtgtgggtaaatccccagggcatgcagtttttgcgtgggctgaggcaactcatgtcatgccagacttcactgaagagtgagcagtgttactgtgagataccaaggaaataacacactttgacgtgagatctttagattttaattaaaatgcaaatattaatgttgtcaatattgggggattaaagaggatattccccatgaataagtactgaggaagaaaaaagaccatgatctgaaagttaaactgtatgatctcccataaaaggggatggcagagatatgcaaagtcactttactgagcttctggaaggcaaaatttgactggaagctgcctgaatttacaaatccatcagaaggaggtatgataatcaagcatggccatgggagcagagagaaaagagttatggaaacaaacgtgggcaatggcctgctaggatttttcaggcctaaggacccaatcagttgttcccagtggatgggaagttgagttgcccaacttatgtgtatccaactatctgcacacaggtgagcggttagaataggggcagagagagagagagagagagagagagagagagagagagagaaagagaaaggaatgagatgggaatgaggaaaggaataagaaatgaaaagagggcaacagagtggcagagtgggaggagagagacagagagtgagatggagatgagagaggtgactcttaatccttcatcagcctcttgagcttctcagaagatgaacatctctctgtgctcagcaggatttttagtgttaattacagctgctgttcattcaatgtgacccctaaatcagtgttctccaactgaggtctttgagccaacagcatcagcatcacctggaaaattattaaaatacaaacctgagtctctccccagtcctactgaatcagaaactctggagatggggcctctcagtgattctgatgcacgatgaagtttggggaccactaccctaaacacaagccaactaccacatctggagctccactgaaaaaacagctggagaaatctctcttcttaaataaacactgtaatattctgattttaacacaggaatgattattttatatatcagttttgagagcttgagagatttgagtctgctctctcatctctgaacactgcaaagacaagacacgtttttgagtctgtggagctgaaagtttgtctttgtaaataggagacaggcaccaacataatggcccactgttagatttcttgggaccccgacctctccatgtcctgcgtgggtacttctctgttttcacacacttaacagaaaagtaggtttccctgatttgagagagatccacaccttgataacatgctgcagaaagatacagtatactcttccaaaagactattcagcatggtgtaaatgtaacggcaatcatgtagagactttgaagtgacagatggggctagaaatctctgtgatacttttggcaatggctaactaaactgttttcctgcatttctaatacatcaatctgttatttgtttctagcctgcttttattgtttcattttatctgctatttgcactcagacttgacttgcagacaaccatgggcagcacagttgggtataaaagagagttatttaatggtgttatttaaggtgtgcaccttagccatgcagtttacaaaagcaaatctctgtgaagtacaaagcatcagagagcaaaacaacagtcactgacatctcttcagaggagagaaagaagctgagtcactgagcctgcaattcaagagaaggcaaatatatcacagaacaaagaataaacctccaccctgggtcacaggacatctgcctcagagatgttcaccaacacagaaagatttgttgcttatgataaaagacatctgtgacaagacatactgaacaaaggattatttgacccctaactaaacatagctgctgtataaaaggttgtttttttatataatattgccaaacactatttctgtagctcttttaagaagagggagaacagcaagtgttattaaatctgtggtagacatcattctaaactgtacctgggaaagcatatgacacctccatcgtaactgcctaatttgctacttagggatagaaactaatgctacttaattgaaataaaaccagatgcgctgctgagagcctaccacctttagaattatgctaagcatcacagggaaaaaaggaaaaaaaaaaaaccaagttgcacttcggcctccagaagagacaaggtaaacagaaggtgagttcaaaaatgtttgtatttagagaactccatgtgaattggaatgtggcaggagaagctttcatagaagagatgaactttgctcagtgggtaaaatttcacaaggcagtttggcaggaaacacaagcaaagcagcacaatggattcaaggctcagtggttttgaagataaaattcaatccctcacttccatttgggatgaaatattgggaagcagcaaaagtgtcaccagcaggaaggtcaactcaccattggagacagacttattgacttgactggccaagcccaatttaatcctccatccccaattctaaacacacagtagactagatgtacccatgcccttcacaacacacgtttcagctgttacctctcccaattatcttgcttacctgtcaactttaaggcgtcatctagggatcaagcagatgccttcagaagccaggactgagtctaggggaggggctgaacaggttacagggctgggggattctcactagggatgtcagttcactgctggctaagagtggggcccagattcagtcttctcctttttttcccctggtcccaaagtatcctggaacagtgttttctggttgggctatgagttttcatggtggcaatctcagttggtacaggaacctaaggtagacggcagaggtgctagcagcatggcgggaagtcagagttattaaggaaaatatccgaaatacaacccattctgtctccctcttccaactagcaataatcaggaaggcccttcagcttcagtaatatttgagaaaggactcctgcacccagaggaaaacctttgcataggccagcattcggtttaagacttttggccttgtcctctcagttcatgaactctgatttgatattctgttacctgaacaaactctgatctgatatatatttttttcttcctgaaaaagaagtgcattggaggtatggtgatttccagagcatctctgaggaagtgtaagtctgtttgtgtggcccctgtctaccatgtattataatgatttatgggtctgcctcgctgtcccctactagagtatcagcctcaacactctctaccttgctcagtctaaaaatttatactggggaaacattcaataaacagttataggcatctacggccatacctccctgaaggtgcccgatcttgtctgatcttggaagctaagcagagccgagcctggttagtacttcgataggagaataaatagatacaccttggctaaaggaacatagcggtgagaattcaagttcttgccaccttcccaatgcctcgaagacagaaaactgaggtcttgctagacctttatttaccaccgctccttaccactatgtcctttcctagagcccaccggtgcagctcttcctaaatgcctcagcatccaagtgtactttcagacctgaacccctgcagtgcctttatcctggaccattctgctacaaccatttcatagctgtgcatcactagaggggatgccagtgggtggttagggaaggtatcaaattgcatggaacaggagagggtacaatcaggtggatcatgttgtcactgctgttggacggtctcgtggtccaactgcacacagcccttctggaaaagtgatgatgtctacttctacctatttccaggaaaggaagttctataacttcaggcagacaattcctatgtctaaaattcattacgtcccctagtaattgcaggatggtgctcttggaagagcaccacctattggcaaaaagaccaatggaaggttaacctctagactagtgcttctcagggtgtggcctctggaccagcggcatgggcagtacctgggaactaggttagaaatgccagttcttgggtcccatcccagactgactgaatcagaaactctgggcatgggctcagcaatctgtttttaacaagtcctccaagtgattctgatgctcactcgtttcagaacccctggtctatagaatgggggctataagcgtcatgtgtatatatcagttgtcaatttagaattacctgtttgtttggctcaggtttcttctgtttattgctgcttgttaggaagagatatcccctgcattccatagattgtgtgaactgtcaactggagaggatgggatacaattttcacaggccactgggctcctggaagctcaggctatttgacttcgaagaactacacacaagaccctgattaataaatttgtcaagagctgctcctttttgtgacaattctagcagagacttcggtgacagccgtccacttttatggattttaactgagtaattaataggataacagttacaagtgcaagttaagtgcgtattatttctcctggattgggtcataaataagtaatatagcttttggaagtgaatgggaagagacgcttgaaaagaaagacctattgggagctgaatgagggagtccagacttaatttgaagctctaccttctcattttagtgaagcaagcagttccacaagggataagccgagaccgtagcagcttctgtttcactttgtgcttcagctatagccaaacatcgacaatgtaccaaatggagacatttttgaaactgtcctcctctcacagatattaaaagcaaaaacaactcttcaatatgccagaggtaagaagaaaggaggagcatcagcaaagactgaggaatattttacaacacagttacacagactattacacttttatcttttcccagatccccgggctgactcctgccccaaccacaaattcctgggctgctctaggatgtaggggccactcacctgttccaaatcaattcagggcctcagggccacatcacatcttttgtgggccctgggtgcttttggcttcacaagccctttctccataatcaaaaaataagtaaaaactacattttatgatatcgttggtattaagacaaatataatccaggctggatttcatcattatgtattcattattcttacattcatttttgtccttctgatttgaaaagaaatgaaaattaaaatagttttgttggtccctaaaagtcctgtgggcctgtggtcgtttcctacgactgctggaacaaagttccactcactggtggcttacacagaggaagcgcattgtcttacagatctggaggctggaaggccaagatcaggttgctggcagggccatgcttcctttgaaggtgctaggggaaaatccattccagtcctctgtcctagcttctcaaagtcctctgtcttgtggcaacataactctgatcttcacaaagcattctccctgtgtgcatctgtcttcaaatttcccccttttataaggacaccagtcatgtccgattaggggcccaccctactccatgatgacctcattttaacttaactaattgctcggaacagccttatttttcaaataaggtcacattccaaggtactggggattatgatttcaaaatataagttttgaggagggggacacagtccaacccataacccagggctgtggccttgtatctaatgaaaaagtcacttctttcaaggacgttctctgagattctgaaggcaacgtagaaacccggggtcttcagtagcatcagaaatgtgataaacacccaggggtggggagagatacatttttggtttggggctgggcgcagtggctcacatctgtaatcccagcactttgggaggcccaggtgggtggatcacttgaactcaggcttgagaccagcctaggcaacatggcaaaatcccatctctacaagaaaacacaaaaattagccaggcgtggtggtgtacacctgtggtcctgctactcgaggggctgagtagggaagatcacttgatcccaggaggcagaggctatgatgagccctgatcgcaccactgcactccaggctgggtaacacagcaagaccttgtcgcaaaaaaaaaaaagttttttttaaaggaaatacttcaccacacttccaggaagattttgtgtggaccaactcagtctgggggaaggtgaacttctctcaatgccccacttcatacaagtgccctgcctcggggacctcccagtctctgacttaggagcaaaccttcctccaccttgagcttttcatcctgcacatttaccgcttgtctctgggagctgagccccactaggtattgaggaaggaaacgatttctttttttaaagaaatctgattttcatggaggccttgtacttctcgtgctctttttcccatgttaactttagcttttttcctctcctgaaagaaacactcagcttgcccctgggtcttaactgacaatccaaaacagaggaggaagaaagagaggttccatccaaagaaagagatttgtccatctcccctggacaccaacctctcttctcctcacctgactcctctcttctattagaaaggagagaaagggagcgggggaaactggaaaggggacttgagattatcactcccttttttttagcttcagttttttttaagttactatcagtccatggcaacaaaggcctctgaattctttctgtctgtggctcaatggtttaattatcaaaggattctataaaccccaacaacgtgtgggctacccagttcgttaccccccgcacttcagaagaaaaatcacctcacacaaaaacagccaaataaagttgcacagtccgagaaggcccatcaagcgagaactgaaacagtacatgaactctgcctgtccatttaaattgcaaaagctccagctcattcgcagacacagaattcggtctggcaaaaccattcacagtcctggatgtgaactggagcctacgacattaaaggcaccaaggacaatgccagtgaggctgtgtccaaagctggactatctccatgaaatggttctctctgagcaggcagaggtaaataacagtaattccttcgagagtgtgcatgccagaaatgaagagcttgaagtttatgtggaggagctgttgaaaccaccccaggaagactttttctctcagcacaaattataataaaaaaatctcagtggcactctgagctgtaaatctcttaggttaacttttaaaaaaatgtgacattgttaggtacatacgcaggaccaaatgaggtatttcttttaactgttctgctcttcatagagcctctctctctctctcacagctttggtggttttatgaccatactgaaggagctagcagaatcctgttgctaccaatagagggtgggttggttaacctaacagactgacccaaaaggttgggcaaaccccagtgagaaagcagctgtggcactttttgaggctgtgcaattggttcacctgtatttcccgtgtggtgttgaaacaattgcaaaatataagcctaggcattcttcttgggcagtggcaatgctgtggtttagagtgaatggacatcccatgctccaagtcagtgataaaccgcttgagttatccccaaatcctctccaaatgcttcaagcagctaatgttacaacactgaccattaacaaataatgtgggacaggaagagaaagttcagtgaaccaatgactcaaattcaattcccagccagaaacttcatggtgcacagaggacagtgtcctaaggaacagtggctcttgcttaatatgaccttcaggctttctttaccttgcaggggctgcgtgcgctcccaggcttctccttccctcaaaggagaaagactgtttactctgttcatatgatctctgatgataagagactcaacaggccatgggcttcaggggttctttcttgatgctatgaaaaccaagatcaggggaaagtgagatgggtctatgcctccttgggtaagagcttctagagaatggaataaagcagaggatagggtcagacagactgaaaattctcagagggttgtgttccagggcagagactgctgttggctcctccctgtctggccctggaaatgtagaggtttacacctgggccattagtaaatgccccataattcctcatagcagatctagttccccaaccttactgcagaggcatgggagccgcacctcattggcctaatggactccagggagttggtcaaggaggtgcagccctctccctggaaatttagagtctcagggaacttctcactgtcttcatctcttcattattcaagtgggaggcctcaacaaccttgtcttctttccacacttcctgcatggccgcatggccacagctgatcccctcactcgcctcaaaccaaccgtgcaaatctccttgggaagcaacatgccactccctgccaagcctcctctggacagcgcctgcgagttccttccctctccactggacaaaagtttctctcacagcatttctgtaacttctgaaacccaacctcctccaagaagccattctagattgattagagagaaatgcaaataattcctgtgactacaactggagatatatctatatctatctatatgtatagatagatatatatgtgtatgtattgggagttattatcttcaacagccaccaagtttcttggtgtctcctcactgtcatccacattgaatgctgttattcttttaaaaagtgaaaataacttcaatgtttgagtgattataaaaatgttatatgctcacttaaacaggtagatatgtaagtgcagaaatctattcagaagaatgtgaaaatcacacaaaccccactacacacagagtaaacttttctttatctgagaggtaaaaatggtatgtgtctatggtgtacaacatattttgatatatgtatacacagtcgaatggcaaaatcacagcaagctgtttaatatgcattacctcacagacatcatttttgtgatgagaattcttaaaatttctgatggcaatttgtaagtatttattattattaattgtggtcactacgatgttcaatagatctcttgaacttattcctcccgtctaattgaaattctatgtcctttgatcaatgtctccttgatccccccaagcctcagtctttgctaacactattctcctctttgcttctatgagtttgactttttaagattccacatataagtgagatcatgtagtatttgtctttctgtgcctagctcattatttcactaatgtaatgtcctctaggtccatccatgttgttgcaaatgaccatgacttccttctttttaaagtggaataaatagcattccattgtatattgtgtatatataccaccttatctttctccagtcattatttgatggacacttaggttgatttcatatcttgactattgtgaataattctgcaatgaaaatggggaggcagatacacagaaacaagttatatgatatccctatttatgtaaatgcattcattctatttttttttttttttttttttttagtctcactttgtcacccaggctggagtacagtggcacaatctcggctcactgcaacctccgccccctgggttcaagtgattcttgtgcctcagcctcctgagtagctgggactacagatatgtaccaccatgcccggctaatttttgtatttttagtagagacagcattttgccatgttgaccaggctggtcttgaactccttacctcaagtgatccgaccgcctcggcctcctaaagtgctgggattacaggcgtgagccaccgcacccggctgtaaatgcattgactcatgactgatactggttctatgatgctggcaaaaattaaacttaggctaatttccatagcaaaggttaagtagctacttattaattggccctgtttacatgcctaccatgaaagaattatttttaggcttaagtggaaaccttaagcttgactaagaccatcataagaaaacagtgaatagcatatctacttgaagtggaagatgagtgagcttcaatcccattgtcactctgctatagacactgataagtcttataaaggcagaaaacactagtttgagtgaaagaatgactgaggttgacaaaagaagtatccacaaggcatggtgagtggatctgccaatctctctgcccatctccagacagtatgactctgattctaagcccaaatttagtgggaggctctgccgccacatcttatgtgctgctgggcttggtgaaggttagcagtcactgtctcagttacatgcatatgtgacaaggaaaaagtgatttacagcttctctttccctcttgtcttctagggagaagagaacttccgtccaattttatcctgggccttatttttccaatcagagtcatggaatggggatgaaggagaagaataaaaagaagcaagaccatttggttggtttccattggagaaaccagactcacaggaggggaaatgctagatctgtaagataaggggtgggtgagaaaaatataagaatcagaaagcactagggttgaaaaaaaaaagttctgggaaacttcctttttttttttttgagaaggaggagtgattaaggcagctgtcatattatgataggtggaattttgaggagatagatagataaagagatttttcagaaaatctgccgtaagctgtggatggaactcttcctttagcattttctgaaagactgtaataaagatatacgttgcttttaaattatttttgaaaaccaatgtgtgcttctttgggaatgacactgtgctgacacgggggacatgaggcagctccatttcatacaaattagatagaaacagctgtgtcgtttgcttagggctctcagtttccagaggacagactcccatacccatgtagctgattcggttatatccagggaggcatcttgccatagttacaaaagctctgaagtaggaacctgaagacctgcatttgagtcctggttctccctcttaccagctgtgtggcccaggacatgtcacttacgctccctgagttcagtgtcctcaccagcaaactggggggcaagaatggtgctatgtgcctgcaccctggacttccatgagaatcaagtaagataagggtatgccagcttgctctgaggactgtgaagagccacccaaatcattactgaggaaggccccttggacagcatgatattcagcaacttactgtcctggtgataacaatggtggctgtgatggttctgagactgattctgcccagggccattaacaattctcctctactccttcctggtatcttctctgagtcgggagccagggaggaataaactcagtcctaggaaacctactgggaactggacaatttccccacctcatttcacccggggcctccaccactgattaaatggaaatgctggagggcatgatgggcccaggccaggattctcttgaatccagcctatgcctggccaccgcgccctgtgctgatggtgacttcacccgctggctcccatctcaatggacggctctttctgaaaggccattttgtgactcgtcttgggagtgcttcattcatgctggctgaagttctttgctcaaaattaactctactcagcccaaagcagccaaaaagaaaccgaatgagacagcagggagtgaagacctcgcacactctaaatttgcttccaggggagttttctctgctttccaggattccagcagaatctcatccaacctcagaggcaacggctaggctgaagccaagagcccaccttctgtgaagtcctctccccatacgttcccgtcactcccaggatccgcatcttcctgtgcaaaagtcatcagacacatgtccgggtagctacctgctgcctcagaagcagatcttttctttttgtttttagttgctgagaccaaaaacttggccgattctgtctctggtctgaggcaagagtccttgcatctgattttcctaagaggcagcccagaggctggtcaataaggagctggcctgctttccttggcctcggcatggccagagaggccagggcccaaagcagcaccaggatcttgaactaagacacaggcaactcatttcactttcctggccgcctcaacacatctgtcttgttggcctgtgtctaaacctcttgagcgattccagctgctgagccatgcctgtagacatggcgacatttggtttctgttaaaacagaacaggtcagtgtgttcacctgcttcatttttttccctcctgcacaaggacagggacagaggcagccaaaaactgatgctgctgatttggagatctcccattctgtttcagtgacctcatgccttggactggatgccgctgggtcttttaaagccgcttaatttcctgtgtatttccagcactcagccaaaaagaatgtacactatgaaaaaaatgtctactacccctcaattgcagaccctctggaaaaaaatatctggaaggcttttaaataaaagaaataattacaacctgctgagtgccttacagaatccatgaaactcgaccttttccaaaatatcatagtatttcctgtggcttctgtaggctaagccttcgtggatttataagtatgtgtccaacacagtctctgggctccattttttaaaatccaaaagtcagagttgaaaagcacaaatccatactcttggaagacagcatcccaaaaggtgttaagttaaaacccagctgtaaaaatataggctgccagctgtcaggggtggtgggccatgtgcattttttttttaatttaatgaatggaggtttgatcttccagcttgctgcccagttgcagcttttcagatgctgaacatgtcaggtatgccctgcaggtgtgtatagtcaccgcttacaactacatggtgggtggagagtggtttatgagccctgagattcataaattctagtctttagaactcgcaatataaggatggttaaaaattggaaagggagagaaaaaaaaacattctgaccttcaactacctgtgatcaatgatgcagactcctggtagccggtcccaagagaaaactgaaacctttgaaagacaaacccaaggagacagaagtttctattaactttccagaagaggtaaagattctaagcctgggttcactgtacatgactgtgtcttgctatgactgtgtgtggacagacaagatgaactagagggtgtacaattacatggatacttcgtcttgcatagaccacctcaaatatgtggtcataaaaaatatctttccctaggtgtttttgaaaaataattcagattattatttcaacttcatgctgtaggttgcctgccttagttaaacccgaggaactagggacttcatttccagtggggaagagtcgaattccatatcaaattactctgaataaaatagtgagtagaaactcaccgatcgactctagttagtgtcagcctcaggctgaattgggaactgattaccatttgtgttcacagtcttctgccctccccttttgttcctcttaacccccaatgttagagaccctctattaaagcttggcagcaccccaggctggggaatatccccctgctcaatctcttctctaagaaaccaataaagtgattttggttaaggtgagaacagctaagtatggcccacctcccagataacagcaatgttttaatccttaagggagagttcaaaaaaagtcaaaattcttagaaacaaggcaagctggtgaggaagatctttttaactgggagatgggcatgttcaatgcttcttatccaccagcttcaagggagtatgagaacactgcctgagagatgggagtgtacagatgaacttgatttactccataaatcaagggtagggttcgagtgactggaagtagagcaaagatatcgaaacagattttttaaaattggcatctctttacttagcctcgatctattaaatagaagaatacatacaaatatttttatacagaaagaaaaattctaacatgctccaatcacctgccagagacactttataaacttactaccatttggacttgcttccaccatttcagaatttcagaataggtgaggctttcccatgtggaccacaagaatgactactgtgcacaaggagaggcggttttgagatgcacagtatgtgattgctggaggacacaagcaaggcaaggagcagaatatgcaaacaggccatggtaagctctcagatgaattgtcttgggctcccagttaagctacaaatctagtaggtagaacctttcttgtttctacgcctctattttagggatctaattcttagtaaagcaactcagaaagaaaaaaaataataatgcttctttgtttctaggacttggccttttgttttataattaatatagattcccacccaatgcataaatgtttaaagcatcatttatattgcattgcccacttgttaaagtttaaaatgttgcaaatggccaagagtctgtgcttcagttacaagcaaacttgctcgccccatggtcttaatctccagcaaacagtggcataaatgaacctctgggtcaactttgtgtttgctgcacatcctttgccattataaaataagatgaaaagatttgcttttaagtcaaagcctaatttaaaatattttaagtatggacataaatgcgctggcctaaaatgtgtgtgtttgcacatgtgtgcacatctatatcatatagtttacatagaaatggatgaaaaaagtagtcctaagccaatactgatataattagcgaaaaaaaaaaaaaaaacacacacacataaggagacataaattagtgccttcagacatagggattattttgttaacaagggaatgggtccagagattgaaccatctgcattcaaataaagtaagaggttcctcctcacgtggttcttatatatgttaatgtttcacacttctttgacttatatgtcaactcacaggtggattgtgcagtggcttcaaattaaggcagcctcttagtcaacttgtcctgagctgggttcttaactaggttcctgaccttatgaccttatgaccaacacagctcctggttcagtaactgagtccttgttcagttctatcctggttctccttctaggcctcccaggtctcagcctggtttctttgaatcccactcttaccaccctaatttttaggcagtatggatttccattacagggttataatgcaggaagcatggcattgataacgggaagttggggtatgtttcagcaacacctccctgtttaagggggagatcagtctgcactagtgggagtgtttgtattctagaatatttttaaaagaggaagctcgagtgttttccagtacacggaggaactctagatagctgtgaaggagtttcccggttaccttaatcaatgtataagtgattgtcaatattttgtataatagataattataaattttagtaaatataagaatcaccccgggagcttgttaaaatgcacattcctagagtccatccccagggatcctgattcagaagtcgtggggtgtagtttatgagcagtggtctttccccctattctctcttggatggaattttgagaaacatggctctatgccttcattgaacaacatccacctataaattacaaattttaatttcatacagactattattgttataaaaatatttactgtctttaaaagtttagtacatcccttacaatctcacttgcaccattaattcttccagtaaattatttctctaaaacatagatgtaaaacttaacgtagcctgatccagattgaattactgcaaattgctctaagcagggatgaaatgtaaattaatgggatttctgtaaatgcttatttttttctaactaatattctatggtggtgagttatgatatgtagtcaaatattgaactgttttagctattttaggagattaatttacactagctaagagagggagaataagttgatgatcaatttaagtaacccttacattaatggactaaactttgtgggaaaaagtaaatgcaaaccagaattgcccaggtaaatgttgcaggctgtctgttagcacacttagacactgtctccttttaccaggggatatgatggagagaaactctgttccctgattttaggcacctaaagatctaaatctaaataacaaaaacaataacgataatagctaatattagggctgggtgcggtggctcatacctgtaatcccaacattttggaaggccgaggcaggaggattgcttgagcccaggagttcaagatcagcctggacaacatagtgagaccccgtctctactacaaattacaaaaaattagtctgacgtggtagtgtgcgcctgtagtcccagctactcaggaggctgaggtggaagaattgcttgagtctggaatgtcgaggctgcggtgagccatgagtacaccagtgcacgccagcctggcaaacagagcaagactctgtcttaaaaacaatatagctaatattaatcaaaacctttctatgtgccaagtatttttcatttattatttcatattatcttcactacatccctacagatggatactattatcagctccaatttacagttgaggaaatggaggttcaaaaaggttaagtaatttgcccaaagccatacagccagaaagtggcatagccaaagtctgactccaaagcctaggagacccaggtcatatctacagctgagaaaggactcactctccaccatgccactggtctcctcaatcagtatttcctttgttttaggcataaactagctagctaaaacctgcagtttgaaaagttcatgtcaaatgaagtgacatacagagaacaattgtgcagataattttctttagaaaacagaagcagagaaagaatcccttttaaaatttcagtttcaatatatttttgcaagcatatttttgtcccagatgctaccgtgttcaaccttgtctgagtctggtgaccaaacctcagtgagcgttctgtccaggtatagcagctgttttgggcagcctaataattaggctctctatgtatataatctttcaaggagagaggacatcaaactgagattagattagaggaaaaagagcaaaagaggaccatggatagtaatctattcccttttgtgatcagcatgtagaaaacagtttcagaaatgtattttcatttttcacttaaaaaatatttgtattttaccttcagggaaggtattcagtattctagcagttgcttcagaaagagggaattggctggcactgtgccatgcatgcttcatagacaaagccacctaggtccataaacacagtcatctgaggggcgaagggcagggaaggattcaagcaccttagttccaactccaggttggatgtccctctcgttaccccacggtaaaaggattatttcactccactgtgaggacttggctggcagaaggcattttcaggcaggcagtgaggagagcagggaagaaaggcaggtggggagcagaatccaagacagtgcagagggcctgggagaccaggagaacagggacagcccacagtcagaggccctaaggagtatgtctcctaagagccttcagctgaatgtcctttccctccccatggcggggcatctctctctacaacctgtccatggttcactttgttctgcctccttcaacagtgattctaaccctgttgtcatgtattgattacttatggcaaataacatcaggaggaattggcagttgcgtgaagatcagtggtgggaataagaagtgggactagcaggaaacggatcaccatcattagtatcattattatttaattaagctttgctattacaacaataaataataacaatgagaataataataatgacgataagctagcatttagtagaccaggcgctatgccaatcattgaaaatatgcatgtttatttaaccctcaggctattttgatcagtattttctttatcccactttacaaatgatgttgaggtgtaaagagataagtaccttgaccaaggtcctgggcagctgagtggtagtgctggggcccagatcccaaattctgactgcagactctgactccagcacctgctttcttgaccactgcgggcctggctttcacaggtgttaccttcctgcatcctctcggcaccaggttgagcttggtgtcgctatcccttcttatagatgaagaaactgaggctcagaaacagtaaacaatctgcccagggaggaggaacagagctgaggaacaaaaacaggcctctaagctcctctaccaaaactgcatagaccactctgtaaaacactccaagtaaggatgggactttatttctcacccctatgactccatgtctaggtagaagcagaagagtttgggaagagatccgacaacatgtgtgaggagatagggaagctgtatgcatttaacctatctccagggtccccatcacttgagagaagggccatcaataaggaggtggagaaggatcatccgagctaggctgagtcttctttgacttgctaaaaaaaaaatggggagggagaaggcaatgggctagtatgggaaagaataaagaagagagagggcagacatcaggaaagaacatcaggcagagagaagcgtcttagagcagtaatcacaaccaaaattttgcgcaccaacaaaagcccattgacgctcagacacctctgactttccccatttccttcccgatggcacaaatggaagctctgatttcctctttccttttccttctggctgatgcatcctgacaaatacagtatgtaaagcgcagggacgtgtgaaaggaaagtgtggcgacggttgttttccatctcccaataatagcgtttcaatttggtacctaaataaacaatctattttagtggctcccctttgatatctccaatgttcccttctgttatttctggcagttcccaatcctgtgatgtgattagagaggatgattacacttacataacagcatcaaattaatttgccgccgagaacaacagcggtaggaaatcattggagttctcaaattgctccccccacccccacccgcctcgagtttatttaagtgacatcaagggattagagcgaagtcggtcagtagagcactgctgggaaaacaaccaaaacatcgactctgaccttgtaaacgaaagaggaacagagcaaataatgaatagcgctggtcccaggcctggtgcaggggccattggatgaatcagcctcccaaacacacatttccgtctgtctgtgggagaaagaaacaaactgtacctttcagtgcagattagattcattttcctggggctatgtccagccatccagggactgtcaaaaccaaagatatttgagattttgcttatgtttctttgctttgctttttggccccttttcaaaacaacaagaagaatgtaaaagttgacttgaatttttttactctgtgagccctgaacaaaagtccagaaaaataaagcagaggcaaatattattgcttctggttttctaaaagatatgacaataacagctcagaaaactgtagcccatgattccaccaaaggttagaggttcagaacagggagcagcacgtggatggcgtagaaaagggacccctttaagtcctactcgcagtttagttctgacacgaaccttcaacagttacttcaactctctgagccttggttttcttacccaagatagcagatattaccgtctttcatctctgttacagggtgggtgttcacccatccgttcattctgttaatccatccattcaacaagtatttatcgaacaccaattctgtctcaggaactctgctggtaactgggaataccaatggacgtggtcagccctaggagcttatgtcctagcggaacagggaaataaaaacagccagtgtgctctgagggcctgcatgggcaggcactgacctctccacccttcatcccttatcacatgtgaatttcacaaccaccatgcatgcgtaggtatctctgtctattttacagatgaggaaattgagcccagatgtgttaaataacactacgccaaatcacactaggaagcaatgagattgaaatccaaacctaggttttcagaatataaagccatgctatatccctttatattttttggaacctgacaagctctgaagcactctgcaaatacaaggaactactttaagtgtgtttgcacaagctgttcatatactagacagacatcacaaatgcatgaatttctattgctttagtccagtgattacagcacttgattctttttaaagcaaatccacttctattatcccgtttgatccttgtaacagcatcacgatacatgtggagcaagtattattactcccactggacagatgaagagaccaacattaagcaactggccaaggcccttgacccagacccggaacactggtccgtggctactcacttgctcttcttcctcaacctcctctcaatgagtctgaataaggatgatgttttcaattttggcctcaatagaattatggttacttcctatattgtgttagtcttttgagtcctaatggcatccctttttgggtagaaatccatattcacaatatagcatgaggtatttttatttgtctgctttgaaaatcatcggctgcttttccaccttgtgagaacgtgtcacattttcccatcatcttttgtttacatcattgtttcactaccatggaggtttcgttgtgcattcttctcacttagctcttttagaagactgctcttaacaccaacatatggggtttccaaagttgggattactccagttagatgaatttgaccctttgttccaaacaaactcttgctaattccagctgtactgtagcatccatatcatctgagtctgcttgttcatacttctcttacttcataaaatggacatcaaaaaattattagggctgttttagtctcatggcttaattccttcctagttcttctacctgaaatgcttgacccccaactttgacgcccttccctcattcttcagggacaactcaacttccacatccttgaggatacatgtccacaatacctctgccaacattgacatccacctcctctgaatttccaaatcccatagactgtcagaggtttgctgcacaggcacattggaggagctctggtcctagtcctttcttatacagatgaggaaactaggacccagagagggcaaatgactttccagttggtggcaaagctggaaatagggctccattctcttgcttcttgaagctagcacttcccttcgactcctttctctttccttctaatgtctgtggaatgtgggttgtgtatgctcagtctggaatggatatctctcttattatccccgtaaactcagtgcacttcttgaagatgagagctgagtctttttttttttttatatatactttaagttttagggcacatgtgcacagtgtgcaggtttgttacatatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgaataagaacatgtggtgtttggttttttgtccttgctataatttgctgagaatgatggtttccagcttcatccatgtccctacaaaggacatgaactcatccttttttacggctgcatagtattctatggtgtatatgtgccacattttcttaatccagtctatcattgtcggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctggttctagatccctgaggaatcgccacaccgactttcacaatggttgaactagtttacagtcccaccaacagtgtaaaagtgttcctatttctccacatcctctccagcagagagctgagtctttttcatctctgaatcccatagcattttccacaaacccaacacatagaagctgttcaagaaatggttgtgggatacatgattgttcttcatggaaacgatctgccttttcacctacaaggttgtttgctaactcatctcctgtttgttccctctcttgttcttgcagcagtttctctcctccatgcaaatcatgtccactccattccatacctctgcagaaaactctgacttcggcttaacctgcattcattcattcactcattcatttattcactgaatatctgcaaagtgtctgtgctgtgccaggcaccgtcctggtacaggggatgtagcagtgaacaaaacgaaatccttgcccttgtggggcttatcatccctcaatatctccaccttctcctaagtgacagctcccaaactgagggaaacccagggtttcacaaaaaaagtttctgcaatgttcatatcattaaaggtgataatagcagatattttaatttctacttaaataactggatgaatgtagtgaataattacatatggttttcatttaaaagagcagagtttggcatcacctacctgtgctcatgacttcgtcaccctccaccattgggtgaggagctgaatgttaccagttattgtggcaactgaatgacgaggcaatttaaaatgtttatttttggttaattgtttaattgattaagttgtctgattcttacccacagcgggtttttggtaatgacaaatagtagaagaattctgaagtaaaatttgaaaagtttataaagactgtgcatctgatgataactttataaatatatgtcaaagtattcttcactggatttcagaattgcatttacctgtcacataacccattaagatctctccgttaagttcaaaaatcaatgttaataatggaaagtttggtgttgcttatatccagtttggcttttaattttttgtatagatgtgtttactaatagcagccagaaatcctcttttatttcactagaaataaacaaagaataaaaataaatcacatgtttttacccaaaatgtaagcttttctagcattagttgtaaaggcagattttgtctgtttttgactacttttgatactatgagacacagttaaatttcaacctacagttcaatatttatttagttgccaaactaagcacactaatagatgtcattttaatgtatgtttcataaatggtcatttcttacataattaaagtaaattaaaccatgggaatcactttttagatggaactcattcagaatttattattataatccatgaatattagtaaatactatattcaattaattttgtaataaaatctttaatatacacttatctaaaatgacgcatacattttaaaactttaactcatttcattttgcattacatgcaaaaccattagatgtttaaaaaaatgttcaaataatatatattactatgaaatgagtgcataagtttagaaatggctggggaacgctgttctagactctttatatctgcccttgcccttaccatctttgcaccttctctaaaacaaccgtccttctcagcactgttgatcatcttttctctcccttgcatcatcagtctttccttttctactttcttcttttcctcaaatccataaacattatcaggtctctctattctacacagccagccaaccagctatacacaggttcaggaaaactccttcccagtcctgtcttcccctcaagctgccaccttacacagtcaaacttctgcaaagagtatttttctgccattttctctgtctcagggcctttgcactagctgttcttctgcctagaatgttcttctcacaattctttgtatcactggctaagtcctgccatacaggtttcagctcctgtaagagctgaccaaccatgctacagtgcccaaacaatccgtcttctgattctgagtatttattactatctgacactttccttgtcccaaaaacagagcacatccctggatgtgactccagggtgtaaaatagtgcctggcacatagaaagtgcccatgcttacttgttgaataaaggaacagacaagtaaatgatgaaccctttcagcctcccttgctggtttcttccctctctcccgacccccaaatgcttgctttgtgcaggagtctgccttttaacctcttccctccttccttttcacactctcactgggttatcacagccacccgtcaccctcagaattccaacattcacccacatggagatggcaaacacagagcacggtacagcccagcaatgcagacattgctagcagatctctgctctcttttcaggatagtctagtgtgcatggtgatccaagacaggatcttccaatcaatgggaccggcacctctaggtgaaggctatttgctttctttgacctatatgtcaatgacttcccaaatctatgtttgcagcactggaattttcagacccctttgtcaaacagccttctggacactttcatttgttcacctctaccatccagcacaatgcctggcacagggtgaatgctcagtaattctccatgctacaataagcatgtattcagtgacacgacccactcagatagtctctaccagcttgctaggtataaaagggaggctcacctatttgtgcttctcttctttcagagttgtggtggcaatttgccaggtctcgagcacagtacccatttgtaacaagttacacgttttggccaatagttccacaatttcacccttgagttccttcaaaactcttgggtggctgccatcagttccggtgatttatttacacctaggatgtcattctaggacatcctgtccatttgccacaacttgttccaaggctggagacctctctgttttcaaatacagttggggagtgggaattttcctcttcacctccatggtaacagctaatgccaaggatttgccacgactctctcaactagtttttgctcatttttaaagtggtgatgatcaagtgagtccaactgatataatggtctctctcattttttccctgccatcggtacataagaaaagaatactttctgattggcatagaaattccctgcaaagtcatcctcaaattatctcctgaagcactgtgccaactaactctataaagttccagctgataactcagatggattcaaaagctttcacacccaccagatcatttaatctgaattaagaattctgaaagattgataagagaggccagacagttaccattttacagacaaagaaactgaagtccagagtgatccagagatctgaatgccacatagcaagttagcacctgagctgaggctcaaaccgttcttcagatttacaatccagtgggttttctccttgctacaccttgattcagttgaactgcatcaacctattctaatccaatcaaatgctgaatgaatagtcattaggacaactggaaagaactaactgacgtcaaaatggttgattcagtagccacatgcatctatggcctcatgtaacaaaaatgcactctgctaagaaatattccccaaggagagcctgagagaacacactgaagagtcctgccttacagaggccagcctggactatgtttgagggtggacaacacaacacacataaatacatacatagctttgtgcatttcaaggcttaaaagttcttgttgctggattttatcttgagattaattgaattctcactataggatcctcaactggaatccaggttgagggggacatgggggccaactctagcaatgaatacatcatcaaacggggggcaactttgagtcagtagcaaccacaattcccacaagagaataatgaggaagctgagtagttggaaggattaaatactggcatttcatttttaggatcacattttgcgtgcaaccacagctccagacctgaaagactggccgtctcagatttgcccatacacatagagaaatctgcctctaatgtaatctgacatcgtccctactctctgattaaccacttttgggtgggcctcaaagaagtgcgtgccaaatgatgccctgtggatctcaggagctgccagtttcattttcccttctacctactcttttcccaagtattatcttgccagttgggaagatatgatggaatggaaagaaatatttaaccatctttgatacaaagataggagggggaaatatgatttgctatcctattttcccccattgaggagataaaaagtactttgttagatttaatttctttggtacaaagattagtctgagagtattttgaacttgtcagtcattcaactcagtattttaaattttttaaaagcataaccttgaagtatatgtgggctttttttaatagttttaaatttgaagcccctgaatattttataaaaagttcaatttgtatgtgtgtttttttaaaaggttttaatttacttcattagaagctctctgagctttaaaatatttttttttttcaatgtttctgagccttcctttggaagaataaaatgctcttctaagaaatgtcaattgatcgttggggtggaggaactgtgcagaggatgaatgtgggctaaacattctctggcacctagttgatctctcttccacatgaagcgtatttgctaacgaagggagcattggtatgggaccgaagaaaggattcccttagtctgttaatttacttggaataattcattagctgacacttttagctatgaatttagctggtaaatcccagatcaccccaatattatgtgtaaagaggatagttcagtctttttgtgagaactttgggaggatggattaaagccctttctcccatagttaccctgacataagggagcttgttaataaagagctctttggatcctttcctttgtacaggcaccgtatgaatatttatggaatatttcatctgtaaacagcattaaaatataaacagagcataccaagaaataggaaggccattttcacctaatgcatagcagtgctgtgaaaatgctagggttccattcctggttatcagctaaggaacagcaaagaaggaaaaagttatttgtttaacaaatcagggggcagcaagtcgtgtgatccagtggagctttggtattcttgttaatcaagtcttctgggtaattgaatgacgatgcatgtctatacatgcagacagacacacacacacacacacacagacacacatacaggtgcctgatatttgtaaccactgtgactggtcatatgagattgttgcttttgtagataaaaagtggtcaaatatcagagtttttgtatgacgctgcctaattagtgccaccctaagtttctggcccttctccttttgggcacagggaggggtgggaatatgaaattgctgttcacacgtgggctcctactagcaagatgagcaggaaagggaggagagggaggagttgaatgaaaccttcacagagaccaacttctgcagattccatgggcgacattgcctcttcgaagcagcaggatggaggacgtgggggtgccacccagcctgtacaccaaagacacttcccactcaccagttgtggctgtgtgctcttgattgcaaacctctggtacccatcacagatgtattatcaattttcaaagggattcgtatacaataaaatacactcaacaagaaaaccacccagaacgcaatgaatcattctttgatgattcagaaggcactttaggatcctgtagtgccttaggggcagcattacaaacatcaattatcttatggtaaatgtgtagaacagctagttcacaagttaagaaagagctgggcaactctcttttatgatatgtttttttaaaaaattatgttttatcccaggccttttctactttcaagctcttgcccagaatgttgcttctatttttgcaaaaatggctcacttaccagcttggagaagtacctctcctatggtgtgcctgagtaagtaaaactgaagttgtctcattttcctatgagccatttctgggggtagacttctgtcctgtccttctcccctaaccatttaggtatgcctctaattaaattcaaaacactatatgagaattttggtctgacaaagatgacaaatatttgtttagaaagctcagtcaggtggcacacttatgcacggttcagtttcaaatgttccttaaaaccaggagggtgtgtgattctattgaattcaggccaattgcaagctaagtttctccctctttgcaaactacagtagttggtaatgaaaaaaaaaaagtctagtccttggaaatcaagttcttgagcacttttgaaaacagactaatccaaaacatctgcaagaattttatctttaaaaacccaggtgtctaaaacataaggggaaaaatatacaaatgagactttgtcaaccaagtttttgaaaaacaggtttctagcagaaaaagaagcatctagaataaaatgcagctggctttatgaatctttattttccatggtgattcttcctttttggtcttcaacaaagaatggaatttctaggtgagtcttgtcagattttccaaaagtactattaaactaaaacgaggggattccaggcaagataacatctctgggaggctcaactctggcttgaatttattaaaaacttctggttcttaatttaaattttaatggtggtagacccaaagcagccagacacgaaggttatggtatcagatgtgaataactgaagacagatgtgctgtatttctatcaaaccagaggcctgggccttgccccatctatggtgaaaggtcaccagaattcagagaaaggaggacatattacagccaactgtgtgcctttaaagaagtgcatgaaacacacacagtacacacacacacacccacgcacacacacaccacacacacagggaataaaggagcatctccaggttgcttatacacatatttactcctactattacaaggtgagcctacacatgatctaaagaaatgtcattttacttgaagctactgtggctttgtagctacattttcttacaagttcaatatcatctaaccgctaccctaaaattatgtctgcaagggggactattggtatttcgtaaactgctgctgcttctcctctttctctgttagacatggtctaatgggtttagaaaatgacattcaagatgctgctttgccaattagaacttccgctacctgattcttgaaggacatagcacgcctaattgtgtgctcagacattttattaagttgttttgagtgctgaaagtcttttaaccttcatatagacccatattcataaacaaaaatgttttcagggaaaaaataacagggaaaaaggcatttaattacaaataaaagtactgtttccaatatgcacagatttttttttttttttttttttttttttttttaaccaacctaccaaagcaaaggcaggctgcagatggtgaaaactgagttgggaaaactgcacagatattttcccaaaacgttctcagcgatgctgcaaatgccattctgggtagccgagaggaaaagacagcaagcatcatcttgccaggggcagaacctattcccaagccactttgagagcaggagttgaacaaatatgatttagatgtttcccccgccctggaaacatggtcttgggttaaccggtccttggacaaatttaagaacagtgtctcctaccagggaaattatctcatgcaagaaaaaaagttcccttaagcatcaaattatttttccttaactttcttttagaaagtttccttttcaaagtttaggaggttacacagcatgttaaactcttgacgagatctaaggcagaggagcgaggaggttcgctgctgccagccttccaagagaacccagtcattaaggagccccaactgtcaccaatcatacggatccccatgtgggacacactttagcatgaacacaaccttgcctcggaaagcatacgtgggaaaatatgccaggggggtagctccccaattctcctgcccaaagatgtttgccatagactacgctgactggcccattcaggagcccctcgggtttccgctggacctacccttctgatttgagatcatccacgtgttttcccacctccggaggcttttattttctgcttcctcccttcttagtacagtgccaatcactgctctcccccgccgcccccctccccaaaggctctctgaggctgctccctttgtgattggcatctcattaatgaagaagggctggtgtctctcattacagttagagtgagtgagaggacctcagaactaatttacttgctctcactagggaagacacttgcctccatcaagaacttcactttcctgctgcctgtggcaataaaagaacccgttttgttttaacattaataaggtgagagaatagagaatttccaaaagaaattaagaaaggcaagagggtaggtgttggcccatggaagtttccctaaagcaggtctgatggcggagttcagtgagaggcctttgatgcggcaacatctggaccacatgaaaaaaagcctagcaggcaaatgagagactggccaagcagagaggctggggtgggaagcggggggtatgggttctaatcctaggtcctaagtccctgagtgaccttgggcgagtctttgatttttctctggtcctcaattttactatcagtaaaataaaggaatggaataaaatggtcttttagggttctctcagctcgaaaattttaatattctgtaaatggggctctggactatttaaaacttttttcatgtttggagtgagttttttttttatctctggcaacaaattagaaattcctccagaattaaagagcatggaatggaaatcatttggcttctccagctgaaaaggtcaactagattcagaaatgtactccaaggctgcactgtctgcatggaaacctaattagagatgatacttcattggctaaaagggatcaaacttatctgagctttcatctggatatgtatttttaaaaaattactctgagttactaattcatttatctttctacttacaggaaattccactcattgataaagctcggcttcgacgcccctgctcacaatgaaataccttccttgccaaccacattgctttatgatcgtgcccctttaccacattgtacttgaaatgccttgtcatttaagaaaccataaaaacgacgtctttaaaaatgggttcatcatttagctggagatggcttctgtgcctggaaccagaagcctgtcctctcggtggtatgcctccacaaaaggaagcgagctaccacaaaggacagcatcatgtgttgccttcattgctattgaatcgggaagttggtgcccagtttcaacatggatgacaaagtagtgggaatctgaaatgcctacagtagaagtaagggtgtctttatattgggaatatcctcgatcccagggcccatttctaattcccccttctctctttccctgatacaggctatttttgaacgagaaggactttggctcaaatcaacagtttggtttcttactgtttacatctatgagtcaaagtagcttgctcccaggatcccccaccaaaccgaatgaaaataaattcaatgtgtgcccactgagcctggcctgggagttcttgagatcaactcagaatcatggtctttctgtcactcccaaaacaatcctacctaattctacttgttcctaagtattgccttaggatactgacagtcttttctcctacttacagcttttgaatgaaattaaagctaatcctctctggcttggtcgggtcttgtgtaagattcccacaccccacaatcaaggccttgcaatgtggtgttagaagagatagccaagttaccacacctgtatcacgattcggataaggatagtattttttgccttccatgagacagctttgaaaacctgagtcacagaagctgcttcatgcaaatccttccactttcctcctcactgccagtacattggcacctccttcttaaaatgagaagagaagcataaacaagacctctgtggacctcagaataaaatgtaagatcttcagatttccatcgcatgatttcaccaggccaaggcagcccagcttcatttttacgtgcactgtggttctaagtatttacagtggtgtaacccgctcccccacctaaccccccaatatcggtactttactcactcagcttctagtgagaagaataaacaaaaagaatcaaagagaagaaggcaagaaaccggggaccaattttcagctcatcctttccttcttaaaagaaggaattcgcctgcagtgtctgtaatttagaaggttttaatgaatggcttctaaattatttattacgcatagaaagctgtaaacatccctctctgaaccattatgatattatctgggcaggagtcaaaaggttcaaacatttggcacttttcactggactgttgttgaaaatagttctgctctgtgaatgtaacttctctccttccttgttatatggaattgtgtgtgagcctgtgagcctgcgagcctgtgtctgtatcattcacttgagatcgtcaaaaggcatcctggctttgtaatttgctcttttgcagactttcgacttaataagagattccaaaattagtaaaaaaaaatataataaagtaaaataaagccaatttaaaaagccttcgacagaatatacaaactggatattcaagcagaagtgtttgaaatgcctcagcctcatttcaaagagcttcctgctgtcaagcccaaacacccagacaggtagactgctgtgaaatatgtaggcgatgcctgctgcctgattttcagatggcgaggaggcatttgaaagcatcaaagttccctgtatagatgtgtgtacattaatccctgcctctgtgatctctgcactcgcctattgtaacttgctgtttaatagattgccaaactttgcccttcacagactgcactttttttttttttcccaaggatctgctcctctcccaggagcttcttgctggggccgagttttaaaagttttcattcctgggcttgtgctatggcattgggtcactctttgaattctgcacttttgaacacctcacttgttggcttgcttttcctcgcccctggtgtcgatgtctgtatgtggctaaagtcagtgccctccaaccatgaagcatctgccatgagccagccctgatacgaatcattaacaaccacagcactagccctgtaagagcctgtaatgtagtgggagagaagatagagatcaaaggctgtcaactggcagcccacaggttgtgtatggcccaaagacatgtactgttttgcctacactgtgttttaaattcagattagtaactaacacagaaaagatgggaaatttcacttagaaatctgtgcttcaagcttctcttggaaaattggaaggtgtgattaaatagggcttcctgcctgcatgggtcctgttttagttgggatatatatttttttctagactgaggtggtggaacagttaccattaaggacctcagccttggctttcttgatatcttgatgttacctgctgggacattggccttttgagtctgtggtccatgataaggacacacacaaaggcaaatactaactggaaaatttgggggataccagcaggtactctaaatatgtcatctcatttgatcttctaaacacatctacaaatctgccattataatatccacttcacacatgaaaagttgaggctgtttttaagtaccttgccctatttcacacagctgacgatagaggagttgggtgtggaactagagctattagctttgaagcatccttcttttcaattagaaaggcaagaaagtccccaggaagggtgcaatatgggctgccagatctcacattgtcttctcccactgaaactcaactctgctctagtctaaccacaccacacttctcactgtacccgaggtattcttggtcatttgatcacttcttgtgtttgtgtattctattccctgtcctcaccttctcttttgtacctgcaaactcccttcttgctttgcaaaaccaagaataattgttagttcctttatgaagattttcatgacccctgggtcagtttgtctaacactggggctcctagagcctccatttctactcaggtgtctcgtggtaaaaggtccgtacactggtggcttttcactggactgtcagttccttaagggcagggccacatctcgttcatcactctacaccaccatgcccagcacagatgcctgatatgcaggaagtactactccatgcagggtggcctatgggtggagttttcctggctgaatcacacacttatcaagggctccttgggggaagtgaaattgaattggaagggtcaacagtaaattctatctgtgttttcatttgttttctcatcccccatcatgacaccctcgcttatcctccaaactttttgcttaacaagactttgccgctgcctcctcttttgccagatggcaatgcactcactacttccaatacccagatacatccatcaagcaacttcaaatttgaaacacatcagaaacttgctgggcatggaacaggtaatgaggaaatggcatatgtgcactgtgggatcgtgatggggctgtaaagttaatcaagaaagaaacaattccaccaagagcttgtgaacgtacctgaaaggatgggcaggtttgtccaggtgtgagccgtaggctggctgaatgtctctttctcatgtgggttatgggaaaccaatatgcctccaaatcactggctggacctcaactgaactttcagtttttattttccactcccatactatttttgaaagcgttaaataattgcctctacagctaagcactaaaggcctcatttaacaaaaatcaatatggagcagtacaagcatggaataaaccaaaccagaggccaaagcttaaaatccatctcacaactgaatcataagtggtaaaattaagagcaggtgcactgacagacagaggtgaaggctggcctgataaaatggatttttgttatttctaatgaactcatcacatgcagacaatgagaaaggactgaccaggtgggagggaggagctgactttggcaatgatgtgtcttctccacacaatgattatttcaagaaaggatgcagagtagaggctgtagtacatttaggggagtttcaatcggcattatttcatttctcctccctaacaaatcttcactgaatgtgtactgcatgtgtggttatttttaaaacgtgcacagtgaacacagcttgtgaaacttcggtcaacatcctaatcaggcaactaatgccctattcaagattggtgtacgctagcgaccacattttagaacgattttacctggtgtgaacagagagtaaagaagggccacccctttcccttaataacaggttcttagctgttagtcccaggaagtaaagcaaaggcaaatgaacttccatgataaatatttaagaaaaataatctttaattgagttagaatgaaagtaaatgtgcaaactgctatttgagataactgtctcgataagcctcttgcaaatataatatgaagcagaaaacctgttaactctttttgtctcgtctttattcaccagggttaggtgctcttacatggtagggggaatctggactagtaatatctcgatgaagttgcaaaaagaacaacaaaaaaaacccatttggttgagcactgtgagctgacatatgcacctgtaagccaagataactacagagctgctctgcaaatttggttagggtttaggggataatcttagactaataaaataaaccatccttgaatgttctagtcaccaggtagcagaagcctgcttaggtctcagtggattccttctttctggtctcattggcagttagatattgatgttataaactctcatgccacgagtgtgcctctctgatgtctgatatccatttggaatcacctcggaaaactcactattaccagcagtttcttcaagcagaccaccctctatgctcctgaatgttctctgaccaggctgggcctttcttttcctctaataattagccacccattgtccccctccaatttcttccaaccctgtttcctaccccttgcatttttcttgcttctttcattttccctgtgtatgctgactgcctagttcctcttctactaaattatgctctattatttccactgcctgaagaactcacagctgaagcattatttctaaccttattttgtattcctagcatgtgctataacctgttttgagttttatttgcagccaagatgctgacacagctccaattttgttttcatattttgattgggtaggagtgttcattactgtgggtactagggtagggaagaaaagtcattttaaaaaggcacaatttacaccttcgttaaagggctttttgtttctgaatgctgcccatttaaattctaaaaactacaaatgttcaaaaaagatattcctttttttttcttggagaaaagagattttaatgaaaattatagaagtccaatgtaattttcctattatgtttttaatgttgtgcctattatgtctgatctccttttgtgtttcttaactgaccagcacatacaggcaggtgtggaaagcctagaagtcaggggtttgtaagaaattatgttttcaaagcccagttcagctctacattaaccagccttcccagggacaactgcctcatttgtgacattattgaattcatggttcatattaagcttatatctcataaccaggtaattcatgagtttcagctacagggaaccccttagatggggcataaaatttccaatgagctttcccataaaggaaagtgtaggatgagtgaggtttcgtgctcctttacgtttgtttgttttttagagacccagtctcattttgttgcccaggctggagctcagtggctactcacaggcccaatcatagtgcactgcagcctcaaactcctgggcacaagagatcctcctgcctcagcctcctgagtagctgagactacgtgaatgcttcaccatgcctggctagttttcacggctcttgatgtatgattctcaggctcctttttggaagagatttaatttcatgggactcctctactccaaaatcttcaagaactccacagttaaggttgtcaggtaaaatgctagatacccaggtacatttgaatttcagataagcaccaaataatatttttgtataagtatgtcacatgcaatatttgggacataattatatcaaaaattattctttgtttatctgaaactcaaacctctctgggcatgttgtatttttatttgctaaatctggcaaccctatccatagcgcataagggaacaagctttaactcttaaggtaggacttctgggtcccccatagactgactctcttttctttctgccttattttctgctatatccaactccccctaccctccattccactgagtttgagttactttcccatctggaatgcctcctttccttctctcgccctggattattcaagactgcctcctcagggaagccttccctgaacactcagccaaaagtaatctcttggtctttttagaccagtgagctcgttctgtgtggcccattcattggtacatctcacacacttgcctgggagcttagctatcatttcatctctatactgtattctttccaagaggacacaagctcttgggtagcagtgaccttgccttatgtttctttgtgcactttgcagtgtccagcactaggcctttcatatagttggtgctcaagggatacctagtgatagaaaaggccactattgattgtcaccgagctgctctcttttgcagcttcatgtttctcacacttctttccctgcattgagggaaggctcaacctgttctccagaatgttagcacgaaccccatacatgaacttcatcatatacctcattaaaaacttgatagccaggttcatttcccatggacaagtgaataataagtaatacaaaacacagtcttatgtgggcaagccacttgttctctctgtagatcagttgtctcatctgggagaagggcctggttcctcccctacctctcaggatcatgaggatacacgagatcttggaaaaacataggtagcacggtgctgcagtgcatttagtgatgaggccaagaacatggaataaacttctctaagtatattctgtttaaactggatccttgagttgctcatgagaatttcagggtacatgccagcaacaaattttcaaatcatggctgacaaggtgggatttttattttattatttatttttatttttatttatttatattatactttaagttctaggatacaagtgcataacgtgcaggtttgacacataggtatacatgtgccatgttggtttgctgtacccatcaactcgtcatttacattagatatttctcctaacgctatccctcccccaggcccccacccccctgacaggccgcggtgtgtgatgttccccgctttgtgtccaagtgttctcattgttcagttcaaggtgggatttttaaaatgacacaattggagacaaaagtagctggcaagcaggtggcaggattctcttgctaacctagggtactaagtcttggtcactggaaatttatatttaaaaactacctcgtgattgcctggattttagaaatatgcaaaaaataaatttctagggaaaaataccacagagtaataatgtcagctttaactttctttaaaagctgttttaaatgtttctctttaaaaaactattttgcttttcctcgtatgggtacccacacctaccttgtgtgagtcatcatctcatgcaccagggctttcaaaacgtgataagtaaagcaagacgtctactgtatatcttgttaggaacttgctttgcctttttgctcctgttgctctacagaaaagatggagcgttcatgaatggcaaggtgagccacacgtagggggccgtcctagcccagactgcccaacactcctgcaaaacctcatttcactgctggatctacaggcaacccctgcactgcgattcctcctcctcacacccacattccaggctcaattagtggaatcctagtcttatatccacaccatggcagcacattaaaatgtctccgattaagccctggattagcatgtgcccagactttatcttaattgccgattaagattaatcccgccagggagttttccagggctgctttattaccatggggtgaatcattacatagtttgagttgcaagttccatttagctttctttgactaaaatgggagacccagactctcttggcctctaaggaaggggctctttattgctttctgaaaacctcccttgacagctcatttgcacctgaaggttgtgaggatgaagccttgatccatcttgacaagtctatgaaaactggaacacagggagtcacaggctttccggcgggctcttggctttaaaaatctacagtgaactttgacttgaagaatgatctttatatactcggtgctggctttatcattcatagtgatttactgaaaaccttttttttctctctttctcttgctctacatggatgtacatatttgttttctgaaccgtttgaggatatagtatatacatggtcctttagctctacatacttcagtgtgtgtttcccgagaatgggaataatttcttacgcaatcacagctgagttatgaacttcaaaaatttacattggtactttttaccaatcctgattttaccaatacttttactaatattgatttactccaaaatctacttcactaagtgataccccgataactattaagtctggctacaaaagagagaattgaaagcaagagaactctccatgttagaggtaaagtgatgagacctagaaaagagaaataacttagtgaaggtcacacagtggcagaagagtccagacaaactcaagaactcaggggcaacttctagccactgaattgatacgcacataaagactcaagaaaggtcaggtcagtatcgactctggaaacatccagagctaccgggccaagcagacttgacactaccctacctagatatggaaatttcccaagggcagaggccaagaactctgtttttgaaaaggtgtgcttcacatttatgtaatacataagaaagacttgaggatagctatacctgtttcactgaaatacttcttttctcccagctttaagatgctaattgttcatgcaattctgtttggctgtctggggaggcataagtcaggagcattcagcagcagtgtagagatcactaacgtggcacagctgtgagaccctttgacaacagtacgtgcctttggcctgactcagactggaggacctggcggacacccacagccacggcttctggggattcctaaaagggcagttccctgctttctacctcagggaacctgatcatgttatcgctctgaatgggttggcttttgtcagagcatctgggtcaggtgagtctgcgtagtacttttcaatgtcaaggccagtcatgatattcatcgtcaaatctgtggcgccattctgtgatgtctccatctcagaatctgtcctaatccaagagccaacaatggaaatggcttcatcctgagaggccatcaacagagacttcagaaggatcacagaggcccaatctccttcacagatcctccaccagacatcccttcctaaggactcttcctcacatggctgtgggtattcccgcttctgctagtagagtgtatgccaagaaaagagaaagcccgtctctggtttccctaccctgcttactgccctgggcggctaccagtcttagtggtatttgggagtcctaacggatgcacccatatctaggtaacacaaatacccacagtctttatcttcctttacactaaactcatgagatacaccacattggccactggtatttctgaatggacagaagtcatttgctggtctctttctaaaggctgtagtctgccacttccatggtaatttcatcctaaagcagagcctaagaattgaggacgaaagctttctcttttgttgaacccacagcataaccatgttccttagattctattacaaaacaaccattggctttaactggaaacttgaaaatttagggtaattatagtatcaattcatgattactcaacacatttcctcaacttcctttgtgactgatattttgagtatgttactgtaacattcgttgaagaaagtgtgttgtcctgaaacaagtgaggcctgagacaccccacacgtctaagatttcttacctatgattcatgtggctgccagaatatcttttaccttctttcttctttcaacccttctctcttaagttccgtaaacttgtgtcgggcttcctgaatttgccttcagcactagtagtaacgtgactctaaatggatgggttttccatgttattctggtccaagctgcaaaagattagattccccaccgagccctgatggtggtattactaggctttaacttgatgggactgacttcgttaatagaattctctcttcagttgtttgactatgttaatgttgctagaaggaaaaaaacccctgattttcctatatgtaagctgttttcaaatttgcgtgggggttctcttgaacagatctgcagttttcttcctatggagacactacaattaacacgttcctttttctctttataaaaactaatatcttgctaggcactccgccaggagtactgaaatttagttctgataaaaatccttcttggatatttctggtctaagctttaagatctcttttccttctttccctctttgctcttttcccctccctgattaccccctactcaaggcacgagcacacacacgcacaattcatttatgcctaccttggaacagatctgagccaacatattccctggggggaaacaacggtctcttttcctattaatgaacagtatggtgttgcagattcacggagggcttaatttaataaacatggaaagatgaatatgcttatgggacatcaaacctctttaggtttaaaattactgacatagaagaattgtcttgtgaagcaccccgtcctttcatggctgggtcattatggaatacaatgcggcaggggaaaaacatctcctacctggggcttcgactccttctaccctttgactccatctcctccatccctaagtgccagaggaggcgtcagatgtgcagaagtcagcaataactgtgtgtgaactagttcaacctccaattctgtggcttagtccttatcggtaattcgatgggaacctgaaactttgttgaagggaaggtattttgctggctcggctagaattgagtgtagacagcacccacgatattgtgatgaccaaccagcttgagatgaaggcactcatgaccagcttgcaggagcaggcctcgtcccaactcctactccctttctctccccgccactcttattagacacacttcagactgaatcttctgtggttcccacctcactcttcccattcttgagccccttccccttcatcttggactagtttgtcagatggctaggtaatctggcaaggtcttcaggagaggagggaaataaaacaggcggaactctgtccaggcatttaaagacgcaaaaggctgcctgctggggagcaaaggcctgggaggctagtgagcacctacagagagctgggtgctggggagaaagaaaggaaggagcatcagagacttcacaaccaggctttctttaagtacacgtgctcttctgctccttttaaattatgcaaaccaaactgagataggcacagcagagcgtagatcctgcactaaaagggtaagaagcttgcaattgagccgtggctgtaaaaggtaaagacaaggtatggggtccccagggtttggggtccaggtctggttaggggagtggagttcttgtaaagagtccttaaatctttctctaaaccaaggactgtctagacatggcatcagtaacagtgcaattaccgtctttggatttatgcagtcctatccttaccattctgtttaaacctgcaacctgcctccctttttccttgccctatttttcctccttcccttagcacttatcaccttgtaccactatacaatttatttatttcttgtatttactgctaattgtctgtcttctctctgcagaaatatatgctcctccaagacatgagtatttgtctgtttatcttcattgatatatctctagtacctggagtagtgcctagttaataataggtgctgaataaatatttactaaataaatgaatgaatgttattactccttacaagctgtcccatactctaaaacaccaggagccctttaagacgagcaaaaacagagccaaaataactatgcagaaacaaagcataagaatgttcacactttagtcttctctaacaaagtatattccaattagttaagtgaaaagctgaatacaaaacaaaataagacccggaacattagctcaggaagaaacacggatacggagaaatcacaacgagcagcctcatggtatcatggaaaattgatagcctagatatcacgagaccctggttacagtcccagctttgcataaatctgtgtgaccttaggcaaatcaccttgcctctctgggcctcagtttttccagttaagtttgattcaactcaaatatttaatgtgtgctcatttcatcacttctatctctaaaatggcataatcttacctagtcccacctgatattaagatgctaaaatagcctactacctaaatgtgatcatttctgcgagagaaattaagattgcatgcccagccccctatcactgtgggctgcagtccccagatggattacaccttcattttaacatccttattcagcacggtaggcatttactctaagaggtgaagtcgaaagagtcccctcatgcagcagagtccaggtgctcacctctagtaaccactttggagaaccgagaatcaaaccgcaatctcggcagcacagggaatgagtaaaatacccatagtcgaggagcgtattgaactgctgagcaaggggtgtgcaaatactatttcaaatggcttaaaaagcatcacagcaatgtaagtgggttacggttgcctcacaaaagcacatctggaggatctctttgctctcttgcatccttgaatatcgaacccagaaaaataaattgacgtgctgtttaatccaatagtcaatatgagcttctagtgtatagactcaattgacttaaaactcaagctatagcctccggcaagaaaaatgtaacacaactgcgcaggcttggtattgatacatatcacaggtagctgtttcttcagcaagaaacaattatccaatgctcagtgctgagggatcaatgtgcttcataatttctgatgtggcttactgaacagctgggctcaggtttttgtttttgtttgtttgtttgtttgtttgttttttaatctttacgggtctgatggctctctaaagggattaggttattgtgattttttttttcccatgcaaaaggacctgcctttctttccctgttctaacgaaagggcaccccccactgagttccaaagagccgttgccccttaaagtgccctctgccatgcattaccttaggttatgtggcaaacctaaccccatactacagcccagttacctcggtgcagacaactggctgtatttgattgttttgctgttgacaacaggatggattagcagggctagaaattaaagtatattgagtattctttaatgccttatgtacaaatttttctggctgtcagattctctgtttggctttctcggggccttgaaggtagggggtcaggaactaagtgttttgagaactgacagctccctttagcgaaaaacagaattctcccacccttaccccttcccagttcaaagaactgcttcctgcttctttgcatggaagatagttactgtttttctctttcccttttgagtcaggatccctggagagccttataagagcacagtgtctactggttaaagggtaaccattttcagggaatttgcattaatctgattacattttatcttccttcagggtgagggagtgggacggactgtgaggtttcctttgagtttcaggtttagacacaccccagaactcaaagtaaaaatgatataggcttaataataacttcccaagaagccttttcaagttcaaagtggattgtaaacattaattaatcaattcctcctcccaacactgtgtgaggtatgaattactcccattttatagacgagaatgtttaggtagcgagcataaataactcgtttcaagcctaaattggacttctagtcagtaaggcacaagcaatttggattgctgtgcaaagtgaaggctcatcagacttttctcattcacaaaaattaatgaaaacccgtcctaggaacccaaggctcgttgtctccctggagtgatccgagtggcctctcccaggttggcccaactcttatctttttgcatcctcagttttctggccagaaagaattgccttcctccaacacaaccacaaggagttcagatcaaaggctcaccaatggtccatttaaatgcccagggcagtctaatgcatctctccataagactccctgaatggaggcttgggttttaccggcccagccctgccatcgaagtcatttgcaatccaggctgctcactgcacctgctgctgtggaagatgtaataggagcaggaagcaccatagaaggggaaatgctgtttggcacaagtaagtaaacagataggttaacaggccaacacatcttgcagcctttcactatatgaacctgttggctaatgttagtaatccacacttcttctacaaaagtcaagctggtggtcactttgcaggaaactctacaaggtttttctcaagacagtcctagcaatgaagcttccaacaaacttaacatggttctacatttccccaggaattgctgtaaactgataagcactgatattctttccattgactaaaacatcatgatcagtcaactgaggcctgggaggaatgatctttgtggctcatatgcaccaaggaggtttgcctcaactcgaagggtggagacactcagatttcagccttccctcatcagaaacacatttcctcatttggatatgtgttttccaaagcacttgggggttttcagcaaatctttatacatctcatggaagtaagaagaaaaaatactcatacttcacagaatacatgtgacatgtgtctgttaggtggggagagggtggggaggaggagttttagctgagctgtaatgaatatgagaaattaaagataaatagagggagagaattttctttcttttttgccacgctgggagtggaaaagtttggcctagtggatctctaccctggctgcttatcaaaaccatctggagaacttttggagactcttatgtccaattcagttctactgcatttgcttctctggaactagggcctatgcgggagtattttttaaaaaagttccacatggactggtgatgtgcagacaggcctgggaaccactgggctggtctagagagcccagtgtagacagtgaacatccgcatgtaagatacatgacctgtcagagaacattcaagagggaagttcctttaaaaagaatcaggcgagcttctcctcgcctaatagcttccaactagcatcagtgttcaattaataatgtagttttatttgatgtttcatgtgagaaactatttaaaaacaagaactctttcattctttttttcatttaaatggactcaaaagaaacaatttgcttgatagatgagcacaatgagggattctatgaccgtaaaataactgaaaatgaaaaatgattaaaacaacaaaacaaaaaccacacttctccatctgcaatccacatccgtgtagccatgtagtcgtaaaatttattgagggtctattgtgtttcaggaactatgcatgaatctagcagtgccagggtgaggcagacacggtccctacatgctagtgtcacccattctagcaagggaagggacaaccaaagagaaaaagcactctgataaaagctgatttttacttgcctcttaccaggggtcatgcaatcttccaagtgctttttgttccatatctcattttgtcttcacagtaactttagtaggtggattctattattatccccatttcacagatggggaactaagacttagaggacttcagtaacttcttgaaggtaacaaaacctgtaaaaaggagagctgcatcttttggactcagtagatcaaacatatacatccgcctccttctgcttcttaagtgcatagaaggtatgctgaggctggctggtcgtgctagggtggagtggggacgactgagcctatccttgtctcttgttaagtcactgctgctccaggtgagaacaaactcatctctggtgcccgcagctttcagggttggtgttgaggaatccccttccccttgaacttgcatgctttatggttagcagtgcctttgaggccacacacataagcgaggaaggaaaacataaccagcccagagtcctcgtgctggggcttaatttggtacctgagagtcattcattccagttcccggggcaggactctgcctggcctgcttaccagtgtttcagcagcacggaggggacccagccagcccacagagttaagcgcagctgatctgtaactccaagtcatctatttatcccctaaccgtgctgctccacgggcaagtgcagggacggagaacgcacgctttgccacagttcagtgagccgagtgcaagctcccttaacttggctgtggtgtcaagtcacagttatataacccctgggctgagtgcctccctggggtggggggtagggggcgggcaacgggggagcaggaaaggcattattagtataatgttaagaaaacagactctgacatcctccagagtttgagagtctggaactgtttgtttcccatttagtttgtttcccactttgttctacaatcttcaaatcccagattttggagtctgggcagctgtgggtggggagcccagcagcgtgaactggactcagcccctttcaggcagtgggcttatttagctttaagaaatgtcccaggccgggtacggcggttcacgcctgtaatcccagcactctgggaggccgacgagggcggatcacgaggtcaagagatagagaccatcctggccaaaatggtgaaaccccgtctctactaaaaatacagaaattagtcaggcgtggtggcaggcacctgtagtcccagctacttgggaggctgaggcagaagaattgcttgaacctgggaggcggaggttgcagtgagctgagatcgcgccactgcactccagactggcgacagagtgagactccaactcagcaaaaaaagaaaaaaaaagaaatgcccgttgcacgactgttttcagaagaccaatgattaagagcacgtgaaaattaatgcacaaatacagctaaggaagtgtaccatatagcttttgcaaccactcttttgctttgaaagtgttaaagtacacaactggaaagatggaaagacctgagattgacggcattgtagatacttctggaaacttttcaataaggacagcagaataaacaaatatgttctcctttcacgatctttattttggtaagtccgtttctcttggccacaagaattacaaccatcttttcatttttttaactgcaaaggcggtcatatgatatgaagtcactccatatcacagaaatcagttgaagttttattcatggagactcttccacagctgccatctgcccctccctctatgagaagcaaagtttcccgaagacaacccctctctcaaatgtggccctaaaacatttttaatgagtagtaagagataagtgaacatgtgggaaaatgttcatccctgctagtaataaaaaatgcaaattaaagcaactttgaaaaggtaacatttcagttttcggaaataataccctaatgctggccaagctgcatggaaactgatagactcaaatgctataggcattgagttaaaccagcataattcttcttgaaagaaatatggcaattggtaaccaaaattataaagatgtgcatatcccgacccagcagccttctctgggactatacgctaaggaaataatctgacagaagcaaaatactacacaaattgtactactgcctttaatgatcaaatctaatcacagacatacacacaaaattccagaaggagcctaatgttcaataatgggggatggcttagcaaattctggtatattgataatggaatagtaaaaaaaagaaatcaaactgcaaatacaaagggggtgcatgtaagatctaatgtcactggaatcagaggatttacttgaatgtttttatcttttttttaatataccaaagaaataaaggcttttgtacagactgtactaggaggcccttaaaacagctgttttcttgtccacctcatctctgcaaaggggtgtttatttcttttctatttaaaaattaattaaattttattgacaaaaattatatgtatttattgtgtgctacacaatgttttgcaatatgtaaacattatgaaatggctaaattgagctaattcacatatgcattacctcccaaacagtattttttgtggtgagaacacttaaaacacaaaggggcttttattaaggattttgaaaatgaaaataatgaaatacagagggtcaccaagatcacgctggatacaggaagaaggcttaaaacgtcgcatccttgagtctctggtctaagtcaggtccttggcctttgagtctcacctttgcagaggacctcttccattttcccacatgggatgactttgaaaggtgctaaaatggggccccactctcctcatactagccacatgagctcacatccattcaggtcctggaagtacctccagtaagggcctgagaaaactttaaatgccagggtttcagaacctttcagatcaacaacctgtctgttagccaccctgaaatgaaggaaacccagatccatgtggctaatcatcttttcaagactggcaaagaagagaatttgtacgcatgataataaaccattcccacaattagtttaacacaatgatttctggtcaaacctaggggagccatccctcctttacatcaacggcttccacatgctggtcagtaaacagtatgggcaggcccatgctttggttctcactggtctgtatctaactggggaaaataaggataacataataagtttccacgaagctaaatatattcaaaggagagaattattccttactctaagataatgtcctttctattttttcagtccccaaagtccactttttaggggaaagatgacaaaaaatagatggagttattttgttgttgttgttgttcatgttattcctttgcagtaaaatatagggaccctgtattggcctccccaaatgttactgaaatcatactgcttcattaagcacattaaccttggatcttccattcaatgggggagatggagattctggacattccaattgggtcactccaaactgtgtggcaaaaagttctggtcctgctggcatttcaaactgtgctgcacaaccattatagagctttgattccatcactgtgtctgtctgtctaccctacctggctgtgagcatctttgcccaggaaccactgcctgattcacccttctgtttctggtgactagcccagcactgagtgtactgttgttagactgaatccatagttggatgtacaatatgggtgaaatgcaaagaacagctgtaaaattgaagagaaagctttcagtgttggttcagaagacctaattagcatcctggttctgctatttaacagctgtatgacttgagcagtgactctctctcatactaatttcttttctttaaagtagaaaaccaacctaacctctataaagtagaaatgtcgcctatgcccttcaccagtatcctagctgtgtccttgtgtgaagggtcatgtgaaagtgcctatacatacatgttaatttcattcatttctctccattttattccctgaccagatgcttctcatatttagatgtcacccctgtcccagccctggcgagaggaaattacaaagcaaaaagccagatcccccaacccaaggatgtggaagtccagaggcagctgtcagcatgcttcaattaaagacaaaatcaaatacaagcagcatccgtttgcatttactcacgattattgtgtttgacaagataacctgtacccacttgtacattcattacagagcttctgaaatgatttttctttgtctgtgaacataggaatttttaatgaacagtttcagtgtctggtttcatgcactcgaaaagtaaacatcagtgagcatctttctaacaggcttgatccatgccctcagatggtctaccaggaggcagacttgtgtgggtttgaaactttcttcctgaggtcactgatggaaacaaagaaggagaaactttcagcatcccctttccagtgataaacattttaaataaatgaataggtaaacagagaagggatctcaattttaattgctagtaagtgaggcataaaaaggaaaagagagagttgtaactgccaggacaatctcatgcattcttttgaacagattcatctacaaatgaatgtggcacaaggaaatgtcaggtgttctgcaagcagtagctcaggaagctcaagtcaggtctctcgtctgtccctccagctagctacatctcacatcatgcttcctcacgtttcagggctgcagcctcggtagccttcacccagttcctcaaatacataatccttcctctatccacaggacctttgcatatcacactccctttgtctggttcagtcctattcatgtttccgatcatcgcttcctcggggaagcattcctcccctccatattgaggctaaagtatttccaggggacaaatccttcattgcgtttgtcactgttgttgttttacattgatttggtggcaatctgacaagctctgtctcctgcagaagactgtatgctccgcacaacagggcctgtgtctctgttctccatctcatctctggcacctcacaaggttggtactcagtataactatttgttaggcactaaatgaatggaatgaatggatccctgacaaataacttcaccaaaatcttttattaaagacttgcctttgcaaggaaccctgtggaatacgccaaaagacatggttccaggcctctgggggcttcatcagctgtagatgtcatgtttatacatacacgacatcactacggttgagagttgggctgtatcagtgtacaggagtgctctggataggatgttctaccttggacaagccactaaatacatctgtccctccatttccccattgatcaaatggtgacaatatcagtgtgctccttgttgaaaggtcaggggataaaacaagataacagaaacaaaaatgcctcaaaaagataaatattactaataccttttacctaaaagtatccacctccttaaccaactctacaaagagtcttgagcctcgctagagaaacacgatggaagctactctctttgtgagatgcaccttgcacagcaggagtgggctgggccaagttgggggcacagtccaggcaggtgggaagacagagatggggctactctagagagctaaaggacaccaaccttctgccaccagggccagccagggttgacagtggatcacgtggcctccctgaaatagggctactgagcagcttcgtgatgcacagagacccaggggaaaggagcaaagggccagatcctgctgcaaaacacactgcccatctgccctgaggtctgtcattcctccagtggtccttgggccctgtcttgcctgggactggcaaacaaacaggaggcctcctccctccctgatgctcacccgactggatccacacctcactcagcaacagctgtgcgagtgcaggtaaagtctttctggagtctcagctcgtgataggcatttagcaaccttcccagcggaggtgtggagcagacgaatgatcacagagtgagaaccatggcttttctcagggtcagtgtctcaggaaccatggggtggtgtgtgagtggaatcttgtcagtgttttgtgaagatacctaagactttcagtctatagctctgagaatgtcatcccattttacaaatgagaaacagagaggttaataagcaaatctacagcaagtcatttaatgctgcaaaggtgtagtccatggaaagagatctaacaggaaaactcaagagaaatgctggggagcgccatggggccaacagaacagaaggccctgttactgctcaagcagctgccaccaagcctgcgagctcaaggatgctgggctggctgagggacagatgtggcaggcatgcacgcgattcaacaatgcaacagtccctttcttgtttgtttggaaaggttgtacccgcctcgaatgctagcagcaatcacgaaggagccactaactgtggcatttcttcacaacatttcccctgcaactgcggtcaaggtggagggatggccacaaccagtcatcttttctgagtgttcctctgcaaggggtggagtggggacagcatacgttagtgggctaagaatttgcttatctaacagaaatacagcttaactaaccaagggatacatacaattgttcttacaaattctgcaacccatactgagcacttataaaggccaggccctgtgagagatactgaaaatgcaaagctgaataaggcaccttgactgctttcaaggagatctttcctaattggctaggagaggatataacccaaaatttacagctgccttttggcaagcctatcactgcaatctacaaggtgctatgagaacttcagggaaggagaaactctgtgggaagagcctaggaaaccttccccaaacaaggcattgaggaaagagtggaagttcatcaggcatcagaaaaaccattcattcatgtattaacattcaacaaatacttaagaagtattgattgtgctgggcacccttgtggctgctggggatactgcagtgggtgaaacagcccagttcctaccctcatggagctaagtctggtggcagtgataggcacacaaatagtgaatcacaaacttggagaggtctatgaaggagaagtacaaggtgtctgaaaagtatctatctggggagctgatcatgtctgagaggcagaagaagcttcggtggggatgtgacatttgagccgagacaggaaggatgctgaaagcaggggtaggctgaaatttccgggctgagtgagcatcatgtgcattcatccactccactgacatttatgaagaacatgttgttgcaccagggtccctgatgatgcacaagacacatctctgacctcaaggagcacacagtcgagtggggagacagatgattgcaatagaatgtgctaagttcatggctggtggggtggggaatgctttcccattagagggaacagtgtgtgcaaaggccaggaacgcacagctcaagacattttagtgggaagttaagggttccaaactcccctcgattgactgctatgtgacgtgtgcttgacctatcatctttctttttcttgcttaagaacgaaactcctttctctactaatcacggtgttgctgcaccaagaagaagccgcctcagcaaatgctgacgcatgcattttgcagtgagctggaagtgcctggcctagcttggcctgtgcctccctcctttcctccccaggcaggatccacacagtcatcagcaccacggggctgattgcttaaagaaggcaccctccctgcctcattgctccaagctggcctcagcccaggtacctcagccacacccacggcccatccaaacctgctgtctgagggtcagagcccccttccatgagaaagcccctgtcccgcttaataacattttctctctgcctgtctaattaactccgtcactgtatctgcagtcagataaaatgctcatttcacaccacattaatttttatcagctgaacattaagcaacacaaagctatctatgcttggtttaatttacatactgacagacctacaaagcgttacccacagtggctgcgaagcaaataagcagaactggcatcaaacaaggctcttcaaaatgaaatattgatttgcaaggctgacagtaaagaagggttggagggctatgggagaagaagcaaggaatagaagagtgatttttccttgaagaacaattattgatgttgtcaccagtaggcctcccaaaggccaaacagaggagccagctgaggccaggatcccaaggatcaggtgttcccaaggaacacagccccacagtccatactgctccctggaaaaggactctcttcatcctggcatcagaggccatcccagcccgaaggaaaatgccctcaaacagcaaagtattttaatcacatacacaaacacttaatatatcttgcttctgtaactttgctcaagctgtttctctagaagagtcttccttctattccatggccaaactcaagcaccacctcttccaggaagacttccctggacaccctgcttccttacaaatgtgttgccagaattcccagcactgggtctgcattgcaccgactatccataccgtttcttgataatctatatgtatgtttctttatcccacttgttgtgagctctttcagggacagatctaggtttggggcagctgaagtttaagcaagttaggggattttctttaagaagaaagaattgtaaaatatctaacttttgcaaatattacagaaacctataaccatgaaaataaattactaggggcattctcagggctttaggagaggccggtgcaaatgaagggtcctgaagtttaagttttatcagctttgaagtgggtctacttctggtctcttgagtgcaattccttgcttgtaacaagcattcaataaatataggcagcatgaattaaatgaataaagaaaaaggaactactttggggtgcccagtctgtgataggcacagccaaataactttgggaaggatattctcctctaagcagcacagcagcctatagatgatacaaccgataagtgttgaagccagaattgatttccaagactcaccttcctccatctgagaacctatgacccaagagaaaaagaagcaataccccaagtgaaaagacaagtggctcacacaggttaagtctttagactttagaggtcttagcactcataatttcacccagaccagtggttcttccacttttgtgagcatctaaatcacctgactcacttattccatggcagattctctgacctgcaaaccagagagtcgaatttctcatgtctgtataattggagtggagcctgagaatttgtattttaaatgtgtccactcacaatcttggtgcaggttttcgaagactacactttgagaaaccttaactcaactacaaatgttgatgttgaagggaagtgcaccaggagaattaattgggtgagcgctgatggagaggctagtggaaagctgtatttccttcaagaagctgggatgtgactttaacatggtgtggcaccatggcctcaggaagactggggactgacagagaatggaaactgcaagtctagaacctgatgagtaagaaggctgtatacatattttaaagtgcctaggcaagccaccagtttgagaacattcctcgtctttgtgtgactttcaacctgcagatgttttcaactgagtcccccatgaaggagaggagctgaagaccttctcctaccacaggggccaatgctggctgagtattctgctttgctatgttaagaatttcaagaggtagctcctggatatgtaatgcacagcgctcttgtcctggttatatatggcttctcatgaagaaaacttctggcctagcttcaatttcacaattatgcatgctggggcttgtaggtaccagatggttccagggttaccacaggtattttcctttcaacaccatcatggtaacgtttttctcttcagaaatgtctatgaccttcagaggccctagaaacgcccccccattgcccccccaaaaagcttcaaaatccaggactgtctattgtttcattgtcttttgcttgtttggtggtgtttattgggaagaaaatgcaatagatgctttggtatcaaaaagtctggctcttttagaatcaaacgtacataaaactgattgtagaacgagcccaggctgatgtcatgggctctgagttcaggcctgattcagttactacttgggcaagtcacttaacttccctaggtcatctcatctgtgatatagacttgataatattagttctgcctcccagagctgtgttaacggagacaaagtgttttgaaatatctaaatataaatgtaagggctattggcttttggtcataatctactaaccccttacagataacagttaagttatctacacacaataatttttaaaaaccattttcaaggcaatggaatgcagtcaaaagtccaacaggaactggaagggagtctgtcccctgaaacatgaaccttcaccaagtaaaatttatgaatttgtggggttttgtctgggagcactcccaagttagctttcagctctggatagcttgaactgtcagagaaataagtcagaaaaggaacaagaacataaggggagaaattctggaaaggtgggaactgcagaggcagcaagctgcaaaatctatgtacaaaatctgcccaatcctcggctggctgcaaaaatatatgtgcatgagggagactccaagggacccaatacgaagaagcagctggaagctaaaagaacagaaaagtgactttatctgctgtcgaccgcaggaacaacagagctggaatttgagtccaggcaagtcgagtggttgctaaagcaaaaattattttcagagaaacaaacagaatctagggtctctgcaacaatcatttgttttgtctattacccaatccaaagtctccatacatgcaaataaagagtaaaatgtaacacataagaaaaaaaaaagcagtaataaaaaccaaccccaagaatactcagataatgcccttagctgataagtactttaaagaagccattataaatatgttcaacaaattgaaggaaatatatacataataaatgaacagatatgggacttcagtgagaaacagaaactataaaaatgaaccagatagaaatcctagagttgaaaagtagaatgaatataatgaaaaaaaatactactgtatgggcttaacagcagactggagatggcaggaaagagtcaatggacttgaagatgaattaatagaaagtattcaatcttaagaacaaagagaaaataatgaagaagagtgaacagagcctcagtgacttgagcattataaaccatcaaacagtatacatatatgaaatagcaagttccagaagaacagtagagagagaatgaagcagaaaaagtatatttgaaggaacggctgaaaatttaacaagtatggttaaagacatcaacttatagattcaagaaactccgcacatcctaagcaagacaaatacaaagaaaacaatatctagacaaaccacagtcaattttctgaagtcgaaagataaagagaacatcaaaaaagcagccagagacctacagcagaaacaacaatatgaatgatagctatttctctcacaaatagcaaaggccagaagacaacggaataacatctttaaggtacagactgaaaaacattgtcaacccagaattgtatcttcaggaataaagagaaaataaagtcctttttggataaactgagagattcattgccaagagatctgtactaaaagaactggaaaagaaagttctgcagtcttaagggaaatgacaccaaatggtaactcagatctacagggaggagtgaggatcactggaaatgttttctcaaagatgtaagaagttattaatttttccagtgggtagcaaatttataccatataatcatactttgccctatagtaaatgacacattgcctctttgtcacaaaacccctaaattctacaaatactgtctttcctgctcccttcctccccatccccaccactccctcaaaagagagagagagagaaaaaaaaaaagagaaagaaaacttgattttattttctagctgtgtgaccttgggcaaaaagttaacttcttggtgttttagtttcttcatttataacaagaaaaagtggagtaaatgatctcaaaagttccttttggcctgaacatactgtgattcagactaaactggtgcagtatgttaggagtagtcttcatttaatttttactattattatggttacagtaactaagtcttagtcttcatgatcagacaaactcataaaattcattcaagaactaataaggcttagaagtgtcttacacaccaacatcctttggagtctcatcacttaaaaacaacaaaaaaatatgctgccatggctgaagtaatcaaatgaggtaagccacaatacatgtgctctgcaaactgcaatgcccaatgcagacagaggtaaggtggtttgattatcccaactgccagattccctttcacattttcaatatattgatgctggatgccagtttcttaagtcatctcaaacaccaaggaactacattaaaccatatcagaatgtgcttagtcaagtgcgaaagttcactgcacaagtcttgcctgtgtgagaagcagagagtaaggaagccttgagcctccaaggactgggaacagttaattaaatattcagtgtgtccatgtttcacttgggggagaatttatgaaacttcaaagagctttctggtgatttgccacagagatggacttaagccaggctagactccaaggcttactggccaccaaatcctgggaggctgccctggggtagccttcctcagtcctgatgctctgtgacatttgagccgtgcaggctttctctcccgcctcagtgcctctgtgattctgccggattaagcaagcagtgggaagttcctgactcagacagtgcactctagaacgggttctttgaggacctgggtcccagctggctctccaaggtgacagggaaaaggtagaaaaatacagtcccttctttggcagcctttttacaattctgctgagtgccgtgtgttcaactgtttcttttcttccccagaaaacagtcactgcaaataacatgctgtttggtaacaggtctacttaaaatgccacattcatataattatttacaaatactggcataaatgaaataaaggtctgactaaaacagaaaatctcaaagcccaacactattgctttaatgaagagagtagagaaaggctgaataatctgctgtttcaccgcgttcttgagaaaccttttctccctcctgcacacatattccatgtttaatcttccttttttaatttgctcccattacccaacttatagcacataatgaagtatacatatcacctgtgttttcaaatggcttttagatagatttgaacatggtcaccagagaaccattacacctgtgtgtatgctgccctttggaagaaaaacgaccataaagtcctagggaaaaatactgggtgcataccactgagccaaagcttgcttttagatatccaaagcttgcttttagatatccaaacctccactgacgtcaccagctaactgagtccccaatatccctatgagctgcctgcaggtttccgacagcaaaatccaatacatgttcaaaatggcaatcattaatttctaaacgattggccactgtttgttgaataacagtacttctattctgatagggtggagttatcattcaaccagaggcagagaaaaagcacctggcttccttacttgctttctgtttagaagggtgctgtgcctcatgcgcccatatcctagggctcactgctcacaagcaccgtaggcctggagttctgcctgtccactttctgtccttcaaccacacaaatgtggaaaatgggtggtgctgagattctgccctcagaggggttcatttcaaaacaaatcctggaccttagttgctaaaatgcgacaccccttcccactgcttctcaattacataaaaacctcaagaaacctaccataagcactggcatttataatctatcaccattttgctatgcatatagggtgatatcaggtatccaaaatccccacacactagatgtatgccacctcaggaaccgggaaaaagagtccttacctctgaagaaccaacctgaagtttgtggttggtggtggagacagccatagagagaattcaaaatggcaacccgaagtcaatgtttcaaatgggctattcaccttctgtaggctggcaggagctcttcacctttactcctgtgctcaccacgaaacaacaagagcagcagcagcaaataaaaccccaactcaaaatgggctgcttgagatgtagaatttgcttttatattcttcttctctaaactgtgttggaaagggcagccaaaccccgggagagtatttttgagctaagaatttgacaactgtttagactggaagctccctgagggaaggctcagtctttaaactgtatttcgctgaggcacagtttgataccatggtggtatatggtagctaatatgatgcaatgatgaaggagggatctcaaacagccactgatctcctaatatcacaacttcaaacagcttcctgccctccctccctccatggtgagtaaggcagaaacaacaggttgatttgtcaaccacagacaatcagaggaggccttccttatggcgcctccctatatatggcaactcccctcacctagcccaccattctcccctcacctccatccctaccagatgtgacatgccttgtagactgtaaggcactgcaccaccataaaacattacataagacaaagtaatgtaatggagataactttgggaaattacccaaaaggcctcatgcctcggtttcttcagctttcaaatggggatcatactacctgatgtcttgcctacattacaggatcattgtgggtatcaaaatgtgtaaagcctatgcaaatataaccatcatcattataacattttcttaacctttgcatcctcaaaaaagggaagtgcaaagtgaatgtgtggttcttgacagaactgaaagaagcctgaagtaggagtgagacaggccttagctgtggttctgccacgtctcctcctgggtgcgggaaccaggctctctgctctcagtgcctctctgtatcacagtgagggtggtattctagctctgctgggagacacagaatgtatgctggaacaggcttgagctcaagagcttccccatgcacacgactctccaggcactcacccttttgacttccccacatggagaagcctgattctaaacttggagaggtaatgagacctagcaggtcaggctgggccagcccatggcagtgaccaggtcggtataagcttttcacctctgaaaatctttaaactatttgggaaaacaaattactctgaaagaaaatcagacagataccactttatacccactaggatggctatccaccccccgccaaaaaaaaaaagaaataaaataacaagtgttggtaaggaaactggaaaccttatgtgtacatgctggttggaatataacgttgtcactatgtaaagcaatttggtagcccctcaataaatcaaacatagaattatcatatgatcatataatccagcaatttcactcctaggtatatacccaaaagaactcaaagaaagtgttcaaagaaaaacttgtatgcaaatcttcataacagcaccgttcacaattggaaaaaggtagaaacaacctcaatttctcatcaactgatgagtcgatagacaaaatgtggtacattcatacaaaagaatattattcagccacaaaaaaaagaataaaggacccatacaggctacatcctggatgacccttgaaaatattatgctcagtgaaagaagccagtcacaaaaggccacataatatattattccatttatacaaataccatgagtaggtttatcattatttatgtctaaatatattttatttatatatttatataatatataattatattatctatatatttattaattatatttattattattattattatttctgcacagaggcagaaagcagattagtggttgccagtggcagaagggaatgggaaatgggatttccttttgggataattaaaatgtcctggaactagatagtgtcatggttgcataactttgtgattgtcctaaatgctactgaattgcacacttaaaaatgattaaaatggtaagttgtacattatgtgtattataccattaaaaaaaagatagccatacataggtgggaatgaggtggctgggagaagggacagttctggagctcctgtccaggacagccttccaaagccatctttgctgcactgtgtgtgcctttccaagggcctgggttgtacattaattgagaaatgattcctaataagtcccaagaagccacaggtcttttccttacaaacaggaaacaatcacatctcatggcagctcattacacattctttgggtaccatgagttgttttaaaaccgtgaaattagttctggcagagtttacagaaaaacacccatgagatgagactgaatgagttatgtaagacttctcgcactctgcttatgagatattaactccttacgggcccagccaaggacaccggtgtcatttataaagtagtgagcacaccctggttcccaccaagaccagcacgcggttgacaagaagcagcagtggagccctagatctggatgggctcatcgagcaattgccagcttcagcagctaggtacttccttctccacaagaggccggtgaggctgctagccaggtgaagggacttgctcacacaaactggctcaactaaaagttccagtcttttcccaggagttaggctgaccttttggggtggtgcacggaaagctttaaaatcaaccagatgtgtagaagattaatacgatcatcactggcctacagctatgccacaagaccagccccaacccaccaggaagataagtaatctgatccattgagcttgaactctggcattaaggagacacatatttcaaaagtttccgtctggcaatagtcactaaattaattattatacatgagaaaaaaaaacttaattaatgtgtgagccccaaacaatgaaatgagctcagaagctttcctccaccccttccccttcatttccccaacagacacacacacacacacacacacacacacacacacacacacacacacaccacctgcagtgtacttacaaaatatgtatggaatattttacctatgaaatatacttcataatttatttagaaagtagcaaagcattcaaaaatgagtttaaaaagcttgttcaagatttgtctcaggaatcaagtactgaacttggagaaaccttaggactctacttagaatccatggactcttattttagaaataacatgcttagttgtctggttcctgagcactagctcattggaagaggagacagggagcactgcagcaaggtaccctaagcaagaagcaagtattcaccaccagagtgggaagaacagagaggactaaaggcaagcagaagtcaccaaaaaaatggcaccatcccaagcctggagccatgggaagtgccagcaaaccctctcaccctaacaggcagcatggtagcggggaggggacacaggcttaagtatcagacagatccaggtctgaaagccagaccttgctacttattagctgtgcaatattgggtaagttacttcccctctctgacccctaatttccttctaaaaaggaatgatatatccccactctaaagtggaggcaagcatgtgtaacttacagggactttgtgaaaatgggataagttatataatgagctaacaaaggcatctagttattgctcaataaaggacttttttttttttttttaaactcaaggacagtgtattatggcgtgggctgattattcatgctcacaatgagaaccttgagtcatgccgagagggctgacatatagctgtgtcctcagtgagagggcagggaccttccctttaacctaccccaggatcccaatacctcaggcctccgtgccctcgtgctggtctctggaactacactcagactctctatctctctttgaaagctacttgcagctaactattcttctgtaagttatccaataaactaatttatcttaaggtgtcagtgttcaataatagcaaagttttcatgggaatcagttagcaagggggaaccgctataaaccaacagtgatgtttcagcaaaggtgacagactgatgaggaattcacttggggtctgggggccttcttggcgtcctctcaattagactttgtaagcagtttcctttttatggctagcctgaaacattacaatatggagtcgagacacttcatggggcccaagcactggctgttgctgtctggcacgtctttataagagttagatgttgatacacatccactcaaaacacaatagctcctcttctgatcgattcatatttatttatttaattaatttataaactgcattggtccaaaaacattgcgggggagatgagtcactaaggtaaacaagttcagatgccgaaaaatcccaccaccaagatactaagtatatcacatgctacatgccaagatgcactgaaaaatcaaaatcatttatttttctttgtcttactttcccctgcaatctgatgttcttctaaacacccatgtcccagagactgcaatagcagagaggtagataacgagggaggggcacaggaagagacaaatggctgaagcatttcagaatttatcaagatatgtagataggaatggatcagtctttgtcttgctctctgtttctgtctctcagtgcctctatctcttcaaaataataacagaaatattgctaagatcaaattaaaaaattgtctctggctctgtttcctatagagggctgcagccagggctgtgttattcacttgtctatctcctgggcctgcagccatgtgctacaccaagtctgcctctcctcccaacctcgtattcagccaccctcacgttggttgcccaaaactggctacggtgagagtatttacaccacagaaattggcaaacttagacatcagggctttttttttccttccttgctcagtagaacaacttctgtagagttaaacatttcccagcacactactgatacaaatacttgttaaataaacaaaagaagaatgacacgctgttccacttaattcaatcatttccaacacctctctggccctaatcatgacaaacccctctgtaagttcttctccacaacaggatgacatgccctgggattcagttatgaagcagagaaggaaatgccaggaagactaatttaaaacaaaatttcgttttggtaacagcgtctctgactcagctctggtggaaagtatcaaccttataaacccacaaggaagaggtgaagatttcacatcgtttcttcctttgatgttaaaaagagaaccttcttgaaggctgggacagcactgtgagaggagggccaccaggctagcagagagcagtcccttatagcagcctcctcttggtgaactcagggggcgagagactttccctgagcccgagtgtcctggctatagaccagtaactattatagcacctcctctgtctaccccacacagcatctacctcccagccccccaaactcctatttatcctccaggacccagttcatatgccgcccccacctctttgggaagaggcctgctccctcagcatgcaggtctttccccaggtccttcctgtctcaactccagcatttactatgttgggctgcagttagttcttatcgatttggtcactcctctgtccctctgtgaccctctcaagggcaggggccacgttgagcctgcattcccaatactttctgcagtgcttggcacacagcgattgattgctgcatgcctattaaagtgaaccactgaaaaactagacgtgaagggacttttaaactggaaatgtaatctataaagtataaagagttattaccaaaggcagaccacaaaatagagtggcacactactgccaacccttaggaacagcccttacttggcgcagaccctattgaagcatttaatcacctcaccactaggtaaaattcgtgaaaacacctggtgaacttgggtggaaaggttcaattaggaattacagaaaacattctctaagtagtggcctccccctcccccctccttcgacagctttatcccaggtttccacaccctccctgcccacagggctcagaggtaagaatattatataaggaacgaatgctgccttcatttgttttaataaagaaacagcccatttaaagaaacacagactttagtggcttagatatttctgaatgtgaatatgacccagaggctcaggaatacagaacggctgtcttgagaatgagcgtttttttcctatttaaaacattctggaaaattgctctgtatccccatgccaagatgaaaaaataaaaaacataagggctatttggaatgtctctgcattttacagatgactttaatgcataatgttataaagacatgaagctctctggcctcaaatgcccccagtgcagccgcctgaaagcccgggagaggcacgccacggtgtggaatctgtgagcagaccccacaaagaaaactcacggtttcagatgagctttgtggttgttcgtgggctttttagcttacagaagtctcctaagaggatgcaagcaggcttgtgtggaataatcccttaactgtatggtataaaatttgttaatataaaatgataatgatgatgatggtggtgtatctcagtgtaagaagctgttttcacatatatttcatcttgttttatttgacattgcaaccacgttagctaggtaggaaatgaattactgatgttatagatgtggaaaatgatggctgagagagggttgtggctggctccagatctaattgctaggcaatgaatggtctggcaccagagcccagagctactgtacaatgcttggtgggagtgggaagttgggtaaaaacaggcaccactgttaagtagggaagatttgagagaacacaagtgctggatccttacagacccaattctgcacctgggccctgacaaggacaggctacatgatcatgggtcaaccgttacaaccttctggtcaatttcctcatctgcgtatgtgaatagcaattcccaactcatgggttaatatgcagaccgagtgtttgggctccattacagcacaggtaggaaccaaagaagtggtagccattagtattttgtcattatttctagctttacagagggctattggtcctgtaaagaggctcatttcatttgttcattgtgactctgtctgggtgggaattctcctaaatacttcatgaggcccatctctctcttcccctgcagaagctttgccaaggacaaatagctcaagtatctggcttccatgttccgaaggaagaaccttgccttttaaggcataatgtgtgtgtgtgtgtttatgtgcgtgtatgtggcatgtgtgtgtatgtgtatacgtggggtgtatgtgtgtatgtgcatgtcacgagcctggtggcttatgtcttttactcctctttacttttgaaataatattcacctgttgttgtctttttcaaatatttctatgtctacagagatgaaaatctttgcccagattcaataaggcaagaaatcaattaaggttttcatttactgcttagcctcaaaagataagacactgagagaagacctaagaaagtatgtacagtttcctggaggtttcattctgggttctgtgttccagaaaaaataaaacaggaaggaaaacccttacatgtcctatttaaaacctaaatgttttgtttcttttttaaaaaaaaaaatttaaagccataccactttattttgattaatatggacaactccaacaaaagaaagatgcctcaattttttgaagacagtcctaaacctaacagcttggtttttaaatggttacatttaaatatttctttctctattcatttccaaacctgggccataaatcacccttaggaacacaatggcctgtgcctatagcaatttatcatttggataatgtcacttgttcaggtgtgcactaatttatgcctcaaattagaactcctgttggctgaaaccttgcctttcacgtgcacatcctgagcttcggccccttcggaccagctgggaatggtccaggcaaggaagaacctacgcaattcttcactcagggaagggggatggaggtgatgaaaagagagctggggcttaacagttctcttgagttcacttgtttagactcttaatgtttgtggcccaaggatgcaacctattaggaaatactcaacaagtccagactaaagaggaggtccctgcatgcaacgtgcatgtcagcttttgctgctccaagaaaaggcaaggaattgaacagcagtgggttcagagcccacaaggcagcattgcagagcgggagggatgccagagtggctgtcccaagttggaggcctagcgttgctgctaattccctgtcaaatcatctttctgggcctcagtttccctagcagtaaaagaattctaagatcttccttctctggcattctgtgactctctctcaggaggaagtagttgtttattactatagccagctgttattactacctacaacccccatgatatccctattttctccagttacccaaaaagagatggcacagaaacaactcttaagtttctgacccacaatatggagaatcggtacttacacattcggcagggaaatctctatttggaattctccccttctatctccactctatattttctctctttcactgtctctctcttccaaatatgtcaggaagagacaaagcactttctagcaccagcattaaaatgaactaccagggccaggtgcagtggctcatgcctgtaatcccaacactttgagaggccaaggtggcggatcacctgaggtcgggagttcgagaccagcctgaccaatatggagaaaccttgtctctactaaaaatacaaaattagccaggcgtggtggtgggtgcctctaatcccagctacttgggaggcggaggcaggagaattgcttgaacccgggaggcggaggttgcagttagccgagatcacaccacgggactccagcctgggcaacaagagcaaactccatctcaaaaaaaaaaaaaaaaaaaaaaagaactactagttaacacatgtttgctctgtgttagctgttatgtcatagttctttaataaaataaattcatttagtgctcccaacaacttctggaggcccacacgaatcctcttcatttgacaaattaggaaactgaggctcagggaggtaacctgtccaagattgcacagggaatggcagcatctgaatctgaagccagggccatctgaatcccaaatgagtactatttccacagtgctgaaatgagcaagttcgtgaatcagggccatttaaaatgtggctaagtgagtttgattgcttaagctccattggtaattaagatcaacggtagccaagaaggactacaaatatttttgaatttccacaaacgaggggtgtgactatagaattacatatgtatgagattaaacaaccgatttcaagagccacacacaaaaattagtctcattgcattttagccagggtttatatatttgaattgtaaattcagagatcctttctcagttaatatctctttacaactctgtgataatagctcttaaattataataggctctctctttcaatagaagaaaccagaaacctaaaattcacatttgttcattgttcttttgtaatgcagtcattgactttcttatatgtgtagctttaaacacaatttcctcatcgcccaagtaaatcaagggaaaatggcttcccagacacagtttttaaatgcaccagttttgtttaaggcgtgaaaattgtgagaatcccatggatccagggtgatgaatcactgcttccgccagtcacttccccaacctgcagctggagttgtcccaagctgctctctcccacaccccataggcagccatcccctctcaccatgacgccactctcctctgacacgcaagggaacacctgccagagggtgacttcaccatacccagtcactctgacaacagcccaaataaaaccatgtcagtcatttgaaccagaaacaacagtccaacagggctggggaattcaaagtcataggaaagacagagagaaagagggaagagaactgttgccacaaacaattaaaacccaggcacaaataccttaatgtaggaaatgcagggagaaggaggcagccagaagggaggagtcaggagtcagaagggactgggtttgagcccagcacttaccggatgtgcaaccttgggaaacttacctaccttctctgatcttgttgtcctatatgtaggatagaataacaggacccaacacatagagtagttgggattctgagtatttatgtaaaacacttaacacctagttagcactcaatccatgttagctgataatatattgtatcattgatataggattacatggtaggtctatgaacactctagagcccagtaggctcctctctctggcaaactgagcaaaaagagccttggattccagtcctggttttgccactggccagatgaggcaaatcacattacttggtgtcagtttccaattctgccaactaagagggtcatttcaatgccttccaaagacccttttatagctctataatatggtatcttttcctttacacaatgttcaataccaaattggcaacacaagtcacagaagtttaaatctcaggtgttcaggagcctcttcggaggaccaattcttctctctgtcccaggaatctgtagggggtagattgggcaggctttggggcctagcaatgctttgtaaagcctccctcttgattgcttggccaatctgactgcatccctcataagcattttaggcagtgacatgctgccttgaaattcttcctttcagtagaaaagtcagatctgtcaggaggagaataactccctgcttttgatttcttgttaagaacccaaggcgggaaaaaaatgcaaggagattaaaaaaacaaaaacaaaaactttggggcaaaggaaaatacatactctagcagctggctggccaaggtgcccgagtgaaaagcacccacaattctgcacactctgactataagtttttctctgtattaaggtgtctatagctccacccatgaacagcagccacatgcagactaaatcaggccagaccagaatggaatagttaaaacatctcttgccatgccttccggaatgccactcttttaatatcgcagaactcttatcagtattactaacggaaacttctagattgcctgtactgatttctctcccagggagttgcagtggtaatgagaaaaatggcaatgcctgggatctataagacttggtagtttcataaaggaccttatctatacactctcttttgattacctgcaacaatgctacaaagtaggcactgtgggtattattattcccattttacagatggagaaacaaccaacatgctgagtgagttaaggaccagtaggttaggagtagagttagaactggagtcatggctttcttgcttcccatcacatgccctctccctttttggaacaccttttatggacaaaaaggagaaaaaggcaggcttgaaggtgtcaaaggaagaaaattgggccagttttctttgtagtgaggctcctgtctatttagaaaaagtcattcaatgtaccttaaggtaagaaaaaccatctatgacaaacccacagccaacattatactgaatggggaaaagtttaaagcattccccctgagaactgaaacaagacaaggatgcccacttttaccacttctattcaacatagtactggaagtcctagtcagagcaatcagaaaagagaaagaaagaaagggcatccaaatcggtaaagaggaagtcaaactgttgctgtttgctgatgatatgatcctgtacctagaaaaacctaaaggttcatccaaaaagcttctaggtctgatacatgaattcaccaaagtttcaaggtacaaaattaatgtacacatatcagtagccctgctatacaccaacaatgaccaagctgagaatcaaatcaagaactcaactactttcacaatagctgcaaacaaaacaaaacaaaacaaaacaaaaacttaggaatatacctaaccaagaaggtgaaagacctctacaagaaaactacaaaacactgctgaaagaaatcatagatgacacaaacaaatgaaaacatatcccatgctcatggatgggtagaatcgacattgtgaaaatgaccatactgccaaaagcaagctacaaattcaatgcaattctcatcaaaatatcaccatcattcttcacagaactagaaaaaacaatcttaaaattcatatggagccaaaaaagagcccacatagccaaagcaagcctaagcaaaaagaacaaatctggaggcatcacattatctgacttcaaactatactatacggccatagtcaccaaaacagcatgatcttggtataaaaataggcacatagaccaatggaacagaatagagaacccagaaataaagccaaatacttacagccaactgatcttcaacaaagcaaacaaaagcagaaagtggagaaagtacaccctgttcaacaaatggtgctgggataattggcaagccacatgtaggagaatgaaactggatcctcatctttcaccttatacaaatatccactcaagatggatcaaagacttaaatctaagacctgaaacctaaagattctagaagataacatcagaaaaacccttctagacattggcttaggcaaagacttcatgaccaagaacccaaaagcaaatgcaacaaaaacaaagataaatagacgggacttaataaaattaaaaagcttctgcacagcaaaataaataatcagcagaatttacagacaatctacagagtgagagaaaatcttcacagtgtatacttctgacaaaggactaatatccagaatctcaaacaaatgagcaagaaaaaaacaatcccatcaaaaagtgggctaaggacatgaatagacaattctcaaaagaagatacacaaatggccaacaagcatatggaaaaatgctcatcatcactaattatcaggaaaatgcaaatcaaaaccacagtggaataccacttcactcctgcaagaatggacataataaaaaaaatttaaaaaatagatgttagtgctgatgtggtgaaaagggaacacttttacagtgctggtgggaatgtaaactagtacaaccactatggaaaactgggtggagttttcttaaagaactaaaggtagatctaccatttgatccagcaatcctaccactaggtatctacgcagaggaaaataagtcattatatgaaaaagatacttgcacacacacgtttatagcggcacattttacaattgcaaaaatatggaaccagcccaaatgcccatcaatatataaacatatatatgttatatatatgtttataatatataaaacataatttatatatatgtttataacatacattataaacatatatacaaatttatgtgtatatatacacacacacaccatggaatactactcagccacaaaaggaatgaaataatggtgtttgcagcaacgtggaaggaattggtatttgcagcaacctggaaggaattggagattatcattctaagtgaagtaactcaggaatggaaaaccaaacatcgtatgttctcattcatatgtggcagctaagctatgaggacacaaaggcataagaatgacacattggactttggagactcagaggaaatgttggggggtggcgacggataaaagactacacactgggtacagggtacactgctcgggtgatgggtgcaccaaaatctcagaaatcaccactaaagaacttactcatgtaaccaaacgccacttgttcccccaaaacccattgaaaaaataaattaaaaaatgtaaaaagtccttcagctctaaattctataaataaatattccacacatcctaaaaatggccaggtggatatcaaacttgaattggtaaattgtgtggtaccagtggcctgaactacaacaattgacagcaatgtgcacagttaatcccaattctgtgtttttcaaaattcatttatttaaagttgtacctgcacgttaaagagacaaataattctacaaagctttatagaaaaaccaacagtccctgcccatatttcttatcgccaagggcaaccactttcaacttctttagctgattcttttgatatttacctccatatctcgaaataacaggtttatgtaactactttttgatgtttctgttttaggctttatctactgaccttccacgacggaagatgaggtttttgctttctttcaagaactcccacccccaccacacacatgcacatttcctgttccccatcctgccaattgcaatttatcacagttttggttggatcaatattctgtgcttctggttttatgacaatgtaaatgctattcaccaatggggcatgttatatacaatgaatattctctcttttctgtataatattatgttttttttttctggcattaataattaacttttttgcttgcttaattttctctctacttatttcttattcaactccaaactctccaaatgtaagtttcaatgcattcagacaaatcaggtgttctatcagtttcaccttcttgaagctatttccccaggatcctgctgacctgctccagtctagattgttttgtttctgggctgctgtaaggctgttgtgttgtgatttctctttctcatgatcctggggactctcttcactctctattttgttggcttccttgttttttagagcctcctgtctttcttggtttatgccctcaagtttgatggtgcatctttcagtagtctcctgaaagagtgtgtgtaagctaacattttggagaccacacatatctaaaaatgtttttgttctaacctcacattaattaatagtttggttagatagagaattctacactggaaacaattttcctttgggactttgaaaaccttgcttcatcaccctctggtttccatgttgctgttgagacatctaacatgggtctaattcttgatcttttatacaaaagctgctatttttctttggaaaccaagggccttcttgtgtttggtgttctgaaatctcatgatcctgtcttagtgtagatctaacctcaccccttacactgggcatttgagagattcaaggagaaacttcagtgttgggaaattttcctgaatcaccttttgaattattttacccttcccatcccctgcttatttttctctcgttttttgcttctactcttcaatttttaatttattacagctcattattatttttgagtattcctttttttagaacattgttctttgctcatgaatgcaatatctctacttatctttctgtgttttttaaagtcaagggtattccaccctttccctccagttttttttttttcctcccttcgtagtttctgtttcctctaacttgctgctttctctgtatctcacattatatgctttccttaaatgactggtaattcttgtttatctgctctaatttaagagtggggcattaaaaagctgagtgtgatttctgggtacacgaaaggggttcatccactgttagaataatggattaggccatttccttggggagccacaatgccagcttctttggtcttttattcctcttagactagtcagataccacagagaaaattccagttgctgcttagagataaacatctggctgctattgtgtgggagacaagtccgaaagagaaagcagggagtcttcaattaaatacatgaacctatgtcttaaccccactgtttgcacactgtcctgagtccagagacactcagtttcacactacccaaaggataattgtctagctcaggagagggatggtaccatttcctagagtgaatctaggataaaattgctatttcaacagacttttcatccaacttatttttagcccatcgatttcattttcagagatacctggtgccatcagttcttaaacctgcatggcactgggttctgtgataatctgggttttcccccttgctggcttgggattcagctttcctgtatctgataagtcagttatctctattccatctgctttccagctcccaaaatattgttgccaatctattctccactattctttttggtctgtgggttattcttgaaaaagactctttacaaatcattttagtggattttgaggagagaatagaattacacatgtgtatttaatctgctatctctaaccattctgtctaagctccttcattctgtgtttaacatagtaaaacagtcaaatatactttggaccaatgatataatacagaaacattctttgaaaagaaatcttaatccactggaaaactgacagtttctttatggcatttattattacccacatctcaattctcatttctgactagtccatctctgcagaaccggtcctgcccaatggatttataatctgtacctttcaaatacctatttgatcattaatccacagtaagcaatgtgggtgcaaggccagccaaggaccaaggtgtgttaatttcatttactgtctcttgggtggctaacaactttccatctcaggttatttatgcaagttgaatcattttcatattcattattttaacggtgaaatggcaaagttttctaattattaaaaatcccaaagttgaatcaagcagtagcattctttagtttttaagaactgtgcacattgtggggaagcatcacgtgtttataagcatggcatctctgatcacactacctagatttgaatctctgcttccctttgtttgaccccagaaaatctgcttaaccactctgtgccttaatttctccatctataaaatggaaacaacaatagtacttaacctgtaagtttattgtgaaaattaaatgaaagcaaggtgcggtgcctcacacctgtaatcccattactttgggaggatgaggtgggaggaatgcttaagcccaggagtttgagaccagcctgagcaacatactgagaccccatctctacaaatatatatatttttaaaattagacaggcacagtggcgtgtatctgtagtcctagctactgaggaggctgaggtggaagaattgctatagcctaggagttcaaggctgcagtcagccatgatcatgccactgcactccagcctgggcaacagactgaggccctgtgtctaaaaataaataaatcaataaataaagaagagtgaatgaaataatatgtggagaaagcaaattccccagtgactggcacaaagaaagagctcagtagatgttgtcatctcatatttttaaggacttaggaataacatcaataaatatgtattaagtggcttaaggagaccagagacactccctccttgtccactgtgatagaagagaagtagcagtgtcgtctgagagttcaactgtaaattcagcacctagcaggtttgagcagaaatacagaaagtcaggttgaaggaggtattaggtcagagagctctaatgcagtgtaagtgatggaatctggacattggataggtgaacatcatccagaaggggcatgtcctatcattgtaataaaaaaggacactgccagtttctgaactatagtgacaccaccaaggcaacgggactgtgctggtcagaagaggctgtgccctatgataacaaatctctacctctcagtagcttacagaaaaagctttatttcttgattccatcaggtctgatgcagatcggtggtctttctctatcttgtttctctgccatctgcaacatcctgcctccaaaggcaccataggagagaaagagagacagaagaactaggacttgtatcctgtccatttacatcccatttgccaggactcagcctcacggccccaacccaggaatgaggggactgggaaataccatatcctctctgcccaggaagagcagacaggttggtgagggcagagaccattgcaggccactcgctttgtggagttctatctggacgcccagctgctttctccagggaacacctttctgtatcttcattgagtgctcacggttgtgcatgacgggctgtgtttgctcacgtcccacgaagtgtatgggtggcaaagtcttgaaatctgtgtgcttagctctcttaggcttcaaaatagtgagaatctaggcaggtaatgtgttaggagctccaccccagtgctgaatggggtctggaatctgttgactaaaatctagtcttcaaaatgagccccacttaattgtaacctttgcccatcttcccatcagcctgccattgaaatcttagcatacgttgtgtggctgaacttagagtctaactggccacagttgagggagtaaaaactactacagaatactatatctttattataattacctatcagatcaaatgtaataagagcaatattacagtatagtttacaaagtacttttacctgtgttgccttattttatctttgaaataatcctgagaaatagcataattatcataattttatataatagaaaatcaaggctcagagaactgaagcatcacatttaagatcaaaacttgtgttaatttcacctttttctttgtcttttaggtaaatgtcggatactcagtcctgcttagttccatgttatgggggagaacaaggtcttagaacttgaataacatataatctatttggataaaaaggcatactacatatcataaaacaatctatgaagattatgagagaatatattattagggactaatttagctcttctagtccaaaggaacaatgtcacataatgaagacttaactttttatatggcttccaagcctcctacagtgtcatgtctccatgcccttactcaggctgttccttttgcccagaaggactttctcttagttctcagaccaaccttggctcctccccaaaactttctccaactccccaggcagaattagccagcgttcttcaaggcgttctgcatgtgactctcctgtactgaagcatgaatcatatgctaaggatgctgattttgggtggaagtgggagaggcgaaggggatctatggtatctttttctctttccagatggagcttcctgagggtaggaattaagccttattctactgtatctccagtgtctagtgcagttcctaatatgagttaaatattcatggaataaaataataaatgaagagagagcacagcttcctaagatgcccaacatagtccccgggatattttttccaagcttgaatccaagccgaagaaaatggatggaagagaggaaaggggctgcaccagtggatgctgaggaattgctgggcttcaaactcctgccatcagaagaggaagctcctgaaaatagtggcctctctgtccttccatttccctccccaccttacctggctttgtttgccattttcaaccagtgctgtgattttcctccaaagcactgtccttggcatcattacctatcagcttctctctgtgcataaaggcccatgagagtatggagaaataaagggcacatgtattaggattgcttctgggtgcttctcatctccagcccgtcctcaaccctggggtgaggaaggtaggaccagggtctctagggtttctcaaccctgtaggtttattctttgcctaggcactaggtgaatctgaatccatgttcaaaagtaggacacatgaggcgaaagggttgatcaaacataaaaacccccaggttttttttcccacggtttgaccttaaggaagtcaactaatccaactgtgtttcagtttgactcctctataaaaacgagtctaatgatgcttcacccaacttgtggaggagtggccaggtttaattaaccaatgctcatttctctcagcactttggatgtcctccatgggcacaaaattatgttattacttggaataataataatagtttcccctaataattctgtgttattattgcatttaaggaactgtattagaggccttctggaactagtttaatacctataaatgtctctccctggcaaaacaagggagcattgcctggtgattatggtttgtcttacatttcaaaactagtccgtttaaaccctcagcagagtccttaaaacagcgcctggccaagggggacctctttcaatctcaatttgctggaccactgacagcactgaacttgaacaaagtggcttgttttcacagccgaggacttggcaactctaagggcccaacttacaaacgtggaaagataggcacagagaaaagataagcagacccagcttcccccactgcagccagagccaggtgctgaaatcacagatctgaccaccattgcccaccctccctgccccgccaccacttacttccaccggctccccttggctcttcattagagtccagtcaacaccccccgaggtgtgcagagccctccagctcatctttagatgccccctcccttgcactctgttcctccattctgatcttttaaaaaaaattttatatttcattgacaataatagtatatatttacactatttatatactataaactatataaactatatttatactatttatatactatagtgtatatatttataaactatagtgtatatatactataaatagtgtatatatactataaatagtatatgtatttatttactataaatagtatatatatactataaacagtataagtatttatatactatatatagtatatatactataaaaactatatgtatttatatactataaacagtatatgtatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatattttatatgttaaatgatgagttaaagggtgcagcacaccaacatggcacatgtatacatatgtaacaaacctgcacgttgtgcacatgtaccctaaaacttaaagtataataaaaaaaataaaataaaataaaataaagtgtagtgttgaagtctccagctatcttcttgcatttggaagctctgttattaggtgctatatgtttataattgttatgtttttctaatgggttaacatttttattgttttaaaatgtctccttttatatgtagtcacattttctgttttaaatgatacttttttctgttagtagtgtatgcattctagctttgttatgattgccatttgcaaaatatattattttctacccttaaaaaagttttatatttcattgacaaataataatagtatatatttatggtgtacaatgtggtggttatgatacacgtatgcattgtgaaatgaacatatcatcacctcacagacttatcatttctttgcagtgagaacatttaaaatctaattttttagcaattttgaagtacaggcaaatgtcggagagattgtgggttcggtctctagaccacggcaataaagcaaatatcgccatcaagtcacacaatttttttggtttctcagtgcatcgaaaagttatgtttagactatactgcattctattaagtgtgcaatagcattatgtctaaaatactttattgctaaaaagctgacacagaaacatgaagtgagcacatgcttttggaaaaatggtgctgacagacttcatcgaggcaggcttgcaacaaaccttcaatgtgtaaaaatatgcagtatctgtaaagcggtgcaataagatgatgtatgtctgtatataatacattactattaactatagtccccaggctgtgcacctgtgcaatacaacaccagaacttattcctcctgtctccatcctgggcttttgtttcttcagtaacaccaggtccaatctctccttggcgccctgacacaccttgctcctagcctggccagccctttctcccgtgtctttacctctagttcccaggtacacgttactgccttcccatgtgtgggctgaggcccctctagggtgcacccaaaacaccctgtgtttgtcccctgtgccaaatcacttggcagagagaatcatacctacctgcttacttccaggtttgctcatatactctgtgcaggcatgaagtatgtcagtcttgggccctgggtctgcacacagtaggtgcttcatcaatattcactgaatgaatacaaggatacagttttcttttctctcttatatactattttcttttactcaatgccctgattttaatgctaatccttccctaccctcttttatgccagtcacaggtgagtaatacggatgaagaaatgaaaaagaaaaggaagtagattctttgaaaggagagagagaaatactgtgagtgagagggattaggaacaaggcaaagtgagagagaaagagggatatttggatggggagagactaaaatgaaatcaaggaacaagtacaggattctatttaggttggtgcaaaagttattgcagtttttgctattacctttaatggcaaaaactgcaattacttttgtgccaacctaataataatatgttaaaatgcaaaaaataaaatcatccttaaattttatttttcaggaattttccacataagagaagtgaagagggaaggagaaacccgttagaattatttacatatatgatttccttttattcctcataccttattagacaggaattcaagctacatttaacagaggaagacaaagaagctcagagaggtggagtaccttgcacaaagtcacacagcaaagtggcaaagcccaatgcagaaccagcatgtgtttgaatcccaccttgcccatttataaccaggatgaagtgttcttcctttgggactctagagccttcaaaggtcccttctctttgggatgcagaagagaaaggcagtaattaataactaagaagaaaaagaaacttagcacacagctaaatgctgcactttgaagagtggattcttgcttttgcatgaaagattaaaaaacaaggatttctatctttcatcagtaggacaatgaattgaactgattttctttggctcttggtttgtctttcctatgattaggtacatgtttctgagccctgtgtacataagcccagcacgaaacttgctatttccttgtcacagcaatattttccacgatggtttggggcaggcagagagaatagtgctgctggacttttgcaaaaccagccaaaggaaggccaagaggcatgttgaagaacaaactctacaccactgtttgcctatcttaaagcctccctgacgataatgaatagattccagcagcccagaccattactgacagctaaataacttggtctcactctctggttttctacatctaaatatcccctccctctggggcatgagattaaaaacaaaaatctcgagcagagcaagcaacagtcttgtctttgatttatgctattactggaactgtagtccttgaaagaaattccttcaccaccataatgaggatgaagattccgttaactaataaatgcttcaggagtatgctctgatgctgttgaacttttcatgaaaccatgatgtacaagaaaagaagaaagatttttaaataacactatacagacacacatccgctatggaattagtcaaggcttcgaaacaccatgtgtaagagaaccaggttgacaatcagtgataatacatctctcctgaaaatactaggtaacttagccttttcttcattcctgggcctgcctttgtaaagggaagggagagaactaaaaacctatcagtgattcaatcagaaaatgcaaatgaggtcaagtttcttacaggcttctgtgagatttctctagagacatttccacagcatctctgctgctggcgcccttcggaggctggggctcgtctgttgggtgggaggaatgcagtacgagcttcctcctttttcctcggacctgagtggatggttgaattccagtaaggggctccctagtgctttgggaatatcactcctggactgaagtcaaacccagacacacacacacacacacacacacacacacacacacacacacacacacgggttgctttttcatgggtggaactcatggccggcccctctgccctgtctcagagtgaggaccctgcatcccaatcaggcaagagggaggctccttaagtgaatccctgtgttctgaaccgatcctgcctgcttccctgcctgcttccagggccagcatctccacccctgcagatgccccagggcagtctggaaggagctgtctctcacacaaccacgcctctccctaacatcccaaactaaaagtgttcatgcgtgtgcacgcggtcctcccctgggccacagaagtttgaaaagccttccctgctatctttgattgggaaactagtcgattgggacaggctgacgagtgaggctgcaagtcaggacgctgcactccacctcccatcacgtgagggtggttcagggaatttacagggtttctctttgttcagcacaggttctagcacgtgttttgaaagttgcctattttttttaacccaaaggtaggtaaacaccaccaatcaaagctctaagccagttcccttaagttttaagattggacagtatcaggtgttgtctttcaaggggttgaaaggaaggaagagacaggaaaatccccctcaccctagctttaagggtgttggaggtcttgaagaaacggacagacccttgattaaaccttctatatttttatgtaaaacataggaaaagggctggtgaaaatgaggcctgcattgcgtgaagaaggtttaagatttgagggaaaaaaggcgcattctcttttctgtaaaatttttaaacattttaaagctaaatgctaccctcttggcctatagctttcacactgggagtaaaggcagaggggtgggggtggaggtggcaggtgaatgggtccttcaggaaactttgaggaaaacaacacaggtttcccctaaaccgtaaaaacggcagatctggaggtcccaacttctaattttcaatccgtcggcttagtcttggtttttcattactgaggttcccttgactatatagtatctcacaatgtctctcaaagtgcagtcacagactacagatgagagaactatgagtgaagctgcttaaaatgcagattccaaagtccttccctgaaggattctggttgtggtacagggatctgtaaatggggtggttgatctctaacccccaccccccaccccagctctgcaattctatgcttctagactctctggaagggaacaccaccaggaactgtggctgtcccactgccagaggatacctcacctatgccaggtgtcaccaattacctatttccagctgtagggcctaggaccttggccaacattggctccttccaccaggtaacagggccagttaggctgtacaagggatccatcttccactggagatgcctccagtgcctccaggttcactgatcattggctgcagtgtgtgctctacttagccaactcccccttgccatagcctctttccgtctccctgctgtgtgctgttccctttcagtgctgactcttgtccccttggctgtttggatccggggcttctagcccctacgctctgcactgggtccgctccatctgctgcccgtgtcctggcgcctgtggtccccttaagtcctccagaaggtagggctcgcattaagagcctgctccttcttcctttcaccacccaaagtggctcaaaggcttccacgtgactagtaactcaccacttttatcccctatctctcctctgtattcctcaaaggctgggaacacacttttgtcatttcacatcatattctagtgatttgtatctctttctcctccctgcctaggttgtaagctctatgatgccaaggactgtgtcttactcatctttgcatccgtagcaactagtgtggggcctgatggtactgataaaaacatttactgagtgcttactatgtggcaggcattgcactaggtgcaagatactcctttgtgcaatacttgctatgctactctatcctcacaatcactctacaagagccccagttttattaatcccatgtgaataagtgagagcaatgaggccaaagggtttaggtaattcgatcaaagtcacacagctagcatgtggtcagctgaggattggaatccaggcagtctgactcctgagcctcatactaaaaactcaaagtttgctgaataaataaaggaaatctgaataaagcaatgagtagcagtattcacagaagcacggaattttagaactaaaaaaaatatatacactgtgtagtccaaaccctgattgtattgctagagaaactgagggtgagagcaatgaaacaaggtttggtggtaaatggtaaaactcttattttatcaaagggaaaattggggttcaatttcactcttacttccacaactgaaattgccagaatttgatcgtttaaaagaagcatagttatctcctagttcaagagcctcattttgcaaaggaagaagttgtagcccaaggagtgctatgacttgccaaggtctctacttcaccagagcagaactggaaatgaacctggctctcctaactccagctacactaacacagacccatgagccagcccattccccaccactctcccatcccagcttcccaggtcaggtacagacagtccaaccgtccatgatttaacctcagtggaaacgctccacactggagctcaaatgcaaggcaagcaggtccatccagatccagttctttcatatgacaggtgggtagagttacaggctcacattgcaactggggatttgtgagatccacctcagaagaaggcaatgctccccacaacgaggctgactgttgagtgtgtgaatcagcatctgggtggtgaagcaccccaggatgtatacactagccagtgctcagcaatcagcaccacgctttctggcaccacctagcatgcgcattagctgcctttaaaaatgctgatgcccagggtcaggcccggacaaatgctaacagaatctctgggagtggggccaggcatcagtatttcgtttaaaggcaccaccccctggctccaggtgattctaatatatgctaagctaattcataaggcaagtgaaatgtcttccatccaaattagcagtgtcacctggaaacgtgttagaatccaaattctacattaggtacccttcattattttctttctttctttcccatctttccttcctttcttcttttcttccatcctttcttccctcccctttccttccttccttccctctctttctctctccctcccctcccctccctcccttccttccttccttctttccttccttcattcttctctttctctctctctctctctctctttctttttttctcccttcctttctttcattttctcccttcctttcctcctcttccttccttcctcccttcctttctgagacagggtttcaaactgtcaccaaggctggagtgcaatggtgcagtcatagctcactgcaatctcaaactcctgggctcaggcaatcctcctacctcagccacctgaagtgctaggagtacaggtgtaagccaccacaggctttccctgttattttctctcatagcactctattgttagttttcataacacttagcaggatgtgaaattatacacttgtttattttatatcctttgcctcctcccaacctcagatggtaggcttcatggatagaggccacacatgttgtgttactcagcacacctcatgcctggcacacagtgggcactcaatacacataatcaacaaatggatggatagacattaggtgcatataggcaagacagatgtctgaatttttcattttttggaattcattgctgtagccttatagagacagaacacaagcatatgtaataggcactttatcttccccagaaataaggaagtttagcttactggagtaggtaactaggaattttttttagacaagttaccagaaaaaagaaaacaccaaaaataaataaataaaaacagcaggtgctgataagaaattaaaaaaaaaaatcaatgtaacaactttggccataagtgtggcttcgcctaaaatcctactgcttctttaggtcaagtccctaaatatttattaaatacatcttgggggtggccagcatattaatacattttttttggagaaataataaagtttaaaacatggtttatggccttcaagtttgttgggaaagtggagcttattgaagtagaattataagaaggataacataagttaataagtagtgaagtgttattcccaacacacaggccggtggaatgcatgcatatatgtgagctggcagatcccctttcctaatttaggttcaggggagttccaaggaagagatctgcatgaggagagcacactatgggctgccataatcaggaggatctttgtgaatgaggaagaggtttgggacttgcaaacattcttgattcaaccaggctcttggaagttaatgtagtcaacattttcccctagtccttgtgtggagaagaggtctaatctatgaagtcaaaacaaactttgttcttggatatgatttgggggttcaaatgaggagacacaattatctctttgagctttaaatatcgttttgctgacagaagacaactggctcttttcatagacatcttcccttattaaaaaaaaaaaaactcctaaagtgccaggaactggggtgttacattcagtaataaaatccatgtttcaaaacttggtgtgctcatggccatatgctgtagtgattaaatcagactagctggattcaaatctcatcttctgccatttaacagctgtgcgactatggacaaattatataaccttcctttgtctcagtttccccatctataaaatggggctaataataattcctcactcgtacgattgttgctgtgaagattaagtgaggtgatttttgtaaagtttcataagaaatgctatagaagagttagctctcattggaaaccaaacctaatctcaactcacacccatgcaatctcccattaagatctatttacttatccaaaagaccacctaaaatgaactgcaaatctgctagaggacagaataacagctggccaaggacaaaataacctaatggttgtggaaaaggtcacagcagtgacttcataatggaatataaaatatcataaagacagtccaaatgggctaacgtaggactgtatggctaggaacttctagagctgcctactgctgatacctgggacttacctcaagtgatgagagcattgttggtaggagaaaagtatagggttcatcctaatttgaatcagttgctatctttcctgtgccgtggcatcagaggtatctgttgtcaaccagggcaccttctaaattcttgtgccactgttaccgagcagaaccagaagaaagtgtagtggagatggctggccacaatccatcactgcttctagaaccacacctcagagcacatgctaagtacttctatgttcacaccacccaagcacagagaaggcattaatgcaattatcatacaggaaagtcaggtttgataggcagagcagtagaaatgatgtagtgattctgtggaagtcactgtgacattaataactatattcactattcatcagagaccagaatttgaactatggcaaagctatcttagagtctcattcaggaggttggtttgaatcactgaagttccatagagggtttgattcaagatggcctcatttataagtcccaaggtcaagaaccagaggcattatagtgaaatcctagcatatacacagtcagcaccaagtaggcctgcttccccatcttccgtctccatccttcacgtgctgtgatgccaccttccccttcacacaaagcatggccccgaagaacagcgaactggtaccccagcagcctgactctcccagaacctcctcttctgtgacatacaggaattgggttagctaatttctaacatctttccacttctaacatttgaatctaagattgtctttagtaggtatagtttagatgtaccttgtctgattattgggcagaacaagcagcggccatccagaataacatgaagagtatccttactgaaaaactctctccccttcttcctatcacagttcctgaaattctagcattataaatatattcctttgggcttcaaagcccttttaaattcttaaaaggctttaaattctatgaaaaggcaggtaactctgaaaacaatttaagccttcactagttctcaccttaggcagggccaattggtcagaccgctttccaaatatgaggaagccacaggccctatgggaaaggaacactggatggggatggagtggatcccagtctacccaacagtaggaactatgtctcattcatggccataaatcatgtcctagtactggcacatgcttggcactttttacattttcttttcttttagaaggaaggaaagaaaaaaggaaaaaagaagaaaggcaggattaatgaatgaacaaaccagaaattactactgagagtattttccacacctgacctggtcagcatatccccaagggcaccttttcaacttgggtcccgggtgctaaaaacaacccctgttctcaaggggcaatttccagcctggctgctgacttcccttagctcagagagggcccttgctatcactgaggactattcagggactgaggcagcccaggccattgcaatgctgagtcctgcaccagttctaggcgctacactttttttaagcacttgatttaaatgaagaaagaaattggcttatatttttagcagctcctgctactaaaactcatttgacaaaagtgccaaagggacagttaagtctgagtatgattttttttttttcccatggaggaggaggagggtataatttatctgaaaatgactggtactttcctggcctggggacattattctacctgctctctctctctctctctctctctccctctctctctctctctctctctcttttttttttaaagacacacctgttcttttccttcccatcaaattccaagcttaagatatttactgtcttcaggtttagttcctaaaccctaagacaatctcagaaagggaaaggtatataattggagtctggaaactccataactttcagtaacattttagaattagcagcatcttagtgggtataccaaagccctccgtgatgtgagtataatatcaagttcttgtaggagtataacattaagcccagttgaaaaacaatattaacgccatttctacatgtactgggtatcagattcaaagtgtatgacttcagagtgccccaagcccctcttcccaatgtttctattactgacttgcttagtatctacctgaggtcccctccattacagctatggggagaaattcttttttctttttcagggctgaggcactgttctgtcagaaggctctgctaaaatacacatatattacttttgaaagtcacatattaacccaatgctttccaaacgtaaatgacttcaaacaatgcgttagctcgtggaaattgagtcttgaaagaacaggagctttagggctgctaagaaaatgtctggcacgtaaaaaaatccaaaatgaactcatttgtttatttgttatttggaaacttttccccagaaacacaaagttatgaagagtggttatgttcccagaggacagtctgaaaaaatatgttttataaccataatgtaattgaagtgtactcctaaagggtatccctgaaccacactgcatggccaggcttccaagggaaactgtgttcagacaaccagcttggaaggccaggaccccagattcctgctgctgggacatggcgggtgttggagctgcctcctgggagagagggggctcctgaggaatctgggttgggtgagcagctgcctgtgcgggtccctgggaagaggccagctgcatgtatggatgtttgctccgcgtgagcctggggctgctgattattgctgcttccagttccaatcctataaaggattcttgaagactcctttatagcagtcaggaccattacagctgtcaaaaaacgatgacaactactgtttgagatgttttatagacagccaggtataaccgctcattcatgttagtaacccctggtatagtggttggcatgtatttggtgctcaattagtactggatgaagtaagacagattcgtgtacatatcagagaaaaactagtaccaactatgttggacatttcattgaagagggtcactagggtgaagaacaggcaatgccaggagtggtgggcactgcacctggaaaaggtataaggcaggaggcgggcagggagctgacacttgaggagacagctatgagggagtggcggtagctgtgaggagcaggagggagtgctgctggtgggaaagtcagggtcaggagaggcagcacccttccctatcctttcagccttgactcagtgtctcagcctggcgcaggcaagtaaagagacatggtaggtgaagaaggtggccctgccaatctagtaatcagttccaggtagagaaagtcttgggttgggcccaaagtacttcaaagggctccagaaggaaagagaatctatgaggaggacaagggaagggaaggggaagtgaagacactctagtgcacgtaaagtctggatttagctacagtgtgggggtctgttcatttccagcatctctgggtggctagtgactgaggccgctgagtgtggagaggacacaccctctgaaagcccccacacaggggagagtgcaccactctgcctggttcaggcgcatggggcctctgtgaccctcaaagagaaagctcctgggaggcactggggcagaaaccatacgggatatttctttataaccttcggaagaaagtaataaaagtcaagtcttcgttaatagcttctctaaggaccacctctttacattttccttctctctcttcttcctgattcccattgattttgattctctctcatgatcagacaacggctctccaccagtagttctctaggctctctcaaacctctgtaaaggtgcagaattcatttgcattcattatggtctcagggcaactcatttactttcatcttgcaatatccaaagagttgctcatttacttagatcatttaagggtttccagaaatcctgcaaagaagacatcaggtgtccctctccccctaaaactttcagaagaagttttgcacaccccatgggtcggggggagtgatgccttggagccagtgagagaaccagtcagacagagcattcagtaagaacctatcagggaggagatgcctttcttctggcccactctggttcaagcctcaccttcgcttacctggactgctgccagcctggagacaggagatgcctccaggagttttgcagcaggaaggcttcatccccactggcatttatttataccttagggctaatggaattcagcaggtcactgctgcccggagcaccggcctgttcaactctacatctcaccgggatggacgattccctcctcagtccctgtatcagtgagcagggggcagtgagggtgacagagggccttttcaggacctttgaggtcacgtcttagaggttttaacttccacctccacatgggcccgattctgccaaaaaatagttgtctggccacatctctagcttgagttctagtcccacaggatccccacattgactaggaagaaacttcacacatctggaggcctccaccagtgactccttccagagtcatctgttccttacatggtataagctcgccaggacagcacatggaaagagtttgtcagttcttccatgagccattgtcattttatgaagcaatccgctgaaagggtagggcccagacacttgagattcctaccaggagatggaagaaatctcacagagcaccagaaaactccggaataaaaggccagtgctggtgatgatctctggcttccgttcattggtaaattcacacatttattaatgtcttcagtgaacacatactttattcacaacaccagaagacaattaacatactgtcttagcagtagttaatgtctccctactgtactgtagtcttctcatggtgacctaggctttacttagtttagcactgtgcttggcatacagtgggagcacaacaaatagctctgagtaatgaatgaataaacaaataaatgaacaaacaactttaaagatatcccactgagcacatgactttgtgttagaactcactcaaaggtgaggagtcataccatttgtcttggatttttgtagaaaatatctacttccatccataccttcacccattttttaaatagtagttttgcgcttattctttttaaaaataaaaaactttatttataattgtaatatgtattggcattcaaatagaagaaagaattatttatttagaaaatgtgggaaaatacagatcagcttaaggaataaaccaaaacttgtccacaatctcacaaactctgttaacattttggataattttctgccactgtttttttctgtatataaaaatttacaaaattgggatcatgctgcagatgcagttttagatattgatttttccacttaacattatatcgtgagcattttaccacatcattaaatattctttgaaaatgttacacttaatcgctgcataatattatattatagctcttcgattcttaactaaggcagatttattgtccttaataaatccctaaatcactacacaactgaaattgttccctggcttctgtaactgtcttagtggctgatgcagattgaaaacttttacaatatgacaagtacttccaggcaagaaaagctgtttcaagtatggctggatctcatctccagctttttcctcctcaaagctactaattcatacaagcatactaatggctttggaatgtttattctcttaaaattggaggctctagggtacacaagaaaacaggcacagaatgtgatgagaaacacatggcaagtgtctagttgattcacaaaacactcaagattttcttgggcatgagggaccacacctcaatttaatggaacagaaatattttagttctctacagtaaagtgttgttgctaaaaatatatgtgtgtgcatgcacgtgtgtgtgtgtatgtgtgtggatccatcaaaaagagaaaccccaattcaacatagacacacagctatgcacttgtatagtcagcgaggagactgagaatacctggagaggcgatagtgaaagagaagcagatgaagggcctttacagtttggggaacattaaataagctgtgtcttccgctctcttctaatgaacaactagtttccaaatgttactgtattctctttcactccctgggtctcatccttttccaatccagtcttctttgccttgaagctggagcatttgacagggtctattgaaacttctaatgaggggaggttacatggagagctcactccagaacagccaggacaaagatgggatggtatgcctcgcaggggtcaccctcacgactcagtggtcacacctgtgtcctctggctcattctctcctgacatcccagcttgagagtggatactacctcctaatagcaaaggacacacaacagacatctctcctagaaagctatttctgggctgctcattggccacttcaatggaaaatcttccctggaggtcaggtctgaggcaggtccttacatttgctataggtgagtctcctagaagctcacagttatatagctctgataatattttaatacaaaacaccatatccatgcatttgtccccacctcatttgggtattttgagttgagggagagagacaccacactctccagatgaatctttctcaagtgctttttcatcacgtcatttcacgactcttgaactcaaaaccattccggtgacctactggaatgcaccttagtgtctgtgtctggccaaaatggtatgttgcaatcaattctgaggatgtcagaagaaatacttgtggctgattaatacttttaaaaacaagcgagtaaggttcaaggttgcccctataaaacatcactctcagatatgcctcctaaattgggaaaaaggtgaagtggcagctaatatggtaggaggtacacaaagcctacaacctgaccttctgggacagtgtctgctgagctgcatttacggatacagcaccatcagccacacgaatgcctgctaactcttctctcgaccaacaaaaaaatttgtatgttatcgcaaagacagctagctgtggctcaatatctattatccccttcttccatagccagaataaagaccatattttccatcctttcttgcagcttagtgcaacttggtgacaaaattctagaaaatgagatgtaactacaaatgaagcacacaactttcaggtggggccctagaatgaggctgacaatctgcactcccaagcctatcccacaccacccctccagtttgccaggaattttcctggttttagcattaagagtcctgtgtcctgggaaatccggtagtctgggcaaaactgggatattagtcacctacctccccatttccctctttcctcagcctatttcctggagtatggacttggtggtgagccaccttgaacatgcaaataaaggcagaccccaagaaagacaggagaagcctgggaccctgccagcttcatggagcacaactgttactccagctcagacttcgatgtaaaggacaaatcaatttccatgttgtttaaactactaatttttgaggtttgtagcatactcttagacatctatacccaaactaatgtatctaattgcatagtttaccttgctgatgaaaaaaaaaatggaggtggggtggagagtcgattcatcaaaatttaaatatgccagaggaaaagtgtcattcccaaaaacatcatctgtcacattttgttgaggaaaaaatgttgggcaattttataggactgaagtccgaggctttacctggcatttctctcctgctgttaccatgcctacactgtgtctcccgccatccagccttctcctcgtcccatctaaccttctgttccatcccaactgagtgttctttttttttttgagacggagtctcactgtgtcgcccaggctggagtgcagtggcgtgatctcggctcactgcaagctccgcctcccaggttcatgccattctcctgcctcagcctcctgagtagctgggactacaggcgcccaccaccatgcccggctaattttttgtatttttagtagagacagggtttcaccgtgttagccaggatggtctcgaactcctgacctcatgatccgcccgcctcggcctctcaaaatgctgggattacaggcatgaccaccatgcccagccgagtcttctttttttatttgtattttttattaagacggagtctcactctgctgcccaggctggagtgcagtggtgctatcttcacttactgcaacctccacctcccaggttcaagtgattctcctgcctcagcctcctcagtagctgggattacaggcatgcaccaccacgcctggctaatttttgtatttttagtagagatggggtttcaccacgttgaccaggctgatctcaaactcctgaccccaagtgatccacctgcctcggcctcccaaagtgctgggattacagattacatcccacccgattccaaatgagtcttcttcctgggtccttcctttctatgtccctttctcatttgctactctccagttaaaaaactcttctcttttcccttaagttcaccaaacccaccaagcccaatctcctttaccgttttttgttaccatgatttcatccttttctggaatctggcaacacctctatgaatttggcatataattactaatatctttgtactgtctttttcatgtatttaagtcttgtatctctggaaaggttctaagatccagggaggaagagtggttgagagaacatagcttaggagttagaagatctggactgaagtctgggttccaagacttgcctcttgggtggccttggatgtcagtttcctcatttataatgtgacggtgattataactcctctgcctttgcaccatgaggttgtgagaactggacactataggaatacatcatcaaccagtaagcaccttagccatgctaattgttcttcagaagctatcctttctctaatgtcccactggacagccctagcatgcttaccacagtgctggggatgtagtgaatgacagccccataaatctttgtacaatggatgaggaaaaaaggtaaaaataacagttcctcaaatattataaaactgcatagaaaagtctctgcctggacatctccttcaaatgcaaagaaggcacaaaatagcggtacatgtcaaactgaggtctcaaaccccagttcaggggcaaccttgaaccttactctcatgttttcatttctgagtggttttaaaagctaaatgactccttaattcatggtaataaagtctaagtcaataatgctacagatccaaggttagttcctgtgaacagcggcaccacccttctcagcctcaagtccgtgtgctccataccttgacatgaacacgagtaaaaatcaaaatggccccagatatgtcctaggatgccaagaaagaagtggcttctactcagcaagctgcaaagagagttgctattttcaggtgctctctagtttggcagattaccaaggtgatgatattaagcttaagactgcctgttaatggaatgataaatgtgagaaattcagtgaggccacttaagcaaacaccaactgaaggataaaaagcatcacaaagcccatgggggaagaattcagatgcagatttgcccagcagcccaatggacctacttccatcccccgatgaggggctgcgcatttgttgaggggaagtcattttgttcgcatctgagagtgacacagcgacccctcgacaatgctgagacctaggcccaatgcctcgagttttccttgcttgttccccttttcccctctcacactgcaatagtatattttccttcaggaccctcatcttcgcaggattttttttttccctccaaaaaaaaactatctttgttttcagaataggagtcgacaagctcggcatcactgaattataaatgattagtagttatgtttcctagatatatttagagctttaaagggattggaggttcttaaacacagaacgtggacttgtaattgtgaagctcaagtgtctacaagaccgggtagcagtggtattgtaagggaaagtggttttgaagggagagacaccccagtcacttcagaataacataatttggctgctgtcttggctgcatctgcacaaagtgggaccagaacactgcacacaaattgctctgatcaaatcaaggggccctaaaggagatcaggcttggcttaaaagctcttgggctatgagttaataagaattttaataaaaatggaaagtatagcctggggccatggtacaatatctctctgggttgctggtgttctatcagtcaatcatataatctttctgacgttactaaaacgaagagggtaagcaaaaactgtgtggaccaaagatttcaaaaacagaacctacagaaacaccatcagctctctgattggccttccagagccaggagatatacctaaaagtgaagtcttccccagaatgtgagacaccagtgaaaacgacctgtgcccaactcacttcacatcacaaagcagtttccatacacatataactctcatggcaatcgtgatttcaggttatgaccatctctattttacaggtgaagagtctgaggatggggtgtgggagccttgatccaggtctttgactcttacttccctgtccaaactcctcagtagcttatttgtacatttgaactcaagctattgaatcgttacgatcctctgctttggtttactattctgacatgcaaccaagtagatgactggcctctgtcatttgattcaactctaaagccagaaaatattattaattcaccttacctccaagaattggcattgatatgaaaacttattactgatttaaaaacaaatagcttccctggtatttgtttttgtctgcaaaactcaagttctgcgatactcaaggcatacatgaatacctagagtgttgcccgatcacttacttacttcattacactgacctcttttagggtgtccaccagtgacaggcatatttcttatggttaagcattggtcacaacagtttacatgcaaacttggtttgtttttgaaatagatggcatttagccgaaagtctagtctatgtggtgtaccgttagtcagcatgtgctggcgtaaatgtcattccgtgggaaaagagcacccccaggcaggactatgatgtggcttgaaacatccctcaaagatctgggctggccacattgctttatgtgcagatggagagaggagacaaaaaaaaggaacttccgtcttgctctggattttttaaaacttgtacaatgacagaaggagaagagatgtaaattcaaggacactggttgtccttgaatttctcggaccattctttatccttgccacagactcctccctctctgcctgtccagaagtgaaggtcccacaggcttccttgagcagtaggctggtcatcccatgctccacactttccctggacactaagaaaatccccagcatcaatctctaagcagagctctccctgggtctaagctccctctccgatggctccctgaacacttccacccacacgttcagcggggactccagacatagcattgtcagaatcaaactcagccttcttgcctaacctactgtttcccaggttttccgtcttagctggagacgcctccatttaacccctgcaggaaagctgagaatctctaccatcagccctcttcatcatagctcatgtccattagtcactgaatactccatgagctctctcctaaaatatcctccaatcagctcccccctctgccctcccacctttactctcctaggttaggctgtccatgtcttttgctttactcttaggcaccagcccacattcttgtgtacattgcagccagcaatgcttctacatagcaaatctgaccagggcctttccctgttgaaaaatccttcagtggctccctaaactcatgctcacatacaaaattcatattcataccttgaccttttttttttttttgtagatatggggtcttgctaagttgcccaggctgatctcaaactcctgggctcaagagatcctcccacctcagcctcccaaagtgctgggattataggcatgagccatcatgccgcaccccctcgttgacttttaaggccctcttgaactttgtctttggcccttccttcctgtcactgaaactctttctttcttattcattttctttcccatatttcctatgtttgtgtcaatatatcaaattagaaaaagcaactgactaggaaaaaaatgaagcctatttgattgaggtgattccagatgtgaaatgaagcttggcgaacaccagctcctctacaggtggggctttaataattacgaagcaagaaggatgcacatatatcaatcaatgcgcacgcagcacactgccaacctcacccctccttgcacacgtcaatacaggctcaggcttggtagcaggtactacaagttccacatgtgaaaaacacaaagcaagaaaatcgccacctcctgccctgccttccatggggagcctgtttggagtgtaggggcgcacccactctaagtcatgtctcaggctggcctgtagccttgcccttggtttccctgttgaacacagccttgtgcaccatttcccccgctaaagagctcaccggggacacagtccttactgtcttcatccgctgtgaaatcataaacggctccactaaacaagttagcatctgattgtttcttctcaggttgccagaaaaaaaaaacaaaaacctggatatttggacacctctgggagcaattgagttgtccgctttgcatgcaggcatttggcatgtgaaggtacagcctgaaggacaagagctgcctccttcatgtctgtgtccttgttgcctagcatgggagctggcagagaaaacgtctgaaaatacttgagaaggggcttttagaaatgaacaacccggctctatcccatgaagaggagcgtagtggaccatccagatccttcaaggcttggcttccaagtccttctctgaatacagactctgttcttactgcctctgagatccactcgagccatcccaagtggtgggatgagctgtgttccctacccccttagacctctatcctattgtttctgccacccctactctccagcatgctgttccacaccagaccttagagtctgctttatctaccaacaaccctagaaaacaggtgtaatttgttgacccagacatggcctgggctggggattttactctatgaccacatagcaccaaacatctggaacagaaagggaaaaagctctccagctgtttccagacatccagatgtctggcatgggaaagaggaacatcctgccacctgccccactgagggtatgctgtccaagcagacaggcagcaggtcaccgggccatggggccagcctctgtggtgcagggctgccactctgtctctgtgcaagatgagacttgacctgaaacctccagactgaaagacccctctttctgaagttttctttagaaaaaaaagtggcagaagccacagtaggttcatggggaaccccactcacaccagacgtaatggcgtcttttatttgtaggtatcaaaaagtgtggccagttcaagatttccctccctgctttcagtttccagggcacatggtttaaccaaaatcatgttaaaaacttcagtgtcttctgggtttaactcagttcccccagacaattttcttcttttcctttcaagggagcatttggctttccacctggtcatccttcaaaacattcattcaacacacacacacacacacacacacacacacacacacacacacacatatactttttttttttttcagagggtgtctcactctgtcactcaggctggagtgcagtggcgcgatctctcctcactgcaagctccgcctcctgggttcacgccattctcctgcctcagcctcctgaatagctgggactacaggcgcccgccaccacacccacctggctaaatttttttttgtatttttttagtagagacagggtttcaccgtgttagccaggatagtcttgatctcctggcctcgtgatccacctgcctcggcctcccaaagtgctgcgattacaggcgtgagccaccgcgcctggcctcaacatatattttttaagtgcttacgtgtcaggcattgtaagaatagtattaatatattgtacccttaatgaatataatgacaattttgactaaacaataatcacattaaagatgatgataataattgaaattacatattgaccatttatgtacctcactgaataatctcatttgtatttctttacttaatttatcaaaccacactaaaaataaatgcattacttttaatggcaaaaaacgaaattacttttacaccaacctaatatctcctaggaagctcagagtgattaaatacctcacagaaagccacacagcatattgatagtctagctcaaacttgaatgcaagtctgcctggagttcagcaatcacacccttactcactgcattatatcaatgcacatctgtacagtgcacgtggcagagaggaaccagggtaggtataatgagtttgtaactccagagagcaccattgtattccatgagactggcactggctagagcacagtgtacagcctacacggtgaatgactccccatggagttgtgagacacagtggccctgtcctgtgttcacttacaggcaccagaagcatgggaggaaataaaatcccatgcttatgtatatgtgcatatatcatatatgtctatgtgcaggtatggagtgtctagtatgaaggctggcatctagtaggtgctcttagatctttgctgtttgcctatttaaataaaaacattttaaaatgtaaatagagaaggcagatgccgagactggaggaggaagtaagagttacgccctgttgtgggtagcaggcaggggctggagggagagtctgggaacagccaagggataaaagctgtgatgatgggcggggtctgagtgtgtagaattgggcctaagatggctctcagagggaggaagagacctgggtctgcagcagcaattagaactgtttctggggttcacctcacttgctgccttagtatgagaactaggtttcctttgacagcctgtttcttgggtggtccacttttgactcggagggctcatcagagggaaaggaaggatgcctattcctctggtgcctggtcctctcagccagtgtcctctgcacctgccccagagggctctgacacaggcctggtggagattgagagctcaacatggggccaggtgaaggcaaaattccccaggttcttaggcaagatttgattcagatctgtggctgtgaagccaggccttttgcccttaaccagaagtctccagacaatggatttgcagccatgactcatagaaccctgtccccactctcaccagcagaggcttggctctgggaaagatggttcaggactctggacctcaggagtcccatttagaaaagaatcaagagagtgagatgtttgctcagctgccttttccctccagagagggacactgcatgtgtcccgccactgctaggctgaaggaggagaagagcgaatgagctctgtgttcacagcacatcttcttacccagcctctctggacatcccaggaatggggggcttagcttctggtttgtgacaaggggaggatgccttcattatcccctaatcctgtctccgtggcccggcagcctgactgacaaagcatcctgcctggcactgtggcaactgccatcgaagcctgaccagctggagcccaggcgatagtttttcgaaagctgttacccaaaaaaagcaacactgagttgggtgtagagataactatctctgctgtcacaccacacggggagggagggtagcgacaataccacctccttcctcgacaacgataccttacggaagccagagaaatttaggcattgaaagtaaaaacattcagcgtacttaccaaatgttgactgactccccgtgagcattttttcagcagagagctgagggaaacaactttttcttgttttctctccacgccatcccacagctgacacagcttggagaaagaacacacacccatagactgcaaacacttctcaggtggctgtgaaccctctcggggcctcaggcactacaaggtgccctccctgacctcctgggtatgaaacacagaggaatctagggctgagtgattgtgtgctaccaaagagaaagagagaggaagcaaagccacaatttggatcgtcctgtggctgccgcggccacagccatccaaccagcagctcgcctggcagtgcctactggcaatgggctctctctgtctctctctccctttctgtggctctttcttgttttctctctccctctctctctctcctttcttgggggctgtattggttctggagaaggaggcccctgccattgcttctgacattgcacaggaaaggaagagtaaaaatgctattgagaaagacctggtttttctgtttttcctggagggattcctccctcgcaaagggagtggattagaaatgatggaataattcgaaggccacaagtggacaggtggagccaacacccctccacacacctggtcagtccattttctgccctcgttctctcctccccgtcatgatgttgtgctccgccctttatctccttttttttggttgtcacagtttcagctcattgtcacttgtgaggaaagtagaaaccatccactgtatctggtgtaaaacagcctcaaacctttttgagaaaagcaggatacaaatgaatcaatgtgccaagcagtgcccttgggggcgtgggacctgggtccagtgatcccagatggtggccttcccccaggagagagaacagcactgtctctcctcccctcgcactacagtttgggtcactgccatcacggatgccttctcaaaacatatctttgaccccttcttccttctctgtggttgccaagctgacccatcccttgctcctcagccatcttcctttctaaagttcacgaatttgtgttttccacccccttcccttctctaccaccccagggccgtcgtccactttgcttggatactgacagagcctccttgccaacattcctcctttctccccaaactgatgacaggtgaagatttccccaaacagcaatttatttaatatcatccctgcaggaatatcttccttggctgcccatgggctgcaggataaagtccaaatacctagtctcagcaaacagaaacttctacatcttgaccctaacttactgttcaaagcattaatcataatagatattttcaaagctaccatttatgatttatgggccacttagtacacatcagatacagcgttaagcattgcttcctgagttagttctcacaagagtcctacatgaagtttcattacttgcactttccattttcaggcctgtagagatgaagcagcttcagaaggctgacagtgggtcagtggtcagtggtgagcattggactgcagatcttatgatgtcaaaacccatgctcttgaccccttcactgccccttctacctgaacggatgccctgtgctgctgtcacacccctcccccgaccctccacacaggtcctgggctgtcatggtcaccccctcccaaacccaaactggtgcctggggcagaggagctctaagaagtcctcaatccatatgagctgaaagttctcagccttcaaagtagaagatcgggtggataaagaagacacgcagcccaggaagcttcaagtagatgggcagtgagtgccagcccgccacatctgctgagtgagagtgggtggtggaagagctggggctggctgtattcatttgaaacgtgggctctttctctgcatcctgcagcagcctctttctctgtccacccttctcgttcacccaccacacccctcgtgaaactccattcctaaggtaattctccaaatgtccaaacccaagatctactcagccaagaagctgggttctgccgctctccctccccctgctgttctgctgcaaggaaatggaagaaggaacaacctcgctgggccacttggtgatttgttttttccttgctcaaagcacaaacatgcacaaatctcagagtccccatgttaagcagagacgctccctggtcagtctcctgcactctaacttcctaaaaattaaagagtcaaggcagaatcagacacggtagaagggagaaaaggcctcttagtagccataaagtccaggtacctcattttacaggtgaggacatcggagcctggagagaaataacttgtccaaggtcattcagtatcagagtggtagagcccacacagttcccaaggccttttctcccaggcggagagctctttccctctccctgtgatgtggctgctgcagccacacaaaccaactgttcttgttacacgtgtcatggtcaaatgtccactagctgcccaagggcaagatgagttacaagagcaattcttcccatgactttacagttgtcaggaggggtcaaggacgctttcaagattcacactctgaccgtggcaagccaggttctcggagggttaaatgactgatgaaaagaaagccaaaggctgagtcagaaccagggacagaacggctggcacagccctgtcttgctggggaaggcaaagttctccattttggcaaggtccgtgaatgtctctttttgcttttcctgggtctctggtgcacttgttggattgaatcttaaagcataccctgaatgctaaacatctcaggataatgcactaagtccttcctcagctgggctggcccatctttctacagcctcaccctaatatacctactctgctcagggcacaggaaacatagcccacactttcacatcttcatttactttttttttggttattctctccaccaggaatatcttcccctctttaactggcaaacctgcacttgactttgaggatggagtttaaatgcctgctccttttcatagcctcctctggctcttctctcctagtcccctcacttgtcttcccagagaactctgttcctggcacctctctgcccttcctgagttgaattctagctatttgttaacatgttttctcctatggctgtcctgaggctctctcaaggacagtgactcagtcatattcatctttgtaccctgggttgtcagctcagttactgggacacagagggaacaaaagaattactactttaaactacacagaaatgcatctacttaaggaaaactttgctccaagttcccaaatggaaaagccaatgaaggagttgttgttgttgttgttgtcgtttgcccctaagagtatagcaaaggcccccaaccagccagttttcattctgaatggtaaagtgtcattttacaagctgctgccacgagcaagcctccacgcatgtcgaatgcacacttgtatgcatgcacacacacataggagctagaaggagctggttgctctatggcaagaagcagcaaagaagataagatcaccatactgcaaaggaaggtaagccacgtgatgatgtgggtaaccccaggcacagatgataccctcagcgaggcccagcttaaatctaaccacatcaacttttcatgaaacagacatgaaaaagtaagactaagacaattacaaaaaaggtggtttaatgccttcttgcctcgatggtatcaaagctattggctccagggctacacttggggaaacaattctttgagataaggagatgaactatctgctcaaaagaatgtgcaggaagccaaggtaactgggcaacacataatgaaacggtttgtggccaatgagccgtctaaacaaaaatatccctggtaggcatcagttgtataagtgaaggaaaccaaacccacccttgtttcaaagtgaagactttgtgggtgccagtgtgtgagtgtgtgtgtgtgtgtcctcactaaatattatagttaaagtgaaattcacaagtcctccagctgtggctgacactggtataaaatgaaaaggttgagaaggtgagactagttgtcatacagcaaccttgaagtgcctttccgggtggcactgcctgctatgtgaaggctcatttgctgaatgaccatcactacgtcaacacaaattgagatctcagcattgatttatcggtgtgtgtcccagaaagacacactgcatttcagcatcacggtattctgatgtagttaggttctgaattctctgagccacagacgatggtatgtttctcctctctgaagctctgctaatgcctcgtccctatttccctgaaatatggtttcccccatcagttttcaaccttttcgtttccccaggcaatcttttgatgattctttaaggtccccagatccacagaatgtgacagctgggatgagcttccgggggtgccgattggaagctttacaggctctaaaacttgctactgaatctcagctctggcattagtcggtgttctttgatttcaggtaagtcacacaacctaaatctcagctttctcatttataaattgggactaacagaacccatcttctagttgagtttgctttagaaatatatgagttaattcgcattaaagtacttagcacaattatacacctcagtatgtgaagccatttttttgtttgcttgtttgagatggagtcttgctctgtcgcccaggctgcagtgcagtggtgcgatctccgctcactgcaacctccgcctcccgggttcacaccattctcctacctcagcttcccgagtagcagggactacaggtgcctgccaccacacccggctaatttttgtatttttagtagagacggggtttcaccttgttagccaggatggtctcaatctcctgacctcgtgatccgctcccctcgggctcccaaagtgctgggattacaggcgtgagccaccgcgcccagctgtgaagctatttttattaccaccaccagcatgatcccttcagaccctcttaatcttgaggtccagagagataaagtaacttgtcctagggaaatgaatcttggttgagacaataactattgtctctgctatacaatgattaaaccaaagatagcagcaatcgtaagtggctgtcagggctcaggtctactcgcttccaggtcagaaccacattggtgcccgtactgtgatttatcattgcatacttatttttttcagagtgtagcacttgataggtactgtataaatatttattaatcagctgattgcaaagatcactgctgattttcaaagcaacaggtttctctatcgtaactgcttctcctccacactatcacgtccttataatttcagaacacccatctaggaaggactcatactaatgtgttatcagagggaaacattccacccctttttggaatgcagatatagattgctccagatttcaggaacactaattagagccactggtaatttgactgaagcgctaaagcaccaaagcactcacagaaggcacctttgtactcacacattagagcttttgtcactacatatcaaaaatggtcaagctgccttttgatggtacccgcaggctggatgacagggtcaagatgccagcccaccaaatccatcatcggaaagaaactcggggccagcccatctcctaaaagctgagtatgttgcacagattgctggttctaaataggatattctaataaacattgctattgtttttattgtcttgtgcagtatcgaatatgcttctcacatactagactttatgcaaaaccaccatgacctaaatgtttaattcagatctttattttctgtttcataaccccttttaatatcactgtaaaaatctaaatggatatacatgatgctcttttggtaccaagctttttgggctatacttttatggttaatatcagggtcacagcaagagctcaagagagcatgggtatagcttaaaagtgcctggaatatacttcttgtcctagcaattgataccctctcattgcttcattgaatttttcctgttcttaacctctgcccttgttttcagtaatattagtataatgagttgaataaatggccctatctataaagaaatgggaaaaaaatcgggctttggctgaaactcccttgaggattaaaggtataagggtgaacgcagaggtgaacttagatatctatgaaataaacagagacagggtgtttctcggaggttgcagccaggcaagagtctaatcagagtctgtggctgaacctcatcagcttcaccagaggacacatcctttctagaatctcctgttccatcccctacttcctgtggcctactcagaacctctggaattggggatggctgatgggagtgacaggtggcccatatgttccgtgacaatgcactgttcattgcttttctgaacacctttgagtagactttgcactggattctgagaacagtgcctagacatgtactatccaaaagtagccaccaaccatatgtagctgtcgagcacttgaaatatggccagtccaaattgaggtatgcttcaagcataaaacccacactagatattgaagatgtggtacaaaaatgaatataaaatatcgtattaataagttttccatattgataccacgttgaaatgataatactttggatagattgggtaaagataaaatgttttattaaggttaatttcagctgtttccttttacttcttaacatgtggctactagaacatctaaactgacaaatctgattacattgtatttctaccagacagcactgctctaaacaactgccagagaaactgtcttcatccatgtacaagttagcccagtgagaacacaactctccagccctctgcccacgttccactgcactcagaatgaaatctgcgctccttctctggctcccgcaatgcagagggacctgggccctgcctccccctccagcccccgcttgctgctcacttcagtcatgctggcattttcctcagaatctgcaggcttctgccaggtccaggatctttgcagcctgtccccctcatctgtttttgtcgtgtgggtctcctctcaagtggcagctcctgggagaagccttccctcacctcctgtggtaggaagaataatggcccccaaagatgtcacctcctaatccctggaacctgtgaatatgctaccttacatggcaaaagagactcaaaggaggaagaattttgagatggggagatgatcctgggttatccatgtgggccccatatgatcacaagagtcctcataagggaaaaagagggaggaaggggagtcagagagggaggtgtgatgacagaagcagaaattggagagatgcagggccatgagccaaggaatgcaggtggcttccaggagctggaaaagcccaagatacgattcttccctgaagccttcagaaggaatgcaggactccaacctgtgttagtcctttctcacattgctacagagaactacctgacactgcgtaatttataaagagagggggtttaattggctcatggttccacaggctgtacatgaagcatggctggggaggcctcaggaaacttacgatcatggcaaaaggtgaaggggaagcaggtacgtcttacgtggtggagcaggagagagagagagtgaagggggagatgccacacacttttaaacaaccagatctcatgagaactcactcactatcgtgagaatagcaagagggaaatccactcataatctgttcacctcccactaggcccctactccaacaaagggggttatcattcagcatgagatttggaccgggacataaatccaaaccatatcacaaccaattttagacttgtgacctctaggacaatgacagaatacattcatattgttctaagccaaaacatttgtggttatttgttatagcagcaataggaaatcaatatacctcccaacctgagactgtgccccacccatgccccagctcctctattccatccttctgggttcttctttttgtatcctttgctgctatcagactgtttctaatttctttgtggatttgtttacttgtgtattttctgtctctcctgactagaatgtgagctcccctagggcagagacctcctatgttatgattacctctgagtactcttgcctttgaactaatgcctgacacatagcaaatgctcactggtataaataaatggttgaatgaagaaaggcatgacagacaagtagctctttgaaacattcacttatagccaattggatatcatctgaaaacttttagggaaaaagtacaccccaaatattaatagatgaaacggacaacattgacagatacagatattggacaatacttgctatttacgaggtaccatgatgatgctgtggagatacaaataacttgatgatcctcctacagtctccactgagagacaagcatgggcacatcataaaacatggccaaagtatggttttaattgttggggccaaacgagtggtggggctttaggtatgagcagtgatgtgctgataaaccagcctgcaaaacaacagcgaagataagggtctgatttgcaatgtttgccaatttctgtggtgtaaatattcctacagtgattgatttcaagctaccattgcgatgtctctgaatgtggagctgggaagaaacatgtacacaaggatggttttgttgaggaggtgggatttcagttgggcccatcagggttggtgggatgtggatggcctgagaatagaggaggaggcatcttgcacacaaagggaagaatctcttcagggctagtgaggtgcgtctcaaaggcccctgtggctccagtgggtttcctgtcattgagagaaacagaaatgagcaactaatgagacgtcatcatgaagaggactccctggaaagatgcaggagcagggaagacatagataattttccagccctgtggtcattttaacaagcatggcggtatagctaacgcacaggctgccaaatcccagggaggagaatcaacagtccgtgttcatggagctggtcccaagaaatccagacctgaatccaggctgatgccctcactcattctgcctctcacatgtttagggtcgaaataacatgcagctcctccagcccaaagatgagccagcaagggaacttagaacaaccctctttggaacagttctcaaagtatacctccctgaaattcccctcctcatccatgactcaacccctctaatttgcaggcatgggaggtttgattctgaggatattaaggtagtgtttaagatgctggtgtgatgtttaagcggggggtcagatggtacccgattcaaatcctgactccacatgactcctggggaggttacttgacctctctagactttgggttcctcatctctaaaatggggataataatgatatcctcctgagagggtttggagcagattatatgatgcctaagagacaccctctcctgtgcctggtgcatggtaagtgcccaattcatgtgcacattgatggtgatgatcatgttttccccctcttaaggccttgccagacagagcagagctggtttccagcaagcccctttcccatccatagtcacctgcccatcaacttgctctgagcagggagccctgtagacaactggtgcagcatcctcccagcccacgtcttccctgctgatcactttaagagcatgcattcttctgtgttcagggtgagatgttttccttgctttgggaatgtttcaatgaaagacaaggataaggccattacgtgaacacagggacaacaacgaaaacaagactgctttctgaaaagcaccaaaaagccttattttgcctgaatggccattattttcattctttttccctcacacaaagcaccggagcacatttcattcagtctgttgctgagtgagtgggtgtgaagatgcagtacaaacaaaagtggtaacatattgctgttgtcaggactcttgttaagcgctttgcgaggtggaccaagcttccctgctagcaccaccgcttgagtcatcaggagcaacgatgtacatatacacacataaatagaaaaaccctccataatccttgacatggctacacggcaatttatgagcaggagctggatttcaaaagtctgcagaacataaaagcacaattttcttctaagatgacagcaccttgtcagccgcttccacaatcttatgtgtggatcctgccaccttggagatgcagttccttctgtgcaagaaggcaaaactgctccattcctctgacacattagggcccctgggtgtgagcgtgaaaggcctcaacggggttgcatgtgttggcagccaggtgcctggagagtggggaggacatgtgaggtcccagggtgctggggtgttctaggtcccaggctatccaaatcataccactcaaagtaggagaaaacctgctacctcctactctgagtttgctgaaaataaaaagcaattttgaataggggaaggaggtaaaccttggcacttgcttccttttgccatgtaaatcttggcatttaccataaactgtcctttcttaaagacaattctgtggctttggtttatggcaatattatatgtgtgtgtgtgtgtgtgagagagagtgtgtgtgtgtatgagtgagtgggtgggtgagagagagagagagattttttttttttccccacaatagttttcttcctccagcttttgtcaaaaagcttactctaccaatgacgtaagttctgagaacttttcttccggatcactggatggttctgaggaagtaggaagtgtgtgctgataatgtctcagctccctgaagggcaggattccccggccatgttccccatcaagtctccaaggtatccatgtgtgcccacattgtaaagtatttactgagcgagctggggaacaagcaacactattgtgactttttccaatttcacaatccctgacaggccctgtcagagggatccctgccccgatggcacaccagcgcttgaacctcagtgcagggcctgtccctatgtgattcagccagaagagcatcatgtttaaggacaccatcatgggtgttcttattgaataccaacgatgtgtctggcgtggtcgggtgggtgacacaagggtaaggtagtccatgtttggaggcttataggagctaacatcatacatgctttgagcctcttcccacctttccccaacccatgtccaggggttggcatcctgccttggtatgggccagctgcacagctgtgcgtgatgcttggcaagtttgtaatgttcacagtgcctataagctccagtcccgtgtctataaagtgaggataacaactcctaagttgcaggtttgttgtaaggattaaatgaaactatatacataaaatacctaccataggtcctggcacaccgtaggtgcttatgaaattttcatagtcagcttcgctttgacaagtagtgaaaaaaagctatctgaggaaacaagatgaacatacagaaagcaacctgggaatattttatagttagcaaataataaagaactaagtagaataaataatgagacctttagaataggctcaagctgtctgcagcctggaagggaaatgaaggatgtggggtgagtctgcagcaaacagtatcatcaaggacaaggactggagatggagcttgaagagatggcctaaatggctgtggttcctctcggatgacaagatttctggtgcaataaataatgtcatttgaaaaaaaaaaattcaagtgcctgattcatctcatgggatcatgggagtaaaatgaatatgagaaggaaacatgggctggtccaggtgggacaaaggccctcttctgctgacagcatctccccctgaaagattgccggtaatatcctttgtgtctgtcgctgtggcaattagtaatgacccccagcttggcattgagagcattcctttataacgagagccagccagacacaatctctctgctcagagttcagggcggagggggagaaccaggcagatccacacggtacacgcttccaattaaaaatacaaacagaggcaaagcaaaatgaatgtcacagaaaagaaagtgctgccacccactcttggcctaaaggtcactgtgccacagccttggccattatctgcagccgcaaaggtcaggggggctgtctgcattgctggggagtatgtaggctttcataaggtctcaaaatgactgttgctctgacaccaaaattagtgataagctctcagcagaagacgataatagagaaatggagtgactgtaaccttttccgccatctctcttgtcggttccatgaagcagagtcacaaggcataaaacgagaagtttccacattctacaaaagactacaagattgctgacttaattgggtgcgtaacaaatggctataccactgccaacaagaagacatcaaaaaggaaggagaaaatagcgattaaaacatctcatgacaaccctttgaatttggaaactggctccagatatacctggacaggccttgatacaagtgcagggagctagccatgtggttccattaatattccaatcattgtggcccagcaagggcaaccatgccactaactaatttgttgaatttcaggagaatttaaatataggaagaactggaagaacactggacttggagtcagatagacctgcattcaaatctcaattgttgtccctatttgatggacaatattataaaatcttttaccatccttgtactgtaattccgcaatgttttcatctggaaatttaatgactttaatacctactgcacaaggtcccagtaaagattaaatgtgaggaaaaacaccggaaaagttcttagtaaatgatcaggtacagtggggcgtggtggcttactcctgtaatcccagaactttgggaggccaaggcaggtggatcacgaggtgaagagatcgagaccatcctgaccaacatggtgaaaccccatctccactaaaaatacaaaaattagctgggcatggtggtgcgcatctgtaggcccagctacttgggaggctgaggctggagaatcgcttgaacccaggaggcagagattgcagtgagccaagattgcaccactgcactccagcctggcgacagcgagactccatctcaaataaataaataaataaataaaaataaatgatcaggtacaatacaaatacaaacatagttcgaattcaaatacaaaaataacttgaatcattattattattagctagtaatatcatccattatccctgagaaaatctctactcctatccactctgaggtaacgttgtttttctgtatttaggccatccagggagaaaaatttttgctgttgatgataaacagaatctgcaaaatgctacatgcagaactatttcgttgggttgatatataaaacactaaaggaaataaaccaaggcacacagcacacacatgaacatatggctgaatatggcctttagtaggtatcagaaacaaaattagcaacttgtagcacttcagctaagcttcctagcaacagaaatacataaataacaaatacttatgatgattatccctaaaagtcactggaatattagcatgtgatattggtccctccaagtgttctctagctcaaggcaattggcatttttcaattacttaggtaataaagtatttgatgtttaaacctgccaaacatcgaggacgaggcatgaatgatactttggcagtttaaagtattggcctccttcctttccagaaggaaatcaatcattgaatcaccactactccaaactcagaatcgcccaacatagcaatgtgggttttccttctaaagttctgtgcctgtccctgttaaacaggtctggagaagatgctggtagtcattttgagcatcgcacagtaactgaaaggagctgacaggctcagaggctgggcagagcttacgattgtgcttgtctgtgtggctgaccacatgggggatgctctcggcactgtttgctttattagcccgcatataacttcttgggagacacagccaatttggtaagatgtgggagaaatctgtactttaaagtttcctggaacactgggtatcaaaggaatgagacgtctcctggcctttcatgttgcaaactagatggagagacacagcttagcagaacagctaaagcttaggatcaacttttacagtaacatggaaaccacatgacagattgtataggcgcctgcataacttctgactcactccccaggtgcttctgttctctatagctacacagagccatgttgaggagacaagaccagagcagtattattccacttggtgaaactggtcatatttagtcatacacttatgagggaggacaacagcagaattagaggcagtgtctgagtttactctgcctttgtgcaggtaaaatgtgactcagataccagagggtgaatgtgtggacccttacactttattatttattctcttgcagtgtttgcttttatttatttatttatttatttaatgaaactaagtctcgctctgtcgcccaggctggattttgcggtggtgcaatctcagctcactgcagcctccgcctcccggatttaagcgattctcctgcctcagcctcctgagtagctgcacaggcgcccgccaccactcccggctaatttttgtattttcagtagagacggggtttcaccacgttagccaggctggtctcgaactcctgacaacgtgatccatccacctcggcctcccaaagtgctgggattacaggtgtgagccatcgcacccagccctgtttgcttatttttttaaaaagcatttatgcattaaattgaactaatattaaatacagtgtagatttctgggctaacctcatatatactgaatcaggaattgtgatgaaaggcctgggaatctaaactttcagcaacctcaagggatccttaaacccactcatgttaaatatggtggccctgctgatccatcctcaacaaccacatccctgaacagatctgaagatcatccctaccaactggggaaactgatgaagtggaaaaggaaaagttaaaagacaatgaaaagagctcaggtaaaactatcttcttggcatatttgaggccactattaagtggcatagaacgttttgcttctgaaggtggaaaccattcagatgccttccacaactcaatattttcttttcctctcaaccctcccccaagtaataacactgaatagagttcacctttccaggtctcttcctgtccaaccactcacctgttaagatttaaagcatggtagcagatctcctgaatagaatctcttggggtgaagaggtgagatccatcacgattttaaagaatcactgacctttttttttttttcttagaactagaagagtccttagatattatcaaaatatttacaagacaaagataagtcatcgatgcaaatgaattaatacttttacaacttgaaaaaaaatgtataacattttacatcatgcttgaatcaagggggaagaaagagtatgctgtagagtgtgaattcaggtgactcctggcaactgcatgtttaattcaaatagagcaagagagaaagtgctgcctcttttctggacagggaacgctgcctgaatgagaagagttttagctgacatttcagaggtggaacctggactgtcagaagcatgtgttggtaaggacagagagggagaaggggtgctattctggggacaaattagtttaggagaaggctcagaagagagattcaccaattgggtaaaccttgagtctatcaaaagaggaaggatgaggaataatgggagaatgtcagaaagacaaaggaaactcttgttcctaatctgtgcgtagaacactggaaggatgagcacagaggaagccatcgttgcttcattcattcctccactcttcattcaataaacgtctagtgggagagcatccagggatgaatgatacttagttggcacctataaggaccttgcaggctcgtgggccagccagaaaaataatgagagacattttcattatggtgggacaagggctatgatgaatagttgaggggcacatgggtgaagtataaatgcagacagaacatgttagggaaagctttccagataacatggcacttcccagggcttgaagagaaacaatgaacagagatctgaaccccagggggagctacccggcaagtcaagttcccacgaagaagcccgagactgaaatgatctttgctcatgcaccccaaatggaagtaaatgtatcagatgttgagtctttgccctctccaccttgaacaccccatccacacaacacaacatgccaggctttggaatgaaaccagcagtgtacactcagccaaagtgactgatgttgctttccgggtatttgtagctgaaggtatgcctactcctttcccatacaaacagaggaactcagctggcatcaagactcagcctcaaagcatccagccaagcagaaggcctacctggctgccgcacacgccctgcaaaatggcacacaggtgctatcatccagctagcagcttcagccgtgtaaccaactccagagtgttgacagctgcagtaaaactcacttggagttcaacataattaagcaaaatgattagtaccgaagagaagctggcaacaaagaactttggtttctgaggcaaaattataggatcccaggatattagagctggaaggaggtcttacagatcacagccagccacctccatttcacagatgagaaagtcaggccaagagaggtgaactgaagggctgaggatgacagaagaagctacacagtatcagggtaagagtgaggactctgagatcggtcacactggggtttgcaacccaagtttggaactcactgacttcaggacagcaccttggtctctctaagcctcagtttcctttctgaagtttgtgttgctatgaggattaattgaaggttattgcagggcctgttgcccatggccagtatataacgttactatggagagtcagaacacggggtccatggccttgcttcaccatgtatgagctgtgtttccctgggtctcagttcttgtacttatgaaatggaaataaagatgctagtacctgccctaattatttgccaggataggtggaaggcttgtgggtgagagctgtgtacacttctaagcaagtttttgttattactattcccattatggcaaaaacacgttctgggtctttctactggtaagtggcagggccaagacaggacacatgcagtgaagaaaaaagaccagggacattttctcccaggcaactgatggactgcaatgtttggactcacccagtatggttcagaaggtctgatgggtcagtgatgagctcaggcgggagaagaaatctgcagtgtattcaatgccaaagggtctcatttctgggtgggagggacagcggggatggggtgaagcaggggtgggcagcaggaaggagaggaaagaacctggggaaatcaaaccacctgcctgggtttcactctgagttttcagattcattaaaaagaaagaaaatacacacacacacacacacacacacacacacacaaaagcacaaagcaaaacctcagtttggtcaatccacaaaaaatgaaagacagggctgcaaaaagtgctgagaatgggattgctcgacttttcacagcttcagctggcttacaataccctcagcttggtgcttctcccgaatccacatctcaaacgctctaattagattgtgcagccgaaagaaggcccggtgcccttggaaataagtgattgcttacttgccacaggaatgttctgtgctttcataggcttcatctttttttttttttttcctgggggcttgggaatgaattgggcaatttcttaggtgtctgctccacagaaagacgttgagcttacatttggtttctctttttacctaggttcttgcctctgcctgaaatactcttggtctggcttccttacttgctcacctgctcacctctaagacccagttcagggctcccacaggatccatccacctaaatccttaccaggggtgcctgtggaatggttactgtttacctgtcttcccaccaagagatgatcccctaaggacaatggctttgtcgtcttcatctgttcacctttgtgttccctatatttggcatggcgctttgcacctggggccttgcaactcaaagtgtggcttatggcttagcagcatcagcctcacctgggaccttgggaccttgggaccttgggaccttgtgagaagtacagagatctcgagctccaccccagacttactgaatctgaattttctttgccttttttttttttttttttgagacagggtcttgctctgtcatccaggctggagtgcagtggcacaatcatagctcattgcagtctcttcgtgggactgcccaagagattgtcccatctcagcctggtgagactatagcaacacgacacccgggttttttttctttctttctttctttctttcttttttttttttttttagagatgggggtctcactttcttgtctaggctgtaaattttcagtttaacaagtttcttatgtgatttgtggccacactgaagactcaccagaacagggtggggtggggaatacttaatcaatatttgtggaatttacccgatgaaatccagttattcctgctgaatttctctctcctccaggaggacatagcaaacgagctgaggaaggtgaatgctgcaaccctctctcctcagccctgcagccgatccctgacataaactccttgaagttcagtggcctctttccatgcacctaccacctacacctgctgctttcaaagaaaccacaacctggaccgggaacagaactggacgtgccaaaatgcctgaggacacttcatcgaatgtggctggcttgatgggaagctggcatgactagaaatgtcaggagtcttccctctcgaggtttcaagctttgtgtttctgactcaatggtccggattgagatcagatgagtcaagttcagatgaccatgcaaacctttagatggggcctaaaaccaaatctgtgttctcaaaccattccaaatgtgttcatcaccagttatagtttaccataccacccaatccaagagagtgcagtcatttctctaatagcagatgcataattttctcatcaatggaaaatctaagtgtacatcacaaggtcaaaagttgcgagaaacttgacaccttcgagattgtgccaaacctcaagcttgcagtaataagggctctcagtcaaaccttctgagaatgaagtgtatttgacccaacgtttagcataagcaagcacgtactatgctgtccctttacgatggctgaattcttggctagactatgaaggaacacaacagcctaagcaaagcctatataaaacatcaacccacggtcatggcccaatgagatatagagatattgttgaaatccaagaaagtgaaacaaaaatcctgagccttattcgctaaattcccttaattgtgacacactaaacaagtaacagtcattagttctagtatcatgtaagtacaacattctaaaatggctactacagatatcaaaagcattaattcaatgtacacttactgggcacccactgtgtgctaggggaagtgtgctagggtaatggagattcaccatggaacttccttttattttccctcactgcctttctcttttcaaatatttaatgaccatccactgcgtcccagaagttgccaggcctggggcaggagattctctctccttaaggcccctgtgtcccagctgggagtgacagatacatcaaccaataaataacatggtgggaaaagtccattaataatgatgtgcacacagtccttaggggtatccttgaccatcatgctccagcttagatctctgaaaacgaccttttggctgttactgaggatgtcagcaataaaactggatcctaaagaaaccattcatgatgatatatccttattggaattgacaatgcatgaggaaatcacacatgtaggtcccaactgataaagcattatccatccattaagttagacaggagaggtggcttaatgtcaataacatatctcagaaaaaaaatgtgcttatctcttgatttttgtagatcaaatcccactagaggaattgggtatgtttgtagacccaaccacttacattgataaggcagttttcaaagtgcttttataagtatttgctcattgggtcctcagagtaaccctggaggtagctggtggctcaccagtgtggcatggttgtgatgaggactactgtaccatgctcttcgtcaagcaaaaggcagacagtcactctccacctttttatagatagattgactgattgattgagatgagtctcactatgttgcccaggctggtcttcaactcctgggctcaagtgatctctctgccttagcctcacgagtacctgagactacaggtgcgagccaccatgcctggctcattcttcattttaaaagcataataaatactctttaaaaattccaaggaacgagatgtccctctaaactgccttcttcctcttcgtgtaatttgacattaagtgtcctggtgtgttaagcttgcctctatttaaatagccctgcagaaggccataccactcaggcttaaggggacagaaggtactctgtcctggaagcatcatgacactaaaagttcattaagatctctatcccagctattacactcctaaggtcactgggctctcctcaataggtatattaagcagcagcctcaaaaacagtcctcagttttaggatgcaaggaaaataattcacgaaggtgatcaactttaagttcaaattatattcactctagattttatcatggctcctgcccatgaatataccatcttccattcacatctaaggcaactagttcagggtgagaggaaatgggcactttatgaacatctgctatatacaaatctttacccacctttttcctcctttagaatttttctaactcagtggactctccatgattcaaaggaagtccttgattttcactccttctcacaaggttacctcttacaggtaacagtaccctcttgcctgcaaaggtcaggacaagaggatagaggaaaaagctaagggaatctcagaaccgtttatgtgctaaaattcttagcttagatgtatagatggacaaggaaaagtgggcaagagaaagtaaaactaaaatttaggcaaggaagccaattacccagtaaagagggaggctagcatcctagcatgagagtatcagaccagactatctcagacccttagtcttgtggatcaaggcactgatggagggcactgtagaaaagtgttgaaagcaatatggcagacactactggattggcaaattgcatccgctcctaccaaaggatcacactcccagaagctaaaggaaagaaatggagagtgggaggtgtattttgggtaaaaaagaaaaagaagcgcttgtatgaattttcatgttatttcagtgaagtcataatagaacagcttcccttcccagagcttgcccagaacagctatttaaagggggagtgagaactgtacaagctttgactagattctgaggtcggagccttaattagagtcacaattgtattgtacatctatttgtgtaactgttcaattaggagtgtaatagctgggacagagatcttaatgagcttttagtgtcatgatgcttcaagactgcccttttttggttgttgttattattaagctttcatataggggcttttcctctctgctgtccaactgtgtggttctcccttcaggcaggttgaaatgcaagactgagtcttgctatatctaaacttgggcattaaaaatgggctgtcttccccttatcatcttcatgattagcttgtaaacagtttcttgggtctatcctgttatcaacaaaaactctaggaatactggaatattagggccaatcttttacagttgagataattgagattcagaaagatgaagtgaactactggacacagcacagatagtgacagagcctgggcttgcacattagtgttctgacctttcaggaacaaaacaatcacaatgcctgtacatgtcataataaggtcattctaacactacaatgtacaccagtacccaaactggatcattcatttaaaaaaaattcattcccgaagacatagtttttgtggtcttaataggtattttacttaattttcctctgcctttcactacttagacttgggtacaattaaagatgatatttatattttgtgttatatagaatgaacagcactcaaacacattcttatttaagcaaatctggcctacgaaaagctgtattcatgaaccctcaccaaataaatggtgaggatggttttttgttttggctttagaaaatgattctctgccttaattccctcacatgtaaaataggcataatactgccatctaccttacaggattgttgggaagattaaatgaagtaatgcagttaaactgtttagtagactgtttcgcagagcttcaaactcagtcaatactagctgcttttgttcttattcttttcattatcacaaaagggtggccagaagattatgcatgccaactgtcagaatctttttttttttttttttgagacagagtctcgctctgtcgcccaggctggagtgcagtggcaccatctcagctcactgcaacctccgcctcccaggttcaagcaattcttcttcctcagcctcccaagaagctgagactacaggtgcgtgccactgtgcccagctagtttttgtatttttagtagagagggaatttcaccatattggccaggctggtcttgaactcctgacctcgtgatccgcctgccacagtctcccaaagtgctgggattataggcgtaagccactgtgcccagccctcagaatcattttttatattttgtaggaggaggcggacaactggggtggcatggtgggggtggtttaagtgttaatattttgagatgattaaaaaggaagagaaaatgaatgtcagagcttgtgaaaatgactgttgagacaaaacaattactctgttataaattaataatgcaattaacttatgatatgttattgagtgcttgaagaatggatagccctcaaatattctttttaaaacccatttattgcccaagataaacttaagggtagtgtcacattttgaaaaatgttattttattggccataatttttcacagtttcgatggggacttagtgacagcccaacacagcaaacgtcctttcatgttaccatccttgttttttttttttctttcttctaaagctaaattgtcctgggacactccaaatgtgatttatttgtcccaaggccagtagaagtttccatgtaggtgaaaatggatgtttggctagttgaagagaaacggaaatgagttctgcaagctgacttacccagtggaaatgggtaagtaactcaggaacattatatcactgtacattctgactataaggaattctggataattcatgtcccttatagatacatatgaacttacacatgatctatcaggaaggaagaagacaggagccccatgaagagggtgggcatctcagtgccaggcctttgtgctatgtgctttatttactcacttagtaattgcaacggtctagtgaagctttaggttccaaagtcacagagcaccaagtaacactaccactgggatttgttccacatttggtattgctagtattgtggagactttgttttaccttgcctcttcctttggggaacagtagtaggcatccacttttacaagaaagttgatgctgtgaagaggaaataagaggccagataaattcaaggtaaaattaatgaagatatgtttagatcctggttctcccattgcctggtccaacgttctttccaccacattccagtccttagggatgaggtagaaagagaaagatgtttgatagacctgataaaccctgaacagggctccctgtcagagaacttgggttccagtctagtctgtgaatttcactgcctgaaacctggctctttacttcctcacacctgtttcctcatctatcaaatggagaagttggtctagaagatctccaaggtccatttcagatctaacactctattattctattatctttgtgctctggtaagtagaagcatatagccctgggcttattaatattaactggggcaaacaagtgaaattagtttatgaaaatagagctgtggtttttgcttggagccaaatctgccttatgagactcactttaagcattggtaatgggattgctgatggctccttggccagaacctcaatgccctgctgttacactttccaggtggtgccaagggtgagcgtcctctgtagacacatgaaactgaggcattacacagtttaagtgaaaggaataaatcaaatcagttacattcagcctgactcatcttttgtctatcttttctcaatgcttgttcagtccagctcagtacgaaggccaacccttcctggaaacagccccttccagtcccagcctgcattgaatgggttgcttcacccaaccacagagagttcctactctctacactcataccatttatattttgggactcaggcctgtctatatgtctcaatagctgagagctataatgaagatcgttgtgtcaggggtaatgctttacgcctttgttcaggggagagatgggatattaaaattttttggcctagacaacttatcttcttttatttatatatttttacatgtgatattttgatacaaacatacaatatatagtgatcaaaatgcatcaccccaagcatttaccatttttctgtgttaggaacattccatttctcctcttttagttattttgaaatagacaataaattattattaactatagtcacccctattgtgccaatgaacattagatcctattccttctatctaactgtatttttgtacccactaaccatctcctctttatatccacctccccactattcttcccagcctctggtagccattattctactctccatctgcatgagttcaagatttgttttagctcccacatattaaatatttgtctttctgcacctggcttagttcactcaacataatgtcctccagttccaagtgattttgtgatttataacaagacatatatatttggtcttcatccatttctgttactgagttcctaaaacccttggaatttcagaagggataagagaatgaaggcaaaatcatcatcttttattgttcataacatacccttttcaattacacctgcgtttatattaatgactgccctttaggaagctcctaagcatggggggctggttgccagaggaacaaactgtgtgattgggactctcagccccactctccagacctctagggaggagagaggggctggagtttaaattagtcaccagtggccaatcatgcctacatgacaaagctgccataaaacccaaaaggacagggttcagggagattccaggttgctgaagacatagaggtgctgggagggtggcatgcccatcccctatatcttgtcttatgcatcttttccatctgggtgttcctgagttgtatcttatctttatctatctatctatctatctatctatctatctacctacctacctatctacctatctagtttcgagtcagaatcttgctctgtcatccaggctggagggcagtggtgcgatcttggctcactgtaaccactgcctgcagggctcaagcgattctcatgcctcagcctcccgggtagctgggactacagctgtgagccaccatgcccggctaatttttgtatttttagtagagacggggtttcgccatgtttcccaggctggtcttgaactcctgggctcaagtgatctgcctgcctagacctcccaaagtgctaccacactcagcctttttgtataaacctttttgtatctatcttttaatataaaccagtaatttagtaagaaaactgttgtcctgagttctttgatctgttctagtaagtgactgagcctgaggaggggtactggcaacttcgaaattatagctgatgggtcagaaatcacaggtgacaacatgtagattgacatcttaagtgggggcagtattgtgcaactgagcccttaactgtgggatctgatgctatttccaggtagatagtgtcagaattgagtttaattgtagaacacccagttcgtgtgtgccacagaactgaattgttataggaaaagaaacgcacacatcaggtgtcatatgtgaagtactgagagcagtagcagagaatctttcctcttagggtatacagatgggagttcataggctatatatttgacctacatcgccctttttgccaagtttattttaatgttctgctcttgggttctaacaaaagatgcattagagcctaagtgtatcaatgtgctaaataattaatatgtactctatagaaattttgttgaggctacagctaccaggatctcttgatattctctatatgagatcctatgagagagttttctcacaatttcatttcaagaaaatggctaccccgttttaatgatcatttgattaataagaactgtgaattgacaatgtctcccattttattttggttgccaggaagtccaggtgaaatacgaaataaattgatgcactctttcttgttctatataatatgtatagtatatttttaatctggtcatgatagttttcaattttacttacacgttccctgatcctgcttctctaatcttatttatattttgccattgttatatatcagaagtttccttctattttccccaaatagctcttaaaataaggtgaaatatatataaatatacaaataacacccataatttgtttaaatctaaaatgcctagcatggtgccagaattttagcagttaataactactgcttgatttatagggagacacattacaccttatagagaagcagtttctgagagtcagagctggctggagaagaactgcatggtccctgtcactggaggtatctgtgaataaactagataagcactttggctcacttagttaagccttggtttctttaactggaaaatggcagtaatagcatctcccttggaggtcactgtgaatagtataagttggtacatgtcaagctctcaagctcttagcacagggacgcacatttgaaaaaagtagcctttattattaatgaggacttgtgcattgaaagctgttttattagcttaagtacacttccaaacctgatggttctgttgggctagcaagccctcagtcatcagaagaatcatagacttagagtcttggaccaaccctgcctgtgtggctactgtgagagggatttaaacagcaaatgaaggactggatggagtggcctttaggcttccttccaccccaaagtgcgtggtacttcggtttcaaatccattcaatcagagatggcataagggtgtctgggagaaaaaaaggattctaatgtcattttattagaagttctcccttctttcatgtgtaaatttcacttgggaccttatcaattggatattaaagcattttccaggggggaaaaacactcagtaagaggaaaattgagaaaatgtctgagagcacttcatgccttcctgtctatctgtacataaagagctgctttcttcacagctttccaaacacaggttggcaacctgattatttccactaggcacagacagtacacttcaaacaaggaagctgaccagaacccatgccaaacatgatggatgttccagttttattaccatcaacctcggaccaaatcactccatcaggcacccccccattattttacagtattttgatggtggtatccttcagaaaatgggccacatctagaaaaaaagaacacatcagttccttatattttggctgaaatgaccataaaattgcaggtcctcagtgcagccaaggtaaccattttttcccactgacctttgtgtaaggagttgtcaggcatcggaatgtggctgaattaataggtaggacctttcccagagatatagagggcacaggctgatttcgcgattttataaacagatttttcttttccatgaaaatcccaggagaggcatctattacagaggttgggactataggtgtcacccaggataggccacaatatagattatccaggtgcacctaacaggagaaggaaaggtggtctcaataatgcagggcatgtttcagcttaatactcctgagttcagccaacactttggttagaaacatgattggaaatctcctgttgatagagtctctccaaatagactcttatcaacaggagattgccagtgggcaggtctgatggcacacaatgtccggcatgtggctggtcacataacaggtattataaacatttgttaaaagtttaaatttgccccagctgctctcaagtaatggcttttacaagtcccagacttctaggatcgaaaaatgcataagcaagtgaccactcctccctctccccttggaaaaccataaaatggacaagaaagtgcataagcgatgctagccctaaggggaaccctggccctgacacgttttgccatcctcctcttgttccctctggcttggtagtgcatcactgttcttgcttcctccacacttatgtcccagaggaggcaacttgactaggatacattgcaccactcagaattcataataagatcaagaagaagtgacttgaggactctttgtgttccttggttgcctgcttatcttttctcactgtggttgactgggccaaggaaaatatctccatgaagtagtctttgcaacaatggtataagaattcaatcagacatgtgactaggccttcctattattcatgatttcagtcataagttaatgagcaaagcaaaggttattccgttactagccacagctggctacagaaaccaggtgctatttattcagagagttattgaactgctggtatgtaccaagtagcatgctaagcactgtggggctaaataaaggtaaattaaacaaacatcctatgcacaaattaattatcctatgagggggaattagacacctacttacatgaccagagagtgaaaagtgcacctaagagctatggacagcgatttttgtggattttagaggagaaataatgtcttctgtttacaggtatctaccaggttgtacggaagaagcagttcatatgttggtccttaatggataaaaggcatctggacccaaggaggtagtggaagtgtagtgagagtggcgacaaccatagagcagaggggcgtctttagctagcaaatctctgtgggaggatacattagactaagaaggcacttggccattagattacgtagtcagtttataactgtatatgcgtggtgacgctcaaacacttttgcacagaaacctacttggcgtcacaaaagcataagacctcctggacaatggcctgcatcttcccctccccactaggcattctggttgtcagtggtcacaggcattttatgctaggccaatccttacactcactagtcacatatgggtcacttatagagttgtttaactgtccctgtgacataagcataggcttgcctttggcaactgtacaagacaagtcctaatcctattgttcttttccaagacaatcaatgtgatctcttgccaagaagtattttttaaacaacttcttaactctctcagttactctactagtcctgttaggaagacacatctggtttgctagacaatcaatgcaagttggagaggtttgatactcatgcaaacacagccagatcctcttttctctaaagtgagaacttttagaaatgtcttcttgagcacatcggaacaagcataggaaacagtaattagaatggacttcaatgcataatagatcaagtctacaaaaggagatgggttggagatatccaggcaacagaagttttgcacgtttccccaaattacattcctgttgcagatcaaagatttgtttttttttcaaaccacaccaaagcacacatttggaagccaaactcctcaagggcacttaagaattatttggtaaccttcctgttaaatttggagttcagcctacaagcttaaggtacaccaaataatggccttcactgaatcgctgccctagcaaacaaagcattgtttatgggattggagaatgacatctacatgaggtttgaagtattttatgtgcataatgtgtttcaagggccatggccagccagactacctgtaatgccattcatcaaataaatattaatatcaccaactcagattttgactctgttcttccttgtgggagccattcaacctaggagggttgatgagggaaatattgcccctatattccaaagctgaatggtttttccacttaagaaaggaagacttttcccttttacagaactggctctctcttgtccagtctagccagttcaaagcctcttatgtgaagcagtcagcttccatataccacaaccatgcataattaaaaactttaaggatgttaaatgcaatgcagtatcctggattggatcctggaaacagaaaaaggacattagtggaaaaaactggtaaaatccaaataaagtctggacttcagttaatagtaatgtgccaatgttaacttctgagttttggcaaatgaatcatagttatgtaagatgttaacgttgggagacactgggtaaaaggtatgcagaaactctctgcattatctttacaactctatgcaaatctagaagtattccaaagtaaacagtttattgaaagctttgtggatgaacttatgctttggagaataactcactggcagcactatgaggtaatctctatcataaagcaagtgtgccatagcaaaataagcactagtctaagaggtaggagctccatgtctgaggcccaggtctgtacatactttaagctgtgatcttgcattggccatttaacctcctatagaatgaatacctacatctgtgagatgctctgcatctctcacaggggtattaggaagatcatatacaaagatgctctggagaatgcaatgaaaacctaaaaggataacaaattcaaaatgcggtctgagcaagacgttgggtatcttgagaaggtactgagccatgatccgcaggcaaacacaaaggcagctattgtttggtcttcactctggaagtgggacagcaagagaaacttttcgaatggtacctgagagaccacaccagggtctctcagggtgcacagaatttagcaaccaagtataaagtagggcagtgagaacagcaaaggttttgcttgacatctcctggaatctctgaaactgcagagtggaatcacttctctatttagtgactgaagaggtggttcatacacaagtagaggaatcttgtggtcccaaatgctagcaccaccacttgttgatttgtcattccaattaactagttctttcctatggcagtacatctggtctttcttgcacaattccccagcaacaacaatatcaaagtcaactccttagcatggtgcacaagctccttcacatctgcccccctggctcatctcctgccctctcctccttacctccagccatgcacccctatgtgctgttccccaagtgcacatattgtttagtgctatgtgctcttcacctgctcttcctcctctctggggtgcccttccatatcttcctcaccagcgcaatccctactcaacttttcttttcctaattcctttatttatgggctccctctttcctcttctccttcttcttagttttcgtttttcacatcaagtgccgagtctataaagattcttccttgatcttttgtctctcccagtctcagctggtgcccagagcctcttgtgcccagaatttcccctcactcatgattaaagtgttcatctcagattctgactctctccctaacacatcctccacaccagattgtggtcttctatgggtaaaggtcgtgtgtgtgtgtgtgtgtgtgtgtctgtgtgtgtgtgtctgtgtgtgtgtgtctgtgtgtgtgtgtctgtgtgtatgtgtgcaagttatcttaatcatttagccaaatattcagtacaaagtaggtttttggaataaatgaatgaatgaagaaatggtcatgccccttagatctagtccagaagtatgcaggtacttctaaaaggccaggaaaacttgggattacatgttaaaagttacttctattagaataatttccaaatacattcatataacttgtggtgagctcacacagttcggtattattaacaatatgtacagaggattttgcagaatgacataatgagaatgacaacattttatgactaagtaccagataatgaaagaaaattaattaatttgctgctaagataaatgactatacaaacttaggggggaaagctgccacagctattatgtttctaagtttgttctggaacataaagtagcttccaccgaacaactcccacctccaattagctgtattagctctattaagttgaaatgcagctagagatatccggttgctgttttaaacattcccaaataatacattctggagcaaaaagcaaattttgtaggtaataggtataaaatatcagggaatttatctttcacatagtaattcacaaaagaaagggcaaatacagaatgcaaagcagtctgtctatccttctataaatattcgccaattagcttatagggaagtcacttaaaacaaataacctatttttttcaatgttaatattaattttaccaagccaaggcatgaagtcctgaaaagggaagaagaaaaacctacaacagctgtttatcttaaatctggcatcccttttttggctcaagaaaattgataaaaatctcattttataataagttcactgctacataaaatttatacatttgaacattaaattttatgggttttgtttttttaggggagtagattatactaaaattctgcttatttgcagacaaagctgtgtccttgagggtatagttgaagttagaaacaaaatgttttatcttatttttttcaaaaatatgcattaagcatcaactgtgtaccaggcactgttctaggtgctgggaatacagcagtaaacagaataaactttccaactttgtagggttacattccagcttaggggtcagtaaacttccataaagcatcagcagagtaaatacttttagttttgtgccaagactgtcttttgtaagactcaactccaccattgtggtacaaaagcagccacagacaatacatgaaggaatgagtgtagctgttttccaattcaactttattaatatagaaaggcatggggcctgatttagcatgtaggccattgtttgctaactcctattccagcgtataaaatttcttcttaatcaccaaaactaagtaggggtattacagaatttatggaatgatttacagaattatggaaatttagaattgaaaaaggacatccacttattttaaccttattttgccctgaggaagtaggatcatggttaaaagtgtggcctctggggtcagcctgctagtgtacaaattctgctttttcactaactataggtgatttggggcaagttatttaatctttcactttttctcattgataaagggaagtgaataatactatctacacctcaggagactcttaggataatccaggtaaacatttatcagggcatatggctcacaggaaactcacaacaaaattctagctattcatcagaacaacaacatcatcaataacaacaataatggtaacaacaaaaacactgagactcagagaggtgacaggacttgcagagggtcccatagctagacccctagcttactgacccctaagtttactgacccctaagctggaatgtaatcctacaaagttggaaagtttattctgtttactgctgtattcccagcacctagaacagtgcctggtacatagttgatgcttaatgcatatttttgggaagaaaaaaaaagataaaacattttgtttgtaacttcaactatgccctcaaggacacagctttgtctgcaaataagcagaattttagtataatctacccccctaaaaaacacaacctatacaatttaatgttcaaatgtataaattttatgtagcagtgaacttacaaaatgtccagtgtccaagtcaggataggaactcaggctctgtgcctccaaactcaggatctcgtctgatcacttgctgtccttcctggatctcggtaaatcatgtgatccatgagtaataaatgttgggtatgtctacaaatggtagcaggactcactcagttcaataacccagggaattctagagctgggctgtgctgtatggagaggcacttcagggaaacagacctttgagagttaaccaaatctttctgttagaaatgcgtctgctgttgtctcaccagtatgtccaacggtgaggataccagtggaaatcacccaggagaagaatatggtcattctgggaataaattctgcagccacggtggatgagagaagccaatccctctagatatgaatgaagccaggccttcagtagtagattcactgtgaaccagaacgcctgcaggaggttaaacattttggcttttttcacctgatggcaggctccagtggaccacccaaggagccctttgaaatactacttttcatggtaattagtttcaaacttttgcttgtttcacttaaggatcaggttctctaaaaacttctttgaagaccacagttgttcagcgtatttaatgtcagttatcctcaaggaaagagaaaaaccagttgtgaaagccaagggttttataccaccacaccctcctgaagtcccacagatttctactatttcaagcaaatcaagccacaatagcataaatgttctttcaaggaactttaagctaattaattgtgaatgtgacagctagagtacagagaattaatttcctgaggttggtctcccccaaccaaaaaatgtgttttttctgaagttggctttctgggatctgtcatttgtgggctcttacaggaagtgggggggggggggggcggctaggagaccaccacacttgttggaggcactcggaattcttttgacaaatggttttgctgacttgagacatctgggccatattgggcttaaatttgattttaaaatctttcttcttaggccaaagataatgttctctttggaaatcctggacattactgcactgatgcccatacacatcaaccttcacacatttttttaaaaccttcgttatcacatcaaggctatgtgataagagtcacacaacttcagtctgcctgtgacaccatggagcacacttgttaggatttttgctgattttttttttctgaaataatttttacatagtaccatttccaggtaattttcaaagagaaacttcatctagtgtttatgcttcaatcattcatatgcttaatacaggtgtatgggacatcttctatgcctgagagttaccaggtatctgatatcatgaaaacatggctctttcctcaaggattagcgagacagacacctagtcacaattcaagatgctaagtgctattaaattttgtggatattggacatattttcacttgcgagtgggagctaaatgatgagaacacatggacacgtagacgggaacaacacacactggggcctttcagacggtggagggtgggaagagggagaggatcaggaaaaataactaatgggtactgggcttaatacttgggtgatgaaataatctgtacatcaaaccctatgacttatgtaacaaacctgtacttgtacacctgaacttaaaataaaagttaaaaaaatactttgcagatattggggaagactttttagaagaaaggacatctcaacacaaggctgagaagtagttcaccaaggcaagtaaatgaaaagcacacatcaggctgagcatgtatgaaatccagatgcagacacaaggacctcttaagacctaaggtagtattactgaacaatgagagcctgggtttctttcacctgcttggtgtggtacactcttaaccttctcatctacctctctctccccaggacttagcatagtgcccgctattttataagaatacagtaataatgtcaaatgaatgaatgagtgttcttatgactttttttggacacaaatgttcttcccctgagatagtaagttctcttaagatagggtgtgaggctgttttgatgtaatccaaagataacttaactgatttagtctgtgagtaaaaatggctgttattatttttaaaatccaggtagatgttatcactctcattgttattataacactgttatcatatccaagcatttttaatgaaaacaccaaagtttatcttataaataacaaatccattacaaatctaagactctgttaacaatcaagatccatattaatggagttcctgacacttcactacttcagaaacactagtaaaataaattaataaaataaagcagtcaaagcaataaaagaaagatttcactttcatgctatggaattatgtctgaatatacccataatttcttccctttgcagaaaatggtaaaattgcctaaatcatagatcagtggtgctctaatgagacccgatttggattcacttctattcaaggcaaactaactgtatataaatgccttgctttaaacattcacaatattatacaaactatcccactgaagtgagtttgggctgggaagaataaggtgtggagcctaaattaagaattttccagcgttggccaggtgcggtggctcacacctgtaatcactttgggaagccgaggtgggcggatcacgaggtcaggagatcgatgccatcctggctaacaaggtgaaaccctgcttctactaaaaatacaaaaaaaaaaaaaaaaaaaaaaaattagccaggcgtagtggcgggtgcctgtagtcccagctactcaggaggctgaggcaagagaatggtgtgaacctgggaggcggagcttgcagtgggccgagatcgcggcattgcactccagcctgggcgaaagagcaagactctgtctcaaaaaaaaaaaaaaaaaaaaaaaaagaattttccagtgttgaagaggacagagtgactttctcctcaccagcctcaccctctggggacacagagagagctacaaatttggcattacccagttggtggctggtgtgactcagaaggagggaaaatcatggctcagaaactgaagatgtgttgaaaccaccttgatcttttgaggctccgcctgctcgccctgcagtggctgagtcctgaccatcctcggaggtcactcctgctccccgaaagctctgctcctctgctagtactttttagccttcttagctaaatcttaacttactattattgctcagacctctgtctgaaaacctgggccctgcagaaacagcagctattggaagcaatactcctgtaatgacctactgtgcttatttttctagatgaagtaaattatgtctgaggtaatgtcttgcagggcgttagttaaggaaaaattcccattaggtaggcctccctacaggtatccagaattggtgtcttatcctacaatgtttattttaattttcttaatttaagctccttggattccagacctccagaccaatggtggatctgctcatcaagtcccaactcagccactcatctgtcagcttgtgcaggttttgggacaggatctgaagacctccatgacctttctacttcttggagtcatgatttctaaaatctggctggccttggtcttcttggctcccaaggtcctctactgcccaagttcctgtgtcacaaaatcaactgtttccatgtgttagaagcatacacttcatctccactagcagcagcaaagaatgatcacctatctttgtaggggagcaggggtttactgcaatagagaaccagggtagtggggcccacagtgctgagtttcaatctgttgctagttgctaaccaggtggccttggagaagttttttttttctttttttaacctttccaaacctcagtttgttcatcagtaacatgagaataattatggtacccatacatcataggactgttgggtagagtatatgagataatatatttaaggcctttaacagagccaggcacacaatcaatgctagaaatattagctgctcgtgttagtgttacttagagaagggaaagcaaataactgtcaaaagtcaataaaatgatactctaaacatctaattaaatgcaacctgataatcatagaactgtacatttatatgatttgaagcattttttcctaaaaagaacagttagtttctatgattaattatttagattacagaaacaaatttgaggactcactttaagaggacacgaagtggcaccaatggagatcagacatcagaggatatcaatgaaatttatgtctaacaggctaatagcactgagggttagggtcagggttctggaaattccactatattaaaaggaaatgcttttaaatgttacttagcagaaacaaatcatctcctttttcaccacttgtaaaataagtcacaaacataaaccttccacatctacgtgccattttagaatgctgtttcctttaaaagcacacatacaagccatccccatgaatgtgggattgtcactgggtcactagataaaggagatttataaaatctgtgactgcatctcctgtaagcatgctttgaagaagtaatctactccttcacccatgggtcctagaatatggcctgcacacagacaaatgtgtaagttgtaaggagcagttctgcctccctcagaggctgaaattctttcttctgaccaatcacatctcaccttactctttggtttccaggaacatttaaggattaactactggaaatcctgtaggtctataagcccatgtatttctattccctcacccactcctcaccctggcattggtttggcatccacctcttcactctatcttacttttggtcctaatttctcaacaatgatttctattaggtcaaccctactgtcacttatgtaggtcaaaaacctttgaatttcaccaggcacggtggctcatgcctataatcccagcactttgggaggccgaggcgggcagatcacgaggtcaggagatcgagaccgtccgggccaacacggtgaaaccccatctctactaaaaatacaaaaattagctgggcgtggtggtgggcacctgtaatcctagctactcagcaggctgaggcaggagaatggcttgaacccaggaggcggaggttgcagtgagccaagatcatgccactgcactccagcctggtgacagagaaagactgtcaaaaaaaaaccaatgaatttcaacaacttcatttgattcaacctatttttcccattgttagtttatggatttgttgtaggccagctcaaagcctccggaaaaggagaaaatatatgcatatagcaataatcagcaacagactggtttttatagatattcaacataacacaaagaaattaaatttaatacgtgtctgacctgagaaagccagaaataaaaaaatccgccgatgcatttaactttttttcttagggtatgccttgctttaaaggtgaggcaggtactaatctacaaaacaaatcttgccacctgacacctcagcctctatctctcacccctattttaacctcaaggcctcttctgtagaccccattatggactcctcaatggttagacaaatgctgatctaaacaaggattaattagaagtgagatgaaaacaatgctctgtactctgccttttccacactgagtcttatgactccaaacttcatcatgatctttggacccttgctgcacctttcttattgtcagcctctgctcttggactgcacttgtctttcttcccactgccacaccacacccctatggcctcctaagctgcatggctcctgccattcccacatctggacacactcagcatgactgtctctgctgtttccagccccactagagagagaccctcatcaggccaggaggccccagacaggcacctctgaccagccctgctgggacccagtgctggcccaccatttctcccaaagggagattcaatatattcaactgtcctgaagtctctactctacattggatgaaacaccattttaccatgacttagaaaatcaggatacggcttaaactgcgaggctggccattagagctgaggctcaaagcacatttcaaaacccaaaatggccactctgtcactgtcatttcatttttagtaaacctctagcctttcttttaccaccaaaaaacaagaagagagagagagagagagacagagagaaaagagagtgggagtaaaagggaaagagttagaaaacagggtgactttttctgaacaatggttgcattaaaaagtgtccttgaagcagagagaccactcaagaaggaaataacacctcaaaccagggggccattcaccaaaaaagagttcacatttgaagctctttgcaaaatgttttcgtgtgtctgctttcccttgttcattacaaaactgatgaaaaataaagatgataagtatgtttatacaaaaagaacccattcaataattcatcaccttgttggcttacaatataactactccaaaagaaacgtgttttcctacccactgaccatgaatggatacctgagacttaaatatggctcagagcattgtcttcccgcgcacgtgttgcggaactgtccccagtatgctgcccgtgctagttaacccaggtggggcttcagccttgatttgccccactgttctgtatcttccatctcttatgtctcccactacaaagcatgctggcgaacacccaaagttttgtttcgttgcaaccactaaaattcactagacacggaattatagtatttttcagcctagaatggcattctcgattaggggcaattttgtcccctagggtatatttggcaatgtttgaagacatttgtgattacgacaactaggaggggagtatgcactgacctctaatgggcagaggtcagggatgttgctaaaaacatcctacaacgcaccagacaacccttcatgataaagaatgttctggaccaaaatgtcagtagtgctgagattgagaaactctggcctaagtggaacacagtagtaagcatctgctaggccaaagcctagggagggaagggatgacaggatttgcctagaactacccagtttggaggtggtagagctacatgcggcactcaggttaggtagtgctatatatttcctctacagcatgtttattctaaaaggacttaccctttagatggagcttaactacacacacacacacacacacacacacacacacacaaacacacacacacggtctagaaggatacacacctagacgtaactggtgattactgctggacataggattgtactgattttccctccttgttctgatacgttcagccaagatttgtttggtttgttacttttgttttgctttacaataagtacttactgattttataagcagaaagaataagaaactatttttattttgaaaaactatatagggaggccgaagtgggagaatcacctgagggtatgggttaggagttcgagaccagcctggccaacatggtgaaagcccatctctactaaaaatacaaaaattagctggtcttggtggcaggcgcctgtaatcccagttgctcgggaggctgaggcaggggaatcacttgaacctgggaggtggaagctgcagtgagccgagatcaagccattgcattcccgcctgggcgacagagagagacatcgtctcaaaaaaaaaaaaaaaaaaaaagaaagagagagagagagagagagagagagagaaagaaagaaaacctatataaaatgcagttgaatttagcttgattagtatttattgccggtgtgagcacagcaagaacagcattacgaatcataggaaaaggatggatacgtggtacaaatagggactcttttggaaaactgacaacatggattcagagtattaaatatctaaaatatggcttaataaattatagtttgaacaaaatacataaattatattaaaaagtgtttgtttaaccccaaatatatgcaaatgatggaatggtatgcagctgttaaagatcatgttttccattatttcagtgttgatctccccattaaactgaagtccatgaggccagggatcttgccttttcaattccttctgcatccctggtatccaaagaagttcacacagtaggtatgtaataattattgttgaatgattaaaatgaataaatgaatatagttatcagtgacagtattacagataattagaatctttttatttttctgttaatatgtttctaagattctccaataagcatgtgctacttttataaatagaagatagattgtgttgtttgtgcaaaaagtaaaggaacagagaacttaagtaaaaaagaaaaatggagtacaaaagagtatacgaaagggtgttgagtacttggaaagcccattccacgatgcaactgagggataccacgatgtggctaccatggattccaagtgtgggtgttatatttagccaattgacggccagcactcctttgtcaaactggttttctcttccagcattcttctctgatttgagcttttctcccactggtaacaccaagagctaaaacaatggagaagctacaaatgagattcgttggttatagcctccagtggcccccacagtattggaggcattgtggcagccgtagaggctggaggtgcttttcaactggattgcgtccgtggctgacaaatggaataaaagagctatgctgtggtgctcaaaatagaacagaaaaaaaaggatcccaaagagagaaagagagagagagagagaaggacaagaagaagaagaaaatggcacagacatgagaggctagcttctggaacaacctaaaaagaccaatgttaacccagacccatgaatatgattctcacatcctttgtagaattttttttttttttcaaaagtgcctctttgggactgcaaccctgaaaaatgtcatctgcccctttgctggaatgactggatacttatgtcacccagtagaaaaaaatgcctggtgattttatgtatatttgactacttgtggttatctgggtgaggtgactgaagaaacaaacaaatctaaaaatataaatccacatttgtgtatggagagagagcaaaagaatctgagggaaaaaaatgaaagagggatacagggagagagacagggagatgtggacagcctgtataacagggtgggccccacagtaactgtcatggggtagagttagcagttactgaagtggtctggagtttattgactctattaaggtcctatgtcaaaacccattctctcttgccttcttcatcctcccaaaattttgagacagtatgtctttaccaagagaaaaatcctttcctccttcatttagagctatagctcaagatgaaaacagcccccaaaagagcacgggagtcatgagtgtctcattgtttttgagcacaggttttagggacatagagcaaggatgattgggaatccaggggtgagaggaaggtgggagtcactgaagaaataacaggcccccaaaacaaatgttgttttccttatagtttggaccatagcaagccctgtctttaaaagcagccttttcatttcattctatgaaaacagcgtatatgactgtagtagattaaagatggctatatatttttaacgctcccttcagtgagaagtgggtttgatttccactggccttgaatctggactggtctataatactttgacaaatggagtacagtggaagtgatgccatgcccatctggggctcagcctataagagaactcatagcttccatcatgttctcttgtagccctgatcttccacatgagaagtccaagtactctgtagtagaaccatgtagagataacctcagaaaacatggagtgtgcagttgaaccccagacttccagctatccccgccaggttaccagatatacaagtattgccatcttggacccttcaatgcagcctggctgcagttgaataccaacaagtgactaactgatgctaggcagaacagaagaattgcccggcctagccctgtctgaattcctgacccaagaaacattgtgagatataacaaaatggttgcggctttggctacagaattctggagtagtgtgttttacagtgatagacagtctggtccaggcaagaggatgacaatgtctgtctactttcaatgttggctttgaatcaaaaatatatatatttcagatagattgatcgacagaacacaacttgtagtctttacggaatgcagtacaatgcaaatgctatctgtttgtctcagctcaaatcttagccttgccatttgctctgcagtatataactttggcaaactactaacttctttgagcctcaacttcctcatgtgtaaaacaaggataacaacatcgccttgatggaatggttggaattgttatatgagaaagcaaatgtgaagcacggagctcaggaagaggtatgcacagcctgtgctccctgagccatcttgtctgtgttaacgtccaattttcaaatctcaggcagcttctctgctgcctcatttcctggtcactctgacttttcctagggaatcacttccccactgtttgtcttgttgacatttccacctgactgactgttagaccttcagcaaatagagggaatctttaaaagaaccatatctggtatccaaaaagtccttcagtagccgagaaattgttatatgtggagattacatttcccccaaaaaatcaaagaacatggttttttgtaaggcagatgatctaaacacccataatatgaacattaaaaaaagatcaaaaaggagttctaagaattgagatggtaaaaataagaagaaggttctaactcgggatttcattgaagtgactggacaaaggtgagcaggtgggggcccctggatatgtttcccatctcccggtcctacagctcacgagggctgaggcagtaactaggtctcaaaggctatacactgcaacgtcttttgcctacaaccaagtgcagaaatatcccacatgaaaggcccgaattccatgcctgggtggttcctgtggaacctttccttgcacttgcttatgttaaactccttatagagtcagcctgccaagggccacccagtgacaaccatggatttcaattcctcctgcaaaatatgtcaacccatttgtttactcaatatagacagctttgatctccatctgaggtgggtctaacagtaatgaaaaaagcaacttttcttgcatgaacaattgtaaggatgatgaaagaatcaaaactctgaaagaacaacttaagacattactaaaaggactgtgtcctcatccaggttttgcaatggggatattttatagttacaacttcttcctagacaactgagtctctttctgaaatggtttggcacacctgctaagagtttgtggcatagacttggaagacgactgagaactttgaaatccctaccctttgcaaggaccagaggacactcacagttgccacatttaaacccaacagcccactagaacaacatcatctgtgactatctctcttgtgctcctcggctacaagatcgtcttccttgatagtttttattgcttctggaagtaatttgctcttcatcaggttatcacaaatgaaaaccaagacaggtcagaagaaagctggtttctttgtcagcaagatacttccctttgccagagctgagagagagagagagagagagagagagaaagagagttggaattagaaaaaaaaggtttcaagtccctttctgacatctgtgatcttttaacagagatgtaaagcatatgagatttgcaacctttcgtggcctgaagggatccagttatttggccagttgtgaagacatactcttgttcctactcgcactgtcatgctgtcatggggggtgcatgcctgtttcatgataaaaggaagctaaacggggtttttacaggaatttcagaagtctcagaattattgaagactcataccaggatgaaacccaagttcttcaaaccaaagtgaagcaaatgtgacatattatagacaagagcagaggagcaggaaaaaagagaaagaaatgacaaagaagcaggcggacaaaatgaatagaaaaaatggcatcttttcatgcatgttggatgtaactcctgggacatcaatttctttctatgtggttatacgtttgtggttatctggcatttggacgggcagaatggagggaaggggtttttaaaaataacacactctctttggcacaggacagtactagcatgaaaggttggttgtttcaaaggactaatccaggctgtggggctgtcctgcaaacactgaatcatgaccttgccggcaccttgctgcgggcatcagcaggagaagatgtggaggttccagcaatggtattttgttccacgtaagaccaaccacattccctcacatcttacttcacatagtctagcactccgtgtagtccaatatgggcatctaagaagcagcaggctaataagagcccaaaatgaagaaaatctaaaaattagcccgacttagccaataaaaagtagctccagctaacccagccagacctttaggaaagagcccaggaatgtctctctccatccttgccctgctcctcaacctcccctttgttcaccaggctcccaacttctcttcttgcctcatacatacccggccacggatgctgtctcatcggctggatgcacaacacttcaatggagcaagggctttctgttgttgttgtacctgccctcttgctccatcaactccaggtgagtatttcagggtcccagctgggcggtcccaaacctgtcaggtctgaccaccccacctcaggggacactggcctgacctgaagcaagggcagcaggccggtgggcctggtcaccagtccctggagaaggtgtttctaccacgttctttcagtgtggtgaaaaggacatgtgtgactgctaaggaagagttacacggggcgaaaagggagaggaagattacgtgtgcacatgcacacacacacacacgcacatatacacatgcaaacacacacatgcacacacactcacactggcagtcttctcagggaaagcagctgatgattatgtttccgcaactgaataaaatcaaacccaaaccacaaggtaacagcagccgtctggcccgccctacacatggcatttctgggcacagtgtggccgattatatccttcaccccacggctctttcagccctgctgtttctggctctcctcaagattctctttccctttaagacatcaggcgggtgcttgtcaattagagtgagccacagagaaaagctgtctgtgctccgggagaggtgaacctgcttcttgatgagcccttcctgagccagcagcaggcctcctgcccagagaggatggggcagagagatctgaccaggggatgggcagagggagcctcacacattcctgctccgaggagtgggagggtgggtgggggcagagtaggagccttcaccacagaaaaacaatgcgtcttcaattgtacagaaagccactgggatcagaagctgctcacgctgtttaagagatgcttaaggaaaatggggccacctcagaggcacctctcctgacccttctctgccacccctagccccgtgctcagggtcagagttgcctcccatgtcgcacacttatgctgtgtttaccccaccattatcctggctgcagctgactacttcccacttgaactcctcgaggcaggaactagattctccggtgctgtgcttccagcaccacgcccagcacagagagggggttcactcagtgcttgtgcagggactgacatctaggcaagcttccttttgcagaagaggaaactggtgcttagagagaaagacagggaagggagtggggcggggggggggggaaggaaatccccccttctggaataccagggagcatgttaggcatctggcactcatttgttcattttcctctcagaaccctggtgaattaggcttcactgccttgcagacttcctagtgagtgctgggacatccatttatttgggagagaacaaaatgcacagttgtacgaaggcaaaggctgaacagttggggagagcgacagttggagagaagagcatcagaggcctcgtggtaaacccaaatgagagctgcgctgtgcgggaggatgcctgggaggcaccaacgcccctggaacttagatctggacggccttgcaggcaaagatacacaatcccccaagttaaaatgttgaagggcaacagaccaaaaccagaacaacacagtttccacctcctccccttcacctttgcccattagcagagttaaatttataccagagttaaatttctatgtatgaactcacacacagaaaccaatatacactactactggaaacgtaaatcacgacaactcttttggatggcaacggacgtaaaaataacttaaaaatataaaattacttgtgacacacaaagaataagagattattaaacagcatcaagtaatttaccaactttgaaaatagaggaaaatgtatcatacatgtattcatgtactctggaaggttccctactgaaggcaggccctattgggattctcggagtctatctttccatagtaagtccctgagaggtcagtcttattttccaactgtctgtgctatgcacatacgcatccctgcattatatcagtacttgtttaaagtcacctgatgttagagctgaaggcactttcacgttcatttattctaacccccttattttacatgtgggaaaattgagagctcaatgagttttctcaaagttaatagtggaggtgggcctggaatactgcatatttctaaaatgtcccatttaatgccactctttaactacagaccacaccaactcccctcagaagaatgcagagtacacaaattttaaataaggaagaaattgcatgcttgccatcaagaggtgtaccgcttgtccacaccatctccgcttttctcttgccctggaggccccagcagcagaattgtgagcacataagccatggaggatgacgctgcagaggagaacatgtgttcctgtggtcagggcatcagccaccatcgccctgctcggggccccttcacagggaccagagagagcagtggtgataaggtgtggccgagggctgttctttttgagccattttagtgatgctgggatgttatgcaaggaaatctttggcattgcagtaatcctggattataaataatttagcatatttctttgtaaactacaggccagaatccttgcaaataagaaaggattaacttttttagaagtacttgctcttgagactttaagttcaaggcagaacaatgcttgccgtggtaattccatctattttaagatcacaaaaccataccaagttgaaaccagagcagaagatattaatgcagtgctctctctgaagtgcccaatagtgggacgagaaagctttcaaagggaattaagtagacagagaaagctccctgttcatgtccaaatcacaaggaggcggttgaataggattcacagttctccgtgggaaggacccacaccacagctaatgttcaaaacaggggggagatgtctcgggaagatcaaggacccagaattctgctgttagaatcagctgcctgcccattagagcctcaaaaggaccctctaccatgtgtgagccaatatgatcctgcaaatgagcccatttttctttttgtaactggcccaaactttatctgaaggaagctatcattatgtaatatttccaaagcacccttgatgtaaacttcagatctgatatgtgggtgtatgtatgtgcacgtgtgtgtgcacattgtgtgtgtgcatgtgtgcagtgggagagggtgaaaggacagtgaagagtcagatgtacatacaaagtagaaaaactgatgggcagctgctctgaatatgcaggaacagagaagcatccagggagaccctcaggtcaaggctcagcacctggtacatcacacagacaacagacatgagaggaacaatattagctccagagaaagtcagagccaggaacagtagaaaagtcaaacgggcagcaagaggcggagactcagaaaccatcagccagtaagtaggtggcaaggcaggagcatgaaggactaggacagtcagtgaactgcacctccaaagcctgtcctccagtgcccactctgctctggcctctgcctgtctttccagcctcatttcctgctattctgcacgtgactcctttactccaccaaattataaatgcagcctactctgcatgctgttttctagcttcttgcctttggtttttctgttctttgtgctaagaaaatcctttctcccttctcctaaaaatgtatctcattttccaagatttagctttatggtcaccacctcctggatgccttcgtggcttcccaaaccttcagggtgggtttagtaccactcctacaagctctgatgatatcctgccaatttccaagcttcctccagaggaagatgacaaagaagtttcatctttgaaaaaagctctaaaagaattatggctgtttggggcaggcgctgtgttgagaatgattccgaggcctcatccagaatccattggaaagactgctgcagtcagttacggatgcctgccatttaagggtgtgggttgaagtttagccattcctgatgaggccaacatcttcattaggcagatgaggaacctgaggctgaaagatgggaaatgtcttgcccagtgttacaaggctgggtaacagcacactcagatgggaattccaggtcttgggattcctaagcaagtactccatttaaataagattcccaaagattctaaatcaggaatattgaaactcttaacatatttttaacttttttccaggggaggagggtaattatatagtgaaggagccagtgaagaaaaacttgaagcttttgcaattttgcttggacacccactcacctgaacccgtgccttataatgttttctcctgcccaatcctccaaaagtccccgcctttatgctttttttaagtgagcactgttggtaccaccagtgtctattacccaggttaaaatgaagacttcgagctgactctcctggtatcacgaatatacaatcaaaatggatgcctacacctctgtgtcagggaggaaaagtagaggaagttgaagccacattttccaacttcatccttcactcctttcactctagaggctgaaactttcctgacaaagaaatatacttagaatggtttcattagataaactctttccctatcttactgtgaaagaaattttccagtgagttccagtttcaggaggttacaaggtaaaagggaaggaaagttggcatgctcccagcctgacaagaagttgtcgcattaccatcaacgtcacataaatttagctggaacattgtatcggattctataatgcacttacgtgagcgattaaatggtgagaaacacataacatttgcctgcccaccccctctcccattgccctctgcttctgtgagagtttgggattccagatgaattctcccagcatagcctcagcttgcaaagggtcatctaacctttaaacttcagtccagcaaagcaggctgaagagaatcaccagggtgtctcctgttatgtgcttcaacatcaaatgacctgcttcaccaggttacccaaggacacagctttaaccaaagacgtgagaattcccagaactggaagcaaatgcgagctgatgataggacattccccaaaccccctatcccaggatgctcgacagcaattagcagccatgtcctttgtctcacctctgctgtgtttttagcagctcagtttcttcagaggacaaggcaagagggaatgggattaggctgggagccctggttttctgagggaagagggtattaaacattttcacttggagtttctctgaagggtttctggacaaccaaacccccactccgcgcccctgcgaaactcctcctggcaccgcccctgactttctattttctttaggtgcccaccttacccctccacaagaaatcaaagcagccgatatgcagttgaatttccaagtggattcccttgtatccgtttgtctgggtgtgtgtgtgcgtttttaaaaaattttaaattttggataagccctctaagaaagaggctcctaagggaagcgggggctgaaggaaggaagaagtgggtgacaaagcctctaggggatcaataaattcagctgctcctgtgtacaagggaaagggcagtgcaggaagtcagatgggagaagaaatcccagaatcataaattttaaagctgaaaggatctttagaggtcacctggcataacctcctctattttataaatgaggaaactaaaagtcagacatgctaatggacctgcccaaggttatgtaacttggcgatgagaaaaggaggacccaaacccagacctctcaagtcccccgtctgggccccttcatcttcttcacagcccacagcagctgccacctcggccgagcagccattttgatcgctaaagtgcctgcgggaagaccccatggccacccccagacacttcccatgatgctcctctcctcagaagccatgtcatggctgcccactctctccaaagactccctccaccagccacgcggcccgcagccagagttcttcctgtgaagagccctcaccgcttcacttttcatgtgaagctggcaaagccgcttcagcgatcattttttaacacggcagctccctgacaagaggattaaagcaggcggctttcaaaaaagtatcaagaataatttaaaatgcaatatgttaatgcttgtccagagttttgtacactttcgtgaaaagtcatcaatctctcccgccacaccctaacgacaatcctgtaactggcacggttttctgacattaagaaaaaaaattagtgaacacagtcataaattaggaccagaaatctaactgcagatgaggcttccgaagtcacaaagcaaaattgggcgtggagtcacaaactgaggatttttgagggagtaggtggtggttattttggaggatggttcctttgcagtcttcctggaggatgagcaaggggatcagaaaactgccgctcaaacgctagtgtgcatcagaatcacctggagagtttgtgaaaacagattgctgggctccctccctagactttcggattctgcaggtctggggcaaggcctgagaatatgcatttctagcccgttcccaggagctgatgctgctggcctggggaaccatgctttgggaacctctgggctgaaaagacactttcaggcctcccctggtgttaggacttcattaaaatatagaagcaagaatgtgaggtgcaacttaaacatccctgcacaggcacagcaggcaaggcgggaaatgaaatcgcacagacaccagggctcgttgtcacagcatcaagcagtgccttaaacagggaggtaagcagtgtcctccagctgctacagtcacctctaaaaagataatgcctgtctgagcaaaagcaaacaccagaaggcttaaaaacctggggtccccatgctcattcctcaagcagttgaaaatgtctttatgtagagaaagtacagtgtaaatagaaagtagggctcgatttccacaagctcaagtcaaagaatctgctgagaaggccacatgacacacgaaatgaaatccaggtccttgatacccggaggcaagaaagcgaacggaagatccaagacaatccaaaggttcctgaatttttacagtaaacagttctgatcggattcacttgctattttggaacatacatgaagttcattaactggcatatattaaaaaagaaaaaaaattagaaaaagaaggagctggaggacaaatcagtaattgctcctttagagcaaaccaaagttactgagaaaatctcctataaaggctctgtcaaaacaagtcacttaaggattagtgagagctaaatcctccgtcagagagatttttctcaacagtcgtaaatgggttttagtatcggaaaatcttagaaaatatacttctcctgcctccacccccctctcagaatggctctttcaatagctcggcatcttgtgggagcaaagtatttccttaggctgaggctttttatttaaaaaataaaataaaataaactctgtcattcatggcaaagtcagtggctggaaataactctttacaggcatggagtgcatgtttcagaggcttgcccatacaacgcacatggtcaagtacagcctcagcaatttccctcctaacaattagtataagctagggctcttactttgactttttaccttgttccacttttggtctcattttcttaaggcttcactgctcaatttgttcattttgtgaggcaagagcttaaagttcatccttaaaaatgcgtaggtgattcagttttttaattagaaaaaagcaaacactgctaatcccaaaccttttcaatggcagccttctaggggcacacattttaattccatcagtaaagggtcatcttattcattctcttataatcatcgtgggggcccatgctgtatttctgggcagtctctggagtctatgacactggattacagaggtctgtctctgttcattaagtgagtgttcagagaagacccactcatcctgtaagcacttagagacactctggagtttgatcctcatgagagggtgacctggcaaggccattttcctgtctgcttcccagatggtcacactcttctttgtctgcccaagccttttttatcttatcagtactcaaagctaacgcatcttagacatcgttggtaccaatcaatggaaagctaacacacttgcacaacagtccatatgcgaataagcattgattttaccccccttggttatagactgcatttctaaactttccatttcctccattagaccctttaaaaacatccatttgtcagacataaatatttctcctgatacccacacaggaagtcttagttacaggcctggttttaggcattactatactaggccattccttagcatgtgtgacatgagtgagtaatcagaaatcccaaccccaaaatatttcccttcccaatctaccttatacccaaaatttcaccactgcaaaatccttaagacactttcaagtccagaaatacccttttaatattaaattattctgagaggcaacccattaagcctgtttaattagcaagactctggagaatttagctttttttttttttttttttggctgcatagccaagggaatttagggttggaatgacacaggcctgagtggaaattcaagagctgtcatttcctagcaccatgaagttgggcaagtcacttaacctctaagaggctcagctctatcactttatctaagtggggcctgacacttgggtagtactcaataagaaaatttcctttctcatgaggtggctgctcagggagagatggtcaggacagaatatctacccaaggttgagaagacagaggagaaaccagggcacatcctggagaaggcagcttcaggagtgggtcctggggtctggggtggggtgggagacgttttcgatgttgtttaatgggcggtagtgggaccaaggagagttccagtcacttggaaaacaggactgcagagtggaggcaagagccatagaaaagagagaaagccctagaaggggctaggagggccatcttctgccacttcactcatctgtggatcaccaggtctacccacagttttacaaatttcactccagttctgccctaacttattacatatcagggcctttcactcattatctcaaaaatgacatatagagatctttgcctgtggggttaatgagtaatcaggaggtatcacattaatctccatttcactccagaataagttaaacagttgcctcaaatccttctcctgtagaggaagaggggtgtaaatacgaggtaaatatgtaaagaaaagcatgaaccaatgacctcagtaatggttccagagaccaggactccctattctgggggtgaggataaaagtttccatgtctgatttacccttgctcagggatgaacccatgtttctgtattccacatccactggatagatgccctgcagctaaagacatctttttgagcccccaaattgaagcctttggatttccctatgacatgtgaattgtatttatgtaggtattctgatgaaattgcacttccctcaaaaagatgaaacttaaatgaaagaggatgaacctggaacatgtgcagtgtgaaaatttacacagcgaaggagctaagtctcagccatgatcagtctattttgagcttcctgttaagcaccaaagtgatggaataggacaaagaaaaattgtacccataataaatagaggatgacccctgtgaaaagtaaagatagagcccatattggattagaaaaagacttgatatttccctccacctttacctccttctaagtctatccaggagtaacaaaaatgatgaacatgggatcttaagtagtcaaaaaactgtaagattaggaaaggaagctgtaattgtttagaatctactatgtgctagggattttaggtgtactgcctcatgcaatagatgagatgagagcacaatgaagaatacttttctccactttacaggccaaagaagcagaggctcagcttggctcaactgcatatcagtaaatgacaggaataagattcaaactgagttctgatgactccaaagaatgtgtggggcagggtcaggatggtctttaggctttggaggccttctctttactggaggcacaggctttgttctaggttgtaggaagagaagtaaataaactggtaaatctttctgtataattttctcagggttgaaatggtggcaggggagctggccccggtggctcacaaatgcaatcccagaaactcagaaggctaaggcaggaagatcgctttgagaatagcctaggcaacacagtgagacattgtctctaaaaataaataaataaataaataaataaataaataaataaataaatttaaattagtcaggactggtggtacacacctatagtcccagctaccctggaggctgaggcgggaagatcacttgagcccaggagtttgaggctgcagtgagctatgatcatgccactgcatcagcctgggtgacagagtgatactctaactcttaaaaaaaaagagagaaatggaggcaggaaaggcagaactcttcagaaaacaaggcaatgcattctggcttttttggtttttgagaaacatcacataggctggatggtgaagtgctctaagaatatctattcaaaatgactatgaaaaggttctatctagcatacagttttcaggaagcggatatgagggcacaggggatgggtttggggtcaatgaatgcatgttctcaggcttactaatagatgagaccatggtagatattcccttgagcttccagaaagcacccagcaagttaatgcattcatgccactgtaaactagcatttgagtaaggggtggtccaaacaccctacttatggaggcaaagagcagcagctcatctgcagaccactaggggttgttcgcaatgcaacagaaaccacgtcttatccttgacagggcagccaataggtaatcatgttttacacatgtcattttccaacttcatcttctttcatccttctgtagtatctcccagggaagatctcatagaagtaactgcatataccagtttcaaacaccctcaatatgaagagcatggaactctgcattcagctacctgggcatgtcaaaagcacatcatgcaataagccaatgtttagtatatggtccaacatggacgtggtaccttcacagctcttatctgattgaaatgcatagatgtggataggaaatgacatgcttactaattttctgagaggaaaaaggggaaatccagtatagtgactgagtgaaaagttagtaataaaaggtaagtgacccagacagggagtttcctgagcaagcataacccagcagtttttagccacacttctttcatggctttctcttcaagttaggttgacagatatctgatccaatgcttggccatctactgaaaccacctcttaccattccaccaggtaaggacgtcagcaaaaagccttttcaccacaagtagcaacctactttccaaaacaactccccgcacttcaaactaaaccaacgactaagtaaacccagattaaatagagctttatcaggatggagtttgagtaatctctaaatcaacaaattccagggaatgtgtgtacagaatatccattatacaaatgtcagaccacaaagtcaaactctttgttgagatgctgttaaggccttccctaatacagccaatatagcagagtgggagaagcagggtcatgctagcttctattccagagcctgtttttccttatgcaaaggccagtaaagcaaattttctgcagaattattttagttgttcctaaaaagaacaagatagcctttcctcattagtctgaatagacagctccttttctgagttgctttaattgctgtgggttaagcttcactatcacacatcctcacaaccataatacaactggcatcatttggcgctttttgacttggttaagtacaaactacaaagtccaagatgggaaaggtcatttattgtctgccagatgggatgtttcaaaaggaaatgatttagtcacatcattaggagaaaagggaagaattaaaatgtatgctcacatacagatttcggtacgcacacaaaatgatcagcacaggaaaacataaacagtagcccaacagcacacaagttacagcacacaagttacacagacttccttaaatggtatcttctacattgatgttgaaaaatgtggattgctattttaatactgctgtcataacagtctagtacaactggtagcatgaggctgaatatgcctcagagtcagatagagctgggtccaatacgggactcttcacttactactcatgtgtgtttggggcatatatcttatttccaaaactgccttataatctataaaatgaggaccatatgggctgggtgcagtggctcacccctgtaatcccagcactctgggaggccgaggcgggtgcatcatgaggtcaagaaatcgagaccatcctggccaacacggtgaaaccccgtctctactaaaaatacaaaaattagctgggagtggtggtgtgcgcctgtagtcccagctactcgggaggctgaggcaggagaattgcttgaactagggaggcagaggttgcagtgagctgagatcgtgccactgcactccagcttgggtgacagaggaagactccatctcaaaaaaaataaaaaataaaaaaaaataggaccatatggccttcctcctaggtttttgcatagatataataaggttacatgtaaagtatctgcccctgacacatactacttcctgaatattattcctttccacctctccttaggtgtgtgtgcatgtgtgtgcatatgtgtttagtattgaaattatgcctatatgtagaaggcacacaataaatacttcttgtcatttactcagtaatggacattgatcatttaccttttacactaagtgagaaagtcttaaatgatcttgattcatgattttttttttctttttttgaaatggaatctcactcttgtcgcccaggatgcagtgcagtggtgcgatctcagctcactgcaaccactccctcctgggttcaagcaattctcctgcctcaacctcctgagtagctgggattaaaaacaccagccaccacacccagctaatttttgtacttttagtagagatggggtttcgccatgctggccaggccagtctcgaactcctgacctcaggtgatctgcccacctcggcctcccaaagtgttgggattacaggtgtgagccaccacgcccggcgattcatgatgttcctaatggttctgtccatttttacagcccatctcagctgaaagaaatatctaacagttctgtttatttgtaaattacacccaaataacttaacaagtatttatgtcctaacaacttgatttctgaaaaaaagaatacacataaactaaaagaaaaatgagtcccattcactgttaaataatcgtaagtgcttaatagtgagatgcatgagcctgttgggcactacgcaacttctcaaactctggcatcaggttggatgccctcacccttgtttcctgctccacactgattttcacatggtcctgttttataatacagcaactgacaagaacttagcttctcaaaggtatgacatcactgaaagaaagttatgcattccagtagtgaaactgtgaactaccttgagctagtagttcacacggtgcctgacagatgtcaagaattgctgtattttcctcaactatttaaaatatttcctggcacccctttgaggccactgcaatgtccagggtgcctcagctcacaccttgggaacccggaggctaattaaccatagtgaatcagattcattttctatgctactactgaaatatgaattagacaatattatagataaagctgaataatatgacttgttttaatacagttctaactcgattttctacttcaattccattcttcagccattgatatttggctttttaaaagctgtccttgtagtgtcatatggtcaccagataaactctgcagtgaaggctctttagattcaaatctatgttgaactatttcaattttatgattttttttttttaaaaaacagagagtaacccaaagcttaccaggtgatccttcttagtaaaagggatttgtgggctgtggatcagcttcccactgattcatctgagatgaagacaggaccctccatcctgcaaaaatgggtttgaaaaaagaaaggaactctccatttacacgtgagaatggctcagccctaagaatgctgcttgcaggttcactgttctgcatttagaatccaggcctagagaagcagcacggcttgcctctgctgtgaatcagactctatcttgtgttgttttagagtcatgtctacatagctgaaagatgatttggatctttttcaagaagagagtggtaaggtgaggtacagtgaggcagaagacaatgctggtcaatgctttaaaatcactctctgagaggaaaacccttggtttctactctctgctgatttctgtgttaaaaatactcccaccgtggttgaacgaggtcactgaattcagagttagggaaagaggcacacaatcagctctcacgagctgactctagcccttcactgggcagaacgcttttctcctcttctacagctgcccacggaatgctctgaatctaggggcgtactccgctgaaaggaagatttataaatgctcacgtttattagctcctaattgaggatatctgccagacacaataaataaagttgaaaaacagagtgctttggagagaaagtaggctaatccgaagctttttattcaggggatgaattctggtcttcctctctgtatatgggacactatcttgacctttctggctgagtctattagctcagaggtggcactccagtggtcaagtcaactggcattcatcaagcaccaaccacaggcttgaaatttatattagttgttttggaaggttccaggagaagacaatgtagactcctgaggaggggatgatgtaggtgaggagagaggctaatggcacatgaagcctgcaaaactgggctctagactcttctcattgcagcttcagagtaaatcaagtaacactgtctgtcttcccagaggtacccttggcagagaccagcaggatctgttgtttctactgttggacgcgtttatgggccctattggccgatttggcaagcagctttatataaaatgtcttccggaaccatcctttcccctgtgagtcagtcatcctcagagtcctaattctgtccagtttgcatcaggcctcctcagtctctgtagcccaaagcacacgatagggtaccaatgttcaaggctctgctttattttgaaattcagctggtgaagctattatattctacctttctccaagtagtatgcaatgcaaagtggcaattttacaccgtgctagcccaacataaattcacagatgagtgcacaccttatttggaataaagagaaacacaacagttattaaaggggtgattaccttcccagggaccatgaatttaaaattatgcaaaatcggaggtcggtctctacaagttcacatagtgatttaaatgggggtaacaatgaatataatatcttctaacatgttaaaacttccacagcaaacctcttatataatgctttgttgcttcattgatttgataagtttgtgggggtacattttgcattcatatacgacgtataaagtatcttgtttgctttacaaaaatgaaacatcaataataacaatcctcaggttgctatgatttctctgtcattcatactgagtgctcagtgtcaggaacagcatttgttttgcccttgaggaatttgcagagcagttagtaggtatcggtgtcctttgtagtggttcaaataacatataactatcgtaatatatttgaaataagccaattattatgccatttgaacatctatcctccttaagatatatcctgggttttactgaaggacttctctcttaataacgtttttctttatgatatgagcgtcctggctggaagagagctgagcttcagatacatggtgttggagtaaggagagagtcttttccctcaatggttatttgcatgggggctaaggagcctcctagttggggaggtgaacttgaactgtagcaacaatcaagattcaaacatgcatagacaagtatgatggcttgaagaggagactgcaggcagaagtcaggagacagggatggaaaagaagggtcactgtgagagaatctggcagggccaacagactcagccacaagtcagcaagtaaatggggagatgctgaaatgggtgaaatgttctccttcagtatggtggctggtgtttgaactcattttaccctctcttccaggggctgtgcacaccttaggtagaaagagctatacatgtgaactgaaacaactctctcaccaaattctaagacactttggggctcaaactactctattcaaactacccatctaaatgagcacagagacagaaaacgttttcctcacttcaacacgggctgctatcctgtcacggtaatgaacgacggaagaaggctggtggctggggccttctcataaccatgagaagaaacaataaagaaaaataggggtggtgtggtttggggtggtcaaggccaatgttgaagacattgatacagctcagaatagcaggcagcatccaatggtgagtggaagcccagattaattccaaaacacatataaaacatgtctacctctttgggaactcaaaaaatgtgaggttgggatgagctgcatgaaggactgcattacctgaacaaacgggtgagggcttgaggctctgggggcgctcgtctttaatgttaatgagactcattcataccatgggctggggaggcttggaaatattttagttacataaactgacatcaacccctcttcttcttttaattgatatgcagtcttagccctgttatcatctctgatcttgaccatttcccttagccactgggcaaccaatgtctccttctgaacagttgggagaaatgtaaattcactgttttttctccagagcagccagaggttccttaatttgcatcgttatatgagtgcaaagcatgatgataaaatatgcaattcttaagaaatgtcaaagacagctcattagatcaacttttttttctgtgtatttttttttctttttaaacagggaccactgtgcttcctttcaagtgacaagagttgtgacagctgctctataaggtattcaatggttaattaagacacgagtgtcattgctgagctcttttgtgtttcatagaaagcagttgctaaacagatgaaagtaggtctgaggcaaggggtagcataactattatttcaattaataaatagctctaaaagtgaaggaagtgataaagccctcaagagcgtctgtatctgccccggttctgtcaggaaaattaaacagagcacttgtgattgccattgcttctgtttaagagatccaagcaagtagggtcacctgtgctgagcaggttagagccggcctggttcttggggcaccccctagtgacatgttcctataccctaggatatccctttccttgctactgaaagaaatggtgctgaattcaccttgttcttccaccctcatcatcctttattctccccctctcttctaccaaagaagccctaaaatgtattttcagataaatatcaggaaagcatttataaatatttcagaggtgtttcataaataaatcagcaaatctacaaaaagacttctctcttttaatgagatcttgtctgtggtatatcccttttacttgagcatcattaaaaccagttgggaagatttttatactggactctcttttcgggggcttcataatatatgaacaagcctgctatgcgtctgtgaaacatgtagcctcttcttctgacagattaggcagccctggcgcgagggaatagcttttactctttttaaagtaaatactaatcaatagcaactgtaccgacaaaaaccttcttgctgcctaattgcaccacagctactcatagaccccaacagaattttcccctagatgtaacaaaattaactaccaggggctgagctagtgaattatcaccatctctctattcaaatgtaattaacacaaccccccaactaccacatgtaccattaaagtaccatttgtatgtgtaattttcaaacagggtctaaaggtcgtgcccacatcaatcttttcaacacacacagctgcacaggaaatcaaactggcagggaggtggtcgcagccattctaggaaatctctccctctctcagatattgtttgtagtttctcttctgcagcttaatgccctctgtggtctctttggccgtgtcagaaatagccagactgtatcagaggcaaacaagtgatttaaggaattttaggaagccaatctagtacccagccctggccaatccaggggctagctatgcagaaatcttactgatagcttgggatggatactacggccacggtggttaataataactaagatttttattgtacattcagattataaaaaaacttgtacctgcatttttcaaactcattattattattggcaattgtagtaataccaggggctatatattgagcatttgagctaagagctgtacatctatagtttgtcaattaatcctcataacaactttatgagttaggaattatttcctctattttaaaaccaaggaaactgaggctcagagtgagtgtgtgactcaaaatgctccaagcagctagaaggagggagcaccagggtttgaacccgattttctgactctgaggctcgttctgacacataatcactttgggagggaggtatcatcatcatcctcagccccccaccaacattatcatcatcaccaccatcatcatcaacatcatctgcctttcatacatgaggtaaacaaggtacagagaggtgaagcagcttgttcagggctacacggcacagaagagtatggaagaagaggcttggaggcaagataaaggcaaggggcagtcattggggattcatggaatagatgtctctctaaatgtctctcatgtcctggtggccattccatctgtcactttcaaaagtcagtggaaagagcaatgtaagaggagtcaggagtcaggggccatccactcagaccagacaccagctgggtgaccttgaccttgacattccctctctgggctccgtgctcttgattacataacaagctagattagaagatatctcaagtcacttccagatgtaacattttaggctcttcatttgtgaattattcgtgctagaagaggccatatgtggaaatttaacacagcaatactttctcaaaacttcacctgtaatgtgcctgttaggactcaggcacccatgttgtcacaaagccatctcttgataaaaggaggagccctgggctgaggatgcccacatttagcgttttttttctcagaaatactctgccactcccagagccaacacgtacaaatagcatttgctgcacaccctccacttcccatgtgtcatttggcaaggctgccccgcttgtcaagagggctatgcaaagtcaccaaggtctgtaactccagttagaactcaaacactaatttttcagcagcagagtctgttgtgagaaaccttgctcccaggtgcacagtgaacacagagggtccttctctaatgggactcccttgacttcttccactcaaagacgcctggttccagcctgtgaggctgtgcatggggtcagctccaatgctcggaacgtcccgcctccacccagatacacactgaccacatgtgtctggggctcctgagtttttctctgcccatagctcacccagggcatgagtgccttctgcagtttagtttatagttgatccatgctggtgaggcctgcctctgagtcagggccaccattagcctggccttgaggggacatgcaccttcatgcctgagctgaccgtagggtgtgtgtggagggggcgcttttggtgtccagaggcacttggcatcacattatatccatttaaatatgttttcccttgattctgaatgaactgagagaaacaaaaaatactaatcaaaatggaatgcaaatatccaaggctcctttctctcagaaaatgccctattttcccccctccatggtactaatgttttagaaatagaaggcacctctggagagacaggataataccaaattttcaaatctgtagaaaatgagtacaggggtaggcggcactattagtgctactaaaaataagctttgggaagctacagtaaatggaaaaaccagaagagtcattccttttttaaactgtactgaaaatcctgtatgttcaggagccattttctccagagattccaacaataatacttggaattcaatatccatttctacagtggtctctctcccattttgtccccctcccttcaccactgccccagtaatgcaggctaaatattaagcttattacccccacagaaagcgtggttctgccaactgaacattgtgccagataccaagaattgaggcgattatgccctgcatgctgcttggtatactgaagatgggcgttcttttactttatttttatttcatttcattttttttttttattaaagagagttctactgtagacaaacaacccagggattgtttgaagaaaagggatatcccctcagacctggggatgcatttctccctcagtggctaaacctctttgtcattattacctccagagagagacacccagggatctgctcacaccacccatctccaggcaagttgaagcatgtcctggaaagccacctgaaccctggacagctccgcctgactagagaaatggtggcaaaggaattcttgctgtggtcccagcggtgagcataacagagttacctctctccaccccaaatattcagactgcaaggacactggctcccaagcttcgacctgcttggagttccattccaggtactctgctgatgtctcggccagcctcagccacagactcccagctgagctgagctgttctgaggagtcaggaaatttgggggattttaacagagaaacaaagcctggcaccccatgtgtcaaagctctggatactagctctttagaacctaggtgggctaacgggaaaagtcaatgttagcagtaaacccaagatcaaaacttattccatgcctttccatcttctctcaaacatagcctttatcgaacgattgaaccctcacacacataaataaatggagaaagatgtactctgaaaaaaaaccatagaaaatagagtcacaagttatttataaaggggagatttgttaaagtagccaatctacttccctcattttataggcagagagacagaggaagagcaggttgaaggttctgaacaggatccccactaagcgtgggtcacattaggggacagaacactagcatgggcttttgcctcctaattcagcgttctcaccacccttgttgttccatagagcctctggaaagagagtggcctcaagtgggactggagtgaaaggccaagattgagaacgcctacctattttttacaaggtggtctggaatgtattattattttttttccttctttatttcagtctgggcatttttgcctcttaaaagcagctaaccctttaccacggaggtgatgcagaaatctactcatcaagtaagcctgaaagccctttgattcctgcagaaaaatctatatgtgcccttcagcctcataattgagttgcaaaggggaaaaataaaattgtttcctggctgtgtggagccattctacccaacatgccaataaaaagcaagtggtgtttttgtccataggatgtccaggttcagagtcagatccatgaggctaaacaagggctaggttattaccaacaaatgattacactccaggttgtattgaacagagtgagatatgtgaactcttgagactaattggaaggggaaatgtcaatgttgacatcccctgactggattccctaaaccacagtggaaactaacccagaatcttaaaaatgctggcttccagaaagccctattcttatcaggaaatgtgaatattaatcccaggcaagtcacttagccactactgtttttctttgccatcagatagtaatagccatctgcggtatcttttttcagaaaattatttggaagatcaagtaaatagagtagagcattttaactagtgaaatactcctcttattcaatcacagttattctctgcagtatgtggaagcaggttaacaccatctacctcaaaacaactttgtgaagttgggggtcccgttttagacatgggaggactgagactcagagagtttaggtggctcatctaaattcacaaagaacttagagagaaacagacaaggtacaaacccagattggctagttccatctcattttctccatggaatcacatggcttctctcttgatacatgcaaaatgcttttaaaggttaaaagagtgatactgtaacaactaattgaattcatccccacactgtcagtcatgtcaatatttaggagttcacacttctctccatggacataaatcatctttatgaggctctggctgttttttttttgttgttgttgttttttgggttttttttttttttttgagatggagttttgctattgttgcccaagctagagtgcaatggcgcgatcctggctcactgcaacctccgccttccaggttcaatgattctcctgctttagcttcctgagtagctgggattacaggcgcccaccaccatgcccagctaatttttttttttttttttttttttttttttttttttttgtatttttagtagaaacaggatttcaccatgttggccaggctggtctcgaattcctgacctcaggtgattcacctgcctcagcctcccaaagtgctgggattacaggcatgagccactgtgcccggctgactctggctgtttttgtaactacagtaagctcctctgtgacggaagctcctagttgtatctgattcactggtggactgatggaatgcctggactagtcttcaacacaccttctgctctcaaggccatttccacggccatgtttgagaacatcagatcaacccaattttctgtcatactcagtcagttgactttactggcggacaaaatagatagttgccttcctgttgtgatttctaggatcttaggggaaagcccttcttcttcactacccttctatcccttcccttaaggttttaaatccttgaatgaggattttaaaaatcattctagaatgaaagacaggtttaaagtgcaaatatattaaaaagccaaggacgcattctttaatgagtaagtaaaatactaagcaattcgttttgggagaaagaagggctaaaagagaaaagtgtcaggtaacggatttttgattttttttttttttttgaaacagtctcgcactgtcccccaggctggagtgcaatggtgcaatttcggttcactgcaattgccaacttctgtgtccaagtgattctcgtgcctcagcctcccaaatagctgggattacagacgtgcacctggctaagtttttttttttttgtatttttacaaaatacaaaaaagacagggttttgccatgttggccaggctgatctcgaactcctgacctcaagtgatctgcccccattggcctcccaaagtgctgggattacagacattagccaccacaacctgcccagtaactgatttgagggaaggtcacagaggtggagaaagggcacaacaggcatattagaaactcctcagtttgtccaatattttgcttaaggcaatgcctgttaaactctctgaaccagaccaggtgcagtggctcacgcctataatcccagtactttgggcgacccatgtgggaggattgcttgaggccaggagtttcagaccagtctgggcaacatggcaaaaccctgcctctacaaaaaaagaaagaaagagaaaaaaatagccagatgtgggggggctgcatctgtcgttctagctacttgggaggctgagatgacaggatcgcttgagcccacgagttcaaggctacagtgagctatgattgcaccactctattccatccagcctgggcaatagagggagaccatgcctcaaaaaaacaaaacaaaacaaaacaaaaaaacaaaaaaatcaccacctcgccgggcatggtggctcacacctgcaatcccagcactttgggaggccgaggcatgtggatcacgagatcaggagatcgacaccatcttggctaacatggcgaaaccccatctctactaaaaatacaaaaaattagccaggcatggtggcaggcgcctgtagtcccagctcctcaggaggctgaggcaggagaatggcaggaacccgggcggcggagcttgcagtgagccaagatcgtgccactgcactccagcctgggtgacagagcaagactccatctcaaaacaaacaaacaaacaaacaaaacaaaacaaaacacaacaaaaaaaatcaccacctctaggtgctagagaaacagtgtttggggaatccattaacaggtgtgatttaaaaattttttacaactgctttactgaggcatagtttatataccacaaaatccacacattataagcatccaatttaatgatatttaatgatttttagtaaatgtatagagtagtacaaccattaccataatttagttttagaaacaagttcaatttgaaaaaaatagtgctttgaaaaggtatcactgcttgcccattatagcactatagggtttattcttactgataatctgcctaaagtaggctccacaaaacactgggtaagggcagccacgctttggaggacttcctctttccctggcttctgagtgattatgtgctgggattcaggagtgagctcagagctcaccacctcgtgctcaggctcagggaggggcccttggtgtggacatggaaatccctgccatgtccatagcctctatgctcaccacctggaaagttacagagagctcccagttacacctctggtttctagagccagtagagcaagcctgtgatcagcccctccaccccagcctcctacagccacctctcccaggaaagcctagaggaaattggccaacgtcttggtattccattctggttgccaagtgcccttattgtttttgcatttctaagagactgtcagtacaacttcccccgtgactgccacgtgacaggctgtgctgtcctttatctcagggcaccaaatgacttacttcattccaggtctttctgtttcactgtgagtcaggtggaaaacagaaaggtggccctattttaagggaaatgttaaaacaaagacaatgctgtgctttgctggcatttgttagcagcagacacggttaaagaatggctatgggcaaatatttggatgactatagaatctgcttaaatactatggatttactgtatagggtgtcaaagtaacaactgtagagttagagtctattaaagggggtctcaacaaaaaatatttatgcccttatatgcatgctgctttgtcttttgaaaattatctttcctgttttttccatctcatagttccctccaaacaattgaccactccttttgccatgtcactgcttcctatggaactcagtccggtggattaagtgtttctgttaatgtctgtctccctttcacactgacttttgtatgaaagggaccgtgcctcttcacctctgtaactctagtgtataccatggtgtctggcaatagatgatctgcactccattgactgggaagaggctgtgaaaacaaagacgggtgcacgttcagagcaaatatttcctgctttggctgtgctaatttgctgtactttacacagtcagggaatgatgtgtgatcatttgttgaattaagaaattgttttggactcaagaagcaccaaatgtaaactgcaatgtcagactgcgagagaaagggtgggaggctttggggaaagggctttcccaaagtgcttgcccatggggaggtgagggggaatgcaggctcctagccacagagaatgaattcattaagtccaccaccatgctttgtgagaaccaggcagccactcctccttacatacaaccccagtcagatctatagccatgacaagaaatacaaaggtgtgctttctatttgtggtttatggaattgccttcgggatttgacttttatctaccatgtccactgttctgcctccaagacctatcacagtacttggcacacagaacgcagtaaatatttgtgatgcaaatgaatatttcatagtccagctggcttctttcccatgttttttttctttaactgtgcactaaaaccacagtgtcccggaataaattttctattgaacatctcacttgactgggaagtaatctgtgaatgtgataaagaaatggagagcaaatccttggaaaccaaggcttgggagttccatcatttaggaaacaaaagcagtcaagactaaaaatctcagacatcgtaaagtgattactcaccttctgaaagaccccagaaatatcagaggacaccgggggtcagtgggccatccaggaagaagctttggtgaaggggagggcactaatgtttctttggcacttattgggtattgggccaaatgcttccacctttcatttcggtactcacaagaaatcctaccagatggtcatggtgatcatgcctttccgaatgaggaggggagatcagagagactatctatcatacccaagattgcccagctagaaagtagccacaccagaacttgaacactagcctatctaattctaaaaactcagctttttccagcccaatatgttcctctggattttaagtcccaggagggcagaaacaaggctatgggcagttatctctgtagcctgctctccccagcatgggccagaagaagcatcaagacatgctttctgagctgcatttcagatcatgagcattgggacttctttccccaataagtggtctgactgaatcctggccactgcctccacaggcactcacctacagagtgctggccctggaggaagttctcaggcagcactgattccactgggggggcacaggccccagtgcagaggaggggctcattcttaggcacatcacttctcctctctggacctcagttactcatctaaattgacatgatttgccagattgtttctcggcattgtcaaagtttccatggtggcgcgaatactctatttctgcacagtacagtacgttcaccactagccacatatgcctactgagtacttgaaatgcggtatgacttaagaactgaattcttaattttatatcattttaattaatttagatttacatttaaatagccacatgtggctattggctccattattgggcagtgaaatgaggaagcttcggcttgaagaagtggaagaggaagcagcataagatcagaattctagctcgctcgaatgtgggttcaaatcccaacaggctgtggggccaagaacaacatatttacactcttcaagtctcagtttcttcttctataaaatggagataataatggcttccgcatgaatttgctgggaagattaaatgagataaagcacttagcacattgcgcttcacataataagggctcctacaggaaggctattagaaaaagttcataaaacagcagagacatgggggtgtttctttccctgattaacccattatttcactcaccaacatgtcacatctcaaattgactggaaggaaagaaaggtttaaaatccactgggtggggcactggagggggaggtgaggagtgatggagacaaggcagttctgccgactttacacttttcccagggctgttcctgtatgtgtcgtttgactgattgggtcaaattacacaagatctagctagatattcagattccctccaatgcgtctgtgttgtgtaatcctccctgccttgtaaaggaacagatctgattggccagggattgcacaggtggcaacttcactgagattcacaatgcattggaaacaagggaagagaccctggtattctatgacaaacgtgcagacagtctaaaacatcaggacaacattttctatgtgatttagctggtatttctgagctggaataattaaacagagatctatccacttgactaaaagaggaagcagtcgatgaggaagtcagtccctagctccctttgccccgaaatatgccaattctgaatatttcgcatcagcttcctcttaataaatagcttaccactcatccatccctcgaaaatatcattagaattgcctggatatatatatatttttaaataccaatgcccaggccacatcacattcaattaaatcagaaaaggtgataggtgagtatgacactcaggcatcaggcatcagtattttttaaagcccctcttgacccccaggtgattctgacatgcagctaagtttaaggtcaagtgttagagatcagggtagaaactcaggagttaactgcacggtgagccctgatctgtatcacacactcagggcctaatcagaacatgctgatgtttcgcttagcatacattgcttattgcaactagaatatttctcaaccaacatccttcttaataaagtctaatttgggccagttctacactgttagtgttgacagggaaattccccatcgcactggtgatgggagggggtggtgctttcaaatcaagccttgaagaagtatccggcttccagagcccaaaaccctcaacagaggagctgcttcaacaacttctgcatactgccacctggtggggcctggacccaacttcatcacagctcttcagccttgggcacctacccgcctccccaaacagatgtaatttaggaaaatgtcatgcattttcaatccaatttactggtgccttccacattgatcagacttccttctcctttttcctcccatctggttaatataattattgcttttacgtggcaaagccattttatgtaatagctttgtttgttactatggttacaagtttagtagccctttggaatataaatctatcatccctgaaagtagctttctgtgtgtcaaggtgcagcccttatgtaaggagagtaacagcgttagttttctgtcgtaaggaaagtggcctttcttggtcttatttttgaaagttctacgagcctagcctagacactcccgggaaactgctgggtgctgtcccactttttccctctggaattttcctaactgacgaggcatccacgagcagctctatctgggagaaagtagggaaacgtcggccgaggggcagctgtgtttgctgggccagagccctcgcattgcataactggtgtttttcctggtcagtgtactcttggctgatttatttaccagttaaaggcaagggctgagaatataatctctcaggagttaagtttctttgcgtgtaatccctttccctcacgcatctgaagcatcggcccttatttcctgatggaagtggagttataatctccctttggaaagtggtaagagttcagtgctgggttcaatctgccaccctcaagtgacaaagcgtgacagcgtctctgctatagtgcttcacacccaactgaatcagacgcagccctctgagcacaaaagtgggatggcctgtgaagctgggctttcttcccattctcagccagtaacagcaaaccttggagagtttataccatgtgtccctgtacgtaacctcatctaatcctttcgacaaccccaggaggtatgcattgccatcaagttggcatcactcccattttacagagaaggaatttgaggctcagaaggattaagcaccatccccaagtcatataactagtgtgtgggacttaatgtctttggaaagtcctggttgctaacttaacagagcctcactttccagattcaaggaaccatgagaaaacaaagagcaggcagtatcaatgccttcactaaagccttgattaagccaaactgaacaaacatcaacaatcttcttccctcttcaggagaaagttactggtttggtaggccattagtgaatttccagtggctactaattaactaaccatgtcattcatgtttattatcacagagcaggtacgtatttatttacaccactcacacggcaggataatttgcagttatataatttcatggtaattacgattggaattgccatgtagaaactgggcactttggagatgcatgattaccaacaactagctaccttggaattacccattaatgacatgattagttgtggctttgtaagaaaatgttgttatgaaagggactttatcttttcattcccaattgacagaaaagcaggaaccttggagatatcagaaatattttttttcttcttctggcaggtgaagaatgtagttgtgcaggtttgtcctgtttctgggcatgtctggggtgccttggtgacagggagggagcagaaagagatgtgtgagcttgagcaaagggtgcaggccctgagctgtaccaggctagtcttcaggtctgttgagccagggtacagccaggaattaccaacttgttaggcagagagtaaggaagctcagaaagcccgtgcttgagctaaggggtacgaaacccaggagactgaatgactgcctgtcctctgctctgtggggaccaagagaatataaggaaggcagaagcagaggaggtggtaggttccatctacttatgatgctacgaaaagacatgcggcttatataatatgcactaggcatgaaccaccctgcccccaaatacaaaactggtctccagactgtatttcttggcaacagtggcctccttggcttttcctccacatccccttgagttgactatcctctgaggttgctcttgctattgattctcactggatatcactgggcatggggaggagaaacccacacaacggggtgcctggcatatgaagaataagagaaactttagctcttagaactgcaggagacccctcgtttaatagaggagaagcccagggcccagcaggggtgaaggaaggtatggtccaatgtcacaaagcagataaatggcagagccaggcctggagcccacacaggccacctccgagtgattttccataatgcaattccttcatgagggaggagttgttgatgcctcaaaattgagactaggctactatagataatacctatatagggagtgcctctgcatccattatagaggctactctgggatatttaaatacatattttttacctgattacggcacctatacaaagactcctgtatcacattcctttcactggtcaagagcaggcagacatttgcacctcctgacctgcaatgcccccctactaatagataatgagaaatctgaagtccacactgattcccttttcctctagctgctaggaagctgaaaaatccatcttttccttaggtaggagttttcattacggttttcttttcctctcttttgcctgatatctgcttttgttttatatattgttttgatctttttgtacctatgtttttagtataaaatttctggatgcaggtagggctgtcaactaatcaataacaaataaacaaataataatcttcatgcttggtgttcaaccatgcaggaaataaaatcttatagaacgtacagaagagccaggaaggatcacacactccactgtgctaactgcatacgaaggagaaggggaagaaggctcagttttagtggaaaggaataggaaagagaagaggcctcttcctttatcagctccctcacagcttcagcagcactatctcaccccactaaccaaacatccaaaggacttggaggcagaaaagaaagcttccggagaccttggaattatgtatgcatctatctatgtatctatctatatatctaagtatctatgtttctatctacgaatcagccattttatcttccacctctatcatctaagttaacctttctctaatatttctctaaggctaatctcatcatctttgtcttaaagaagcagactcagaattaagtaatgttttcaacgtcaaagaataagtagatctgggatttgaacctatgcccatttgtatgtgaagcccacattttttcctatcatatcacccacatcctcagaccatggctgtcacctggaactgtcagtaggccacccattttaggtctctcttaggcctaaagtcaccaagctttaccagtacccaaactgggtgctaggaacaacaggctgggcactaagatatgacagatgtggattaccacataccccagggagaagcctacataccatgggttcatagttaacagcgagctattacaatagatattgttcatcctcaaagatgaaactgtgatgagaccattgctataatattgacaaatcttcaggtacaccaaatgtgaagatgaattttattgaaatcttcataacatttttccatttgctgatagtttaaacaattatgttcatgtttctctctgtgagatgacttttggtgtcctgaaatgacatgctattgtgtaaaactacagatgcaggacacctcagtggagttcttttcttgcattaaactcacttcaaggaagatttatgaagccttgaaggtctggattgggccttggggctcatgatcaacccaggaccagaatatcaaggcctaaattgcagtcttggttctacctcatagcctcctaagaccctgtgttattctccagtcttatagaactaatcacataaagtggttaatttcttaacctatttgtagagacaaatgggtgatagaaagaaaactggagctcctggttcacatatgcctaccccatgcccctgcaattccactgccaggatatatccaacagaaatccatacttatatccacctgaggacatgtataagaatattcacagagccactattcataaaaaccccaaaatggaaataccactaattccatccctaacagaatggatcaatcatggcacatttctaccgtggaacactacatagcaatgaaaaggaaagacccattgcaggcatcaacatggacaaattctatgcacagaatgttaggcagaagaagccgtccataaaagagtacatagcacatgattcaatttaaatgaggttcaaaatatatgcaaaagtcatctaaggtgctagaagtcaagacagtggttacctctgaggaagggtagtgactggcaaggtcatgaggtggttttggagatgctgatcctattccatttctttatgtgggtataggcgatgtgttcacctacaaattcattgagctgcacaaatatgatctgtgcacatttctttgtatgtgttatgctccaatacaattaaagaaaaaacagggttcaattcccatctctgccactcaccatgtggcttttggaattcactttacctttacgctacatcttcctcatctgcgaaaccagcataatacagttcactaacagggctgctgtgaggatctaataagaagctgtgtataaaacacctagcactgaacctcacacatggtaggtgctcaatatatggtcattcatttttaaaattttaaaaatgtgatggacaatattgaatatacacaaaactaaagagaatactataacagacccccatggaccccgtcactgagcttcaataattatcagcctatggccaattttgttttatctgcatctgtctccccaaccgttaaaaaatatatgcacagtctacagatatatgcttgtttttgcatatatacatcagtttgcatctctgagaaataactcttttagaaaacataatttaaaaagatcagtggttgttggggcttgggggagggaagggtgaataggtggagcacagaggattttgagggcagtgaaactgttctgtataatactatcatggtagatacatgtgtttataaatttgtccaaacctgtagaaggcacaacaccaagagtgaaccctaacataaactatgcaatttgggtgataatgatgttggttcattgattataacaaatgtgccactctggtgggggatattcatagtgggagagtggggggaaggggtatgtggaagctctttgtaatttctgttcaatctttctgtgaacctcaaactgctctaaaaataaagtctctttaagaagatactcacatccatgatcattaaagactactgctactatcctatttcttgtccagttttcctaactcataaatatattttcacaactgttttgctcaaatcaagatccaaacaaggtatacttagtatgcatttcttcattcttaattaattcaatgtcttaacaaatcacagagtcaatagataggaaagctgtttatgactttggccaccaatcacataatactttgtgaggagagaaaaaagggtattgtcatgaagcttcctaaaaacacccagagtttctgtctgtaacactcttctgaattctttagaaccatggatggttgctgtcactgtcaaaactacatctaatactataaaggaaagaccctttaacacaagactgtgaatacaaatggcagagcagatactattgtcacacatatatgcagaagagattctgtaaggggtatttccgggaagacagacaaggtgtgatatctggtgtcactgtgtgtatgaaagaagcattttaagatcctcaaataaacataccgcccaaattaaggtgaaagtaaagcagacaggacccactttttgcactttgtatcttttctctctgctctttcagcactgcccaaagaagctgtcgttttcatcttgcacacaggatgccgtcctctgaagtctgaacaaaggccggatcacatgcctaagcagtattttaccttgtgctgattccttaaaaaaacagattgtctcctggattgcatgcatctagaagttcttaccacgttttattaaacaaccagctaatgcttctgcttcctctaaggagatcatgagtccccccactcccgaacaaagggccttcattttattcatctgtgtattccacatcccagcacagcacctggcacatagtgggccctcaaacaaatgtatgtgggataaatgaacagatgagagtgaaaagaggctgtgacgaaagcactggacgggaagctggagacctgaggtcatctaggcccctgacactcagagtcacttgagtcaaggcaccaacttccgtgggcttccgatgatttctagggtctctcccaagtctttttaaaaaaggcacataatcctaaaatgtgcttacttactgctttgctgtgttgatccacctagtgacttatatctaaagactaattgctaaacaaattactgaggcctttccgaacgctccacagcaacaaaactttgtttttcccgttgccccataccttctgtgtcatttatgttcccactacagatcacagtggcaacaaccccacccagaagagccaggaaaaaaccctcccctctaactcaccatagggcttgccatgtgctagctgtggttctgctaagttgtgctggaagctggagtgggcaagggctcagaagccttctctttcccccttagtccatgcctggccctgctgtgggcagagctacgatgactgaccatgatcatgtgtgagcacggggcagtgtgttttaaggggtgagcactggcagaggtgggtccagaaagggccagcccactgaaaacttcccaagtgggtgaaactcaccttggcacttgctctcctctctcctgccctctatcccataccccatgtgtagcattccattcaagaaaagaactctgactttcagcttgttgacaacttatctcctgaaggtgttagctgacaacttttctgaggcagaagatgtgaccaatataggtgctgggagaacggaaggaaggggttgagttacatttattcagtactttttcactcatttaaaactaagcacacaactgagaggagtactcttctacttttaagaaatgttcttattgtatcactgccgctaatatacgcttatagtctaaaaatatagaaacagatttgaacaaagaagaaaactaaagttacacatactatagtcctttaaaattttagagccttctagatcttttcatatatttataagtgaatatatttcttacgtgcctgtaatcatacttctgctcatccgatttaatgtaattctattgtatctgtaatggaatagaaattcttgtccttggataagtcactggccctttctatcctcagattcctcattaatcagtaaagcacgaatacacaggaaaattaagtcgtgaagcactaaaccacagggcggtgcgtggaggcagccaggccatgtggtggaaatactgtgaactataacaaccatagagatatgaggagtgattattgataggacacattaccatttccaaggatttaaaggtaatcaggccaggcacagtggctcatgcctgtaatcccagcactttgggaggccgaggtgggaagatcacttgaggtcaggagttcgagaccagcctggccaacgtggtgaaaccccatctctactaaaaatacaaaaattagctgtgcgtggtggcacatgcctgtagttccagctacttgggaggctgaagcaagagaatcccttgaacccaggaggcagaggttgcagtgagctgagattgggtcactgcattccagcctgggtgacagagcaagcttctgtctcaaaaataaataaattaataaaataaaataaaataaaataaaataaaataaaataaaataaaataaaggtactctaacaattgaggaagtgcctccttatcacatcctgacaggcggacccttgctgcagccacaggtgtagactgctctctcaatggcattttttgaaagttgtcagtttcttggtgctggaacctctcccagctcagaagttgtcaccttcagactatctatcttctctaaatgggattggcttcgaagagaatatttgaaatgtccccatattcaaactgaaaggagacaggctggaccagtaagaccagccaagagatgttgagttacacatattgtttggggccacagagccctactctgtttctcctccacctgtctgatcccacagtactaacaatacattgtctgtaggcccagttgtaaagactctcgcccctgtggactggctgtcctcagaggggagtcagggaatccccagcggggctgtcatggagctttggcccagcagccccacagctcactcagaaatgcactgcatgcctgatacagtgaatgatcatcagaccggccattggcggctgagcactttgcctttctgggcttccgtttcttcactggaagcatgagggtgtggaatccaaggactatcagaattccttcctgcccagatgccacgaacctgtacgtttctgtccatttttgtgttctgctggtactcaggacagtgcctgtaataatgcaggtactttgaagtatctgttgaaggaatgggtgatgaataaatgggtggaaattctgtgcttacgatgagtggaaacacaacggttggtgggaattaaactcttaacacatcacatggtgaccaaaaatgctgaggccatatctggcctgcatggtctgacatgattggaggcacccctgaaggtgggaggatagagtagattgaatgagaactgctcttgaacaactaggatacaaggctgctatatgaggggccagaaaagattgcatcagggcctggagatggtaacattcatgacaggtatacatctatggttttggaggcatctccatatctgcatttcttataagcttgtgcatatagtgacacacagctattcgaaagccaaaagtccctcaatccaatgacatttggaacagaacctggagcataacctggaaggcacctgcagcagaacctggaaggcaccctatctgacctggcatcagctgacacctggctgtctacagctttccataagcccttgccaaagtctcacactccccaacaggcccatggactcagcagtacttggagaccgagtcactgggtagattatagagttatcccagcccccatcttgctcaaccccaaccttgggtgcattgacttcccagtgaaacagaacatcgaatgacattttaagcacagtggtacatcttctcagagagggtatttggctataatatgctgcaaactttaaaatgtgcatatactttgcctctgcagcttcatttctaggagatcatttgagaaatgcacaaatatatatgcacatggatgctccttagtctcgtttataagagaaaagctgggaacaaactaaatgtctattactacatatcagctgaatacattatgatttactgatgaatgaaatatcccgcatcataaacatgacgcataaaaatatcacaaaagatgtccacaagctactatatcattgactaaataaaactgtctatatgatgtaattaatccatgtatgtaagtacatccagatagactgtacagagagagatgactggaaggatcctcatggaagttttaatttactacctggctcttgagatttggggtaaattttcctctgtgcttcctatttttctttacagttggaacacttcatgataagtgtgttgttgatatcaggaaaaaattattatcattttgaaataaaaaataattttattggaagccttggaagggaaaaagagtggagatctctccaaacagttgaaatgaatttctaagcaggtgcacgctagtcacacacatccttcccacctctctgaccagataggaagtgctcaacacatgtggaccagttccctactagctgccaggtaaccaatacgtgaagcaaaatggggattctacaaagtgagagtcctaaggaagctctatcctatgcgatatggaatggaggcaaaggatgtgtcctactgtcatctgtaatgttcacttcccaggacccagccatatacttggcagtaagtagctgatgaacattccaaccattattaaataacacttctttcaatttcgaatatagtctttgcagcttcctcttccttcctacttctaactacaggggaacataaaaacctgaaaaccgtctgactgtggtggctcatgcctgtagtcccagcactttgggaggtagaggtgggtggatcacttgaggtcaggagttcaagtccagcctagccaacatggtgaaaccccatctctactaaaaatacaaaaaattagctgggtgtggtggtgcacatctgtaatcccagctactgggaaggctgaggcatgagaatcacttgaacctgagaggtggaggttgcaatgagccaagatcacaccactgcactccagcctgggtgacagaggaagactctgtctcaaaacaaacaaacaaacaaacaaaaaacactgaaaaacctaatccctgcagaatgcaagcgtcagattttgagaccattcagtccgatgttctcattttatagagcaggatactcattctggagaaaataattcaagttggctattgacagtgtctggattagaaccacagtcttccagccctgttttctcctcaccttcctcacagccatgcccttgtttggggcccgtgctttctcttgtttggactactgcaacagtcatcaagcaagattttcctcccatcctcccatcttctccaggtcacattccctggcactagagaatctctctggaacactgaactgccctgcccatatcttttccctgaataaatccctttaaatgttcctcatagactccaggacaaaattcagactcccctgcatctcacatgagccttttgcaacatattcatggaccacagtggcaccctgaagaaataatctttcacacacaacagctggaaatacttcatgttcctttattgtcaagtaaatgagggtttcttccaagggactatcctgtaactacttaatttaaggattaactaaaacaggaagtgctaatcagctcctgaaaacacaaccaacattctaggcgggaagctcgtggaagccaacaacaaaagcattcgcgctcagtatgcctgccttccccttggaacctaatacatggtaggacctcagtaaacactacttgccaaatgaatagactaagtaataatcagaagtggagaggttaaactaatacaatgggcagtgaaaagaaaagctgtttttcgttttcttataccccttagaactgaaaaagactctgagtttgtccaattcgactccctcatttcacaaggaaggcatctgaagctcagagagacaaagtgaccgccctaaagtcccacagcatgttcatgggagagttaggactgtgctgggagcttctgatggtttccactgtgccatgctgactctccaggcaagtctaaagtaatgctggcaataatgcacagagctctaggcacaggctcctctggaaggtgccagacagcatacaggctggggcaccaggtgtacagctaatcatccccagagaggtttacctgagcttccaaagggtttttttcttttctttctttcttcttcttctttttttaatcttgaattgtttggtgaagagtgtctcaagccaaggagcagacacacttgtgtgccccgctcccactcttccctcctttgttcttttctttgagctgggtccattggaggagcattgtatggtgcccctgctgggtctacaaggcccctttttggttcaattaatgagccataaataacccaatgaaggtgtcaacaaagagggtaatttatcataccttgtcaagacggcaagctttgtgaggcaagcgctcattcacagtctggtgcaacatgttaagatttattcctggccaggtccctcctcctccagccctccctccccctatcaaaatttatctttcacaggaatcctcacaggtgtgctgctttgacaaataagctatgaagtctggtattcatcactggctggtctttgttgagaggaaggcagcgggaaataaatttatgttagagggaaggtacttgtgattcaaacacactcaaggggagcaacgaggttatttccatcctcctggttctgcaaaaggcgagaaggagataatgctaggacagccactttcttcagtttttactacttgatggaagaacagccaggactttactgagatgcgcacttagctgtcagtctggaggctccagtcgcattctcttgaaaatgtttggttgggaaatcttacagtggagtagaaagtgctacaagacatctgatatgcccagaatcgccatatcaggaggttttcccgcttcgctcttcaacttctggcttcccttggagtgctcatcctgaagtgtgagtttgcataatagccatctgggagtgcttgctaaaatactgattcccaggcctcccctccagcccccagagatacggacctgggaagtctagggaggagcccaggaatgtgtattttgacaagctcgcctctgttcttgccttcagacgcatatggtttatggagcacattttggatcaacacgtgctgcttagagtctctggtgcatgcctctgaactttctgcaatgatggaaatgctctctatttgtgttacttaatactgcagccactagtctcttgtggctgttgggcccttgaaatttggctagtgtgagagaggaatggaatttcttaatagtatttaattttaatttattgaaatttatatagccatgtggctagcggctaccattttagatggtagagctctagcccatcattctgcatagtagatacagacgaaaaagctcaacataagacctgatatgccagtctcctcctactctaccctattttccagctaagaaatactccaagtccctggagtgtgccctatttagtcatttctaaacaggaagagggaggagcatatcctcccacctccattctcaaggtctatataagccgagagacagaaagatccaatttcttaagtgccttccatgtgggacggtgggaggcatctttgagaattacatatggtctcccaatacagggagggaagacaaatatacaagtgacccaacaccaggtggcccactatgaagctgtagaaaacacctatagatgcaaagtgccaggagtcctcagcctcccctagcagatgtgaacacttccggacaccagccattcccttcccactttggaattaatgcaacagccttgtagctcattatgcccaattcactgaaggaagttagacttctgaattccttccttgaagtgtccaaggtaggtttcccactgtctgccctgttgagatgggacccacctctgtggttacactttgtatgtggtgactgtcatcacctgctcatctgctcacctgtagactttgaggtccgtgagcagagattcccaatcatttatctctgagccaagagaccgaccctggtggggcaaaaccagtatgttctaaaatgaaatggcctcacatctgcctatatgaggcctcttacgtcttgcttaaggataaaagtggcccttgaaaaacagaaagtggtctgttctctgagggtaaaagggtgtaggtgttccctttctacagtgttatgagagggacttaccccttaaatgtgtattttaaatggcagggggaagagggggaagaccacatggaagagtgactggtccagggtctggggaagaactccctgtctgtgagaaaattccacctgggaaagagaaggtgagtctgcctagagcagcagataggctccaggtccataagtggggccaggcaggcttacaggagtaggaggcacggaggcacattgggaggtaggctgttcactgcccagaggcacaaagcccctgtcccagaagtgaagggcagcctacaggcctccactggatgccctgccacccacgaacagcccctccctgcccaagcactcttccttactcactcctctggctccatggggaagcagaatcccaactcatagctgcaggaggaatagctgaagagagaagaggcctggcttcagcttccagagctaagccctgccaatctcccagactcctgcagtctttcaagtctccgacatttgattactcctttcttctcatgaagtgtccttattttgcctctagaaaacaggcactggtatcaagagttgcatggctgatgccaagacttaatgctccagagtgtcttgcacagggccaaagctgcctcttctggcacacacagagttctacagaagggcccccttataggccaccagccactgtgaggacctcataagcaaatgtaagggcaggaagagatgggacatggtctggcaaaaacctcagccttctccctaagctcttctgccttatgaggctgatagctcagactcaaaacagttggctgagttctccagctaaatattcatttctccagctaaatattgattccttcaatattaacaccatgtcagggagccatgttaagccattgcctcaacttggcactgcagctaaacataatgaaatgccagaaattagggtctagaattgattatggtaccaattctaatcctgaattctcaaagcaatatctagaaaaatattgaatcaagagtttttttttttaaatgaagatcctatactggagggagatgggcaacttctatttggaataacaagcagtatcaatgtctttgaattcaccttgaaaaccaatcctttggagtagaaagaattcatggtatttgaaatgtccaagattactaatgaggggaaaatctgagggacctgagaaggtggggttgcttgagaagcagtaaagcttctcaaagaagaaatggagatgccatgagcagctgccttggaccagattccaaggcagtgtcttgtaaactcagccacgattagggctgggtcattctggaccgtcctaaagagaaaccattaaaaaccattaattccttcagatatcacagctgcttactcatagtagctcattcataggtaaggaaactgagatctccctaagatcaaataagtaacaggtatgttaaaaagtttcatttgtttacgtgttactaccaagggccaagtttctccatgtagtgcaaggaaataatttctgtgcaacagctcgagatatgcagcttgagtttgcctgaagccctggcactgtgaattgcggctccttcagatcttgcaagctaccagcgatttggcggggtgggtaactggttgggaaacctcccaggaaaccacagctcctgcaaatgactcagtaggtggttccgacttctctgagtcagaaccaagcccatggcccagccccatgccaagactccctggcattgttgagatgctctgagcttggctggcatgtgacactgaggacctctggtgtttgtctgcaaagggatgaatgctctttctgataaggaaccaaggagtgtggaacagaaaagcagctgaattctctcagtggcctggctctctcttgccccctcaatccctgaagagtgttgatggcttcctacgtcagacaacctttcacttaaaaacttactcctcttccttacccaggagtttccaggttgccccccacagtcatgaacttgcagacacagaatgcttagttctagtattgattctgctgcttcccagggctgtgaccctgagcaagtctcctactgtgggcctcaagtattacccatcccaatttcatcatcagcccaattgtcctctagtgccatgatgatcatactaatcttccaacccaaattctccactggctcccactgcctatggaatcatgtccagacttcttagcctggtattcaaatcccaatctatcttttaagcctcagcttcctctattattctccctgtagcctacgttctcagcaaattggaccactcactctccctaaatgtactgtgcatttcccattccctgtgcccttgcagtgcccttttcttgagatgccctctccttgcctctggaaattttgcctacgcttccaggctcagatcaaatgcgacctcctcctccaagcagcttccgcagctcttctcttgtgaagcccccttgatctctcacatcacagtttgttggtaccttcctattgacatagaacgcattattctgaatcgcaggcatttgtgtggatgacttctctctcctcctggatggcatactcctaaaggaagaggggtgggggaggatgtcttattcccctttcaatttcccatcatgccagggtatacacatctgtactaatgaacaaatgaatgaatttagaaaatctagatggatgttctaaaattatctacagctgtggtatttcataccagaggtggctgcacatcagtaataaaaaccagcccagacacaagcttttcatatgggaaaaagcagaggcactggtgcgatccattctgttggccatgaaatgtctttgggtgtgtgcacacagactcccacaaaccagatgcaacatctgcttttgaagggcccagagaggctgggctccctcatttctcaaagtgatgagaagcgcattggagtcttgcagctgacagtcgttcggtaaagaaacacctacttagcatagccccagctccagctccacaccatatgcatcaataggggtgggtcacagtgccctcttggcagtaagccaggaggagatttgaggtttggttttgctgtgctcaacaggcagtcctgatctacattaacaagtctcctgcttccgtgtgactagctaacaaggagactgctgcctgcctcatgcagggagacctttcccaaagcttggcacctgccctatgctggcccagtggaggccaaatgggggagcagaaaggaagacattgctaaagttctcttttccactttccttcaagagactagaccagtattctcaaactttagcaagggtcagagtcctctggagggcttgtaaaaagaaaaaaaaacaaaaacacagattgctgggccataactccagagtatttgacttagtagctctgggataaggcccaagagtttgttgttgttgttgttgttgttgttgttgtttgtttgtttgtttttttctgatatgaggtctcactatgtgacccaggctggtctggtcttgaactactggcctcaagcagtcctcttgcttcagcctcctgagttgctgggattacaggtatgagtcaatgagtcatcacactggctcaagaatttgcatttctaacaaatttccaggtgatgctgatgttgcctgtctgggagccacactttgagaaccactgtattggctactccaaagaaaggcaaatgaaagccctcaagccatcactggctggacaagaggtatgactgtctccctgcctccaggctctgctccattacaatctgtcctctactttcccacagaaagcacctttctaaagcacacatccacctatgccattggctgcactgcctgttccttgcctataaaatacaaactccacagccaagcttatgttgtctaagccgttaactgtgtgccaagcactgttctaaaacctctacacattataagctcatttaatccacataattctatgcagtaggtactattattatccccattttagaaataatgaatcccacagggggccctcaggaaatattttctgaatgaatgaataaaaagatgctcacaagcatttacactgtgtactacagaggactatttccatgccaaaggaaaccatcaaaaagtgaagaattggcttgccaaccagtcatttgttcctgcactacaccaaataacccatttgcctgtaattggctggatattctggctttgtgtagacatctcctcgctgggagaaaagccagagttaatccttcacaaagggttgtttaataataaccagaaactggaggagagcagaaaagaacacagtgatcccacacaagctgaggaaaatggactgttcaaacccacagtgtccatgctgccagtaagggcccttggtgtggcctgaggtttcttaatttttattataaaaatagaacatgaatatgtctctcctgattatcaccaccaaatacaccagtgaaaacatctatggctacatattactctaatgcaacactaatgcttacactggaacagaaaatcaggtcattgtcgagagtctataaatggacagccctctccatccattacttatttatgtttcccgccttttgcttaaccggccttgaggcccaaacagagaaacacaccatacataaagttaccagtccagataaataaaacatcagactcaaattggcagcttcatccttcattgctttggaggaggtggacttcaacagccagatgctgcacaaatgatcagcaaaatgtgaccctttgagaccgcagcagacaagtcattcctaagacgtgtatcttcccaaaagttagctttgccctttttagagaacattcttgtttactgcagacagaagacaatgatcccaaaataagtttgagcccaaatctctttgagttgggcaaactgagactgacattgttgaattcatcaccagttgaagtcaagggtttccccatgtggccggccctacagttactcagcctgaaggctcatcatggtaatattacccatgggaaggtctgcatagtaacgaaaccatcagagtccctgtgcaaagttccagcagaaaaacaatgatgctaggacccaatcctatctgatggcccagaggtatctatggccctgggggaagcccttcttagtaaaaggaagacccatctccaggaacaaaatgacttgccttgctccttacagtcttctgtctatctactcacagcagccatctcttagattgaacaaagtaggatgcttttacctagttttcagcttagccttgtgctaggcaacctgtgaagtggctctgatggagagagctggtgtaattagcagcacagggcacgtttccagaaacagcctggatggagaaacagagggcacccttgcacacctgtcacaccttcagcctctgctcaaaagtgtccaccttctttgtccacagtagctacagaagtgaaaatgtttgcctcggcatcctctccatcaccgtcaccatcacctagcccccaaacggggatcacagtgctctatccacccctgagagcaactgtgtgcagtcaccagcaaggatggttctgccagagtgacgggcactgcctgtgaccatacagtggcagcagtcaagaaacaagcccttctgctcaatacttcatcttttcctgtgtgctgagaattaagtacctcttagctagttagaaaaactagcagttattattgatgaaatgtgtaagacagacattttgttaggggcagaggagaaaatagtagaaatgtccagtcgttgaggactgtctgtaaaaccattcaaatcaaaccacttcaagaaggataaagcactgtgctgatgtaagggatggtcattagataagaggagtattacatcttatgctctgtgaaggaaagggtataggtcttatatttttttttaatccaatgataacaactgcaaacatttacttaatgtgtgctaggcaccatatggagtgctctatgttggattatctcatttcatcctcacaattttatgaggaatatatcattattatcaacccattcaatggatgaggaaaccgaggcatacagctggcaagtggcaaagccaaagttagaacccaaaagtctgacaccaaaactcaacctgccccctctgacacagaaactttcatggagctcagtgagaactttaggaccagtgtaggcactctctgaattcttctagatagcactgagcttgagtatggttgttgtttaagagtatttactgtctgggtgattattctggctcatttcataaggcttttgtcttggtgagaaagcactcaccatcttctagttggaaagccaaggtcttccaaccttgggaaaatcctgcctcattatgccaagagttaccaaacagcacaggaaaatattatcacagatttcctgaaactgggtgagatcattcagttcaaagcctgcacaattctgtttcatatgcactgggggcagaaaaatgtatgattggtccttagagctcattctcatgggtgattccaccagtttcccagactccaacttgggtcttcccagtagtgtctgctaccaccaaagacagtaaggtgcagtggagggagttctgaaccagaacacctggttcacgtttcagctccaactactgttacagtttgtgtgaccttgagcaaatcacccagccactctggccatctgaaatattatcagtcaaatggggatgctgatatttgtgataatgttacataaacttgcctacctcagaggctcgcagttaggaccaatgaagattctatatgtgaaaacacaggttaatacagagcacaatatcagtgataatagctaatatttcttttctttttttgcttatgatgtgccaggaacctcatgaggtggatcatattatctgcaattgctggtgaggaagaggaaggagagactcagagaacgaaaattagcagaagtagaatttgaacctaggtttttaggttcaagataggtttttccagcttgtgtacacaagctaatgttgccctaaagggagtgaaaattgatttttgagggccaaaaagttgctgtttttatatataaagtacagatatacacatcgtacataaacagacacatagtgtatttgtatctgtggtattacaatctcatggggagagtgattagaaaaaacaatgtctaaaacaggtctgtaggaggcaataatgaagaaaaatttgagaaatactggtctatcttcaccctatcattccatttcccataattaataaagatgatcattgttaccatgacaattaagtttctgcagtggaaggttgcatgctgtattcaaatatagtacctgtgaaggtggtggccagtttagttgccactgtagatgatctagcttagaggtcgtgtgcaaagaattcaaataccttcacatttaaattctaaagtgtaaaacttctgccaatcaaaattagaaggtaatgtggcattaatgctactcactctacaccctggatacaggtacatggttagatcagttcatacaaactagaggagggaaacactcacttaaacattttaaataagagggaggcaagaaggtttgcttgaggccaggagtctgacaccagcctagtcagcacagtgagacctcatctaaaaaaaattttttttaatactgggaaaaataaaaatgataattggtgcatttagaacattaatacaaatctgcctagatctgccactggggatacagattgcttcttttctttcggctactgaaaaaactggagatttgtgtgtaaactccgagtaatatctgtgaattaaataaaaaggcactggcccatgcccggcttcttaaacaaatcaggcttattcatgcaacatgcttccagaaatgtgttcaagtcctgtcaccagtgatggctcgatcaaagttatttgctcaggccattgctcgttggtccatttcaacttgctacgtcctgtagccatcttcctctctcagacctcttccctcggcatcgcagctcctgacctccactttggccttagtgctccctcggagacttcttgtcattccaatcatggattcactcactcattcactcactcattcattcattccattcattgtattatatacaacaaactgcgaccttgttcccaccatgaaccaggcattctttcagcatggtagccctgcctctcaggtctgagaggtccaactgtctgggccagccttgtccagattctctactggacaaagggggctggagaggaggggcatgcagtcatcagaggcttcattttgtacaaattgcctttgaggtgttcttctgactggagcacagcagggacgcacgtgctcacttgcaactctgggccaggctggtcctgaggtacctgtgataatcaatccagttgccatagcggccttaagtgttcatttaccactatgcgacctggagcaataatatattatgcctttcgccagagggagccgtgccagcctcagcacagggcggccgtgtcggccatcagtcaccactccccttcacaaccttttgttccccgctcattatggtgaattataacagggggacagcacatttttcaggagagtttctcctgttaagtctgagagctaactcttcccgggttgttccaagtcggctgtgctagccctgtacccctgcaatgtttatgcacgggacagtgccgttcactggacttccctcttttccctcctcttgcacttagaatggctgaaaagcagtgtgtgtgcacatttctacaaggcaagataaaaaaccactccagtgtatttactataaatattggatactgcattttgttgcactctgtcatgtgcccgaaggcctatcctggtggtaaattacattacagaacactaaataggccatcatgtcagctttgagccttggcattgctacttcaagatgagtagaagatcacttccaaagtcacacatgggaggatcaggggccaacacctccaaccctatcagcattttttgaaaatgtttcactctaatagtgatggtgaacattctaagatcctaaaaattagaggctgggtcacaagattagatcactgaaagaaattaaagataaaattgttggctaagatgatttctaatagccccaaaccagaaacaaccccaaaggccatcaattggtaaggaataaacaaactgtacgtccatacgatggaatactattccagtaataaaaagaaattataatacaacaacatggatgaatctcaaaaacatccgctaggtgaaagatgttgaacaaaaaagaatatgtattatattattgtatttagataaaactctagaaaaggcaaaatacagagacagaaagctgatctgtggaagccagaggccaggttgcagggggacgggattgagagccaagaggcccgagggaacattttaggtgagggaactgttctatgtattgtttcagatggtggttatggttgtaaacaataaccaaaattcatctaactgtatgcttataactggattacattgtatgtaaataatattgtagtcagcctgtaatcccagcagtttgggagtccgaggcaggtggatcacgaggtcagaagattgagaccatcctggccaacatggtgaaaccctgtctctactaaaatacaaaaaaattagccgggcatggtggcgcgtgcctgtagtcccagctactcgggaggctgaggcaggggaattgtttgaactcgggaggcaaagcttgcagtgagccaagatcgcaccaccgcactccagcctggcagcagagtgagactctgtctctaaataaataaataaataatcataatattttagtcagtggaagaaaaggaaaacaaatgttgaccaaggcaaatggccatgatttttctcctatgtgatagcagacctgcaagaaagaagtggtattgtatagaaaaacaagttatactcattagacaaaatcaaatgagccaactttgtgaacctaagcttggagacaccaaacacttcataatttttatggcatggtgataagctattacatataccaaccctgggatggaaaagccttgtcagttgcagttcaacctctggttaattcaagctgggtctaaaaggcactaaattgagtgtggtttcacttccttggacttcaggttccttgtccttgaagtggaagggttggatgaaatggttgttaaagcttcaaaatgatacaactgtgccagtctttgctcaactccaagctctttaatgtgttggcgtctcgcgattccatttagctattaggaccccagggccaaatctggcttgtcccaatgtcattgttctacagaaccgggtgaaggggcctaagatacttggaggaaagtctaccagtgccatggtcaacagtgggccctcccaatgagacagcctcgggctgagttccctgtctggacacagcagccagtttctatgatgctttcacccagaggtgttcttggaagatctccagtgtactttatttttagttccttggtgagtgctcactttgtattctaagaaaacttttagatctcaagacaaggaatttttgatctcacttttttacgcaattatgagtcattccacatgttagcattagcaacccaagacctccctctcctcactgatctatctttttcatctcttcaaagatcctggaggtaaggaagggttttaaatgtttgcccttgaaaagaaaagacgtgcaaaccggaaactggtgactagcactgctgttgttaccaagaaatagtttttaaaagcagacattttaggaagataattgttgatctttgcattacccaccagtccagtgagcaggcaaatctcctatgcataaaatctgctaagtcttcaagcaaactcacctttcctaaaggattgaattaaaacttaatccataatatcttcggaagattccccctaattttttaaaaacatggaattttttttttcatgtgatagatctggttgaaaaccaaaatatcagcaaaagccacagctcatcataaacgtaactatctatggagcccttacataatggtcagctactgtgcacacagtagatctttcagaccttacaactagatgtggaaactgagtcttagtgagtttatgtctcaaggccaaggctgcctcgcctgtaaacagcagagctgggatatacacccttatcagaccaaatcccaaatcagtgctcttccccctagtgcttattgtcaaattctggtttgtcaaattgtcaaaccagaaccaggtttccgttttacgtttctattcataaggcgaattatgtgtgttaagcaagatgttcggcaattatttgcccatggatgaaaaggtgtatgcttaggtttcttgtatcttatactttgcttcacattagggatgtagcctcaggcacacattcatgtgagcagtgacctgtaatcagtttataagattatcacttaaaagaattttcctgttactgatgatacttagagattggctgttagaatgctgtgtgaatgttatatgcatatacatacaaacatgttttctctttatccttgatcttcctatcctccttcaaaacaaacaccgtctttaatctttaggtttatgtgcaaaagtgataatgcagacataccctgggatggaggtggggaggacacaggcaactgggcataaggagagataataagacacaattccaaggctggcctttgctggccttacacattctggaacaaataaagctaacaatattatcaagcccacgaagccctgttagagttgaaattgcagctcactgaaggtcaaatttattagattttcttttctgccttcatagaatggttgaataacaacttcctatttttagcatgaactctcctttgtaattgcttcacccaaatcaagaaagctggagtcagggtacctgtatccatctttgctggcatcatgttctaaatcaagtccaagtagctatgcatagtagcatcttcttattttgagacttggcccttcaactagtggtttagaaagaaaggtgactttgctaggatgctggggcaaaaaccagggtgctgaggaagactgccaggttctgcaggacattttaaaagtacactgtcaggtttggggtttaacctctcacatgtctttcttaattttttttttttttcacttttaaagttagcttaggaacgtcaattctgattctattcaatcttgttctggctcttgtagtcactcttctgaggcactcttgttctttgctgtatcaaggtcatacttaaaaagagatgttatttcttgatcagggttttgagaggattacattttcaatgtgaaggttcagccactgttttagaggactgtactaatgagcataagacagaaggtcttggcccaatgtggacccgcattcagttctattctccaaggatgacatctttaacctcagccagctatttcgcaaaagtgagtaatgggtcggctgggcatggtggctcatgcctgtaatcccagcactttgggaggctgaggtggggggattgcctgagctcaggagttcaagaccagcctgggcaacacggtgaaaccccatcactactaaaatacaaaaaattagccaggcgtggtagcgtgtgcctgtaatcccagctactcgggaggctgaggcaggagaattgcttgaacctgggaggcagaggttgcagtgacccgagatcatgccactgcactccaacatgggtgacagagccagactccatctccaaaaaaaaaaaaaaaaaaaaaaaagtgagtaatgggtcaaaggggaccagatgagagcataaatgagcataaatatatcacttctattaactaaacaaaccataaaatggaggccttttgccatagtcagtcagtcgtccattatcatgacaggaaaaatcacacatatgctctcatatgagttgtccatctgtcaaagaatttgtataaaccgaagaacagtaacatgcactgaagatgaaaagcacctggggagctttaaaaattcctgaggcccaggccaccctggtcccacctgggaagtctgatgtaactggtctgagatggagcatgggcatcagtataatttaaaagccccaggaagatcctcccatgcaactagagctagaaccactggtctagacccagttggccacagtgaacaccgtactaagggccagggactctgcacaaactgccttaatgggtggagttacaggtggtaaaaaacagaaaaccgtatacaataagcagcacggagcgagatgcggtggctcaagcctgtaatcccagcactttgggaggctaaggcaagtggatcacctgagctcaggagttcaagaccagcttgggcaacatagtgaaaccccatctctaccacaaatacaaaaaagaaaaaaatggccaggtgtggtggcaagcatctgtgatctcagctacttaggaggctgaggtgagaggactgcttgagcaaaaggggcagaggttgcagtgagctgagatcataccactgtactccaaaaaaaaaaaaaaaaaaaagcagcatggcccagaattcctgtctgatgcttcccatattcccagagggcaatacaccatttccaataatcgtccctgcagaaggatagaaaaatgtcagcaacaagagtgacacttaaaactgcaccccagactcctgtggttgagatgctgcatgcccaacgtggtctgacttcccactgactgacctaggcatagcaccaggtggagcatgcagacatatcaaggtttccatagggtccacagctcagagatataacagatgcccgataggagcaaaatgaaagattgaaacaaaaacaaacagcccactttggttttagagcagagaaagctaggagctgattggcttaagagcagagaggaggaaggctatagtttaatatacccagcaaatccagcaatatggggctggaccaccccatatagataacctataaaatataatttccctccccaccctctctctgaaaatccaaactcatgatcacataaactgcacaaatcatgggaaagaacaggaactctcatctctctttttaaaggaaaatatgtattccacggttcctgttggcacgagctggacattacagggctgatatctctggggacaaggcacagtgctggcttcttgcatggaggcaagtggtgccaactggccagcataccaggttggctctcttccaggacacagtggcttgcatgagctcccgtcaggggaaacgttgttatatcatggctgctgcagacaagaagatgatggaaaggataaggctctccaggctacaactaccgagaacagtgcttgttagaaaaaatacttttcaccattaggggaggaaaacggctctttctccaaattcctcccatttgctccccatccctgccatgcataacaatatgttccattcagaagtagtgttagaaataaaggattgcagacaaaactgtactttggaaaagggaaaataattggttcactcaaggggcacttttttggcaaacccaaggcaactcacaatggtacatatgcttgtctatcccagtgcacatgatgagacctgaaatcgagaggtcacttctgtttgtgggaaagccaggatcacttaattggccagaagagccagaagcaagctaacctatcaacctagcttttaatctatgaggcagaatctattccctgactttttcacacaggtgatgatgctcataagttctcccagcagctgggcagactgacgagtcaggaatgtaccaggttccccaccctgagttcaggctgggctcactctagcactcaggtgggttatatgcaggagaaaccaaggaacctccaggaagaagatgcattccaaggggagagtgaagccaagtgcacctttctgaatcaaagataatgagccaggatcagcgggtgtgctgagggtgattccgcacagcgtcccccaccctgagtgtcctatgtcccatgggagagcagctgcaattgcatggatgaataaaaccaaaatgactccgactccctctccctctccctctctctccctccttctccccacggtctccctctccctctctttccagggtctccctctgatgacgagccgaagcgggactgtactgccgccatctctgctcactgcaacctccctgcctgattcttctgcctcagcctgccgagtgcctgcgattgcaggcgcgcgccgccacgcctgactggttttcgtatttttttggtggagacggggtttcgctttgttggccgggctggtctccagctcctaaccgggagtgatctgccagcttcggcctcccgagttgccgggattgcagacggagtctcattcactcagtgctcaatgttgcccaggctggagtgcagtggcgtgatctcgggtagctacaacctccacctcccagccgcctgccttggcttcccaaagtgcccagattgcagcctctgcccagccgccaccccgtctgggaagtgaggagcgtctctgcctggctgcccatcgtctgggatgtgaggagcccctctgcccggctgcccagtctgggaagtgaggagcacctcttcccggccaccatcccgtctaggaagtgaggagcgtctctgcctggccgcccatcgtctgagatgtggggagcgcctctgccccgccgccccgtctgggatgtgaggagcgcctctgcccggccccgaccccgtctgggaggtgaggagcgtctctgccccgccgccctctctgagaagtgaggagcccctccgtccggcagccgccccttccgggagggaggtggggggccagcccccgcccggccagccgccccgtccgggagggaggtggggggccagcccccgaccggccagccgccctgtccgggagggaggtgggggggtcagcccccacccggccagccccttctgggaagtgaggagcccctctgcccagccgccaccccgtctgggaggtgtacccaacagctcattgagaacgggccatgatgacgatggcggttttgtcgaatagaaaagggggaaatgtggggaaaagatagagaaatcagattgttgctgtgtctgtgtggaaagaggtagacataggagactccattttgttctgtactgggaaaaattcttctgccttgggatgctgttgatctttgaccttacccccaacccggtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccccagggtcctctgcctaggaaaaccagagatctttgttcacttgtttatctgctgaccttccctccactattgtcctatgaccctgccaaatccccctcttcgagaaacacccaagaatgatcaataaaaaaaaaaaaaaaaaaaaaaatgaaacaaaaaagggccgttttccagaagtcatgggtagcacctggctagtgcaaagtgcagtcttgggtgctgtgctgcctgcagcctccgcagtgggagatggtacctaaacaaggtattgggaagagttgcagcagtaatggcatcattaacaggcagggcatggggccttggggcctcaggggcagctatttgtgggcatcagaagtggcattagtgctatccacagacaacaacaccacccctatggccacctgtgggcatctataggggtggatgatgccttgatgatttccttggatgtcatggctaagccattgttttttggcagctgcagcttctgaagatgttactgagagccacagagaaagtgaagacggctaagacaaccaggtcatgcgagacatgcccaagacgcccagattgcttaaaagacatttgggaaagggagcatttaaagttctttccagaggatggatggggacaaaactacctggagagcctattttttattcccaggcaaatatgactgaaaaaaaaaaaatcacaggtgttaaagaagaaaaataaaattggatgaaaaaatgtctctgctttttctggtgatgcaaatacaaggcatcatccatttagaagaaataaatacattttttctttccactccaaaatgccaacatttacaaatgagttatagaagtcacttctggaaggcaaaatactctccatggttcatttcctcagtcactcaacaaatagtaactaaaaatagatgaagttcccagctagtgcaaatgtctgtcagggataagtaacaacagaaacaacaatatataatttatgccagacttttttacatgagcaacctcatctaacacttatgaccctactgtgacaagtaccattttctcctattttaaagatgaaaaaactgaggcttagacaagttatgtgacttggtgaagataatagaaatattaagggaaagaacaaggtcacacatttggatcttccaattctagccctagattcttcccatcccccacaacaaatataagatacggtcctattctctgctttcaagaaacagacacaaacccattaaagaactagaaactagaacctgtttctattctctcctggttctaaaggatggatgcagaagagactgatagttcaggcaggagaggaatcaatggaagctggaattgtcaaggagttgttccagagcaggagagatataaggatctgaacaggcaaacaggaaacaggcagagttgagtagaagtatattctgagcggtggacaagatgaagaaatatgagctttcttcctaaggtgtgctggagtgatgagatacagcacagtagtggtgtccagtcctgcattctttccttccccaacatctctgaagcacctagcatgcaccaggcaccttgttacacccagtagcacacaccccctatgacatggccccttccccgtgaagctcacagcctaacgtgttgaggcagctgaaccccacgtgattcccagcccagccaaactgtctcctactatccatgatgaaaacatcagaagttgccaggccaaatcttgcttggcttctcaaatcaggctgtttatcagcactgcttcacacagataaaacctctcaatatggagctaaagtggaaaaaaactcagcacgtaaaaataaactgcccaaatcgtgttccctccccactccattcagcgcccagtatcactacacacgtgaaaatgccacacagccctggacccgagcagcagagcagctgctgtgtgtggacacaaagtacaactcagagccctctccacttctgctccaattgtcgtagcctcgtctgaactctgagctggacactccactgcaggatacagagcatgaattgagagaaagcttcctaaccttcatattgtcaactggtgtcttgctgcatttgccacagatcccatagtgtggtgttagaaatggtgttgacacactcccacatatctttagcattacatttcccatgttgctcctccttatatctttatctgcacttggtttataagtgaaatcaactgataaggcttccatttcataccatctgttatgtgtcaccaacgctggttttgtaaaagagatgagaaggatctaagactattgaaactttcacagtcatttccagctcggtaggctagaaactgaatcttaaagagtcactggacatactcaaagaagaacttcccactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtaggggccaatattcaacattcttaaagacaagaatttacaacccagaatttcatatccagccaaactaagcttcataagtgaaggagaaataaaacactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgttccaattaaaagacacagactggcaaattggataaagagtcaagacccatcagtgtgccgtattcaggaaacccacctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacgtaatagacatctacagaactctccaccccaaatcaacagaatatacatttttttcagcaccacaccacacctattccaaaattgaccacacacttggaagtaaagctctcctcagcaaatgtaaaagaacagagattataacaaactatctctcagaccacagtgcaatcaaactagaactcgggattaagaatctcactcaaaactgctcaactacatggaaactgaacaacctgctcctgaatgactagtggatacataacgaaacgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacacaaaaaacccttcaaaaaattaaggaatccaggagctggttttttgaaaggatcaacaaaattgatagaccgctagcaagactaataaagaaaaaaagagagaagaatcaaatagacacaataaaaaatgataaaggggatatcaccaccgatcccacacaaatacaaactaccatcagagaatactacaaacacctctacgcaaataaactagaaaatctagaagaaatggataaattcctcgacacataaactccccaaagactaaaccaggaagaagttgaatctctgaatagaccaataacaggagctgaaattgtggcaatagtcaataatttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggttggttcaatatacgcaaatcaataaatgtaatccagcatataaacagagccaaagacaaaaaccacatgattatctcaatagatgcagaaaaagcctttgacaaaattcaacaacgcttcaggctaaaaactctcaataaattaggtattgatgggacgtatttcaaaataataagagctatctatgacaaacccacagccaatatcatactgaatgggcaaaaactgaaagcattccctttgaaaactggcacaagacagggatgccctctctcaccactcctattcaacatagtgttggaagctctggccagggcaattaggcaggagaaggaaataaagggtattcaattaggaaaagaggaagtcaaattgtccctgtttgcagatgacatgattgtatatctagaaaaccccattgtctcagcccaaaatctgcttaagctgataagcaacttcagcaaagtctcaggatacaaaatcactgtacaaaaatcagaagcattcctatacaccaataacagacaaacagagagccaaatcatgagtgaactcccattcataattgctacaaagaggataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaatactttaaagttcatatggaaccaaaaaagagcccacatcgccaagtcagtcctaagccaaaagaacaaagctggaggcatcacactacctgacttcaaactatactccaaggctacagtaaccaaaacagcatggtactggtaccaaaacagagatatagatcaatggaacagaacggagccctcagaaataacgccgcatatctacaactatctgatctttgacaaacctgagaaaaacaagcaatggggaaaggattccctatttaataaatggtgctgggaaaactggctagccatatgtagaaagctgaaactgtatcccttccttacaccttatacaaaaatcaattcaagatggattaaagacttaaacgttagacctaaaaccataaaaaccctagaagaaaacctaggcattaccattcaggacataggcatgagcaaggacttcatgtccaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaaagcaaatcaaaaccactatgagataccatctcacaccagttagaatggcgatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccatcccattactgggtatatacccagaggactataaatcatgctgctataaagacacatgcacacgtctgtttattgcggcattattcacaatagcaaagacttggaaccaacccaaatgtacaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggacggtggtggggtggggggtggggggagggatagcattgggagatatacctaatgctagatgacgagttagtgggtgcagcgcaccagcatggcacatatatacatatgtaactaacctgcacaatgtgcacatgtaccctaaaacttaaagtataaaaaaaaaaaaaaagaacttcccataaatgtgagatgggagtaaaatctttacaagtggatggtgaaagcaattgtcttatggaggtctgtcttatggaggagtgccctgtttgggccccagtggatttggtattcatcacctattgacctatgtggggtttctactggatttaacaaaagtgaaagaagcctgttgccaaaaacttcaagggcaaattctattaaaccttgaagtttcaagtgaaatgccaaatcttcttgaactattaggttgttgcaaaagtaattacagtttttgccattaaaattaatgattccctagactccaagaccagttatttttgctgagctctccaagcacttgaagggcctcattcagctctcattacattctgggcagatggtgagcttcttgagggcatggacttgctttattcctctttgcagtcatccagtaatgacagactggatgactcaatacatacttactgaggaaaactgggcatttttctccagttatgtgttgctttgacttaccacattaacatgggttttgtatctttttaaaaatccatcttaaggctgggcgtggtgactcatgcctgtaatcccagcactttgggaggccgaggtgggtggatcatgaggttaggagttcgagaccagcctggccaacatggtgaaacctcgcctctactaaaaatacgaaaattagctgggtgtggtgatgcatgcctgtaatcccagctactggggaggctgaggcaggagaatggcttgaacccaggaggtggagtttgcagtgagccgagattgtgccactgcactccagcctgggtgacagagcaagactccatctcaaaaacaaacaaacaaaaaaataattgtaacgtgtatgtgttattcaagattgctggcattgtctcgttttaaagtactcatgaacattaggaaatatgataatacatacaaaacatatagtatatttcattatatagtaagtactcaataaatatcaggcagacctccataagacctccaattgttgtcattcataaggttaccctggcattgacttcatgtctttaaaaattcctggttctaaatgcaatacaaatatttttcaaaagatgctaaatattcttgggaattcaacacaataagaactcacatttatacagtgcaaaagattttgtgagtcgatttttacaaagttacaactgctgtcttttgctggagaagaaatggagacttggcccccatatatgctctattcaaggtcacagagccagggtggagcaagaggagtcaggcccaaacaagaatgctgacttccaatcctgacagtcccaacgcctctctagttcttccttgctgctttccaacatttttttagtttatccattttgtgtattccactgagaaaaggacactttatagacgtatattctgcaaagaggtcagatgacatctgaaattgcaaagcggtagacaaagcttttgagcaggatggtatattattgaaaacagttagaaaataatgaacaacattgtaatcgctggcacaattttaaaaaagattgctttacctggttttgtttcctttctggttagataatttcaccagcctgtttgtaacaaaaagaagcagggcaagcagattctcttgctggaaatttaatagcatgaagttcagtgatgaatagaattatttctcttattttgatcatgctttgcccacagtatgaactcaataaacacttgttcaaacaaattattattacaatgacttgttttttttttccactgggcagtaataactttaatttgtataatgctttatagtttacaaaacatattcttcatgtattaccatttaattctcacagcaattccaaaaggtagatactaatttcttcattttacaaatcaggaagcagacgcccaggtaagacaggtaatttgtccaaggtcaaaactgctcacagagcaagacctgctagaaaacaatgacaatttaaaagaaaactggtcttttaggggaggaagtatagcagaatgggaaagtataggagctttgaaccaaaccacccaggttcaaaccatgtctgtacgatgcactagctctgtgatgatgcacaggtttcataaatattctgtgtcttggtttcttcatgtataaaatgcaagtaacgataatagctgcttagcagtatattagtttgttaggatgacttatatgaagtgtttggcatttattgagtactcatcttaaggactcaataaatagctattactgttacaatgattactctttctgtcctcagaaaagtatcttagtaggccccctcatcctttcaattatcagtacataccagtctattataaattgtagaggaagctgtgagttagggacatagctcaagcactggaggtcctccgtgtgagtcttggtcccacctttatcagctgtgagatcaggagcaagttttcgaatctttctgatggccagattctgcatctatgaaatggtatcactcttgtcctatcagcctcacagtgctgctgtataagtcaggtgagagctgaagggaaggcactaggtagtccattcattcactcattcattcatagcctgttggcagtgtgcctcctaagtgccaggcactgtgctaaacagtggtgattcaaaaatgagtcaagacgatggaggagacagacgggtagaatgataagtaactgtattagaatatgcgttcaagtaaggtattattacaatgcacttatactgaaatagacactttgcgggctataagagtgctttaaaaatgtgaattcagcccacattctcactgcagagaaaagactaaaatcctctcagcaaccacattcaggaactttgccaagaaaggcaggtgaggactccattgtgcctgtcatccttcagcatggaagaactagtaactgcaagggctatgattgtagctgttgttccaacagttctgtgacaacacgtacctcctcaaacacaatgcaacagtgaggcctaatgtcccaggatttattttcattaagtcgatgcttatggaacacctaatatgtgacaatcactgtgcctggtaaataatgttggaaagaacactttgctcagtccctgagggggctatagttcagtgaggcagagatgcacatatactaattattttgaaatagcctgactggaggtcaggaaggcttcctggaggaggtcacacctaatcttaaagggtaagagctagttagctagagaaaggggggacagtatgacagaaaagagaagaacataaagaagatagagactgttctaaaagagttaattatcctagtgaactgctacattttcttctcaaatataaatacttggtccccaaatataatcatattatgtcccgtactttccatgatttatcctataaggagctttgtaaacataactaatactcaaaatgacctatgaggcatgcttgatttcagagtctttttttttttccctaatccaggataccttgaaatgagaataattagccaactgctttgattcaatgtctcctttgaaattgttcgtctactttatttcttcaattggataaataaattattcagaaacctgactatgggagcacacaaatctaaaatctgagctagaattttggtgggcaaaagttcatatctcattacagaagatgtttgatataaatattaattttcctaaagtggtgatggcagagattttatacaaaggatgttcatattggattaaacaccagattcaaattacctgagcctttgcgtgcatggagcatcaaattccatttcatcttgataagaagctgccctggagagtcattagggatttagcaggctaatgtggtccactgcccccttaccaaaacatatgactgtctaaaatattatttatgccttaactgccttgcctagaggtggagaggaaagtgggattttataatatcccatataatataaattttgcccctgaaactgaataactgtatattaattgcctagcgtagatgctcattcgattatacccaatcttcccaaccactctgggaggctggaattttatccctgttttaaaaatgaggaaactggagcacagagaaattaagtatcttattcaaggtcaaataattgagacttagcaaccattgttgtgaataataaaggaaataaaacgcatggaaaatgcctaatctggtgactgacagctaagaaataatggcagccgtggctgtcattaagaaaatctaccatccacaaaaatgtatggaaagtacatttggaatgtgtcctgtgggaagatgattcttgattgtgggtcaggatatggcacaatctgagacgtccactcagtaggtttgcacagcaacttggctcaggcacattcttaggtggctggcaaggaagacctcacagaggcaatggcccatactctctgcaccagaagagcaagagtcccagcaaccaactctctgccaacaagccagacatcgaaactcttcaaacaccatccaagtctgaaaactgcacacctattaaagttgtacctgcaaagagatccttatggacatattccaaggctgtagaattttggaaacttcaaaagctagaactaccagcttgcttggtacagccattgccattaggtacttttgtgtaagaggaatagaaattgtttcttttccttgcttttatgtctactggacagaggactatggctgcttgactcagtgtaacagagtgacaagtaggaaactgacccaaagagatctaacaaaatatacattaaaaaatcattttcctgaaacattcaaataatttcaagtatgtggcatcttagcctgactagtctaaattctagcactctgaaggaagggcttactggagtcctagttcaaccacgtacctgatagtgactttgttccaatgtctttatctttaaactaacgtattaggcaacatcagtgtgtcctgaaacacacaaatgttgaaagatgtttccaggagccttaaaataaaagggttctttacaaaaataaacaacaacaacaacaaatcctatagatatggctcatgtttgtatcctttcttggagagtcaccgtgctaatgggagcatattaaagagcctgaaactccagatgcagacatattagtgtccttcaagtcatcatttccacatttagtgggccatgaagtgtgacacctttaaacaccctgggaaactggtaggacgcatttgaaaaaacaccggattaaatggtcctgaaggttcttctactgctgcatcccatgatcctccagagaaggcttttttttgttttgttttgttttgccataaaggtttatggtagagacatatctgtgaaaaatctctcaattcctctcccatctagcacttgtggcctccttctcatctctctttcctggccttggggtaagggtgcgggcttgccatgcaagaggaggtatcctctatacttccctatagccagtatagattgtaaaactttcctttgaaaccccctaaataaatgaaaacaggattttttttgtgtgtgtgtggaatgaggaaaaaaattgcctgaaactaggatatgaggttctggacacttcctggtttacacagccacctggctttacctccctctcattgctacaaagactagattgattttgtggtcccttcccactccaaaattacatgatgccatagagacatgttaaagaagaatctttatcataaaatcattagcttacggctggcacatttaacaagcatggtgctctcatgcaattcctgtagcaaagacaacctctacaagcaaatgagccagccatttctacttgttctcctgaaaccatcctcaaaggtgggggactctcttaggaagtagcagctgagatagcacttgagatagacacagatttaggcaatacaattgtccatctgattaaaaagaaaatacctgctcaaaaaatagtctttggcctactggaatggctaattaggagtctgtgcagctgatctactgaatggggcagcgactagagagttacacgatcaggagagatgaattgcagacacaccagtttctccttaaaatccattttcatcatgttacactttggcacacaaatcttttttttttttttttctaaaaacagttttccctctttcctactgcacgaagtccaaattcctccaaatgacttctacgggcctccaaaggctggcttcacttgatcgcctctggattttaacacattcgcttcactctagactgtttcactctttggtctccctgcatcaccaccatcattcctcctttttagctgtgtgctttacaggtattatttcaaataacctcaaagcaacccaagagaccgacaccattgttatcattcccatgtcataactgggaaactgaggttaagtaacttacccaaggtcacacagatagcaagcagcagaactgcgatttaagccaaagccatctgtctccagtcttcactcttaactctcagtttatataggctttattcatcttctttcccaagtctgaccactccatcaaggtcaagggcaaatctcacctccttcaggacattcttagatctctctggcctctcacctggccgttccatttgctacacttccccacataacatttcttttctcatgttgtgtcatgctgatctctgtgtgcatggattctgattggactgttagtcacctgaagctggggaccaaataaagcataactcctatatctgctacaatgccctgcatgatgtaaaaggtacatcatgcacaacagaaatctgttcacagaagagttctctgatggtcctataaaggcattgctccagcctcaatcttcccacctgagatacaggtacacctggtccttgaagccaagattcacaaagataaaaaaaggtaacaagaagaaaatgtttatcacccattgatatacgtgacagagacttaaaagtcaagtgccgataatatgaagtaaccacacttgtgttgccataaagcgtctcagctgctactttaaatttggcctaagatatgaatgggcaggagcctctttcctttgaaagactttcccggctctgaatgggccaaaggaaaggaggagggaggaagaggggaaagaagccattatggctttaatagtttaatccaccgatatatgttgtcgacctggccggcctccaggagcactgagaaccgccagctcaagccaacacaagcacatgctaacttgatgggcagtgtaatgagacacagattgtatagctgaatgtaggcacaaagccctcatcaggtttatggttcctggggtcccagcctgaaaacagtaactgacacaggcaccacatgcgctgggtttagacatataaacacggaaggcctgcgaatatatatgtgaaaggtgctggggtttgtatttgtttggcccagtgcatgagctgcagatgggcagattctgttggaacattgaaaggtgccccggtcctgaccgagtgctgttttcttcttactgtgaccacgaggcgagagagtgagagtgagctgctttgaattccgagtatctttgcttttctggaagttttaaagttgagctttcttcttcaatgccttcaattatcacagtgcaaatgattatattcccagcacctccacccaatagctacagaaatttggcatttcctgtcctgactagaaaatgacctggcacagaccgagcgtaagcctggctcttcagcttttttcctgatgcagcctttaactcatttcccctccccactttctaactgctagagaaacaagagattagtgcagatggatggaaatattttttccgcttcagcacttgctgtcagaaccaagtactaagaaggttctcagacagtgtctcaggcaacctggaaattcccaaactcatcttaaacaatatttacctggtcccaaaaggaatgcacagaccaaagaagctgttttcttctgagagcagcccctcgacatgccacttagagttctagtcgaggctggactgctccccgctctcctccactttaccctagctgtttcagagctgtccttgaaacattagcacaccattttagagaccataaaatgaacacttggcagcctgaacacgtccacctgcccaaacatgaatgttgctcttcactgaaaatcatggtccccaggagccaagggttgtaacactctgttgagagtggtggcatggtctttgtctgaaagggctgacaatcaaactgggaaaacacaagccttgctcagaagaattggtagcaagagataaaggccaaggaagtcatagaaaataggtgcaccttatgttcaaagtaagtggttgcaggagattgggaagacaacatggaggtggtaccatttgtggtcatgaaaaataggtagggttttaaaaggtaggaagagagtattactttcaagggaaatagcttaagtaaatgtatctaatcacctctatgttcctactaccatgatgcctataagcagcaatcatactgtgtaccagacactcagatgctctacatgcatatgcatggtacatagcgtaattctcaagcttatgaggcagatatgactatccccatttacgcttcgaagaaattgaacttttcagagggtaaatgacttgcccccaagctgaatagccaatgggtaagatcagctctgattctaaagtgtgtgctcttaactgctcaaaggcatagaagttagaatgtgcagatggtgcaggggagcccctgttgcagagcacaggcctgaggcatgggtcataaggcactgttgactaagcagaggtcttaggcctgaatagcagagatgaggaatgatggaggtggatgatggaagcaatggttgaaaagggccaagtctgcagggaacctacagaggtttatgttaatttctcttgggcctagagcaattatctgggtggtggtggaaaggatgctggcattatctaggttgtggccccttggcctcctggacggggtaagccaataaagaaattgcacttatttgtgaggtttcccttgcattcctctgctcctgtgcacctgactgctgaaggcatccccctcagcttcatctgaagccctttctgagcactatgtgttgatgaaagtgttctactaaatgctatagaactcagcgggaatggcccagttagctctgctagcacattccaggagactctggcagacaggtgtggatttcagccctggctaacatgaacaagctcaggttcctctgcagtatcctagccacagtaggaactcttcacaagctttctggctgggatattcaaggggaggttcatcagtgggtggcttaaagccaaagatttatatcaaattattccttatgtctaacttaagggaatggagagacatgaaaagcaaggtggatttagcacctcttatttgcaggcagcagtgtaccttcatttcacactttctctcacataaaacccctgttgtcctgtaagataggaatcatctcatttaatagactgggaaaccatagcccagaaagtcttaataatttgaccatggtcacatagctggtaagtggtatagtctggtttcaagtagaagttcatctgattcctacccctgaatggttttcccattctgttgaagccatgttggggctctatggaatatttttggtgcctgaggcattaatatgcctatctgtataagatgaggtgtggtgtccagatgaagaggatacccctgggtagcccatttctttatgaagcagagatcccagtttgagccttactgctactcaccctaggattcgggtatggctggtggaaggttggggaggctctagggtgcttcctgggaaagccctcctctgaaaagaatgagtcttgagaggaatagtgtgagggtggggatggagcagaggggagagggtcatgctaagatttcattctgctcctttccttgtagccatatacctgagtcctggggagagacagaataagatggctagtaaatactccagggccctggggagtgtagggagggcagtgctgccttgtggcaaatgcaggtgagtacagccagcaagacttggggtgagatgtcctgctggcacagcacactgtggcctgagcagttgccaagggagcttatgaatgcactgggaggaactagttgagaacactgctgtctgtcttcaatcactgcagccctttggcaaagagcgccacagttgctgatgtgggaggaaagggaagtggtggctggagtggccactgagaggatggcttcagaagcatatgcaagtgacccttctgggagaagcagtggtgcaggggcagtgggtaaggagagctcttgtttgagactcttgggaaccataagttgcactgaattacgccatactaattatgctatggggatgttccctggaccaaagagaagcttctcttgctctctccctccctgtagcaaacatttattgagtgccaacgatgaaccaggcatagattaggttctagagattctgagataactataggatgaagttatccctcaatgaagataccttcttagtccaacaggactagggtattatgggccttgggtactgcagtgatctttaagcccatcagcaccagtggaagccccatgtcccgccaccagtttttgacatcttggagctcatggtccacccttccttcccagcatcatttttcaataccctgtcatagagcatcccagcaatagaacacaaatggcaaaatatcaccctcttctcagtcctgttgcttctctcaccacctagttagtgtcctggtgttgtcccaaggcccagtagtcagggcccaaatccaaatgtagaattagcaatggtctctgtacactgggcttaaaactaaattccagcattaaggaaatgcctaactgtataattacatgagacacagagagtctcacattggaagaacttaatatatctgagcagaagaagaaactagcccaacacaaagccattttacatctttgtaaaacaagacaattcaataaacatgacatcaaggggaatgagtcctctggagagggcagaagcctctttcacattgatgaagctattaagatgcaaagaaggttgcaacttgatttctctgtttgcaagcgctatttttctccccaagcactggtttctttaattttcttttttccctgaaacactaattatgccaacctctttctctactcaaaacctgaccaaaccttcaccctgtctcacacttatgaccctactacgaaccctccccaatcaggccagtccattccctgtccatgtgctagaattttaatatatatgtattagtttgctaaggctaccgtaatagagtatggcagccataaccaagtaaccataacaaagtaaccacccagtctgagtggttaacatgacagagatttactgcctcacaaggctacaagtctgatatcaagaagtccacagacctggttccttctgaggatggtgagggaagggtctgttctaagcctttctccttggccactcaatggtcatcttctccctctttcttcatatcaccttctctctgtatccacatttcctcttcttataaggatatcagtcctgctggattagcacctaccctagtcacttcttttcacttaattacctctttaaagaccctatctataatatggtcacatgctgagtatggggattaggacttcaacatatgaattttgtggtgaggggacacaattcaactcataataatactctctagacatggctttctgattggtttctggaagatgagttttatttcccagctggctcgcacattccaccaatgtgattcatttctgttttcacaaaacttaatggctagttgacttaatatttaaaatttgtaagctccaagaaagaagggactgtacctttcttgggagccagtgctaatcctagaacaatatctggcacatggtaggaatgtattagatgaatgaataagtaaccagaatgttacacagtgggattacatccctctgaccttccagagactggccttctttctagagaacaacctgaccttggctttcactgtaagagagaatgcttctacatttctgataaacctggtatgttgtaaatatgttgcatcagccacagaagtaaacacatgctagcaacaacaggcagtcaaaatactctttaagtgtgattgaatagaattctgattatacagtttagccaaggaagtcggtccagctcagcaccaattttcactgtcaaagccaatttgagcaacttgggactgaggtttaaactctcaactgccatgatgtttctgcagggccatgaatcggtgtcatagctttaggatattccactcttctgccacctcagcagaatgatcctggaaataccctaaagcagtgcattacccaaaatgattatccatgagtccaactgggaccaactccctatcttctacagggcatggagatagattctaattagtagcagaacctgaagttaagagttcctcaagacacatcatgactttaagtccttgctatttgtgtatgtatatagatacttaaatattttttgtagattttttaaagcatatgacatataatttttgttatacatcggcatatatatttatgcattgacagatgtaccatatttatatgcatgtttacaaatatatgttttcacgtatcatgtgttctttttagcctctacttcattacccctacccccaaatattaccaattaacagagaatttgaattgggaatcagcatcaacaaaatgtgacaacatcgaatggagctaggagggacagaagcagttaaagcaaagaagtgcccatgtccctggttatgtctatcattatgacgtgctcctctccatccaaaatgactgacgggcctgtaatttgttgttgctgttgttttggcacatatttgcagaaacaaacttgttcatggtccccctgctgatagctcaaccatgcaagtgccataggaaacagactttggcatttgagctgctcacagtctgggtcattcataaaagtttaattttctaaaaatattcagtgaggtgcttttcctgaatgagatgacttctggttcatcaacgtatttatgtgagtaaatagaaggcagatcagtaagtcaggaatctaatcagctatcatccagtccatctggtttaattagaaagcccagccgctcacaggcaccttttagtaaaaggcttcagtactggttccagaaaggcgggggtgcttctgaatgtggttacaaatgcttgccatctcccctgcctccacagagccccttatcaaactcccatcacagaacacacttgaaacatatcagtgcatgcctcttaagggcatgcaaatgaagctaaaatgtggcacaggggaaacaccactgaacatcacggccagtccctcaattcattcgataagcatcaacttaagcaccaataataaatatgtattggtgcttacgctattccagagactgtgtgaatgagctttggactaaccctggttggggagatcaggacgtaaacagataattcccaaactctgagatgcactctaaggtattgagggagccccaggactggaaacctgctgagctgactctggaagggcacttgggagcaaatatggacagaaggggagcaaggaaggttatagccaatagtccttaaacatacgcatgcaccaaaaccttggtgcattacaaattgtgggtcccaccctcagagtttctgattcaggaaatctggggtggggccagaacattttcgtttctaacaaggttcctgctgattctaattctgctggtttggggaccatactttgaaaatgggctaatagggccaacccaggctcacactggaatcaactgggagctccaacagctactcaagcctgggtctcctctctggagtttgtgatttaattggttttgtatacaaactggatatcagggattttgtctgtgtgtttgtattttaaaaatgtcaaacttacagaaaggttgcaagcacaacataaatcttttttttttttttattaactgagccatttgagagtaatttgttgtcttgatgtcccatctttctttgtagtgtattttcttacaaataagaacattctcctacataactaaaatataaacatcaaaatcagtaaattcgcatcagtacattacaaccactcaagttttggcaaatgtacccatcatgtttttgatagcaaaatgatctagttcaggatcacaagctgcctttagttgtcatgtctcttcttcctcaatctgaaacagtttatcaggcctcccttgacattcataaccttaacacttttgaagattacaagactgttattttaaaatacgtccctcaatttggatttgtctaatgtttcctcgtgattagatgcagctgtacatctttggcaggactatctcagtagcaacttcttactgtaccctatgaagtggcccatggtttctgtgtgtcccattactaatgatgtttacttgggtcacttgatcaaggtggagactgtcaagcttctccactgtaaatgtactcattttccttttgtaattaataagtcctttttgcagagttctttgaaattatgtaaatactttgtcatcaaactatcaattcattaggtaataatctgtatcacaggaaatcatggtttcctattttgtatattaggttataatctgttactatcattatttctttgagaccagtgtgggcccttcaatctggctctgacttctgggtttttaaaagctttttgggtgattctaatgtgcagccatgcttaagaaccacttctctaggtagaccaaagcacctatattcaaaggatattcacaggattgcaggcaacatgcagcagcctcagggaactgcaaggttttcagtgtggctggtggacaggatggagaaggagatgaagacagggagagattcagtctttagattcatctgagcccagacagcctgatcatcattatctccgatgacagcatcctatccctctctacacaccaagctatcactccatacacgatggtggtactgcctcacagttaggtacatggttttcagcataagggagggggtttgagttcctgctccaacacttcttagctctgcaaccttgcactagtttcctgttatgggctgaatgtttgtgttcccttccaaatttatatttggaagccccattgtggctgtatttactcatggggccttgaaggaagtaattaaggttaaatgtggtcctgtgggtgatgcctgaatctgataggattagtgttttcgtaagagataccagagagctcatgtatgtgcactcttgcacgcgcactctctttctttctctctctctccaaaaagaagcggggaaagaagaggtcctgtgagcacacagccagacggcagccgcctaccagccaaaagaggcctcagaatgaaacctaccttgctagcaccttgatcttgcacttctcagcctccagaactgtaagaaataaatggctgttgtttaagccactcagtctatggtatttcccatctgtaaaatggatactaatggtcctatctcatggaggtcttgtgaggtttaaatgagaaggaaacaaagtactcagcatgctctctggttctcagtaaaggcttaacgagtgtcagctattgcttcacttgtcctcaaacacaccctgtacattcccacttctctgcctttgttcatcatcagttcaattccgcaaacattatttcagcaagtccccactgcgtgccaggcattgtatgaggtcctggggatatagaatgcaacaagacctcgtttcaagtccaaagcctagagtgaagatgctccccactgctggccttggtgaagctgtttcagattccatttggaataaagggactgattcacaagaggaaataggaacttggtttgaaacctgtttcacagcattgggctgctgagaaaatgagtaaatcataggattagatccaacaatttctcatagtatcccttggttttatgatattcatatggtaataaagccctctccccagcttaccagtaattatctgaggccctccaaactaatacggttgtgtattttttccttgacgatcacagagattttttttccctttgtgttggtctcaggtataagaaaatcacactctaaaatgaaaagaactgtgaagcaattaagcaaaaatggaagggccttcctatgctccagtgaaattcagacaggagagagacagaaacattcctgagccacgtgcaatcatcacttatagcaggggttcaactgactcatgttggaagaaagcatagtcataattttatacttcctttgggggcataaacagagaagtactttctttgtttttggatgagaactaagttaggatgagggagtcaaaatgagtttgagaagataaaatatgaagagtccaaaatgtcacccaaagtccatattgaagcatggaaagggacatcatgccatgtgttagaggaaactcagctttggcttggacacttttacagaagccgccctcctctggactcccctaacactgcatttgtatctccactactgcctttcccgatttcctctttgctttagagtgtttgagtatgttccctcctagacagtgagttccttaagggagaaattcctctctcatgggtccttgctggtgtctcccatggcctagcacaaagcaggtgcacactccccactcccaggcccgcatgtccctaactgcagtgggtggctgggcacacggaggatgcggatgtccaacatttggccttggatccagacatatcgtgcttttccctgctgctggaaattcccactctgtatggtttttcttaatatctctgtgattcttctcctcactccattgcaatccttaaatatttttcctcttcccctgtatcattctcgacctcagaactaacctttctgtttatagccaccaagctcccttttcttcctttcttaaagcatttctgcaaacctcttaaaagctcttttacagacatgaatggtggatgaaagaccctgcggaggtgttcactaaagagtcacattctccttccttttggccagtaagaatgtttaggagagatgtggatgttccttcagttcacaggcagaacttgctcacattgggccagagagagggtgtggagctcctgacactggccctcccaccattgggctgtctgggccagggcagtggttcccaagctgcattccctgaaacctgaagcttccttggccctccaggcctaaggagagaacaagaatgggagaggagagtggatggggtcatgcctcccgaattcatgcttcaaacacagccactctgccttcatctgttgtacagattaggcttctctaagagatccgggaagaaaataaaaatggtgccactgctcaaatattttgtaagccattggagtagtgggaaaaaacagccagtcagatcaattgaatgttggcaaatccttcctttaagggtagattggatttgcatattggaaaccatcaagagccacttggagtcaagcctggtgaaaaaataatgtgagcacaaggaataataataccactggaaggcaaaacaacaaggacaacaacagcataaagagcaggctgcagctatgatataaaaatacgcatgtgtatgtgtgtagctcacgaagcactcccgggagaaactccccaaccaagcatctgtgatactgttggaacaagcacataaactgaccttacaaggtgatgacactgaagcttggaactcactggtatgcataaattctcctgttcgttatgagtatggctgagtgttcgttatgagtatggctgagtgtgtgtatgcatgtctcactgcacgtttcactattttaaaataaagtccaaaatttctctagtctttggagaaaaaaaatgcctcgtggtgtttagtctggatttaaatgctgctccaatgcttactggctgtgtgatcccaggaaaatcatttcaacttttctaagctcagtttcatcatctatcaaatggaaataataatattacttactacatagggattttgagaagtttaaatgtggtaaagcatgttgattcgtcagcataaggactgacaaaagaataagttctcttaatagttgtggctcttagtattataattgctattatcattatcctctgacctgagtatacctgactccagcatacctggccagaatgcattcaagatccccttctctcttcagttaatagatgaggtctttaattgactgagaagcatttgggagaaaaaaaaaaaacaatcaatgaggggcaactttgctaagtcatccgatgactcatgggaaatccggaattagaacaaaaagtagaggcagtttggtcagcagggcatggggaggacacgcatttaagccccatgtattttggtgtgtggagacgttgaaaaaagaggtagggagggtcctggaaaggaacatgaaagatgctgaaacctgagggcatcttaaaatcacaggttcactcagtgtcagagtgagatctgtgagaaccctcattctagtctacacaccgtgaggcccagagaggtgaagtttcctgcccaaggtggcccagctcctgggtggatgagcagtatttaagcacttgcttatctcctgattcaggagccactgactttttcctgccacctacccaatttctctgccacccagagggctctgtctgagctaaaagggtttatgagggtcgggcagggtggctgagcagccttcgcccagtgctctgaaaatgctctggtttttcaagtctgcagcctcaaagcgtagcctgcagtagttctcctgtctcaccttctactaaaaatgttcactctgaaacttgtaacagtggtgacctctgacaaacggcacatcccagctgttaacattattcggcttacaacagaagttgccctcacgacccttgtagccaggcccagggaggaggtgacactgtcagggccaggcctcaagaagaacaaagagaaaactcaccttggcactcaaggtctgggaacggctggtggctcgatcaggctccctgcaatcactcccttctgtaaccgtgggtcggagacatgaatgctgcctctggactcgccaattaggcccagccatggggctgcggagccccacacaaggaaaccctattagcaattagctgatggaggatcactttataccagggcttatttttagcacactgtcaccttttcactggggccaaaccttttgtatccaatccatacctgagttgcaagacattgcatttcaaacctctgttaattgacttcattagttaatgtgctgctccttgaatcccgggggtaaatgagcagatgaagaagactaatttaaagaaagtctgcagacaacagaggaggagggatgcccctgcccccaccctggcccccgtggaacccacgtcaaggagcatcagattctccccaggcttaactccattagtcatccctgagtcctctaatgagcttaggttatttcctgtttttccaggttttgatgaagggagctgtcataggaaatatgaagactgtgtctgtatctgaaccccaaagcagctctcttcaccagcacccccttgccagctcatttcagttcagttgtttcacctctcaggctccttgtctatacattgggaaaaattgctgcctcacccatttctccccttcacacagccagccaggtagttctgaggagcaaagccctgctaaggagagtgtgattagctccctggggtgataatggaagtcattcactctgctttttctttgtggctcctaagttatcaggacccttaagagccaaaatatatgaaaaatttgttctggagttttagccctctaaaggcctcattcattccacgtgcactgagtctgtgccaggttccttgtaagcggacaggtatagagaaatcccaaacaaggccccccaaagccacagatgagtggcagcatcatacaacttaaatgccagggcctggcctcatcctagaacagcctccaccccagcgtggggcaaggggaccaccgtatcaggtaacttttcctgaaggaggggccctcacagcttacagaacctttgcaaacaaagattcagccagtgaagaaagggaggtggctttcctaggcgttgaaaagaggatggggaaaggctggcacatctggggaagggcaagcaacactgttcggctggacatggtgaacaagtgtggacctgaagaggtgggatctgggcaggtgggccaaggccagactgcagagagcccggaatctttcctgaatgggaggggagctgagaggctactgggatttcaacaagggaagaagcatgatgaggcacacgtcttaaaaagataactgtggagagagtcaagggcggaaggggcctgggcagggtgagcacagatgcccttggaagctgctgcacctagcagggcttggggagcaagtcgcctgggcagggagtaatgggggcctaaacaatttcaatccgtcataacatacattgtgaagatatgcaaagctttagaagtgagatccgaaaagagaaagcaggcaaaccgagtactgggtgcctgattctaggaaggtgtcccggtctgccaagttccttcccaggctgagtcctgtcactgtcaaggcatcttcctggatttgtcaagtaaggcttgagctctgacagaccttctggaagaagtccattttcagtttgccagacttaaaaaaacagtaagaaaattggatcctagaactcactctggagaacactgaaatgaacatgtggggtcctattcagaacatgtttgccttgagtgtatggaatctgggtcaccttcactgaaagcccctctccctcggaggctaagctggatttctggggccctccacttctctccaggaagtgaaggtaatcatgcgtatgtgtgaggagtcagaggatgaagagtgaatgaatggaaaataactgatacagtgttaggctgggcacaggaaacgggagacccctaacagagttccctgattcttacatgcttgacatgtgtcccctcttacttcacagccaccaacactaaacacatgcacacgtgcatacatacatgtgcatacacccacatctcagttccaactctcagctaagagttggcatttgcattttgtgaggttttcttgggaggggacctttccagagagccacagatccccctacactcatctcttctcctcacctaccagcagggactggcttgggccatataagctggaggactcatgtaacttctcttgctttaaggtactttgctggaggtggagcaattaatccacaactcagcccagggaagcagacagcagatcgtcatttcactaatgagattgctgagccgtggctcggagtgcgtgggcctggccaggtggagacttgatgctggcaggaggggcgttagaatcctcacctacctaagcctgtggtggagcaaacagccctgcgggactcaatgcgtgtaacccttggattttcacccaacagttctgcaagtctctttcctcaaataaaccatcccccatctgcataatatggaagctaagtagatcgcccacaaagaaaagagaacaatcctgtataaaatgaggaagccagactaaataattccaaagtgtctttaggcaaatgcagaccagaatacagcatactgaagatggatccttctagacccactccttctgcttgtctggaaagcccaggcctgccagcatcagcggcgacatttcaattctgccagtttgatcagaccacgtggattttctctctccaatacaccagctgataatgaagagacaaatgttagctaaggcagccctggtcaatcccaaagtccttagatgcaaaagacagggaaggtgctaatcatctcaggaggagaccccagacgggctcattaaaaccattataagaaatccctatctcccccaccacacctccaaggaaaccctgaccctggtgagtgagcagggattgcaggggcttcccttgcaccagttcttttggcttaggagggaggacatggcccagctcacccaccacctgcagcagcaacagcagcagccattacctttgaaataatcctcgctcgcacaccaagtatttgttatgagtctgtgcctggaagtaaatatcacttctgtttaggtgaccatgtgtcctgggtttcccaggacagtctggtttatgcctgttgtgctgacacacatatgattagtacctactgccatgctgaaaagcgtcttgtttgggcaataatgtatgtggttacctaagctctaccaagttgtttcaaaactgattggagggaaaaaaaaaaaaaaaacctatagcgccaccaacaattaaattataagattatttttccaagatcacagtgactcaaagttttccctcatagatgttatatatttagtttgaggtactggtggggagggggtcgtaaatgcaattcagtgttataagattagacaagcaagaatggtattctgtagccttacgaaatcacaaacacatgtcagtcgtcagtttaacaaaggatcctctgtttaaaaataaaatgttatgctaaaaacaaattacatttaagtaagtatataattatacttatttttaaatgctttcctatgaaaagaaaggttttcctgtttttttaatgagataccattcgataatataaaattaaccattttaaggtatacaattcaatagtttttggtgtattcacagttgtgtatgaccatcaagactatctaattccagaacatgaccccaaaaagaaaccccatagctgttagcagacaatccaattccctctccttcatcccctggcaaccactaatatattttctatcttgatgactttgcctattttgaacatttcctatgaatggaagcacactgtatgtgtcatttcatgtctagcttctttctcttagcataatgctttgaaggttaatccatgaggtagcatgtatcagtattcccctcctttttatagctgaataatattcctctgcatggagataccagattttgcatgcccattgatcagctaatggacatgtggtttgtttccacttttttgctattacaaataatactgctataaatattcaatgtacaagttttcatgtggacatatgttttcaattcttggatatatacctaggaatggaactgctgggtcaaatggtaactctatgtttaattttttgaggtactgccaaactgttttccacagaggctggatcattatacattcccacaaacaatgattacgagttctaattacttcacatcttcttcaatctttcttattttcttcatcatcatcatcatcatcatcaagatcatcaacatcatcatcatcacaatcatcaacatggccagcctagtaggtataaagtagtaccttactgtggttttgatttgcattttcctaatgaataattttcatgtgttctttcatgaacatctttttgcagtggctttttgtgtatctcctttgaagaaatgtctattcacaccctttgcctattttattttaatttaatgattcagttgtctttttgtagttgagcttcaagagttcttacatattttggatactaatctcttacaaaatatcctatatacaaatattttatcctattctatgggttgcttttcactttcttggtagtgtccattgattcacaaaagtttttagttttgttgaaatccaatttaccaatttttttcttttattgcttatgtttttggtgtgacacttaagaaactattgcctaatccaaagtcctgcagatttatacctatgtttctttctaagagatttataactttagattttacatttaaatctttcatctattttgaattccttttttgtacatagtatgaggtaagggtccaacattattcttttgcaggtggctatccaattgtcctggcaacatttattgagaaatttctctcccatttgacacccttgttgaaaatcaattgaccatacatgtatgtatttctgtgtggactctcaattctattccatcggtccatatgtctatccttatatcagcactacactgtattggtaactgtggctttgtaataagttttgaaatcaggaagtgtgagtcctccaactttgctcttttttttttttttttttgagacggagtcttgctcagtagcccaggctggagtgcagtggtgcgatctcagcttactgcaagctctgcctcccaggttcacaccattctcctgcctcagcctcctgagtagctgggactacaggcacccaccaccatgcctggctaatttttttttgtatttttagtagagacggggtttcaccatgctagccaggatggtcttcatctcctgacctcgtgatgcacccgcctcagcctcccaaagtgctgggattaaaggcgtgagccaccgcacctagcccttgctttttttttttttttttttttttccaagaatattttggctatccaatgtccctttcattttcatttgaattttagggtcagcttgaattttaggatcagcttgaattttagggtcaactgcaaaaaagcagctggaatttgacaggattgcattgaatctgtatatcaatcaggggagtattctattttaataatattaagtcttccaatccataaacatagaagatgatttctttcaaaactcttttgtagttttcaatgtataggactttcacttccttggttaaatttattcataactattttataatttttgatgccatttcaagtggcatcactttcttaatttcatgtttggatttttcattgtaagtgtatagaaagacaactgatttttggatattgatcttatatcctacaactttgttgaactcattaactctaataatgtgtgtgtatgtatgtgtgtgtgtgtgtgtgcacgtgtgtgtttctttaggattttttagaaaatcatgtcatccactaatagaggtagttttaacttccttcttctaatctggattctctctttctctcttccacttctctcatttctaactctctttctcatctaattgccctggctaaaatttctagtaaaatgttgaatagaagtggtgagagaaaacatccatatcatgtttctgatattacagggaaagcttccagtctttcacagttaagtatgatgttagctgtgggtttttcatagatgccttttattaggtttaggaagttcccttctatttctagtttgttgaaagtttttatcacgaaaggatgtgagatttggttaaatcctttttctatatctattgagatgatcacatgggttttcccctcttcattgtattaatatggtatattgcattgattgactttcatatgttgaacaaactttgcattcctgggataaattcccattagctataatgtccagcccttctaatatgctgttggattctgtttgctagtattttgttgataatttttgcatttatattcataagagatattagcctgtagctttcctttcttgggatacctttttctggtttaagtatcagggtaatactgacctcacagaatgagttagaaagtgttccctctgctatttttttggaaagattttgagaaggattggtgctaacttttctttaaatgtttggtagaatccattgatggagtcatctggtcctgagcttttctttgttagaagttttttcttgctaactcaatatttacttttataagtctattcatgtattctattttatcttgagtgtcagttttggtagtttttatatttctaggactttgtccattttatgtaggttatccagtttgctggtatatagttgctcattatattctcttaaaatccttttgtatttctgtaaaattggtggtaatgcccttctctcattttttaataactttactactttcttttatttctcttcatcagactagctaaaggtttgtcaattttgttaatcttttcaaataaccaacttttggttttgatgattttttttctattatctattccattgatcacaactctaatctttattattcttttcttctgtttgctttaggcttagtttgcttctctttttctagtaacttaaggtggagtttaggttattgagttcagattttttttatgtaggtcaggtgtcatagtgacaaactatctcaatttttatttatttggaggtttcttaacttctcattcacttttgaaggataattttgcaagatacaaaattcttggtttacagtattttttttttttcagcactttgaatgtcatcacactgcctttggcctccatggtttgtgatgagaaatcagttgataattttactgaggatttcttctatataataagttgcttctctcttactgcttttgagattctctattcgtctttgattttcaacagtttgattatgatgtatctcagtgcagatctattctagtttatcttacttggagttcattgagctttttgtatgtatagattgatattttttatcaaatttgcaaagtttcaccattatttcttcaaatcatggttctacccctttctctctcttctctgagacgctctttatgggtgtattgatgggcttaatgtcctccggtctcctaggctctgttaatttttcttcatctttttctttcttgttcctctgactggatactctcaatttacctgtttcaagtcttctcattctttctttggtctgttcaaatcttctgttaagcccctctagtaattttttcttttagttattctacttttcaattccaaaatttctatttggtcccattttataatttatatctctttattggtattcactatttggtgaggtattgctctcataacttaactctttagacttagtttcagctttttgaatatatttacaatagctgatttaaagtctttgtctagtaatgaactcgttttcactttctcactttctcaaagacagttactgttgattgctttttttttttctcctggtatgtgccactgatgtttctttgcatgctttgtaattttctaattgaaaattgaagattttgaatatcataacctgggaatcagattctccctcctctccatggtttgctattattgctgttattttatttgttgtttattcacttttccgaattacttccataaaatctgtattctacgtcatgtgtagccactgaatgcttagttagcttagtggccaattaatatttgaatagaaatatccttcaacacttggaactaataaatcatccactcctagccaaggggctctgtgtccattgtgtgtgggggtgggaggataccttcaacactcaaccaggcagtttactactcagcctttgccttcacttcctgattatgcgtagcctaatggccagccagagttaagagactggggcctgcctgcatttttcctgagtgtgtgcacagccctggacatgtgaatgttcttctaaaatcttaagaacatgtaggaccttttcaaagaccttattccctacagcatgtcattccctagactttgcttccaagttttttggctagtctattgtttcccccaattgttatccattgccttagacagtagagaagaatgtttagaccgtgctcccttgggagcagcttagtataaagcaagttctcagtcaggagagataaaaacatgtgtctagtagcatgtcttcaaggcagccaccagatagatcaaattagaattttctgtaaataaggtccattctgctccctcatatgcctgcactgggaatgtgggttgttatttcaaggctgctgctgagctggggattggagtatgggattcagataagttaagacaccacagttttgcttttttcattaagaattgactaaggttttttgtttttgtttttaaataaatgcttcccagagtacttcaagtatttggttacattccagagttctgaaaaagcacattctgatggttattgccactttttttctagcttttatagaagggtgaacttttgggattccttattccaccattttctctgacattacttgttgttttgttttgtattttcataaaggcgaggcacctcctgcttctcctggatgtcatgggaagccagctacctttatagaccttgaagaagactggcgggtggggagtgggggttgggggtttctaggtataaaccaaaaattaaattcttagtgccaccccctactacaaccaactgaatggcccctcctctcagccaaagggatttcaaagaaacctgcaaaactagttcaggccatgataggaaggaaccaggaaagagtggttggacatgtttcattatactctgttccctttggcatccaggcacaactgaccagcattaacaataaaacagagatcttaagactaacaaaatagactctttgtagcaataagataccaaattccagcctgatgctagtatagcgtcacatgacatagcaggtgctgaaagtatcaaagtgttttaccccaaaatatatttctttgtcacattttgaaatagccctgcaaagctgtctctggtggggaaaatttacattctatagagaatcctcttccctttctagttttttcctgatctgggagagattttaactaagagtctggcaccttttaaggtctgatgagagacatacaccctctattctgtctgaagcctgctacccagaggcttcatctacataataagaaccttggtctccataaacctttatcttaacccagacactcctttctattgattccaggtctttagataagaactctttcaaccaattgccagtcagaaaatctttgaatccacccatgacccataagctcccactttgagttgtcccgcctttccagactaaataaacgaatgaatacatacctcaaatgcactgattgatgtcttatgtctccctaaaatgtctaaaaccgagctgcaacccaaccaccttgagcatatgttctcaggacctcttgagactgtaccttgggccatggtcattcatatttgattcagaataaatctcttcaaatattttacagaatttggcactttttgtaaacatagagaagaggcagaattcataatttttgatttgtatatttcatagcaaaattgtaactctgctgtgtttttaactcctaaatactcctggattggtaatatactggggataataccaaaaactgtttctgagaatatgttagtaggataagaaccaagatgtgaagaacaattacagagtttctcatatacaattattttctgattcactttataagaacatatagcaccccgattgagtaatgataattaacaagatgcttttgttcctttaggttttaaaaattacactttccctatgaaactagatttaagcaatggaatatcttcaggataatactcacaaagagaggttggagaagggtgcattctacatatatttttgttgtttttaaaaaagaatcgtgacaatagtaatagcaattaattgcttttaccaataatgctactaattattttaattatttaatattagtataataataatagttattattataattactactgacagttacctacttacaagtcttattggagagagtgggggaatgtggacacataaatacacactatctaatgtctacaaacaatttacacaatataggaggtaacatacacaaataataaggcactgtctgtaataaccagtgctactcaaagttcatttggagcagagctgatttgcaagcttgttgttattggtttgagacaagataaatacagaaattgagagtagtgtttagaaacttacagcactttgacaatggggcacataccctccaaagtgaaatgtgttgtctgtgacgtttaataataataagcctgggcttggactacatatgtctttttttttttttttcctgtttcattcttctggtaactcattttgattatttccttctttaacaaaagtattggtctgcaatgaattgggagggagaggggaggaactagttcttcactatagacaaatgtcagtttagaagatctatgctgtttggtttgggaaatgaaaggtttgggctacatttattgtttgaatttggagggacagagagattactagggactagagtggtttgagcaggatttatggaacaagtgtgacttcacattgttacaaattataggtgaagaatgaaggaacattccaggatcaagtttcctaaaatttggaaataaactgtggaaattctcctaaggtttgtatctttcttgtctgaatctaagaatctttttctattatgatgagtgagatcaggaaatgaattaaaatattttaatttcctccttggttttgaagttctttaaagaagggatttagaatttaaatagtatggttattagtatctttgagtgaaggagaaagcgtaaattaaatgtcgtctcattttttaaattaggtagaaaagcttactcccacttaagaaaaagaagaactaaattaaaattcgtttcgccctgagagcaatcagtatatctaatccaaattgagaaaaatgaaatcctttttaaattttagtacctgtatgttcaaaagccataattctgtttggaaatctatgaaggtatatttttctcacatacgaaaaattaatcttgtgctaggtaagaaactcatcctctttttttttttttttttttttgagatggggtctcactctgtcacgaggctggagtgcagtggcacgatcttggctcactgcaagctctggcttccgggttcaagcaattctcctgcctcagcctcctgagtagctgagactacaggtgcgcgccaccatgcccagctaatttttgtaattttagtagaaacggggtttcaccatgttggccaggctgatctcaatctcttgacctcatccgcccgctttggcctcccaaaatgctgggattacaggtgtgagccaacgcgcccagccgacatgttttatttaaatcaaggagttctcaaaaattaagagtttatctgaagatttaaattaaaacttccacagtatttgaaggctgtgggaaccacaacggatccgaatcaagttacttaaacttagcagtgaaaagtccctgggccctaagaagctaagacttcctggtggtcccacagcaagacataagtaggtgggactagaatataggaccctggattgagagtaaaggtagtacagtcaactgatttcttcttttttttttcctggagacggagtcttgctctgtcacccaggctggagtgcagtggtgagatctcggctcactgcaacctccaccttctaggttcaagccattctcctgcctcagcctcctgagtagctgggactacaggtgcacaccaccacacccagctaatttttgtatgtttagtagagatggagttttaccatgttggccaagctggtcttgatctcctgatgatcagctaacttctaatccaacatccttacttttatagtttcctatcactacaattagccccttcagacatgtgcttttcgagttcctgaacaatttgaggccacctcttcattaattggccaaagttgtcagtgatcataccaagttagacagaggtgaccggctaggtgagaagctggtaactgtctttggccatgggagctttagacatgggctcatctgaggacaacacaaggttatcagggacagggtgaaggctttctttcaagttcacagtgcccagacacacagaccctgagtttttgaaaggctctgaaagtgcttagatcataaagcacacatcacatgctgtagttgttgtcattgacctgtgtttgtctctaactgcatgaaaactctcaaagctgtcacatgggggtcaggctgggccagtaggattgtagaagtacggaccaacttccacgttttcctgaagtatctgctctgtctcagtttagggggagacagaaccacctagaatcactgacaccttgattcaacacaatccgcagaccgggtgattaaataaagcactttggttttttcatatgtttgtttgttcattttctttgcctgtcctccactcaaagcactttggattcagctacttcggatgtccagtaatgccaaacattcctggaataagactaaacttgcctctccatggaaagactggtaatcacataacaagggatatgatgatattggtagcatgctgaggtcagctgggtagactgatgctcagaacagatttcaggactaaagacatggggttataatgtctcattatttcttcccatgccacatggatggtgtctccttattgttgggcacgtcattctcacctccgtgccttggtcccagctgttccttctttcctggaggacggtctgtctaatcataattatccaagacagactccagattatccaagtctgcttattcttcaaagctcaactcaaatcctaccaaaacagtactgcatgatgggaaaaccatggacttcgaggttgaccagatctgagatgggcaaacaacctctctgaatcacagattctttatcataaaattctgggtcatagtgaggattaggggtgctcaaaaatggtaagtattacaactttcattattccagccaattactgatgcccttctctcattaataccaaaaacctgagacttataaccacatccttcaggatgtgtatgatttgtacaacattttggggatttcatcgtctccccagacattcttgagggcagtgaaggcacctcacttctttgaaacagagattcagttacactgagtatccacttagggagcccttgctttgtgataagtactgggctgccttcatttaactctccaaagagtcctgaggaagcaatttttatctcagttacagacaggaaaactgaggctcagatttattggttgcatgtccaaagctgcacagctagcaactggcactctgatcttgaaggcaagccctctttacctacaagtgctctccacacagaaggggctcaagtgcaaatactgattgatgggctggatcccactcatatcgctggtctaattgcatccttttcttcgtggcagcttggcctgctgtcccctggctgccaagatgttcttactcacactgctctgccttcactcttgccattgtgttgagaatccatcaatacaaagctgtacaattctaagtacccaggaagtgagcagaccatattgcacagggcaactaagtggtaagagtgaaaacagcgtagcagacggaagccctaagcaggtcctccaggccagaaggagggttgggagagggaagacactgggggcaagtgacagattacctaatcctagaaacaggtagaaatattaattccctttggggtagaaagtcagaagcaaatgtagctacaatcagtcatagcatgctaatagccaggaagtcacatttgatgctcctggaaatagactgctcacctcgtaggtcagaaggcaattacctccattcagctcaggaaatgcctatttttcaaccagtgagcataatgtttggggatttttgctcatctgttgttccgcctccattggaaagaatatataaaagtcatagccaaaggcaaaacacttgccccgctgacaaacagcccattgaccatggcaaatcctctactgctaaactattagaattacgactcgctgcttccttggcaaatacctgccctagatgaagtgctccaaacgctgtagctgtctctgtctattcccacccctccaaagactctatgatgtttaaaggccacctgaaacattctcaataaggtacacaatgcagtttaacagacactaacatcttaaagggctgacctagatttatctactccaggtgcacagagattggtatgtgcaccccactccccatttccacttacttttcagttgaaactactatgatctcactgtcttttcttttacaccgaaggaaagaaggaatcatccagaaagggtgcgggttgtggggcgggcacagtgataaaggcagaataaagaaagaaaagggtattttttgaatgtccaccatgtatacatcatcctgatttaaacctaatcaccttcagggaaaagtattcttattttatttctattcaggtgaaaggtccatcagatgcaattagccattttaaagtgcacaattcagtggtatttggtgcactcacaataatctgcaaccactacctctttctagtttcaaaacagtctcatcgcccctgaaaaacaacccatacttattaagtaattgctccccatccccttctcctctcatgtcctcttaatgactaatctgctttttgtctctatggatttgcctattatggatataccatataaaagaaatcatgtaatatctgaacttttgtgtatggtctttcttttagcttaatattctcaaacttcatctaagttgtagcatatatcagtacttcattcctttttatggctgaataatattccattgtatgtaaaaaccactatttatgtatccattaatcagttgatggatatttggatggtttctgctttttgtctattatgaataatgctgctctaaatattcaaatttctgtgtgaatatatgtttttcttgggtatatactcaagagtggaattgctgctttacgtctgctttaagatggggaaactgaggcaggaaccctgcctgaggtgatttagcttgttcgtggtagagtcaggattggaatctagtccagaccactccaaaaccactttttttacttttgtttttataagaaaagtagtccattcacaggtccatccactatacttagaacttctctggctaaaaattcagtgaataactatttttgtcagaaattactaacttttactctccactcaaacaccctgaggtcgagtcaggattggaatctagtccagaccactccaaaaccacttcttttacttttgtttttataagaaaagtagtccattcacaggtccacccactatacttagaacttctttggctaaaaattctgtgattaattatttttgtcagagattactaactttccactcaaacaccctgaggtcatatgattaataccactaatttgaactcatggatccaatagtttcatttggttcatgctgagatctgagctttttgtttcccaggaaaatcaatagcagcagactttatcttgttagatcaaatataacttttatttttaaaagctccaattatgccctaatgcactgtttatgtactcagagggcttaatgagataataaatgaaattttaatttgacaattaatagtataaaagtgttaggatattttgaaattaggaaggcttttgtgtgattttcttttcttattagcccttgttttaggatataattatacttgtgtcacattatgactgggcagcaactcaattattaagaagtagaaaaatgagtaaatttcctactcctgtgccttttgtagcaagttatgaaaacaaaataaaaagtaaaatgtaatcagaaatgctaagaaatggtgtaattctttcatttccaatcattcccgggtaagaaatggctgatcaaacagccaatacctttatcatgaatattcttcaggaatgtaaactgataagacagcagatcctggaagaacttgggttctcggaatgaggcaacggaaaatttaaaatgtgtgaaatatgttacatatacaattacaaagtcatttcctcacacactgtgtatgcacacacacacacatccaagcccaaacacccacacctacagcatgagttttccagggttccaaaaaagcaaaaatacttggaccattatttaatacacatttactcaatatttgagggtgccaagcatgaaacattataaaggagttaaagtagatggaatctcaaaatacaaggcaagcaaaaatcaaattataaaccttaggtttagctaaagtgagttactgacaactaagtaaaatgttcttcatgtcaccaaatcccaagtaatctttatctatatgtcatgtctattaaaaaagcaaacaactgtttttcaaactagcaagagccaaatctctttcatttttcatttattcaataatcactggatgctcactataaaagtaaaatttttaaaaatgaatggaaaacccagtccctgttgagaagacacggactatacccaggaaataataaaacttcactcttcttctcagaaccaggtggcaagagaacagaacttcctgtatcaagctgacttctagccaaagaccaaagaacaaatatcagtaaagcaagtagaaactgtttgttgagtgagtgaatgaatgaatgaatgaatgaaataccgcagacagaataaagaccgtcggatttacttggaaactacagactgggtaaggggagactcaaatgtgggttttcaaggaggtaataggcttcagttagagaggtcaatagaggatgtttctggatcactttagacatgcaaaaattaacttgacaggcaatacatatcaaaagtcctaaaagctttaagagtgtttgtgtcttaataacaataattctaagagtttttgttaaaaaaatggctcaaaagatgaaaaaagtttaaaagtagtaaagttttaaaaaatataaaatggtatttaaaagttaagacggggtgttggcagctcacacctgtaatcccagcactttcggaggctgaggcgagaggattgcttgatcccagcagttcaaggctagcttgggcaacatagcaaaaccccatctcagccaaaaaacaaaaaacaaacaaacattatccggccttgatgctgcaagcacctgtgctactcaggaggttgatgaggagggaagattgcttgatcccaggaggtcaaggctatagcaagccatgacagcatccctgtactccagcctgcgtgacagagcgagaccgtgcctcaaaaataaaataaaataaaataaaataaagtaaaataaaatggtaaaaagttagaaacaacctcaatgtctaacaataagaaataagaacattatggtaaatgaataaataaaatcaagtctttggatttaaggagaagcagatgtgaaatagtgttaagtaaaaaagatccatatgaaaatgttgttagtactataatgtatgcttttacacattattgtattaataaacaccagagtttcaaacaaggaagaaaaatggattcctgctggaggaaatggcacaaagaaggcccacgggtttggaatgacggagagaagaggaaaaaatggaagacttgattaaaacaatttcaactagttgccaggatttaggccccattcatttctggttaagcacggagctatgatgaagttaacctaagattttaagaaacactggcacttacggagggaaatctaggtacttgtatttcctatgcttgccataggataaagggcctacacgacccatacattacaaatttgcccttacaacccatgtagggtaggtcctacagacacaacatatataagaatgggaacaaagaatagtcaagactagatcttcctatcccccacaagtgggtatccaggcctagatatagatggcaagctaccgtgggatcacttccttctcctcattgccactacagttctgagagggaagctttacctccacgatcatctactcatctgtcgtcatcccttgtcccacagtcagagcctctgacaccgtggatgttttcagagagccattcacacaggttacaaagatacaagagaaggatgtatatctggaaatcagaatgcacctgtagacattaagtaagtcaaaagtcaatctgtgctttaaatataaagtctacttcggtctggtttgagtacttaactgatacttaaaacactgatacttaaaagagaaagccatatagaaaaatggctttcctggatccgcataccaaaaaacttcaagtgcttcagcatgaaactactgatccataaattgcagaggtcccaccacccaccccctctcccaaagtgctggactattttgaaatggaaagcatgagcttctgatcaagctcttctgccatacttacttgtccttggcattggttacttaacagtgtaggtaatagctgtctatttacaatattcttattatgttaagctcagctctttcttggatagtggtaacatttccaagttgaaaaagtaccctgcaggtctctgagaaatggctaaatctgtgcattcttctagcatgtgtcatgtcccaagtattcttcctcaggcacttcacatatgggatctcactgaccttcataacattattgtggggaaggtattactgtcccccttttatagactggctaagaaacttacaaagcaagttaacgacctgggatcggctgggcacagcggctcactcctgtaatcccagcactttgagaggccaaggtcggtggattacctgaggtcaggagttcaagaccagcctggccaacatggtgaaaccccatctctactaagaatacaaaaattagccaggcatgcatggtggcagatgcctgtaatcctggctactctggaggctgaggcaggagaattgcttgaacccagggggcggaggttgcagtgagctaagatcacgccactgcactccaacctgggtgacagagcaagactctccatctcaaaaaaaaaaaaaaaaaaaaaagacctgggatctaccttaaatgttgtagatacattgttatgatcagtaccgcatttaattctcattcaaccagtccaactcctttttctaaggaacctaactgcaatcttttaaaccatcagcaaaatcatttggtattcttagacacccacaaacagtgctactagtagcttggataaagacaatttagggggtggatccctgtacaccaaaggtaaattgataaaacattttccctataatatttacctagatacataattttcaaaggaaaataaaatataatctctatctaaaaattctaagacctataaaaggggcaaaaaacatgtgttaccctcatctggtataaatgcactaagtaacttggtaaaactttgggttcatcatgaaatgagtctgggcatattaaaaattcaatgttttgtccaagtttgaactggacaaacaggtttatctctgaaagctacctcagataaacagaggtcactaagagtggttatctaagctgtgtggcatttatttatttttgcattacagatttcaaaacaaagagaacagaagtgaatggcactaatcctgatgggaaaagccctcataatttcttctttatattccaaaaacttcagtgattacacttagaggcttccaaggcgaatctcctcaaatgtagtagctgtaactgtaaatattctgctaccgattttctttaaaagaaactgaatgtaacgtaaccaattgtttgtgtaaataaccagacctacatctccattctcaagcctattcaaaacccctcccttctcctttgactaccatttcatgagccccaggaaaaaggggtctaggcccattagcctggcttcctgttgccatctctgcctttccctgcttctttgggtaccagatctttctgtccttgtaggaggatttgagaaggagaaatcctgtcctcctgccctgaagcctacatgattatagcccaggaatagcggaatgcaaaaactgtgaccagaaatcaagtggtccaagagcggggaacaggatggtgagagggcactgtaggtgagattgaaaccagaatgaagacaactcaacatacgtcttctttcaggtccttccatgccctagcccattgtaaccacaggcctgaatgaactcacaggcctccttgagaaagccaactttaccaaccttttgaagacccttcgttttaacaagtgtggatattctattggggcattggggtgtcaagggccagaaactttaaaagggaaagaaagagaagaaaatcaggaagtggtataacaaaggcctaattacaagggaggagtgtctctctacagacaggtcactggaaggatgccaatggctctcgccgcataaaggaaaagattgttataaaaagatttttaaaaaaagaagaagaagaagaaagaggcatggcagtggagactgggagggtggggcagagaatagggaaatgaataagaataatgacttaaaagctttctttttttttctggttctcttctttcctttccgcagatgctcagctgagccagtgcagctggctccctgacaaatgtggaaaaatcagccaatttgagctggttgttagcactccgggtacagaggctcagataaatgagggcctgcctcaggtgtggcagctgagcttcccgagtgttctcaaatgattctcggccagcgcgaggcctcctggccttcagggcctcatgggtgctcccttctatttcctggctccacattctgataggcgtgaccttggaagaagcatcttcctccatttgttcctcctcccctccccttcctccccctgaccaggtctccttccttcaaactggtggggcttcctcccgctcacttagtaaaaagcctatagcacaaggtctcttgtccccagacgtttgagcacagatctgatagcccaactcaagaccccctcaaaaatgcctgatgtgtattccttttcaaatcactgcattggtccacagagtctcgtgatatgctggcagaataccctggggtttccctacaagacagtgaaggcttctttgtaagtgttcactaacaccaaatagtacgccccacatatttatgtcctcattgttatgtccaccacagagtatgaatatgaaaaaagaacgcacatctgaccattctgttcaagaaaagcagtcaatattttgagtcaagttcaaggggaaaatcgttttcttgcaggtagctgtgaaagttccttgcttatcaaattgtcccctttccagtgattcttgtttatgcattgataaataaaaagaacaaaaatgaggaactaagatatttaggagcttatgtgaggaaagtttctagagggatggaaatgatctagatcttgttttttgtttttttttttttttttgagatggagtctcactctgttgcccaggctgcagtacagtggtgagatctcagctcactgcaacctctgcctcccaggttcaagtgattctccagcctcagactcccaagcagctgggattacaggcatgtggcaccatgcccagctaatttttgtatttttagtagggacggggtttgcaccatgttggccaggctggaatcgaactcctgacctcaagtgttctgcctgcctcggcctcccaaagtgctaggattacaggcatgagccaccacgcccagccctacatcttgttttaattggtggttacatgggtatatacgattgtcaaaactcactgaactgaacacaagatctgtatactttgttgtatctccattatatctgattcaaaattaaagaattttaggtcttttgtttcagtaacacattgaggtctacaccagtacaatgaagtggcagctacagtaaaaatgcacagggaatacatacattgtgtcatatcatcagttaccctttaaatacaatataatatcttcaggccgggcacgatggctcacacctgtaatcccagcactttaggaggctgaggtgggtggatcacgaggtcaggagatcgagaccatcctggctaacatggtgaaaccccgtctctactaaaaatacaaaaaattagccgggagtggtggcaggcgcctgtagtcgcagctactcgggaggctgaagcaggagaatggtgtgaacccaggaggcggagcttgcagtgagtggagatcacgccactgcactccagcctgggagacagggagactacgtcttaaaaaaaaaaaaagagtatcttcaaaagaacctaacgtaatttttacaccatcctcaaatacattttaggagcctataaagtccacagtgggtcaaaaatttttttatggaagaagagatgatattggggtttgtgtgtgtgtgtgtgtgtgtgtgtgtttgattactgctattcttataaactgaaaacaaaatatgttaggtgcttgaattggttgttctcagacgttttgatgtgggaagtactagctgggagcttggaggggagggtcaacataattggtttgtttgaattatactgatttgcagattaagtaagaatgtttgtgtgatttaggaagagaatgatagcacttcagaggtgaaaaggtatcggatttatagggtctattctctcattaaatcaatataaaaatagaggctcagagaaggaaaacaatttgtctacgaacatacagctgtctcgtgccaaacatgaatcttccgagagtcaagtctgttctccttccagttttgcattagttttattttacatgacattctctacaatattttaaagaaaagatatatttatatgtcattaactttctagaaagtaatatttttattaatattaaaaacatcttcaaaaattgtttttcccctgagaatggctgcttctcaaatagtgtgttttaaaaaattaagatagtctactgatatactcaaatactcacatttatcttcttagaaagcacccatgtatatcttccacatgatagttatggcttaaaaaaaattcaaatttatgttgctgctgtcccatctacccatctctacaatagaagattctaaaaagtgattttgtcaccagaaacccacattttctcccatctggaccttgaagtttcctttaactttgctttagtgattgggcaagtcatctttctttctgtggctttaagaattgcccatgataaagtaaaagagccataacctcaaggaaaccatttattaggcttaatcaaaacataatactcttgtttatgtcttcaacacattgtttatggagagagtgagccacaatgcacagacactatcacgatgctccggtgaagatgggtgatttaatgcccaagagcacaactgaatccactctagagaccaataggtgtggctcaaccatagcttcaaaatttcagaggaagttcagaaaccccatatgggtttgctttgctttttctattccttttaaccaaagctgccttcatcatgtataatctttctttttttctgagacaggttcttgctatgccacccaggctggagtacagtggcccgatcacagctcactgtagcctcaaactcctggactcaggtgatcctcccaccttagccccctgagtagctgcgactacaggcatgtaataccacacctggctgacttttttaaaaaaagcattatagagatggtgtctcaccatgttgcccaggcttcaccatgtatatttctttctttttttttttttgagacagagtctggctcctttgcccaggctggagtgcagtggtgtgatctcagctcactgcaacttctgcatcccaggttcaagcaattctcctgcctcagcctcccaagtagctgggattacagtcacatgccaccacgcccagataatttttttgtattttagcagagacagggtttcaccatgttagctaggccggtctcgaactcctgacctcaggtgatctgccggcctcagtctcccaaagtgctgggattacaggcgtgagccaccgcacccaccccaccatgtatatttctgacagcctcttcacaaggctgataactatgtgatattcttgacaggtccccagtgtctctctcagcttggccagggcccacccacctacccctctgtagaatctcgaaacaacacctcagcatcctgggagactggcatgataatattcgtttttcagagcaagaaccaaactgacaaggaacagccataggaggctcagatcagggctatctccgctcagtgacagggaggtctgtctctttgggagaggttgaagacagctaaactggagtggttgccagggggagagggggatccagaacacaataaacaaccacactggattctgctacagtcacagcatcccagagctagaagagagcctgaaaatcatcaagcatggtggttatcaagcagttgttgctgatgtgttcaagcagtggaattctttttgaaattaaatcttctgtggacccctggcatagaaaacaattaaaattgaggaagaggttgctgagcagtgaaaacatcctcatcgtttgatagaaagattcctctcacggcatacggagccctgaaacactgctgtgggaagtttcccaggctccatttgaacatggggttctcaaaagaacagtgacagggagctcactcccactaaggctcactccaccataggtagcccagactagcagagggtatcttcctggcacagacctggaatctgactcctgctagcttatattcatggatgttagcttacctttgaggccaaataaattagcttgtatccccatttcacatgggaaaatcttcatatattcaaaactagcaggttgtcttttagacatgcccttcattacatggcaggctgtgtccatgccccatctctcccacacatgtgcccaagctcaccccacctctgcccctgccgcggccttatcaagacttcctgtacatctgtctgtgtgtgctgggggctcagccttcacgaggacccagaggctccttagggaaatccacaggcccttgtgcatgtgaacaataaggaaaggaaaagattttgcttttgggttcttcatcccccctcccaccagcttcaaagttgaccccacccgttctgaattgagggcgatgaaaactggcttgtggccatttagaagaggatcagattctggaggcaaattctaaacagactttgcatgtgaaaagaaaataaaaacagctgaattacagacaagaaattaatctgcccctttccccctcaaaaaaaggcatcctaacagaactacttcaagattgcaagggggacttcctgcacagtaacatgaaacgtttccatcagatcaacagctggaaaagcaaagtttttttttttaagtgttaacatttcacagttacaatcgtttaacagatgtaaaattataggatatacttagcgtttaggttttaaaaaattattagctaaatatcttttggaaaatacagttgatggtgagttcttcttgatgatgatggcaagaatattttaaatgttcattacactaaagaaaaatgttcattatactaaaccatactttaatcagcttaacgtgtggcttacacaggtttacctaagattaactggacattttaaggcctgggaacagattgttctactgaccagccaactaatgtaaaagatgagaagaaccaagactgggaatgatatcagatgcaaagtgaacatcccataatcgaaacggataatgacacactggtgagtgaagggacatcaggatcacaggttcaaaggcaaggagatccttgtccagggagcatgcctgggagagcagggagaggtggtgtccagccactgcccttcaagtaggggaaaagtgagtgcagaggattgaaccagagaacagaagctgctaacctgacggaaaatagacctggtgagtgaaggttagtggaattggggtggttttgacctcagaagaaagaaaaagggcaatttgattactattgtccagcacatgactgacccttataagaggctttagggaaattaaatgaaagcaggagaaattcaggtggccatttccagagggagatcaggcaagcaaagcgggaagtgatcagccagggaattagaggacctgggtggacccagcttgtcactatcatgtggggacacctgagataagcatcttaccctcttgggcctcagtttcttcatctttaagataagaagactgtagcaaatgactatgaagattcctccagctcatgatgatcttttaattaaaaataaatggaaaaaaaagacctctcttaactgaggttagtaaaagtatcaagcaggtttctgaggacactccattttaaattaccttattattgggcaaatgtctaacccactggtttcttgtaagtccttccaacattctggccctggcctgctttgtcccatcccaagttgcagtctcatcactctgtccctcaccactgtgataaacacaatagttaccaatccatggtctgctggaggaaacaacgcttttgaaaaatgaattaaaaatccctgtgagggcgcaagagtgtgctataaaaaggtcattaataactcaacttagggctcagattcccattggaactatcaaccacaaaataatctgcttcctggctgagtaaggtaagggctccaagaggagcacaaagcctttgaagctgaaatgttaagagtcagaggaagaaaactaacgtgatgtgctgggctagtttccttgaaatagatttaagctttacagtgccgctgggagatgggcatttattatatctaccactataagcaagcaatcaaaattcagagaagtcaagacggctgcccaaggccacatgggtagattgtggagtcactctttcaacaagtatctcctgagtgccggctctgtcctagacactagggatacagtaggggaagccaacatggtaactgtgctggcagagttcactttctagtgggaggagtgaacagctgtaaaagcaccagttaataggaaagaaatatttgatagtgtgaaatatgacaaaaattaaatcaaggaataggacagagagtgactgaggggttacttctatgtggccaaggaaaaaagaactctctgaggaaggggcatttaaaccaagaacagaacgacaagaaaggcacagtcatacaaagatccaggcaagagtcggctgaggtgggcaggaggaaagaagacagtcctagagtggagacagccaacttcaaacagagcgtggcccacgggggcagccatgaacaggcagggcagctggggagctggtggccaccaaatgagctcctttctctgccaggctgttgaggcgggctgactggtttcatgtctgtctttcaatagaatgaatgggagggaaatagaaaccatgtccacatgacattagtacctgcatctaggaaggaggacttagtcccaggaaggctggccctcccatctggccaccctgagaggtttcagttcccttctggttcatgtgccaagcttacctgtcagctttcacctcccaagggatgcagcgtcagtgtgttgaagctgcagcatatgaaccaataaagctacctctgagtaacatggaagcaaggtaggaaggcaaaaaccacatcccactgtgatatcatcagccatatttcttccacatggcaagttttattttgtttaatttaacaataaagtcattatattaactcgattcaatagaagcagcagggggatttctcctaatttaatcgtgggctttggggcgtcttgctcagtgttaaaacaataccatataaaaatattaaagggattgtattatattgaaaaaaatatgttagcgtctccaaatgcagcctacctttaatttagaaactagtcagcctactttttactttatccgaagtgtcatctagtcaagagggccaatctctgcaagcaaatcatgccgctttagggtttaaactccgcaaagtgagcatttcatccatggaggtgatgctccaatttgaagagttattagatacacccagccagggaatataaataacttgagcttaccagtgtcacagaactggttttctgtaagtcacttgaaaatacaaggacatagggccgggcatggtggctcacgcctgtaatcccagcactttgggaagaagaggcgggcagattacgaggtcaggagttcgagaccatcttgcctaacacagtgaaaccccgtctctactaaaaatacaaaaaaaaaaaaaaaaaaattagccaggtgtggtggcgggcgcctgtagtcccagctactcgggaggctgaggcaggagaatggtgtgaacctgggaggcggaagttgcagtgagccgagatggtgccactgcactccagacagaatgagactcagtctcaaaaaaaaaaaaaggaaaaaaaagaaaagaaaatacaaagacataaccaacattctgtatcaatctatgtatccattatataggctatatagtatgcagtttaaaacgaaaagtagttcctaacaattaaccgttataagaaataatctccaagccttttagaagtcttgaaggactgaagagactatgtaatctgctgatttagtgatttgaaatctggggattccaaattcacacacacatatacacacacacaatggctagagaccaaacaatgttttttgttctcagctggcaaaatgaattaacaaattcattaattaggatgctgtttatgcttgtactgaatatatatgaatgcaggcccactcaaggattccagctgggagatgccaacttttgaaattcaaagacaaactagatttatctttggtgccttcataagcttattgtagtcacactgaccatgtgggtttgtgtgtctaagtgaggcctgtgaatatttatttaaccaagcaagttttaaagtctatttcatgtcctttcaactacaaaatgcaaaacaaaaagctagccatgggtggtgggaagacagaagaaattatctttatacaggactgcttttagaagaagaaagaagtggctgaaatctggggaaaggtacagataatagctgtgattcactccagccgtagctaacaaggccttgtgcttttcctggtgggaagcagatgggaaggatctggaacagggagaacgagtagggaaaggaataagccttggatacaccgctgtttccctgtctctctctcacatggtctttctctctctccctctctatgagaaatcttttttcatggcccaaaaaaaaaaatgtttgaggaacaaaacaagatcccattgtggagggactaaagacacgccacagggagcttctgtcacacggttcagatcccagagtgaaggggagtcagacaagaggaggtttcaactcttgaaatctttgtcatgcatttgctttctttattgacagtacttacttcttgtcatggaaaagtgtaatttgccaaaaagggggcagtggggagaggggaggagtagaaagaaatggggagagagaggagagagaagagagagggagagagaaagagagagagacagactaatacgtacaatacaaataatacagcaagaggaagcatcctattatagaattctttatgcttaaaatggagtctgaatgttttttttttttttcatctaaaaataagcctgcgaccttttgcatttttcaggccataagtatttctgcaaggtccagagtcccaaggcacatgggggcagagtgagggctgtctggtccaggtccccggagctaagaagtatacctgtcagagaagcagcagccaggttgaaagagaagaaatccacagaggcctgggagggtactctgaacccccacttcctctgtcagttattgattaaacctcttacacatacacacccgttctagggaagctgaactttaattttatgcctcctgcagaaaacagagatggatacagacatgggtccgggagtaaataacactcagcaacataagaagaacacacacctgcaaacgttgccacggttagattttttaaagtgtaaagaaatgaaaaaaaatgtcgaacctcacttataatcaaagctatgcaaactaaaatgtgttacactttttaaaacttatccaattagcaaagatgaaaaagaaagataataccaatgttgatgaaggtttatgcagacaggcactcttatgtctattcaaagttggaatagaaatgagtagtctttctggagttaaattaggcaacatgttgcagatgccttaaatgtgcagattctagtgcagcaattccacttttagcagcgtattgtatcagacatatgcagtaggatgttcatcacagcattgtttagcaaattgatggaaacaatctgagggttcaacaataggatgattggttaagtcaattgtgttacattcatacaacagatgtgattaaaagttatgcttggccaggcatggtggctcatgtctgtaatctcagcactttgggaggccgaggcaggctgatcatttgaggtcaggagttcgagatcagcctggccaacatggtgaaacaccacctttactaaaaatacaaaaaatagccagtcgtggtggcaggcgcctgtaataccagctactcaggaggctgaggcaggagaattgcttgaacctggaaagtggaggctgcggtgagctgagaccgtgccactgtactccagcctgggcaacagagcgagactctgtctcaaaaaataaaaacaaaagttatgcttacaacaaatacataactaatgaaatgctgaggaaatgttgctaacctaaaaatgaaatctgaaagctttctctctctctctttctctataatatgtatatatacatacacacacatatatgtattatccatatccatacaatgcttatgttctaagcgtatagctaaatgtacttgcattacttaacactcacaacaacacaataaagtatacactattattgtggccttttcacaaatgaagaaactggaaaatgagagaatgaaaacctaaactcaggtgtagtccagtctaaactatataaacttcctctcttggccatgagtaggagtgtgcgtatgtctgtgtatgtgtgtacatgtgccttcctcatgaatacagatactctgaaatgttcatagtcacctcttagtggtaggcttagagccatatatatatattttttgtttgtttgttttgttttgttttgttttgttttttttgagaaggagtctcgctctgtcaccaggctggagtgcagtggcgcgatcttggctcactgcaacctccacctcctgggttcaagcggttctcctgcctcagcttcccgagtagctgggattacaggcaggcgccaccatgcccagctaatttttgtatttttagtagagacgggatttcacagtgttggccaggatggtctcaatctcttgacttcgtgatctgcccacctcagcctcccaaagtgctgggattacaggcatgagccaccgtgcccggccgtaatattttttttttattgttttgtgctgtgtgtttcatgatttctacagtgaccatgtatttcttttgcaactaagaaaaaactgcaattagcttctcttttgagatgttattctgattatgattatcttctgactcgttggaactcagaaggtgtcaagaagagggagaaagtaactaacagataattttcccctgggtgtactctgaagcccaggaacagccactgggaaaagtctgcccatgtgccctgggaaaggtcacttgactccatgaagtgacaaataaaagtgataatgcatgtgttaataaaaacacctgctgcacacaatccatgctgttgctccttcctctgccagcctctgaaagacaccaattccagcagtggtattctccagactccccatcagacacagttggaattttctcaggaaagaccatgaacttacaatcaaagggaaatacattctgcctgaagaatgcattatcagtgctcactagatgcaactgactgtccctactctcgtaagttctaactccctttgaattattgtccttggtttttggagcttatttctatctctattacaggggttttcaaactagaaaatgtatcctcttgaagtgtcacaaaaatccttcctagaattatatggacatagataattctaaggaaattaaattccagaatctcaatttcccggagtctttcctaaatgtgtctgataatgcatttgtggttaagaggtcatgccagtttactcatctctccatttacaagcttgcttctcttaccttcaagcagaaagacataattttcacctatggcaaatctattataactgcctgtccagggctatgaacaccattggagttcttgccccagaaaggaccaatttgatataggggttaaaagtaagccttctataaccaagacattataaatccaaggtaggtggttggttgttttgggtgtataattcagaggttcaaaatggaaatgaccttgctctaatgaaactctgttcccatcacataattgataggcaatgtttctcaccatttatatgatacggactaaaacaaggaatggaattgatattgaacccttggcaaaaataacattcatccataggtaaaaaaactaattggaaataaagaaccatccatctcattaagaaatatatttctaatagacattaacttctatatttaataattgtttattgaaatgttcaatacgtttgtgttgttttgatcaaatttgttctaaaaatcactgtaatgataaatcaatctagaagatttaaaaaattacctatacctttacggtcataggatttaaaaaatttatttacacatatttttattacaaaggattatgacagcatgatcaatgaaagatttttaagcataaaaatatataacattaggctaatgttatataggctaatattatatattttatataacattagcctaatgttatatattatatataacattaggctgttatatatttaacattaggctgttacatatataaaaaatattacatatttatatatataacattagcctaatgttatataaaatatataacattaggataaaattaggataatagaaattatcctaatagaaaattaggataaaagaaaaaagatgtagaagttttgggtatcaaaaaagagcttgttcgtgtatttctttaaaaaatgaatgacagcaaacatttacaccaaaatagtatttagatttcactagatacatttcaaaagtgacaagttttatttttaaatgtaaatatttataaaatgccagaaattaaatcctctgctattgaactatttaaacttatgataaaaaaaatttaaatgtcaaattttggataaacatgtggaggtataaagaatttcaaaattctctctctctctgtgtgtgtgtgtgtgtgtgtgtgtgtgtgtgtgtgtgtgtagtaaatgaacgacaaaaaatgaaacccactgtctaatgcatctcatgactattctttttcctccatgggacccaagaatttactttattgggtttaagggggctaatgaaaatatttgatttagctctctaaagagatctggccatattccagctgcacccacaagccaggtatatcagctgggtctctcgagcaggtgatcaagaacgcatgaacaggaatgagcacaggtcagccctgaggaagagggtcatgtctgatactgggctgttccctgaggggtggaatcaatttgactcacagaaggaaaggaaaactaaactttccacctgtgacttataactacaatcaggtcatttatgctatcatttccaagaatggaagaaatcctatggaaaaaaatgcgcatgtagatggaattcttttcctttgtacacatttgacttacccctttttaatgccttttacttgattccattagaaaaaaaaatccacaactgagtacactatgctttagaaaagctgcatacatatacccactctcaaacaatgaaaatgacttggaaattaatgatgttgatgtagaaaaattgcaggaacaggcatactgcttttcttcctctctgctgactctgaccaagggcaactccaaggatagaaagttatccatttgatgaaattagaaagacacggggcatagaaagggtcaggtccagccacttaccacctctgataggataaacatcctatcagagtctcggtttccttatctttaaggtggactttaaaacagacaccttgcctactgcttcacaagactgctgtgagtagcaaatacaaatgcgaatctgaaagaatgtcatatgccattagtgattcatcactttgagtattaacagctcttcaatgccatcgctgttagaagaagaaacttggtgttctccatccccttcttggtcctgatgctgcctttctttccctataaaagtagcccattccgggggagggatgggtaggaaagttgccatggattttattaagatagagtaaaaatttattataggaaggatgcacatttcaacaaaagcttagggcttgcagccctcgtttcactctaatgaaagaaactgccacaactctgggcatagtcctatgcttaaacaactgtgtttagcttggtggaaatacaccaagatgaaagatgtccaccttgattcatccgtacgatacaggaaagaaaatctggcaaattagaaagacatggggcatagactgtctatttatacctataaggtcaagactaatctttaattttaattcagatagatcgtcttaatgaagctgttaacaacagtgagaaatggaaacatctgatttgtcttgactacgcttagacctcacaaatcttgaactacaatccacagaatcaagatcacttaacacttacttaaactgatttctgtaagtaatgtcaaagctctatcctgaggtaaaatattattagtcctgacatgattaacctgggcaattgacacataaaaaggatcttaatccattaatttgctaattggtgttcattactttggacatgggcttcgacatgtcagcctagtgttcatctgtaggaaataaagacccaaacagggtatgcaactgtgcagatctgactgcagcttggaaaaaaaattggagtcttcaaattctctgaacatgaaaatgaaaaacacaactaataaacagttgtgttgccttttcttctttgcccccaactgtactgcttcatttttaacatatgtttaactgctattttttattaaactcatatttaggcagggaggaacaagcttaccacatatgctttgggttatatgctaactattccttgtcagatggtgagttaaaaagaaagacactggaagagtagaattaaatgtaaatctgccttatgaaaatccctagcttttgagaggaaacacttctatttgagagaatttgggacaggtaatttttcagggccccctgggacttgaatctaatactatcatacagaggttctgtttcaggtagagtcatcttgagtcccatctgagatgtccctgaagtgctaaaaatcatccctttaagaatccatatctaagacggtccatatcctagaccctattcttggcttataaagttgtagtgaaaattagtgaccttggtcatattaggacttagttgcaagtactctctatcgaagaaacaaaaggctgagagatcgatcacctggtctggccaattgtatgaatgcacaggcatacaatccaaacatcccaggggtgtggagcttccattcaccagaactgaccaggaaggggagtgttcactagcagattatagaaaacatgattttaatgtgccctctcttcaatatttactgtgatcccttgtgcctcagttttcctacctctgaaatggaaataaaaacatcaatgaagtcatattaggacttagttgcaagggggtgctgtgttatgcccagtggacaataagaacattgcatgactttagaacctggagatgaggactgttggctgggagtactcaaataaatttactccctcaggttcttccctcctatttctacttacatcaatgagcctggttccttggttctgttctgctgttattccaaaactctcagattccatgcatatatattgattaagccaagcacatttcaactacatcatgtcacctaaacatcgtgtaaggcttatatgattattacttcatgatataaaaagattctgatgaagtcaagtgcgaaggcaaaggtcatttaagcaaaggcagaggtaggaactgaacccatatcttctgattccaaatccagctttcctcccacccccctcattcaactgcacacacttctggcttcttgtcatttccttcctctctccattttgtatttctttccttttcctccaccatctgcatcttctgcattctcttccttgatccattctctcatgagatccattatctcatcactcaatctgtttctcttctatagaactgctattaaagttcctgaattctaagacaattttcttagaaggatagaaatgtgggaaggaactctaataatgatatcctaaaactaatgatgttaggactaataaaatgacaaaagttttgcttttgttgtttgattttaaatgtataaatctcactttaggtatctgtgagcatagttggcttgaaaaaacaaaacaaaacaacaacctgtaatccaaagaggaaacacagtgccgtttcctttgattttctcaagggagatattggcaaaatactctcatggaaagcgtatctgcaaaagctttcctacgcattaaaaaaaaaaggaacataaaaagtattagctatttgacactcataaagcagactgaattactctaggcattgctgggtacctggcatttactacagtcacttgagctattttgatttatgagggtttagccctcaagcaggttaggtttaactaaacttgctaccaagtgcccacttaaggattctttcagcaaacaagaagaaatattcttcacttagagttcatgccaccaagcctcaagcttcactagtaatgaggcactcatttccagagagcttgcgctctgttttctccacagcttccctcaatttacatctctatcaaagaaacaaagagctgagagatcacctggtctggccaattgcatgaaatgcatgggcatgcaatacaaacatcccagggctgtggagcttccgttcaccaaaactgaccaggaaggggggtgttcactagcagattatagaaaacatgattttgatgtgccctctctccaatatttactgtgaggctctgtgcctcagttttcctacctctgaaatggaaataaaaacatcacctatctcataagattgtttggaggattaaatgaattaattcaagcatagcatgtaaaacatgtgctagaagatgatattaagtatgcagtaaatttagctaatactatcaacgctttcccaatttgttcctatagggcacccaaattggtacagtaatctttgctgacaaccttcctccccatcacaagtctcacaaacactaacttgttcctcttgccttattctctctcaatcctaccctttgctagtcaaaattaagttctaacaagacaactggacagatgaatttgtaagccacctaaggtattttctctcccagggaaaggaaaactataattcaaacaaaattcatgtctcagaaagattcttaagcaatcactttaataatagacttgtaggttagcagataaatgtttttttgatcaaatatcctttctcaagtgcctggcaaacattgtttcactaaaccaagttatcacttttttttttgagacaaggtctcattctgtcaccgaggctagagtacagtggtgtgatctcagcttactgcagcccagacctccagggctcaagcaatccttccacctcagcctcctgagtatctgggattacaggcacacaccaccacacctgtctaatttttgtaatttttgtagagatggagtttcaccatgttgcccaggctggtcttgaactcctcagctcaagtgatccgcctgccttggcctcccaaaatgctgggattataggtgtgagccaccgcgctcccagcctcatctaacttcttgattcatctgctcccaattttaattacaatcacaggcaaatggtatcttgggatgacaaacttccctgaaatctttctgggtacatgtcttcaatttacttcatggagcaccaaactataaccacagaaagtgaattctcgttccagacacattgtttattcattcagttgcataggataagtcactttacttttctgagcctcaattttctcatctgaataatggaaacgataatatgtattcacataaccacagcttgagaaccaaatccagctcgtcacatcttcttgtaaatagagttttattggatcacagtcatgcccatttgtttatgaactgcctctggctgcttttgttgcggagttgtgacagagaccgcatggcccataaagccaaacatatttaactatctagccctttacagaaaagtttgctgacttctgctccggatgactgctgtgagaaaccagtaagacaactgacagggaagtgctttgttacctgcaaatactgatgtaaaatgtgaatctttattattgccttttagatgtctacaggattagtgtgtcgctcaccctgtagctgcattcttcctagctaagcaatcccaaacaccttgagcctgttacctattaggccaatttaaaaaatttctcttgttgcctttgttgttgggtggggtatttttggacttgctccagtttctcctattcatttttcttttaaattttaattaatgtatagtatactggaaaggttattatctggttctcaagtaaagtctcagttactatagccaagaactgggttggctttttttttttttttttttttttggagggtgtctcgctcggttgcccaggctggagtgcagtggcgcaatttcggctcactgcaagctctgcctcccgggttcacgccattatcctgcctcagcctcccgagtagctgcgtctacaggcgcccgccaccacgccaggctaattttttgtatttttagtagagacagggcttcatcatattagccaggatggtctcgatctcctgacattgtgatctgcccgcctcggcctcccaaagtgctgggatcacaggcgtgagccaccgcacccggccgggttggctttttaaataacagctctgtaatgaagtactcttggtcaagtagatacagcaggatccaaaaccagttaaatcactaactgtgaacatttgagcaaattatttaccctctctcggcctcagcttccacatctataaaatgagagcacaaattatacacagctttgagagttactgttgagattattacagtgtatttgtaagcaagctgacttatgcaaaatgcctggcacatagtaggtccttagacaaggctgcggatgtggcttcctcatgtccttgacagagagacacttttccatcacaatcatgcccagatgattttaaaattgtgagtccgtctattaggcataagtatcctaccttacatttgtccctattgaacttcaacttgcttttgatttattgaggtcactttgacttctattcctgtcttctaaggagttagaatttatgctcttctgaatttgtattctgtgaacctcatttccaaaggatgaaagaataagagaaaatacaggttaactagggtcataaggctagctgtctaaggcaaaattaagtgtagatttgacacaattattcaaaacccaatatgacaaaatgttttggctgtaactatctaagccttaagaaaaaaaatacattttcctatcaatttttcacttcacactgctaacacagacgaagccaaaggggtagaaagacaaatgggtggtcaaaattaacagcatgcttagggaacaaggaatagggaacctgcgactttcctccctggcaagctctccctgatttttaaatgcttctgccttaccaaggtttgttttgagagtgtttttaatctgagatattttatctgctaaaaccttattttttctgctccattttctgcattttcctccagcatctttgattctcagcatttacagcaagcaccggatctctcctatagcccgaagctcgttaaactaccgcaaaataagatataagcacctcattaattaccatcagcaagagaattagtgtgcctatcaataaatattaaagttgcacattctatctctaaagaatgaacttgccatgcacaggtaccggatgccttcccacctgagacagatctcaatcacagaagacaaggaaagccctggcggcagattctattttaatccaaggatttggggagggactttcctgccaactaaggattagttcttttccttagagccttgtgactttgaaaaccagctaaaaatgcatatcaaaatgtaaaatgcctaaatcagcattgtgggaatcatttaaaatatactgacaaagctgctcttataagttgagatattaattcaaaatttttaagtaaaaaaaattaattacattgaaatacacaaaaaaaaatgtttggaagaaaggccttttgctcacctgcaatttctaattttccaataacacaataattatactagttcatatttattgaagttattatgtagaagacgctgtattgagaagcgtaggtgctcatctgttcaccaccacaatgccatgaagtctgtgctattattattttactcaccaaaaatgtggggcttaaagagattgagcaacttgctatagatcacagatctgtttttaaaaatcagctgcatacatgggggaaagaacaccaaacaattctaagaatatgctccaaatgatacaaaattatatacctgtaaaagagcttattgcagtcttaggttgcattaattgaagaagatggtccaggaaaaaggaggtaatgaccttgcccaaatccttggacctcagaattcctccaggggtctgttttcagtatgatgaacacagtttacgtggaatatggataaaccagggggaacgtggccaagacgaccggagggcttgagtcatgatatcggagagatgactgcaggaactagcagtggcagcctggaaacagaagagtatcaggctttgtgagagactgtagacggtgtaaaaacaagaacattagctgggctccagtttcccctttttctctcattagtaccacaatgtagagtgagttatttaacctctctacatctcagtcttctcatctctaagacggtgctaataatggcactctgcttcatacagttcttgagggaatttagatgagataatacaaataaagcactgaccattgcacctggcattcgagaagctcctagcaaatgctagccactaatattatggttgccgtcatcattgcttctgtggttcttaaaatagaatggtgatttccaaaatcactgcagaaaatggtctcccaggataaacaggtggcatgccaacaaagacttcatggttccaaaggtttgggaaataccaacttagagaaagttaagcaagatttgtactctgtgcatgtggctctccaagaagaggtaaagtatataacaattcccagctgtgtttggttaggatcatttttaaagaacactccttggaaggagtgtgttctacgagctttgggtcccatgaccacagacgagtctacatcgtcataagctacgcccatcatctgatgtggatgaagcacaccccagagaatctgcccggaggtttcgcgacccataaggagtaaagaatagctgaatgtggtgaaatggggagacaagtcactgggcaattagaagtgtgaaaatgtgcctcgttggacacagggtatgaggcaagcagagaaaactggtggagtagtccccctggtaaaagcttacttttaaagtaaaatggcccagataaacctgatttcattaagtgagacctggaaataaggttgccccatatatactcagccgaagacgtatgaatgaataaagaaatgaatgaatatttttattccaaagttacccactttcctataaaacatatcataaaagtcacaccattattattattattatcattgattaccattacagttaaaattataaacaacatccaaacgaatatcacctgagcctttcttttccaagttgaatatatcacataaagcaggctcttttgattcctacgtttttatttattggcttaacctccagggctccattggaataagtaacactacatgaaaacaagttccaaatgtgagagattcaacagaacccaggacaggctttgtgtagacatggattttcacatgcttattcaaaatatttgctgtcaacggtacttggtgaaagtgattgttacatacagcatggctaacttttttatgtaaatgaaatgcaaatgtatgcaatgttatctttaatgcagatgtagcagaaagtattaagatatgctgagagcctaattaggtcctacatcaaaaactatacataaacttgactccaatatctcaagaacacaaattgagtctagaaatcccagtttgcaagcttaaaaaaaagatgtacatatatattttaaatcacagttctttttcttttcccttctctaagtctgaacacttgaaaggatgatcttggacagatatttcagcgtgggggagggggtgtggagtgggtgggaaatgaacaagtttctttctaacaaaaaccaggaagcaagaagagaaaatcagccacgagccccccaaaaaggcaaaacaaagctgtcttgtgctttccattttcatatgaaaaatgatgacgtgccacaaagcatatttttgcatttatttccatttctaaccttcctggagacaaacacatgtgcattccttcctaatcgctgttacagtaaaaccttatgaactccaggtccactaattctccatgttgatccttctgacggggtgagcggaagtttacctttatttaaggagtgaaagggttgacaaaacaaataaatatcataaaaagcattgcagcatgcctgctcaacctacatgacataagctcttcttaagcacttagaagcactgttcatatagaaaactattcaactgtcttttctatttactacaatagatcctccaaaagaatgctcctatgtgatactttgttagccccttataatttactatgcatagtagaaaagtgataaaatggaacatcttcgtaattgtccataatccaggctccttactaattctgaggagtcttgccttctgattcctcagcaaagtgtagtaggcttagagtggcaagtaccgggggcctctcctgggctctagctgtgacttgctctgtgtccttggacagctcagtggcttctttcctgctagttttatggggcttttctttccccattcacattctaaaattgctttgggaatcaaaatagaaaaaaaaggatgcagaaacaatcagaaaagtatggaaagtactttataaatgtaaggtgtcactggtctctaaattgtgagggcgtgtgggagcgtatgtgtatgtgtagtgtgtagcgtagtgaaaaactccacatgcacaggcatatatatatttggattcataaatatttacaggtgtatatacatctgcatgcatgtatatacggagcatgcatgtatatactgcatgcatgtatatattgtactgtgctcatatataacatgtgcataggtactcatggataagtacagatgtatatatgactatactgacctcagagcaatcatacatataacacatatgagtacgtatgtatatgatgatatactcaaatatacacacatatattgacacataacagacacacatcctcataaatggtaaggatgtatatgtctatctctgccaaggcacacattaaatgtgcatatatctgagctaattaacctgtgcaccttgccacagagagtacctgaaatggcccaagacaaaatctagacctacgtatccaggctgaagggcttaaagcaaacagagcttatccagctctattcccctctgagttttcttccatcttatctaatacaccctctgaaaagaaggatcttttttagttctgctaagatccccaaatgctcttaacatctccaaagctctctaatacaaaaggacccagttgctgcaaggcacaagaattgcactggcttcacagcaccacagaacatgcccagcggaatacattacacagcgctccacgcagctcctctgaaattgatattgctggcatcactcgccccaaatttctaacattgtcatgataaccccatttgttctcaggaactgcttcccacattttaaaggaacagaattttccccatgtctgtccttcatcatgccctttctttaaagaaaaaagaaagtcttcccctgggttcttcctccattttgtgtagtaattcctagtgttgtcagtcgatgattatcaagtatataccaaacattatttcctgctaatatacaatctgtgcaattttaaccaggcttgcacctcaaactgaggacagtggaaggttttgtcttcgtgctaaatagtttggttcagaggataatcgttagagatgctcaaaagaggtggggttgttctgggctggaaaagttagtgaagggggggaaacctgtcctgccccactctcaccttttccagcactcccctcaaaagaggaaaccattcagctacttcaagtctctcacatctgtacttatccatgggtaccgtaccttcatgcaccttgcttctcctctgtgccactctcctaatgaccatcttccctcctgatggggttcctgatgtcggcctgaccacctctccaatggctggtcactgacggggcctgcctgcccccagaattcacctccaaagtacagcatgctcctggttcctttgccacttctcaaaaagcttcttctgatttctgctccgacaccaacttcccgtcctctgacctccgctcttctctctctgtatccttcaccaccacccttcagcattaaccactgaaggaatcactaacctctctcagaggctccagattcacatttgcaagtgtctgctggacatcatcacagaacgtccctttgtagagtatcaatgaaaccagctctgaatgctgcatcttccttccaaatcctaatgtggctgccactgtccgaattttgcaagtttgaaacgcttcatatatgtctttctgttcccttctctttaggactccacattaagtcagcatctcagtatcacctccacttagcttcccacctctgtcacttaacattccatcctctctcctactactcaagttcagaccatcccacctgcagcccaggatgaaagcactctctttgccccagaagtagctagcatcttaccatggaaagcatgcacacaatggggaaagaagagccaggattctagttcggaattgctgcttcttcgcaaacagactttgggcagtgactcaatacttttcaggcccaatattcacatctctaaaatgtgaatgaggctcttttcttattgtttattgaagataatgatgtctggctattgttacaacaaccaaggcttcccttctccaatccagatgcttccaaaaccttcaccctcagagagactgatcaaagaatatcaacaaaaggcccttcacatctttattttgaaaagtatcccaggcaatcttggtgcactattagattttgtagtctctgctctaatccatcattgaacttgaagctggaattcccttcctaaagcataactcaaatcacattattcccaaactgacaaaacttcaagggccccgtataatttcctgaggacattttaggcccctcatctatcttttctccttcccaaatggtaacagacctttgtgctgaattaggctatttattgctgcctctcagttatgatgaattcaattgtatcagaaactcaactgacagtggcctaaacaactaagcatttacttttttccacataacgtgaattctgggggcagatggctttgtgctttgcttcactggttgtacaaggtcagggatccgggccacagttggtaactctcttggtcctcccctcaaggtggggagatgacagtagcagctgcggcaagcaccaagttcacacctgtgttccaacgctggggacgggagaggcctgcaaagagaggtcctcctcaacgccccctctctagtctattggccataaatgggtcacatggctacaggggaggctggaaaagtgactgcgatgtttcagcctctatagtgggagactagaaaggcagaggctccgtgaatgactatgagtaaccaattattagaaaaccctaaatacaccgtcagtatcactgcctaaacttagaattgtccttttccaaacctgtgtctgtttaagtgattatagctaacattcagtaagtgcttgctataggccaggcagtgcttcaaatgctttatgagtattagttcttaatatttacaataactctgaggcaagaggattattctagcaatcgtacaagtgaggacattgaggctgatcaaggttcaaacacagggaacctgaccctggatcccacactcctagccacagaacaacactgcctctcaaggaacagcttaagcataaatcttctccatgaagaggatcttgcctgcaatccccggaccagatgcacaattctcttccttaaaatcctctgatgtacttctcctatggtgagggcaatgatataatccaaagtagggcatgtctgagatgcacggaagcactatcaataattacaacaggaaaacacactgtcctatgcaaacagggatgtatgaacatcctacctgcggttctagcctccaggagagtgcttgtgtacacatccaatttcttcttactggtgcactgggattttgagggcgggcactatacatgaatggtatatcacctggatgggcttcatatggtgctctgctcagaataagtgcccttggtcaaatagctatgtgctgacccaagggagccttgaaaggctgacaggatgtacttacacaagggactacagggtggcatctgtaaagagtgggaaaggtgaaggctctaaatcagattttgcctgaattcaaatgctaggtcaaccatttgcaggctctatgatttgggacattttacttcacgactatgttgactgagttctcctgtctataaaatcatgataacaaaataaatttccctacagggtgtttgggaccactgagtgagctaattgcatgtaaaatgcttgacaaagaaagacttcaaatttaggcagctattaattaatacaaacatgttcattaatttgtgggaaaaaatgtatatgagtagaacggggcacggcaattgtgtcacatgctaaggtaccgcaggaagataagtttggattgtgtgtgtggctgctgggcttgaccttataggcaccatctttttcccaatgcttttaagaacagagctcaaagttcagagtgccatctttgttttcatgccagtattttcaatggtgcacacacagacacacattctgttgatgcaaaatctgctatggactgggatggggtcatattcagagccccgccgtgataaataagactcctttctgtacttttgtgctttcttatttcaaaagtgggtaaaaatgtgaccccctagacacattgtggcaaagagtgtacagatttaagtaaaatggttaactgagagttaactggttaattctattctaaaacacgtttgtggttttgctgtctggaggtagaagaaaatggtaggttgaacataaatgcaggtttgcatcttgtctttggctcctcaggtaagagatgcagggaggcagcagtatccctagtggtaatcaatgtttaagaactgacaggccgggcacggtggcccacacctgcaatcccagcaatttgagaggccaaggtgggcagatcacttgcggtcaagagttcatgaccagcctggccaacaaggtgaaaccccgtctctactaaaaatacaaaaaaaattagctgggcgtggtggcgggcacctgtaatcccagctactcgggaggctgaggcaggagaatcgcttgaacccaggaggcagaggttgcagtgagctaagatcctgccactgcactccagcctgggcaacagagtgagactctgcctcaaaaaaaaaaaaaaaaaaaaaaaactgacaaaacttgtattagtccattttcacactcctgataaagacatacctgagactggggaaaaaaagaggtttaattggacttacagttccacatggctgggaggcctcagaatcatggcaggaggcaaaagacacttcttacacagtgagagtaagagaaaaatgaggaagatgccaaagcagaaagtcctgataaacccatcagatctcatgagacttattcactaccatggcaatggtatgggggaaaccacccccatgattcaaattatttcctactgggtccctcccacaacacgtgagaattatgggagtacagttccagatgagatttgggtagggacacagagccaaactataccactcagcttttgcagggttatggaaaggtgggacaatctcaagatcagttagaaacctttaagacagcaaacctgttgctggtgttgctgcagtgttccaggtaacagctttggatatttttgtctaagcatatttgggtttcctctcatgtgagtggacactgaaacaaatgaactagctatgaaagatgcacctttattcattgtaatctcaatcccaacttcttccttttcatcatttcacatgggatgagagaccttatcacactgtcttcatcagtagataactcccactaactcaagaataagcagaagtatccaatttgtatacactgatatataaaaccatggtattctcctacttactttgatcaaccccaatttggcatgtccagttactgccctggggacccattaagagtctatggaaacaaaaaatgcatgaacgagtgttgggagttgattacaagtccaaccctctataaaggccacggcatacttctgtttatttaatatgcacaacaccaagagagagaggtagtaattcagtctgctgggtttctccacaaaatctaccctaaggacaccagcataacaggggaacaagtcaaactggggtggaaatcagttggtatttaaaaaaattatacaagtagcattcatcctaggaaaaagcagaactttcttggatctcttttttttttttttttttttttttgagacagaatcttgctctggtgccaagtgcccacgctggagtgcagtggttcagtcatagttcggtgaggctttcacctcctacactcaggtgatcctctcacctcagtctcccaagtagctgggactgcaggtgcaagctaccatgcccggtaatgtttttttttttttttgagatggagtctccctctgtcacccaggctggagggggcagtggcatgatcttggttcattgtaacctccacctcctgagttcaagtgattctcctgcctcagcctcccgagtagctgggaccacaggcatgcaccaccacgcccagctaatttttgtattttttgtggagacagggtttcaccgtgttggtcaggctggtcttgaactcctgacatcacatgacctgcccacctcagcctccaaagtgctgggattacaggcatgagccactgcacctggtcctggctacattttgtattttttatagagatgggagtctcccaatgttgcccaggctggtcctgagctcttgagctcaagcaatctgcctgcctcagcctcccaaagtgctgggattaaaggtgtgagccaccgcacccagctggaaatttgttagacccctttccgcacttgatgttagacaacagacctataagcaattttatatcttctggcttactttttgtttgttttgctttggtttttgtatttcatggttgggagcaaggcaaaagtgccccaaggttttcggtgtttaagatctccgaagttttaggcccagatcacatatctaatgaatcaaacagacaggacgcaaacccatgcctccgtgacccaaagccccttcatgtataaaatgatgagccagggtcaagctccaggatgcccctgaaagttctagccattcttatggcatagcactgtacactgggacatgacttaatttctccacaggcttctcaaatcctaaaacacgtctctgtccacgcctgaggctcggtatcacaaagccttgtgaaaacgcctctcctgagagaactttcagcccccagacagccgctcattcccttcaagggctgtggtcccaggtcccgggccctagctgtgcttcagtgacatgattcaggagaacctcctccaaagcagcagggcaaaccctgttattttctgggagctgttgtccttgagtcattacctcacactcttagaacttcttccagtttctagagatgaaaatgcgactcagacagtctttgtgactaaggatagaagagaatataagggtgaacacaggacaccttgtggactgaggacataagttcgtaaaagctccctgggctgatgattttaatacaaaagagccaccagacacggttctgagtttaaaagtagaagaaatctggtccagtgtaaatcaagcttattaacgtaaagaattagtgcagaaaaattaaatgagtggatgaagaaaaaagtttggaaggaaaaaataatcctcctcactaccttttaccaaatgagcgttggcaacatgggttggagttgcctttatgcacataatttgccatgcctacattctttcagggcctacaataatgttcctagccatgtatttgaattaaccaggcccagaggataaaactttcaaattaaacacattcctaaaggatttcaggctcattgtgtatgcaccaaggaaacataacatcctaaaaataatacgtacacagagagaagcacattttccatgaacattaaagtggaatatgaattatgacccagctcatgggaatagacatctgattacatgcaaaatggagcttttgtaaataacatcagtcttcgtgagctaccacaattattatcaaccatttaattttattccctagcaactcatccatcgttgttaaaactgtccacttttgttttttaccttctgatgcatgaggctccgaattttataaagttcaccgttaaagctatgtagattaccagcccaacagcgaacgagttcacgaaattattagattcaccaaagcatatgctgcattgtatatctgctattttgggatgtattttgctggtgaattgctagaagcagcaaaattacaacggtagccattctgttcactttttatacaaaggaatcatgaaaatgtgtttaaactttcggtatttgggtatttaagtgcaaagtgactctcaagaaaatcaagtatacttctttctgtctccctggcctgcaatctttgacactattttatgaaataccatccataattccagttggtctatgtcatatataatacgcctgcctcataagtagtaaaataagccactttgtgccttcaccaattctatttcacaacaaagtcaagagacatgtttattaatagaactaaacttttattgatagaagtttaaacaggaatagatgaaggatgctgccaaatgcatcctttgcctgttcctattttaaactcaaaaaccagacacaagaagtacctatggctaatcttttgttctgggagaagttgctaggtggcacctctgaacaatgcctttaacaccttatgggagacctgacctcataaaatacgttgtattttctttcccttgaaattccatttcagtcagaggtgaggattttcattggcttccagaaacctttgagttttaactgcatcaggagtaagcttagaaagcctcctggcctgcaaaaaaaaaaaaagctgttgaatttcaccatgcagcttcaacagcatttatcattgtaactgagctgtatttggttgaattataaaagcctgtttgtttatgtctcttctaatggaatatgagcccagtgtgggcgagggtccattactatcatattcatttgcatgcgccaatagtattagttgaattgatattcactgaaatgaagagaggactatttaaggtgcgaatgcaagtttatatttctagtaaacattttaacattttagtcccaatttcattttagtcttggcctgaaaacgtattaactgggagggctagccatacctttctattggagccattcatttgcccattaacacagaagaagtagaagaaatgaaagggcagaggtggcttattctgtttttagcatctactttgtgtcagactttggctcggcgttttgtttattttgtgtcatttgatccataactatactactgagattgactgaattatccccatctttaaaattaggaaactgggactcagggaaagtaaataacatgctcaactaataaatggtgggatccagatctatccagctcccaagcttgggccacgtcctctgctctgttacaacaagtatgcttttactcaggcatcatctctaactttcttctttaattctctactttaaatcttgcaattaataggagatcctagatctgccaaaatggatagatagtacctaaaactatggtggttaacatgtgatttgaagttagaaaaactatgggataaaggccaaattacattttctctcaaagtctcagtttaccaatctgcaaaatggtaacaggcaatgtctatctcccaaggtggctaggagaaataaatgaccttacaaacctaaagcccatagcactgtgagtacctaacccacagtaagtgttccacgaagggtagctactgccattatagctaaccacttgttcaagcaaaaatatttctaccataaattatttcctaagagaaagtttgctcaaaaatattttttttccccaaatactgacaaaagcttgccctgggaatcccattcctcttcacatctgacagtaacctggattttgacagctctgcttctggctcacaatgtattcacatcaggacctgctctgcttttgcccatcatggttacttctacatttttgcaacttaattccaataaatatataaaataaatgctgaattctattaataaatacacaaacgggtaaaggcatgctgggggcatgaggaggagttgagtggtttatggagggcccttcctatctccagcacaatagagactatgccaaggaaattcatacaaacggtctagataagtagactgccagaaacaatctggttttaatgaactaaattaggattcattcattcaacaagtatctaatgagctcctactatgtgcggggccctttgttaggtgttagaatatcatggtgagtcaaagcagatacagtacctgccccctctagtttacagtctgttagaaaagaccagcattaaattaggccaagaatcaagcaaacaaaagtagaattgcaaccatgacaaatgctagcaaggtgacagacacagtgcagtaaccctatctagcaggatctggcctagtcatgcaggtcaggaaagttcactgaggaagtgatgctgaattcaatatttaaaggctggcccaaatgtctatcaactgatgcgtgggcaaataaaatatagtctgtccatacaatgaaatatattccatcataaaaagaaatgaagtactgattcacgctaaaatgcagaggaaactcaaaaacattatgttaagggaaagatgccacagtattgtatgattctacttacataaattgtccagaacaggagggatggtggtggtgagggtggtggtggctgaagagtgactgctagtgggtatgatggggagtgagtgctagaggatacaggtttctttttggggtgatgaatatattctgaaataagatagtactgatggtctgaagtaagatagtggtgatggttgcacacctctgtgaatatattaaaaacactgaattatacactctagatgggtgaattgtgaggtctgtgaattaaaaaaaaaaacatctaaacaccaacccgaaccagatggtctgtgaattatatcccaataaatctatgtgaaaatactgcaagcctagggaaatgacaagctgaggagcaaagctcctgtgtgtggttggaggacacatgacgagcaccattggaaagacagaaaaaaaaggccagggaggatcaggcctgagatgagactgaggagggaagcaggagcaaatccacacagggccctgccagccatgttgatgttctgtttatcctaaatgcaatgggtggcactggagggctttaagcaggaaagaggtggagggaagaggaaaggacacaatggaatttacattgtgaaaagatcattctggctaaagtaaggagtacagacgggagggagttggaaagcttatgtgtaggccagttgagaggctgcaaaagtccaaggcaaaggtggaggtagcatggatgggccgaagtgaagagattagaaagatgtgtaagatgttaaatcaacaggacagggtgacagactggatctgagggtaaagaaggggaaagaattcttgttttcatgttttataacaagatggatagtggtggcacccatgggagacaggacactgtaagaggcccaagatgtcagagggagacaatgagtctggttttagacatggagatcaaagcctttggtatccaaaaagggccacgaggaagacagtgggtgcaatgattccagagctcactggagaggcctgggcttgagatggggatctgtggctcacctaaagagagacaagtggaggcataagtacgcatgatcctgccccagtgagatgacaggaaggcttgagactgagctctgaggagccctgacacttcatagcctgaaactgcataattggaatctcatcataagacaaacccaaagtgatggtcattccatgaagtaactgacctagagtcatcatctgtgtcaaggttatggaagtcaaggaaacgctaaggaagtgttcacattaaaggaaactaaagagacctgacaactagatgtaataggtgattctgaactagtacctttggctataaaggacctgattgagacaatgggtgaaacttgaacggggtcaaaggatttgaaggttataatgtatcagtgctaatttgctgatattgatggttgtattatgtatatgcaggagaatatccttgtatacagggattacacactaaagtattccaggtattggggcatgaggttggcaacttattctcagatgattgagaagaaaattaagtttatctgtactagtcttgttacttttctgtaagccagtgggcatgacccatgtgagaggtagagtgggttttagaagagaaggaataatccatggtgcacaggtcctgagaaggaagagttgaagcacaggaagtttgagaagaaatttaaaacagttgtcatgttgtgtgagaaaatgagtcaatcagagaattagaagattgccaagcatatttggggcccataacaggatggtgattatgaacaaaacaatgccgtgacttttaagcacattcgagaactgaaaaaaatgtagcatctaaaacagatttttaaggttgcgtgtatatccaacttactaagcaagtttatttctaataaaagataagctatactttatagtatctcttccccattaattttgagaaaaacgcaaatgattgtgaaggatattagaaaaatatagtttaaaactcacaaaactatgaaagtcagtttatgtatatgtatatgtgtgtataaaaaatatgcatatgcacacatacacatgtatatttcattttaattaaaaaacccaggttatttaaaatatcattattcaagtacttcaagaccaaaacagttgacatcagtaactgtttaactgaactaaactgaatttatttacaaattgtcactctcttgacaagatttgagcagtagaaaggggtaagagaaacaacggcataaaaatatcaaatccaaaagtattattagctagctgaaactcaattatgatataaagaaaaattccttttgaataccaaattttgtgaaacaatgggatacttatgaaagtgtaatttatatttattttcttttcagatctctaggtgaaggatgcctttatttcacacgtcttcatctgggatctataatgctcaaaagagattatgcctccagtttatttatttgcattatttcttttctattatataccaagtggtaacactcttggtctggttttcctgagatgcatatttgaaccaggacttgacttagctcagcaagcaactaacttcctgggatattgttgctgaagttttgtactatgtggttgtgtgtatgttctagacatacatgtatgaagtagttaaagttcttcttggcaaattggtggttgggggaggataagggttacaactatatctactgacttttagaggtatgccagatgtactgttcagtggaaaaaaatatgcatggtatgatgctatttccacaccaaaaagagaggaactccctataaatgtgtatccatgcatatgtacatctgtattagcaaagagaaagacgtggaaggataaatctgctattacttgttccacgacgatgggcaaatggagaggatgacagaagaaccacaggaatggttagagactcttcttatgcaaaagactatatatagaagttcatgtgtactatgtaaaactgttcataattttgttttcattatcacttacttctcttctgaagagttggaagatatatgttcctcctacctaatctgccaaggatggtcattttatcgctgattacctgatagggtttgtctcaaaatagtgtctttttgtgtcacaagggaagtacactgtgaaagggacttattgcacgtaagcatgtatgtcaaattcagcacatgctctacccatgaagaacacttcagttaattgactggctagcaaaattacatgcagagtacttgaaattacgtaggattccaaagaaaacccttccaagtagcttacatcacattttaccagttgtggttaccatttgtacagatcccttagaaagctataaaatgtgacccaaatgtaatttaaagccagaagtgttgaactgaagaagaatggtatatctcccccaatacacaaatcaagtagaatcctgcaaatagtgcccttctgggcatgagactgagtcatatgaaatttggctaaactcacaaccttgaaagtgaattagagaagagaaaaaattaaaagttggttttcaaactataagccactaagaggtaaaaatcaagaacttctatatttgatcaacggagtagaccaaaattgcccacttcaccttttcacatgacaatcatatggagtgtaatcacacacccaggttggaccaagggtggatattagaaacattttacattcacaactaaagtcattttgaaaacaatgaaaagaggccaaagttaagtctaacaaatgcttaagagttttctaacacagcccagacatctacctattcctgccctggcttcagcaagaattatcttcatacaagatcataaactaggaaactagttttcatttatgggtcaaagagcagtacaggggatccttctgcataaggccacagcagcaatttggaacaataataaaataaggaatcctttcttattacctatgtctatataaatattacatgcgtatacatttatattatgataatagctataatttattgactgcctactatgtgtcaggcactttgccaggtgctttaaatactttatgatacttactcctcaaacaactctgcgaggtaggcattgcctttcctgttttacagagcggggaacagattcagatctgcaatttgctccaagtcacccagctgttcaaaccaaaggctatcagattataaaagtccacgctctcttggctataccccaaggagtttgtgcatgttgatcactgagcttggaacaaatttaggctccagtctatggctacaaaacaaacaggagaggcaaagcgggtcttccatgaggcaagagctgcctcaggcaatcaggggagagtgctgctgagttttcctttagtccaaatgttccctctgttctcagattgttcagagaggactaattctccccaacaatgcttccagttcagtcctcacttgcaagcaaaactcaagagccccaaatttatagctttattctgaaaaaaaaaacaaaaaccagttttgctctcagtgggacccttcaaatttgttaagacctcctgccattttctttctccaaatccatcaccaaccaagtgagagacagagggtgattcattctttatctccaaattgacctagatagtagctccatataaataagacactcaagcctacagattttattaacttaatagtggttcttattcaagtattatttacttgctatggtgtccaatttggtcgccaccaacccacatggcttttgcacatatgaaatgtggccagtctgaattgagatgtgctgtaaagtgcatacatacaccagattttccagatttagtatgaaaacagggatgtaaaatatcttatcaacaagccaggcatggtggtgcatgcctatagtcccgactacttgggagattgaggtgggaagattccttgagcccagaactttgagaccagctgggcaacatagtgagaccatgtctcaaaaaaaaaaatcttattaactattattttatattggttacatgttgaaaccaaaatattttggatatgttacgttaaataagctgcattatcaaacttaatttcacctatttatttttattcattttaaggtagttactaggaaatttaaaattacatatgccacttccattatagttcaattggacagtcctggtctagaatgaaggcttgccaaagctatttaaagactgttaaagttctgtatcatacacaggctctttttgtttcagtttaatcctagaaggaagaaatgtgttgaaattgcagctatataaaatccttgatggactgaaactaagggggaaaaagaggaagcaggtgggtttgaaagaaggaaaaaaggagtatctagcattttcttttaaaaatgtcattcttgatttatttggtggcacaaagtgattttcttacgtttctcagactgcttgagtcagtctatatagaggctattcctggatcttagttgaaagctgttgcctttctaattgtttaactgatcacttctgaacgacaattacagttcattgttattccctgttaaaaaaccattgacatccatccaaaagttatagcttacaggtcagggaatatttatgtgatatttatagtctgtgaagaaaaccctggggaactgccagtagggaggattatttaccaatttctttttcttcaagtttgaatttatttgagatttatatccaaaagacattttgtaatcctgtgtaactctgatgtgtgactataattgtgcatgttggtcaagttcaaggaaaaaaaaaatcttttttctttttaatagtgggggctgggaaccctggttgattccactaaaaacatcacagaccaaaaaaaaaaaaaaaaaaaaaaatccactcaaggaagtagtgttacatacttgaagaattttctgaagttagccaagaaaaataagctacgatcaaggaggaaaagctggagtttcagttttctggagattgtacttcctggtaacataaaaacaaaagttaaattcagaaaaattcaactatgaagttagcatcacataaaaaacaatggaaaatatttaactatgcgcatatgtttgtacacaaacagaaatagatataaacagaccttaattagcattgtagactttaattatctttgtacagtaattgggaatggttttgttctgatttattccataatgcttactgtgttctgttaacaactcatttttttccccttccagcccataatagaaggcttttactgcatactttattacatctgcttctcatttaatgaccattgttctggtctgtcagagcgagtggctatacaacttcccaaatctgcaagattaagcaaatattttgacaatgtctagtttcttttttcctttttttcaaaacataccagataaaaataaaaagatttttacttacccacacaacgttaggagagtttttaatctaacgacaataaagaactaagcggcagcaaaatgtacttcatgtggcaaaatacatcaagcaattttctgtcccatttcacttaaaaagtcctaagaatctggtctgaatcacacagctggggttaatgggagcactcctggactgcagggaggttgtgggcccctgggcaaaccacgtggagaccttcaagcttctagaatgagacagaggccttctgctcattttggagggccccggcaggtaagctgaatgataggtgtctgaatcactcactatgaaatgtcatttttaaaaatggtcatgctacatacaaaattgcaataccactgatggcataaggaccagggtcataactctccccaaagaaggtggatacaaatacacaaacagaagcatttctaagcaactgggcagagagatacagagaaaagaggatacagcgaaaaatctattaacccataggcattcattaattctacaaatgatctaatggtgggaagcagaaaatacacaaataaaccaacaaaagcatgacatggacataaatgctaagagggaatggtatgtggaagatgctgcagtcagtggaatgagggaaaggggttaagaacagatgagctttcaagagacagtctatgcctttcagagtagtttaggaaaaaagttaccgaaagataactaggaacagaaaacaaggtgacagaaaggaccgcattaaccccagaagcataagcctcttaaaactttctggtggggagcctctccttggaggcagcaaccagggaaaattcccgcaaggaggtcctacgggagcagccagaattctactagaaagacaggaaagacatgacagggatgggtctgtaggagagcatcggcaaagatagcaagaggatgcaatcctctttagaggaagtagaggtttgccttgttgctattagattgcttcacatctccattggtttgcgtttactatagggcggaaagcacaaagcaggatatgtatgtgcttcaggaagcttaagtgcaaggcaatggggttcatttgtgagctactggcaaaccatttgtatttggggtgggcgtcccgtgcagcacgcctctggaacagtcccttcactgttaacaccactgactgggcccttaattggagcaggtctgcgcgttttaataaacatctttgatgagttctctggactgttccattaaacactcattctaccaaaaatgcctggtaattctctctaaaaatgttttcatgttaccgcttccaggtctttctaaagttaggcagtacaaagaaacaaaaatccaaaagacttgactttaatttagaagtctcaaagagagtgttcaccctagagcagagatttctaaagttgtagtattggactcgcttgcctccacccccacccctgcccttctcccaaaacaagaaaacaaagcagcatcaaagcttgaggtacagaacagaataaaacatgttggtgcagatttgctggcctcggtgaaaacaacctgaatcagtaggtcttggggtatcttcacttttaacaaacactacaggggattttgatgcagtcagttcaggaattaaattttgaaacacacttttgtcaggcggcaacagggtagatagcttaagaatggggtaggaagctagactataggaattcaaatcctagctcctctacttcctagctgtgtgaccttaggaaataaacactctgtgcttcagtctccttatcttcaaaatgggataatgggagcaatgtgtaagaattgaaaaatatgtaaagtacttagtactgtgccagacatgtcgtaagtgcatgaaaaatgttagccactattaacagtggattcatcccaaagtgatttcagctaatgagccaaatttgggtagaggaagtacgctgaagcagattccaaccaaaccaatgaatgaatacagctaagcataaaatagaatccttattaggtatcctcccaccatcatttcagtacggtcagcaccagtctataagctgtacagacatcctatacaatatcaatctcctgtagcacaatatatcctaacaatcctcttgggcacagacgcagccacagggcaggagacaaagcaacagaaccagcaagcacgcactctgctgcctcacttcatgggaatcccattcaacaccagtctaggaagagatgaccttggaatgcagatccagttaattcaattcaatgagcatttattgaacccttgtgatgtatcagagattcacctagatgctgaggataatacaaagagcaacaagaaaatcaccctgtcctcaaggaggtcataatctagtgggaaaaagagatacaagtaattgtaaggcaaggtggcctgagatgaatgctataatagaagatggaagaaggccatgcgaacacagagtaagtagtaattaactctgatgggggcagtcaggaaaggctttcctgaagagcagacatagcatgccattgtgagagatcaataaggcaagcctatgaaattgtttaatgactttatcattcatggaaacaacccagaaaaagcctgagggaccatctctgtctctgcattaacatgggtgtgtttaagatttgattaaatgtttgttgtttctgtaacatcgcatttaaaaaaaaaccaagtatgaacattcgtctattattctgatcttcttcaaagagagaaagagtcctagaaatacttttcttttttccaaagcaaaccctctgcattaatagcaaaagaagaatggcaagttatcgaacgtattatgaactagttagccaaagcgcaagtctgggaaggcccacatttgttttatgtagcaatgagacaaaatatgagagtttttttcttcttatatatggttgcctctttctacttgactataatcattaataatttctttggaccagcagaggaaacaggtattgatcacaataaaacattgcatccacaaacacttgctatagcaggttatggtctccatggaaaccctccaatagaaccaatctgaattcaatttcagaagtaatgagaacagataattttacactcaatcaatcactgtcagctgccgttatcagccaatcagtcattatgtcagtcagtcacactctcaacaaacttcttctgtggcatggtcagatgagaatgttttgacatccagaagcaacacgagaaaattggctcatctttcctggcaagatgccaaagacacagcactgcattgtgtttgctaaggcaataaacagtccaatcaaaatacactgtggtagcggaagattctaggcagcaatttcaataattgttatgatactgatggcagagacgtactttcgacccaaaagtcatacagtttaatcctctcatttaaacatgaagaaacagagcaccagagaagttcaagtatctgcccaaagctgcacagctaactggtggaaagcccacgactaaaacatgagcattctccccttccagtgctcatccaggatgccttgctgctgctcttcactgccttcctttttgaggcaagagggtaaagggatatttgaagattaggttctaattctaaacagagagccccaagcctgtgggagactcacgggatatttgtgaggcttgtgctttggagccaactcaaacctcttgctgtttggggttagctcgtccttggccaagtacaacttctggtttctaaggaggaacaaaagattttgaaacactacagggcaaccaaatcactgttacaaaatgacattttcgataagtttagtgcaggactatcaagaacacatggactgaattccctaaaaatgcttgggagagggaggtaaaatttgaggggaaaaatctggcaaaatacagttgggctcttgtcaacctcaaatgttagaaatgttggcatttgggaattgtgaagaatctgaaaggtgtctggtttctttcttttttctttttactgcattattgctttgtccatttctcagagacagttctctgaggctgaggttcacattcttccttggtaaaacagatggttgggaggccgaggcaggcagatcacgaggtcatgagttcgaggcaggcagatcacgaggtcaggagttcgagaccagcctgaccaacatggtgaaacctgtctctactaagaaaatacaaaaattagctgggtgtggtggtgcacacctgtaatcccagctactcaggaagctgaggcaggcgaatcacttgaacctgggaggtggacgttacagtgagccaagattgcaccactgtactccagcctgggcgacagagtgagactctgtctcaaaaaaaaaaaaaaaaaaatagatggaccagcttgatagtttgcaaacttcaatgtgcatgggaacttaccaaatctgttaaaaatgcaaatccccagatcccacctccagacattttcattcagcaggtgaggctgggcccaggaatctgcctttttaacaaaggacccaggtaattctgatgcactttctttgccaatcagtgttagaaaacattggttaactaatgctatttggtaaagaatttgggccattttgttgatggtagttttccaattacattcctccccaaacattccaacttcgtaaattgtgtgtatcacccatattacaagaacataattctaatggctatgatcacaagctttgatatatatatatatatatatatatatatatatatatatatatatatatataaaatatatgaaatatacattatagtgccactttctattagctgtaagtaggctttatcttaaataggtaggtggtatatgggacactaatacatcccatcagaatttgtctaaggcaaatgaggtgaaaaagcaaagcaagaatatgggttcaggcttgagctaaaactagtaattgcaaaaagaacagtttggaagctttcacatgaaatgcttgcttcatttctctagtctgcttgcctgacctcagctcacgatacctattttatcttctcgcaaaacattgatataaagctttttgcctgtttctacatgtaatactgatcttttccctccatttccttccgggctttatttttttttctttttctgatgcatttcaggacatttgatgagtcttggagtgtgtttaaatgatgacaagcatgtgatgtgtacactaggtagaccgtacaccctatgaggacaaatacagttctttttttgccatttcatcccctgaacgtgtcacagtacctggcacaaagcacttaaaaatattcatcgaataaataaaatgaatgaaaggatggatggatggattacagacaagtaaaaactcatccatctggaggctgaatgaatgcagatacttcaaaagatctatactttatagtcataatcaataatcactcattttttcaaaggttgtttttattgataaaactcttggttaggtgttgttgaccccacagaaaccaaaagcaactatagtattttgtaattatgccttcctttgtaaaaccagctatcatatagatttttctttgccaggcttatttcattgttgttttgactgaaatggaaatattactggaagctaaaataactcatagacattgggtgaaccataggggagacagtcaggaatggggagatggaaaaaaaacccaaaactcaccagtgcaatcagcaacagatcctccagaagcctgtaaaaattaagacaacttttaaaactctctttgcctgtcatcactacacacatcccaggctcacagtctttctgcatcatgcagatgacagaggtaacccttaggaagcttaacttatctcactggtaggtttcacagcctcatgccagtgacgtcacagaaaacaactttaaatcttccatgaaacaagcaaactggaggagagatgaattcaatgagctatcagaggtgctttccatcctattagaaaaaaggaggaaagcaggaaggaaggcagtaagaaaaggaggagaaattaacatttgtcgagcatccattgacaaccaggcgccacactaaactcttcatattttatctcatttgaagcttattatatttccagggggtggaaattcattggttcattttattttattcatttatttactttatttattttagagacagctctcactttgtcatccaggctggagtgcactggcacaatcatagctcactgcagcctcgaactcctgggcttaagggatcttcctgcctcacattcccaaagtgctggaattacaggcgcgagccaccatgcccagctagtatgttcattttatagatgagggaaatagggctcagagaggttcatccccatgccccaacagctaatgaacaataaagctgggactaaagtaatagcaaatatttactaaggacttaacgtcagtcagtttcatgtgtgttaactattaattcattgaatcctccttttaatcttatgaggtaggtacctctatgcccttttcagaggtcacagaacaaacacagagaggttaaataacttgcccaaggagtcacagctgatacatagcagagctggggctggaacctgcgtgatcagcatcagaccctcgtctcttaactaccacactcagccattctctacaatagcgtctaggttggcctttttccaaaggctaaatcctttccggaatacaactttgattttatgtttctagagaaaacaaaaaaggcatacctcaacaatagcctattagacttttccaagcatgacaaatcatgtgtatttgttatatatacagataggctatgtggtcttaattaaggtgaccatataatttattgtccaaaccatgaaagaaggtgctatcaataattatccagggacaacagtggtaacctggaactgttccaagatggcaagggtgcctggtcaccctagtcctaatgaataaatacacacacacacacatacacacaaacacacaaacacacaattagatatcgttactttcagacacattctgatactacccgctggagtacggatgtgtagttaaatgctttctaacactgtgtgagcccaccctcctcccacctcaagagctgctagccctttctttacctaatgcatttcttttaacttgttttctcacaaaagactgtacgtaattggtcagccatgagagattaatttgtgcttagctggctgagcggacacaagataactcaatagcggatgatgccagtgcatgaaccagcagcttctctcgataagccttcctacctactcgggacctcgtccctccatagcctgcttctttgggaattgccagccaagtcctttactttatttacctcatttttgcctgcctggagaaattcaaacttgcagtttttaagtttcttcatgggccatttttcttacggaaatagaaacagtagcaaagacacccagactctccccttctaaagcaatgcatcaaagagtgcactggggtatgtggatagcagagaaactgagcaagggcaagtttatgcatatccttcatcctgctcacattgtttataactgcagtcagacacagacagcaggctgagagtgatggacatggcgatgacaatggcgatgatggtgatgggaagacttctaagaacttaaaaagcgttttacacagatgatctcatctaatgctatctcagccctaggtggtgggtgcaattatcattcccattttagagatggaaaaacagatatttacagagggcaaacattctgccccacgtccaatctaggtaacttaacctcagagctaacactctaacccacagggcctggacattcaaatgcacaagtcaaccacagatgacagagtacaggacaaattggactggagagatccatgcctcccaactcctcatctcacagatgagaactccagttcagtccttttgcctcctccagaaaatacttacctgtcaagaactttgtaaaaatgaaatgagagaaggttaaaaacataaccaagaagtgctacataaatgttttctactgtcactagaccagcccttaaacgctatttcagaatgtattactctaatagagtaatttttaaatacctggacatcagagctaattggacatcagacattggagctaattccacctaaccatagaaatgcactgtggcctgggtttatgcctgtcatacagttccctcccacggcaggtacatttgccacatcccaatacactgccagtaaagataaagtaccttctaatatacttataaaagcacagagtgcaggggctagggactatagaagaaggcaggaggcaaggaagcaaagggttttatttttttttaatgtccccaactcctctaacctggtccctttgctttgtttggctggtacgacaggtggtgactcttaagcactgtgtagcctgctcttgtgtccagattatcccaagcagtctgaaacttcaagagaatttgcagtaatgcacaagtcaggatttggttcccagagcaaagctgtgctcaaaggattggacatcagaaacaaacctaaaaagagccacaaacacggaccccaggctcctcccaccccctccctaactcacctgtagggtttaaagagattccattttaatgaagcaggatgggcataacacttgggaaggaaaggaaatctggcctaccccaaagcaattagcttcctctgctaggaagagactgtgcttgtgtcctgaggtttttatttcatttttcctcaaggggatgggaagttcgctggtctaagattcatgcctttcagactgctcctcaagtgaggaggccacgtggccctgtaacccaaatgccaggcccttggtatcaccttctgctcctctcagagacaccttgatgtcaccttccgctcctctcagagtcactctgccgagtcgccctgtgatgaggacattatctggacctgtgctaatacagtggctaccagccacctgtggccaccgagcacttgaacctggccagtcccaactgaaatgtgctgtcagtgcaaaatccacacctgagttggaagtgaataaaaatatctcaatttttttacatgaattacacattaaaattgtactattttggatatattgagttaaaaaatgtatctccaaaattaattccacctttttcttttcaattcttaaaaaacatggtcacacaaatatttaacactgtgtctgtgcttatcatatatacgctatatttccactggacagcactgttctagacactcatcaggtatgattgctccatttcccagcagcatgtgtatcaaccaggagcctgctagaaatacagaatctcaggccccatcccagacctactgaatcataatctgcattttcagagatccccaggtaatctgcatgcacattaaagtctgtgaagcactgccctggggtctaaaacattacttggcacacaagaggcacttgagaaatatttgttgaatgaataaatgagttatgtctaggaagctgctgtacttgggggcactcgggaaaatgtgaagggctgtccctggctttctccttagctcagttaatattgatatactcatcagattaatcacctttcattttagtagctgatacggtttggctgtgtctccacccacatctcatcttgaattgtagctcccataattcccacatgtccagggagggaccaggtgggaggtaattgaatcatgggggtgggtctttcccatgctgttctcatgatagtgaataagtctcaccagatctgatggttttctaaaggggagttcccctgcatatgcttgcctgccgccatgtaagatgtgactttgctcctcattcaccttccgccatggttgtgagtcctccccagccatgtggaactgtgagtcaattaaacctctttcctttatacagcactcagtctcgggaatacctgggttataaacagacctccggctgaatgttaagcactttaatgactgagaagctggggagtatggggcagcatctttcaattgctgcgctgaagtaaaaaggctgagacaaggacagaaggtggggaaggtgagtactctgaggcacccaagctgcatagcactgcttgtgctgggatcacaaggtgcccagatcatccaaggggtgtaccaggtatagaggggagaagaagaccctagaacaggtcagacagtgcagagaatgagggcaggccctggccaggagtcagggagaggctgggcctcaaggcatactgcagtgtccagcaaatcaaaaatctgacaagggactggcctacatccctactccccattccattcctttctagacctaaaatctcaacacaaacggaatgtctgatcactttagctataaaaacacataaagccatatttttcccccttaaatcagaagcaaatgctaagggaaaaggacttcgtggcatgcagagaacaacaggcacaactattgtctctgtctcctggcagtctcccccagacatctgcaacccccactgcaacaacctcagaccagaacaagagagggctggaaggtcggtggggagcagagagaaaagaaagcaaggactgagaaatccggggacaggatagatcaacggagaaaaggggaggaagtgagaggaagcagttaggtctcagaagttccaccagaagctacatgtgtgcatgggagagggaaaggagggcaggggaggtagtggagagaaatatgaaggtatgtcttaaataaatttcccttttaattagcatgaggaaaaagaggaatctacgtctggctggagggcactgtacacacaggatggcccttgtgcaaactcaacttccttcaccccattctggcaaaacatggtcagctctttctcagctttgataattgtcctagggaatagtctccgccaggagaggtggtggggagacagccagcaggtttctattagccaataagcctctcacaaaggggaaggtggtcgtgggcacatggaactgagtgtcgcaatcatcctgctgccaccatgctggagcagcttagagatccacctgagtgagccagaggcgagccgcaggaagggtactgcagagatgttcatgcaaatgcagggtgatccccaggtccctataccaagcagcaaggtgcctctgacaaatgttgcttaatattttttaagcaaatcaacaaaccccagctggactgggtggaatattacacagcaggatccaggactgaactgaggaaagggagctagaattgataacagatgccaacaggccttcaacagagagggaaaaaacagccttcaacagagagggaagaaacagcctcctctggtgtcaacctgaagtaaggttcttttgacttcgaggctgctctgatgaaaaacgaggactcttggaggtattcagagccagcctcctgccaaacagcatactttgtcaaagtggaattgatatttgcaagctcaaggcccttcttggagagcatcttttgctcgaaatggctgcctcggagttctcaaccgctgaggcagctctacctagtccttcatttcttaccttgactggggcaaccagccgttccacagccacctctggtgtgaaacctataaggattctctctttttattctagaaggggtctgggtctctggcatgctgagcggccttcaaaaccacagagggccttctttgatgccatggatgagtgggttctgaccgtccttatgcccagcatccagggatttgcactagctctcttcaggtcacctggcacatggcctgggccccctgcagaagcccttgccacacaggattaggaaataagacagactgaccaggggactgatttgtgttcccttactctcaaacgatttcaaaaggaagaccagttttctcattctatactcacatttttcctgaagaggaaagcaacaggacttgggtttttgcaagtgggagggcataaaatgcattaacaccatagaagtgcctctagagggcttggtaattacagcctcaatgtgttctctaccttcttaaaagggcaaatggaacttctccttggagtgtctcttcccttgttcttgagacataaatcaggataaaggtgtcgagaatggtaaaacaaaaacaaaaacaaaaacaaaattcaatgaaaaatctgaagcatcactcattttgcggtattgttccatttttaaaatgactgtttaacatttttccccttttttggcatctgatagtacacataaaattccaatcctttattgcccccaaattatttatatatgcaatagacccagaaagagaagcagaggaagtgaagtgtggtcctccggccatgactttttgccttggttttcccagctattaaaagggagatatcatcattcattcaacaagcatttcttgcggacccattttccacgacagaaccatccaaaccaagacacttcttcctattgtggcaaaaatgagcaacgttaaaactccccagaatgcagaggtgactcacgtgtttatgtaagtaagcatttagatatggctttggaaaagaaaacacacacctaaaagaggctaccagcatttgaataaagtgtgtaacctgggtgttcaaaactgtacaacagtttctgtgtactttaagtcactatccttcatacttcttccctttaaattctatttgaaactaaataatatcaacaatactttaagtaagattatgctggtgttactgatgaaattatatgcaggtctgcttggcctgttctcatgcgtaagcctttgataacttgttcctaggttatccagttctgcttacctgagtacccactttatcccaggaaacgagacctgaacactgtgtcctggtttcatctttccagtgagccaggccttctgaggcattagcggctcagcaagaccatggaggtgagagaggcacaggcacactccagatgcagggtctctgccctctgtcaagagtcacacggcagagaggacaagactcctgtcccgggggaactgtttttccttttgccccacaccccagatatcttcgtgacagcccctgccctgaaagcccggtgagcgtcatggcggagaagccagcctgtttccgattattctgcctgacagggactatctgctgctgtgtgcagttgtagaaatgtcataagctcaggactcaggacactttgacgtcgagtccaacaggacccatagagtccccctgaacaattctcatctgtgtgggaagcctaaggggtggttttaagtaggggctggcaggagagtgaggtctgggctgcttctttacggctcttcaagtgccggccatttcctggagtttcatgggagtcaagacttacttttggcctcagacacagtcaaggatcatcctgatgcaaaaaacaaaatcacctttgaacctcttcctccacaccatcttccactttggttttccgctatgcctttgtactggggacaaagactatccacgaatccttactttaaaaactgaggcagtggctctgaatcattcccccttggacacccccacacatctgaacaccctcgtgtcccaacaccacatctgctgaagttgactggacctgaaatgctggaggctcagtgttttcggaaactgcggagagttctcctgccacaattctcttgttgtcgtcaaaagcaattacatgtttcagatgatgaaaagcactgtcatgaaaagctggcacagcagccaaggagacagatgtattaaaccacacggcttctcagaactcccacttacgttggagctcagcacagagatgagcatggtgatatccccccgtctaacatcctcccatttggatttaatgcatgaggctcgtttctgatgaggtgccaaattctttcggtggacaaacacaaagttgcagaattcagtgatcatacaagtccatgtcctcaaacgaaaataataatactataaatgcaaagatgctaccataaaaaatacagtaggtggacttttgtgagtcaacataaaaaaatccagcatttctaactggtagcatgaggagtaccagtctgcaggatgttaacgcactgataggctatggacaatatattccacacttacggaagtggggaaactataggtcagacaaagctacaggtacttctttctttcttttttctttttttctttctgagatggagtctccctctgtcgcctaggctggagtgcaatggcatgatctcagctcactgcaacctccgcctcccgggttcaagtgattctcctgcctcagcctcctgagtcgctgggattataggcgcacaccaccacacccggctaatttttcatatttttagtagaaacgaggtttcactgtgttagccagaatggtctcgaactcctgacctagtgatctgcctgcctcagcctcccaaagtgctgggattacaggtgtgagccacggcactcggcccaagtacttcttaactgcaggacttctcagaggcttttaatatggtaatgagtgctgtgcagtgagatgactcaaatcaatatatagccaacacgtttgatatgaccacagaacccatttccctgaacactttttatcacctcctagagcaggggtcagaaaactactgcccatgtggtctgatctggccactgcttgttttcgtaaattttcactgcccacagccaacctcatttgtgtacatgccgtccatggctgctttcacactgcagccgcagcgatgagtcatgagacacgcacccgtggctcacaaagtctaaaatatttactctttggccctttacggaaaacgtgtacaaactttgtcctctgaaatatagtttgggaacctacttcactcatgatatcaataattctaaaaaatttcaaacaatttttaaagtcaacattgagaagttttccatggttagaatttaataattacagtcaataactctcttaaagcatcgtgacaataaagtagaaggacactgtgtaattctatatggtctctgtcttcagggagctcccaagctagtttgtgaaaaagagaactcaaggcacaaacaactggggggcaagagatgttctaaacactaagaggaggcaatatggcatagtagaaagaatgcaagcatgtgtaagagtaaaacatacacagggcgcagagtcacaagagtcaggggttggtcttggctgtgataccttctcctgcgataagagtaagacctgctttattgagcacttactatgtgccaggcaccatcccagttgctttccatgaaggattgctctttaattcttatcataatgaataggtactattattatcccagtttatgggtgaggaaaccaagtcttaggttgactaacttattaaaataaagcacatacctagtaggtggtgaacaagagccaaaacaagtctgttggtcagctaaccaccacgttatagtggctgctgcttaggggcagcatatatcctctgcatttccccagaggtgacagaagtagtggagagggtagtgctctctaggctctgacacacagcccatgtttgctgactcaacaaccacacaacgtaatgctatggcacctcaggtggcagggagggtatcgtgggctggactgatcttcagaaggctgcatctgagcagggtgtggaaggatggcagaaggaagaggggagtgaggcactcagggtagacagaaggtgatactgccacatcctccactcagaaggaatctggaaggttttgacaaatatgtacattttggagtgggaacagcagaaagtaggggctggctacctactttccactacccctatccccactccccctagggggtgaggcagagataagcacgctttgtggggcacactgatccacaaacttgcaagcctgagctccactcagcagcagcctgggcaggatgaatggtggtgtgcaggtgtttgcggcatgcatagcttctctttctcctagagtcaatccagtgatcccctgcgaaaagaatcctccacttgacctgaatgctctgtattggcaccttctggacaggaatcctatcgggtatttcatcaaagcatcccacagcagttttaagtgtggctccatgagagtaagacaccaggacagctgtgccacctagtgatgcttgcctgtactgtctgcatcccagagagtgggagaggcttcggaaaggactggtatttgctatttttggccaacacttctacatgcaaaggaatctgaagtctccgcctgggcttcaaaacatttcttgtggcctcactgaccattcccgtgagcctcaggggacatgagtgtcttcaagctaagagggagcagtccaactctgcagcacgaattaccaaggaacatacaacagacacttcccctcctccatttctgcctttcagcagaaagggagggtgcacctcctcttacatcctattgtggctgcaataacctgcttgctttcttgtgcagcctggaagtcttatgcacacagcacctgctgctttctaaactaaatagaaatgctatcgtctgcagtcagaaacagaaaagacagaggatgcctggtgaggatctgtcctacatcccagagtgcaagagttaaaggtgctaaccattagtgttatgtgggtgcagcttatgcacacagagaatgatcagtgttttcatttaataggaactctcctccactcccaaacacagcagtggagggaaaggccttttaagccttattaaggttgaggaaaaactctggtgaaattatactacatatttttgtttctttctctatttcagattccttgcaagaggtccactggaaagctagaattctagaagtcaggatgggaaagcctcatacgtaatgcttttgctcctttgaattacagttaactccagtggtgccactgacactgctttcgcgtagtggttctagtatcgtacgatgctgatacaagtaagctatggctatgtgttttccgtaagaaaggaaaacatcactccaggagagaaatggaggatgaatgatatttatcagattgtagcttctgaaaatggatttgctttaccagatcaaagacagcctgtttctacacatcaccaattctgtgggaaacattccagatattctgagagcgcattttgagactgagtagttggttccctcactgactgtttctactgtaagtaatagtatatttccatgcactcttgattggtattatacagttcatcaataagacaaaagcagaaaagaggtacaaagagaccaacagggaagaaagacgcgaagatgaaaacttcagcagcatgccacgtacagttggcttggatgtaccctgcacaaaagtgtccagcctgtacctcgctgacctagctgttcgccggtacaagattaaggaagtgacagcttttcctaattcactgaaagtgctttgggactaaattgtagcacagtataagtaaagtatcctaaggggaaaagaaaactccatattcatgatccttaatctattttattgattaaagatttagccaaatacatcactcctgcttttgtccctgtaacaaccaatgctgtgttatcaggaagagataaaaccagacctgatcggagctactcaatcacttggtcctgaatcactcgcttttcacccaaagtcaacagtcttgattcctcatattttaaggtgttcattgtaatgtactgttactgtttgcatacagctgtcagctgcaaaaacatttttttttttgaacacaaaaatcaggcttttgccccccaacacccacccccttcccgggagactccatggtagcctactgactcacactgacaaaaaggacaaaggccctgggttgtctctgccgcctgcctgtccagatgtaattaggcctcacacaggtaaccccttgggcagcagagaaagctcagcgagaaggcacggggttgtgaatacagtttcacgatgatttccatggctgccatgaaggctctgatcagctacaaatgggcagatgccaggatgaccctcctgatttcctggtccctcctggacctggatctggatctggatctggtgtccagggaagagcaaagaccaggagaaagaggtagaatcccagcaacaaagcctgggtatgcggtctttgagaatgcctcaagaaaacaaattcttgcttctcccttttcaaggggctacagggagacgacacagctgatgggtatttttgtagccagatatcaagtagtgttaacgttgggcataggttcaaacaaatgtgctccgttaagaatctacacagcatgaagagtgtttagacttcatgatatatatatatataaacattcttcagggagggtttccttcagaaaattcaatactcaaggaaaaggagttagggacagtttattttggttattttctttgtttgttttctccaaagctatttcttgaaaaaggaatcctttcaaagtaaataaaggaatcctttcaaagtaaaatagactacattacatttttatcccaaagctgctgggtggtaggtgtgacttggaaaactgtagtttgtttcaagcaaatccacttggattgagcatgaaggaaaataaaattaaaggatgatgacgaataaatggaaatgtttaaggatcactttggccagcatcttcatacttaattgttgcttttacatgtatgtagtttttcctgaacacaagaggaaacgtatggtaatgtgaggaacagaaagaataagatgggaaactaaacatttgaaaagaactttcattttctgaaaaaaaaaaaaaatgttctcccatagatgcaacagaattaatcttcattagttagcacagctatactcttcttcttaaatgtctcaaatgatactgtgacttcccttagagaggaggaaatcagaggacagcaggaataattaagacagtagggctaggggcatagcaacaggattggaacccaaagcccctggatttctcatcctcactgaggcacaagaaacatcaggccttttgatttaggctccaagcaataattagcatctaataaggtcccttcaatgaggatttttacatttatttcctatcactagtatattattttagatactctaattacttttgaggtgctggtggtatatgaataatataggtaaatgacactacgagacaaggcactgtttgtaaatggccaaattctttgggctgtactaatcaaacaatggttgactctccctttaactttcatcatgcatttaaaacagtttttttttgttttttgttttttgttttttttttttttggtgggggagcagtgaggcagcgtctcactctgttgcccaggctggagtgcaggggtgagatcacggctccgtgtagcttccacctcctgagctcaatcaatcctcccacctcagcttcctgaatagctgggactacaggtgcacaccaccacgtctggctaatttttgtatttttagtagagacagggtttcactatgttgcccagactggtctcgaactcctgggctcaagggatccacctgccttggcttcccaaagtgctgggattataggtgtgagccaccgtgcccggcctaaaacacagtcttgaacttatctggttaagtacaaggtgctaaaggtgccacttgaccatcctaagcctcctcttcttttccccatttctcactttttaaaaattcgaatttattttttggtgtaaagcttaatagcatgggttttaacgtttttgagggctgcttttcattcagaattttcaccactcttcatcgcagcagttcctggagtaagcatggcttcactaagggaccgaggccacagtgagaattaatatttattttttggctaatgtttacagagtgccttaagctgttcagcaaaaatcacttattttcccaaagaaaacacactcatctcacttctctaccgtctctcccgcccctacaatgccttgcaggtgtgtcaggttctttaggtgttttcgatgttcaggtcctgtgccaggccattattaggcccaccctacaaaatgactttagcaaaacggaggctgcttcaaaaattccagctggtttttcaaagtaatactaagcaaaagtacacaggcagaaaaatgtgatcatcctgaacttttatcacacatcaaaatttccctcctatatttttagaaccatttcagtgaaaagtgtagaatggcatcgctaatgtttataggcaaagaacagaatcattaggatttgagacacgttttcagaaaagtgcctttaaataattaacgtcatgacactcttcctcagttcttcatccagcagagtaaatgtctcttgacaggtaatagtcctttatgtgaagcagtaactccagtttggtcaaggtaactagtgttattgaaaagcatgctttaattaaatgcaatgtcttagaaaaccatgctgtttacaagcaataaacaactcttaaatattcaattaatcagctatcaacccaaattcataaaagacccacatactacttctatgctttaaaaaggaaaagagacatattaagaatgaaagcagattaaagaaaagagctaatcaaaaaataagaaaccaggaaatgacattgtcaatagtgagcacccgttttggagtgtgcgctatgaatttgctggctccgacagtaagtattcctacatgggctttctcatttagcactaccctaaatcctgtgaggtggttattggcatccttccattagatgaagaagctgaggttcagagacgttaagcatcttgtccaaaggcagttgctcttaaatggaaaaactaaaattcctatctggaactctctgaatcccatgctccttccactattcacagtgcctctcaaacagaagaaagtaaaaaaggggagaaactgaagaagtcaaaacccaggattattcagaagtacggaattaaccatattttgggtaaatatgtgttttccagccattggatcaaccatgatgtgattcaaactggcttttatgaaagccaaagataccagatggaccatccttcaatctggtgtttttgtcatctaaacatggttctagaaatcaaaacaaatagaaacatgaaaagcatttttttaaaatatgggcaatctctattctagaataaaggcaaagaatgaaaaaataattatcaaaaccattcctagaatagacagggcctattttaacatttaaaaaggcagacacccgtccagtttccttccgcaaatagtcaccaatcactacttctgctgagtacagataaaaatacctgatgtggttttccaaagggcttctcacagtatttggcctattcaacctttgcatctgccttccctcttggctcctgacttttgtcagctgtaccatgaaaaggcgatgcctttaatgatctacatttgacaagactggaaattaaccttttagtgaatctttcacattcaatgtgaaacaacagaaccggtggtgatgtgacatttttggtaggtgcgtacctcaaaggcgcctgccttcaagatctccctgaacacccaagggtatctcaggctgccaggtctccttagactcgacaggcgaagggagagagaggaagggagagagaggaagcctgggcaagctcttggaacatctacataaaatgaaggtattcaaagctgcttctatttagctcctatgcacttcattatacctggctttttaatattctagtataaaagagaaatacaggaaagagtcagaatattgtttcttattgtcaagccccccaatgcagaaatacacaaacatttgacttttatgccccacactcacacgtgatctttctgccagcatttctgggaatgatcatgtttagaatttctgctgggaaggcaagcgccttcagcatttctttagatgtcatgaagcatttttaaactgaaagcacatgaaatttggagtcagctcataacactgacatgtcatagtgaaagtaacaacaaatacttacttgtctctaaggtaccatctttcttgcacccccacactcagtgtgtaatgaccacctctgagacacagacatctatagaaacttcttgtttctttgtctctttcgtttctcctcaacacagggaagcaaggggaggagaaaccatggaaaagtgctagcctttgtacagggccaccatcaagatccagcacttaaccctgagcaccccactcatacttactggagagcaatgataaatctaagtagatggcttgaaactctaggacttctaaaatctctctcttcattcaggaatccatcctcctggaaaaaagaccactacggatggggaagtttgaaggacaggcatttagacctgaaaggcatttaagaggagattcagcaaaagatcctgtgggactaaggattttgcgagtcattcttacatgagtgtggcttgctgctgactgagtaggatgttttctgctgctcagtcctcgccccttacaggcttgagtagttggggaggcctcctgaaagaggaaggactttaatcagactgtgatgagggcagggggtcccctggtagggaggggagcaagagcaaaggaggagataagaacccgcaaggtgttgtgagattgtgaggaaaaagcactagtagaaaggtgacttttagatgagggaaatatagatcagaaaggcagggtgtcgccaggcagaagaaagctagagttttggagttcttccatggggagcttctgagccactcttggcacccttaaccattggatgagtgaatgtgcaggcggtgccagttcaggaggaagaaggaaatgttttagggaacattaatcttactacagggtcctggataactttgaaggaagtcagctcaggggtgaagaaatcagcttagaaagcaaggaacttagcccaagtaggaggtattaaggccctgggttcaggtctgtgatagaagtaagcaaaaggggtaatctgaagaacgtcaggaaagttacagactaattgaatatcaaagggtgagttggggaggacagaacaaaattgctgataactaagcctttgtgctggagtgagaagaagaatgatgccagtgttcacagagccaggggattcaggagaccctctgtctagggcctagcactttgtatcttaaccagatagaacacactgtatcatcacactgtatcataacgtggcagtgctgctcattccactgtaaactaggcaaggacaacgtctctatgttatcggcctttctatgtttaagcatccaaagcccaacgcctaacacaaaaggggtggtcagtaaatacctgttgtacgaggcaggtttcattttggaggaagatgaggtagtcatctgtaaaatatggtgaatttacggtgataaagcatttccacaggcatgataaatgttgaaattttggagagtgaggtcatctttgatttcttccttaattactaactacctctgccgttcctctaatagtgcacaaatactcctgcatcttcctcctaatgtctatcagtcatggcctttcctttccaatgggcagagggatgttacagctctgaagacagattatagtctcctacagagagtgcagagagaagataagaaagccagtggctgagcctcaggggatgcccctatgtaggcagaggaggaaaaagaggaatgtcattcccagttgctgtaatagagtcaaaacaaccaagatccttgcctactgagagaaacataagatgtaggccaatggggccatgtgtagatgatctcaggtatcagatgttcactgcacaccttagagtgatgtttattcaactgtagataatatttaattgttactctttgaaagatagttcactttaagttccctgagtagcatagagttattcaaatgtacctatttattacaagaccattgtataaggaattatgaatgtttctggaagaatagggatttgtagaaatcttccttgctccatacaaaatctgctttgagatacgttattgccatttctatcaacagaatctttcctcccagtaggaaattagagcccaggatttcctgctatttatgagttataataaaagattcttcttctcaatttttttttaatgtgtcctgtccctaaatagggctcagcctgaaagctgggaaaaggacagatggtatcaaggagaaaaatgacagtgaattcaaagttcccgttttggcagccaatcactctaatcaagaaaaagggatttggttactttcaataataaaataattcttaaaatgtaaaggatggaaaaaatgtaaaggatgaattaaaacagttccacacgaagaagaagaagaagaagaagaagaacaagaagaagaagaagaagaagaagaagaggaagaggaagaggaagaggaagaggaagaagaagaagaagaagaagaagaagaagaagaagaagaagaagaagaagaagaagaagaaagcctttctgacaagcaccacccaactactagttccatggaggtggaggggtttccgtattatttgatttatcttcattgcctagagcacaatgtggttccagatctcagtcaaacccaggaaatgaatagattgtaaactaaatcctttcagggagagacagagttcacacttctcaggatctccaccacgcctagtatcctgctgggccaaagtgcgtgcctggcaaacatgtccctggtacttggacatctctttcccgcgttcctcttggctctccttccttccactactcattctgctcctgggagagttaatgcattgcaggaacccttcttccaggcctggtttcaggtggctgtcatgacagcaccccctgagagcaggcacttgccatgggtgcctttcaggtacacctcagggtaggggtcgggggcaagggtgaccgtgaggttcacagcaggggatgaagtgaggagaccccatccaggtaaataacacctctcctgactcccaaccaatgtgagctgctcagggaaactgtggaccccctcactggggtgaggttctagctttctcatgccaaggactcttggggaaggcagtttgggatgcgcttcagtgatccagccacctcactctttctagtgaaaggagaaaaatggctggaatcttacatcaagacaatggaaaacaggggtgtccaatctttcggcttccctgtaccccactggaagaagaattgtcttgggccacacataaaatacactaactatagctgatgagccaaaaaaaaaattacaaaaatacctgataatgttttaagaaagtttacgaatttgcactgggccacgttcaaagccatcctgggcagcgtgcggccgatgggccatgggttggacaagcttgatataaaatgtcaagcctgaatctaaaagcaggtatcctcaaagtcctcacggctgaagaaggagctgctgttcttcctccctggaatttggcattaaagggcattgcaagggctgggcgcggtggctcgtgcctgtaatcccagcactttgggaggccgaggcgggcggatcacaagatcaggagatcgagaccatcctggctaacatggtgaaaccccgtctctactaaaaccacaaaacattagccgggcatggtggcgggcgcctgtggtcccagctactcgggaggctgaggcaggagaatggcatgagctcgggaggcagagcttgcagtgagccgaggttgtgccactgcaggcgtgcagggagacagagcgaggctctatcttaaaaaataaataaataaataaataaataaataaataaataaataaatacaagggcatcgcaggaagtcctgatgtcaaggtaatgcggccaggcatatctgttgttgctgacctgagagctatggatgctgtgagcaggggcttggtaggccaggatagacaaacttctgacctcgcccctcattctaaagtgtaattcccagattttcagtaacttacgtaccaacctctaagcccctttatggttgattcattcctaggtatattaaaaataattcaggtttacataatctatctctaattgcaagagttaagaggaaatttaaactactgctttagttgttgggcatatgggtctctagagacagggtgttaagcatcactgcatcaccactttgcatataggaagcactcaataaatgttagtaaggccgggcacggtggttcacgcctgtaaccccagcactttgggaggccaaggcaggtggatcacttgaggtcaggagttcgagaccagcctggccaacatggtgaaaccccatctcaactaaaaatacaaaaattagccaggtgtggtggtgggcgcctgtaatgccagctacttgggaggctgaggcaggagaatcccttgaacctaggagacggaggttgcagtgagctgggattgtgccactgcactctagcctgggccagagaacaagactccgtctcaaaaaaaagttaattggaggaatagaaatactataggtaaagacagtacccccaccctatggagcactgccacctcttcaccaagtcttcttggctctgaatgcctgacagtgctttcaatgtggacacaggccttgtccccacacagggtttttgctgttctgtttgatcaagccacagaactggggagacggctctgggcccagcttcccaagtttgtctttttcttagtcctttccctgagatgcaggtcctgtcttgctcccctagcccctagcctcagccaccctctactctctgcagtgctgcatggttgattctgtatttcctctgcagcctgcctctctgtgccactctccttggagaatgagcagagcagagccggacgccaggcctggatggagtcagggaagaggtctcagaggagggaaactttaggggagtgttgagagacaggaggagcgagccaagtagagaagagcagggcgagtgattcaggcagaggaaacagcttgggtaaaagcatagcatgtctgtgacccctgcttctcagatgggcggccttcaggactctctgggagcatttgcatatcatatgtatattaatttatgtattcaatgtatgctcagcattcctatctggagtgatgagagtgattacgctccctcctctcccaactgcacaggcatgcaacaggagtgccttatccaattgaaaaagcagtctccatccccgagtgagggtatttccatgctcactaccaaggttcagggacatgctccccagaaatagtctgtgatgaagcacgtggtagaataaggcatcccacttcacatgaactcttgttttctatatttgtttttttttctaagttatgataatctgaaaatgacagaatttacacagttggagtatatttcctgagatcccaccacataaagaaaagatcacaatataaggcatgaagagtgggaactcacagacccggcgtattcaccagtgtgctccctgacctggagaacacaactgcagttgccaggctggccctgtgaagcccacaaatcaggacacgccacttaatggcaccaccagcaacatagccttcccttggagactcaataatatctgaacccttcacggcgtggagctgctgatgttcctaactacaaattcaggctccacagaaaacatggcttctctttattttagattatcttattttataaaaagcaagaatatataaaagatatagagaaaaaaggcagacagaagccactgcccagtgagaacgtgctggaatataaaaatgtaacttgataaaagaaacagttacctagaacctggtatacagtaaatgtataaagcattttatctttcattatctaaatgtgaaaaggaattaacttaagatcacttgaccttgcaactgtacaaaatgaatttttgtacattagtatgatcaaccaacagtgcaataaaatgtaaaataatatcttagaatcagattagcctgggtgaaatctttgtcctcctaaactgtatatccttggaaacacccttgaaagtttctaaaggctcagtctcttcatctttgaaatggagatatctgcctgctgaggagattagatggttcatgggtataaagtatttagagtgcttcctggcacatgtgtgtggtcaatattaactattgttattagaaaagaaaaagaacactaaatgacagtttttccatttaaaattcccaaatcaggtttcctgtgaaaatggtaaaacatgagccagcattgcagaatagagagcacgtttggcctagctactgaaactgggaaaatgctaggaaagccaagttcttgtcctggtgctgaactgccttccgtctggtgtgggcacgtcagatcaccttgccggggctctttctcgcttcagaataaagtgtgaatggagttagtgctggataatgtatcaagcccataccagccacaacattccagagtcaacctcgagggcagctgtgatggcaaaagtcaacacagtacattttataaaccataattagaggacagagtgatcaggcctattgcccacattatgtaattagccctctgcctacagggagggagtgcctgtgtgcaattatgcaatcacattttgaagggaaagacaccaactcacatcacatcatcaagaacaattatgattcacttgagtcacagtttccatccgcgaaggttgtccaggtaattttagtctgtacctttgtagtgccaaatatttaaatagttccttatttttgcaatgccttgcaatacaaaggcacatttacatgacccactcttactggctttatattagaccgtcaagttacatcccattatacctggaccataacctactactcccacacaagcaaactgcagggatctcaaactttagaaccaagagagtcatcagggagcttgttaaaaatgctgaccctcctcgctctatattgattctgcaggtctactgtggagcccagggatgtgctctttttaacagcctctccaaattcctctggtgtcagtggtccacaacatgaaaaaaaactcagatttaccatggatagctttggtggagacaatgcagatggttgcaggaccagcattacatgaattgaggcttctgtgcctcccccagtcattgggaagcatgaaaagctactgcccaatccccccatcccctttcttggcacagaagcagaactctagaatttctaggctataagccaacttgggagcaataaacattccccaagttccccactccaccctgtcccttcacacataatgaagctgcttcattacctgccctgagctacttaactcactcttccccatctcccagcaacagagactaacatcaatcactaagtgttcccagtacatcaagcaaggagaatcttgagtccaaagcaattgagaaagcaatgtatctaaggctccagaatgtatcacaaattaacaatagtgttatcactggaaactcagctcaaatgtcacttcttccaggaagacttccttaaaggtaacccctccccacagaatctgtttaagattttcctcctaggtaataacatgacatgcccacaaaaatcttcaccacaggtagcaagtatcaaatgtactataactgtttgtaactgttttatttagactacgtgctccttgaaggtgggggccatatctgtatcatctttacatctgcagctcccctctgtttcacctagttaattcttactactctaagttaaactgccattttcccatgagagccttccctaacgtaagtcagtccttactataaatgctcatcccacccttttcttctcttttccaacacttcatgatgcttctattttccacattgactggttaaaccatgtctctgcaatcccactagctccatgaggacatcaaaggggaataaaacaaaaaaaaggtattcaaataatatctctttaataaataaatagattcagatgacaataatactagcctgggagaggctggtcagagaatatggggcagagtgggatacctggatgttctacctttaaggtgccgtttgatcttggttgcttcctactcttgcattcaaagaatccagtataaagctcatgctggtaaaagtttgactgcaacactgggagagaaaggaccttttagagcacaaaaattacctgccaagaccttgtttccattgcataacccctaactttcatgcaagactctgatcctactcctttaatctgactacatttcatattctccaataacttctccattctaccccaaaagcaggcaatttatctttctaccatggtcagtgttcccttcaaggttggttgcaacttgggtgaaatatctcagtggaaagccaacaactgaatcccatgctcaattttcctcttctgggctagggtttgggccttttacttatgtctatttgtctgagaaatttactaatgcgtctagtggtttttatgattgtaaagacccagtttgcaatggtatattggcactcatctacattccacatgcatcaggagcttcccattttcacctatcactcatcaacttttaacaaacacagcctaatgattccatggtggtagacaggcattgtggaaccagaaaggaacatgactctgctatgtgttcattagccgtaataacacttcagaaaagaaacttaagaatgttacatgtgtactataaaatttctttcatctgggaaactttttttaggaccaaagtgacaaagatgtgagtagtctacaacttgcacaattgtgggaagacagggcatattcctttttttttttttttttttttttttgagatggagtttcactcttgttgcccaggctggagtgcaatggtgcaatctcagctcactgcaacctccacctcccaggttcaagcaattctcctgcctcagcttcccgagtagctgggattacaggcatgcgccaccacgcctggctaatttttttgtatttttgtggagacagggtttctgcatgttggtcaggctggtctcgaactcctgacctcaggtgatccacccaccttggcctcccaaagtgctgggattacaagcgcgagccactatgccccgctggcatgttccttaagaacacagaataccctttcaagaagttccagctctttttggaaccaagtaggtaaaaatgtcatttctcaagtccaaagagtccaaatcttccttcttctagatccacatgctatgaaaggaaagggttcataagaccaaaaaaaaaaaaaaaaaaaaaaaaaaacccaaaaaggtggatagcctaggccttggtccactgagcactgtcatttttggcagctgcattaaaggtacgattgtggaaaagaatggctgtaaccctgatttcaatgtcagaggttaaagatttagcccaagtgctctagctctcccaagttaaccattattgacatattatctatgtatgtatgcattagtctaaactttttttctttttttttttttttgagacagagtctcactctgtcacccaaactggagtgcagtggcatgatctcagttcactgcaacctctgcctcccgggttcaagcgattctcctgcctcagcctcctgagtagctaagattacaggcccatgtcaccatgcctggctaatttttgtatttttagtagagacggggttttactatgtcagtcaggcttgactcctgaccttgtgatccgcccgcctcggcctcccaaagtgctgggattacaggtgtgaactactgtacctggcctaaacttttaaactctcattaattttcaacttgtgcaatttcacttaaaactgcctctaatgatgttgtcgacaacgagggtaatggtagccatttgttaaatacttttataaatttcaaaaattatggcaggtggacatgcatctctcatttaatgattttaaaaacaattttaagattgttatttctttcctcttcagataagaaaatcaagaatcagaatgattaggtgaaatgcccaagaccagacaaataaatggtgggacaaggatttaaacactggtgttctcatccggtacaacatgctgtcaccctcaaaatatatacatatgtactgctgccaggttcaaggaacaagtccaagtttatgcagtcctgctctataatgttcatcccatccattctcagcttcctacataaaagatactaaatgcgtttgcccttccaaggtaatatctgaaatcccttggctactttagccctgtcagatccttccttggttttgttaggttgttcttgaggagtattggtctagctgtagatgatattatgaatggccagagggtcagagatatgcttttggtctttgattccagcatcctccatgattatacccagcactaggtctctgaaccaaagccatattttggtcaaaatatttggagaaatgtctgaaatgatttataagcccattttctaggttatcacctataattctggctgctcacctccagttgtaatttgaggtgtttctttttccataggtttggttcatatggatgctcttcagtctctttttaacacacttggcccatgatggctttgtatttctctcttagaaagattcagaagtttcactacacaaaacgtatagagaagtgttaaactggattagctctaaccaatgcttaacggtgtgcactgtctatagttctccattcagagaagtaacattgtatatctaaccactgtttcctctcttgaagatagcctccacccatgagagtgtttcctctgatattacggtcattaacaattttgatggaaggaaatagctggaaaaattcactatgtcaattgcatttatttgtcagagtctcatgataatggttcaattgttccatgttccttgacatcctggactcaacttcagaatatttcattgctctgggcatctaaatgtatacaagcaaagcagagtaggtggttgcacaattgttctataaagctgagctatccatttagtcaatataaaccattctgggaagaacaggatttctttgctcacatcaggagtctcaggtactggaaatgaccacattcacccatgtataagctttagcttagctcatttagctcaagacctgcaacaagtcacccaataaaatagcaaaaattttcttgggcacacaagcagttaaaaccatttctccactcagtgagatgcagaaacaagtactcttgaaaaaacaaagagaaattagtctgataatggaaaaccactgaaagcaatttatgaaccatttccccctgacaatatagaaactcttaatatactgtacgtaattcagggtgggtcttcttttgattccttccttctaatcatccacctttctagcagtaatactgacatctgaatctctttttctcactgtttcaaagggatatacgatagcaaaaatggctatgcagtggatgaagctaaaagcttgtattgtttattcaatggtacacctctgataatttaaaaagaagattaatcaaccagctgtgaaaccaaatatttgcagaatctaagcacttatgtaaaaaatctacatttgtagctgtgtgcccttaaataaataaactagttgatcactgcaaattaaaagaacttaaatggtaaaaactgccatttctttaaaaacgatgacagtgaagaaaaagcttttgcaaataaaattgggtggagaatctaataaacagggagctatgccatcccaaaggagaaaaaagcaaaaagaaatttcagaaaagataacaaattagtttagcaaagtcacaaaaagagagggcagacaaaaataaaggcataggatgcagcgtccagggaaagaggaaggggcgagtggaaacagctggaattgttcagctgtgtcaacattcggctgtttcacagattgactagcaaagtgtcatctgaaaccaattacattcccaaaaccccacggacccagttcataacattgattaatccacattgtgaaaaagtccccaagcaaaactagaacagctgtcagcccttggagctcaaaaaacagcaattgcttgaggaaaaaaaaaaggaaagaaaaaagaaaagaaaagaaaagaaaatctcctcttgaaattttagggattttcaggaggtatgtctactgaaaccgaagatagatttaaaacgaactcctccacctcctgtctgtttgagcacaactggctataattagaaaagcaggggtcatgttagaataaacccaaagtccattcccaaagtcagaacagaactgcctcacagtctctaataccttgtatctttttgctcctttctggagaaaacaccatcgtttgatgtttttaaaagtatgtttattttttcttctcattattttaaatgcattaatctactccctttgggcccataaaaatgtagttatatgttatacgttttctattaaaagctgtttttataccgtttgttctatttcacagaggtagaagaatacataaagtcctcgatttgcaagcatccaacttgtgcatgactcaaatacaaaaatggcgaccacacctctctgatgtgcaaaactactggtataggagcctgtaaaggttttcacacacacccgtatgcccccatgggatcctagatacctggtaccttctagcaaagccactcatccgaagatgactcactcatggcaaatgccttggccttgactctgaagctactgcagctagaaatccaccaccaggtatggtagaagagaccccaacaccatataagcagccacgaacatctccttaagaagtctcaatttctgtagaccctggcctaaactcaccactgtgaggatgcagaagttgtaggcatctgatcctttggacagattttttccacggaaataaaatacatgcttattcatctgctcattcattcagcaaacatttattgaatgtctattctatctcaaacactgggttgtacccaaaaaagcaatgttagcttacaaaatgtttgcacatgctgaattttgtagatgggtaaactgaagctccaaaaggtttagtgacctgcccagggccatctaactagtaggtgttggagtttgtactcaaactgaaggctatctgataacatttcatactcttttcaaaaaccatatttactacattatgcttgacacaggttttcataagctagcaggggagcccaaaagcatgcaaaatatagcttctacctggagatgcattccaagttacaaaaaactgggtataaattggactttaagaacataagcggtttacatattcagattacattctacttttgctctctcctctgtaaataccccattagtaatctaacggactcctctgctgaaaagccatagtgtaattgcaagttttatgaattgaagtatgtctttgatacacttatcctttttcttctgcatgcttatgcatatgtagcactaaccaatattaccaatatgaggttgtttctaagtcaaagcattcagagaaacacaaaccttgacttcactggtacatccttggatttgaaaaaggggaggggaagggaagggaggggaggggaagggaatggaggggaggggaggggaagggaggggaggggaagggaagggaggagaggggaggggaagggaagggaggagaggggaggggaagggaatggaggggaggggaggggaggagaggggaggggaagggaggggaggggaggggaagggaggggaggggaggggaggagaggggataagaagggagaggggaggagagaggggagggaagaggtggggataagaagggagaggggaggagagaggggaagggaggagagaggggaagggaggggagggggaagcggtggggatggaaggggaggggaaaggggaggggtagggaggggagaggggaggggtggggaggggaggggaggggtggggaggggagaggaggggagaggggaggggagaggggaggggtggggaggggtggggaggggagaggggggagaggggaggggaagagaggacccacaattcactgagccatacaaaggaacaggcttattctttggatttcagaactgagatgaaggttaccaaaagcaacaaattattttagatgtaaagacaaagtgttactaaatactgttctccaaatagtaataacattcctggagatttgcaataggtaccctccctactgagttttgaaggatgtgttgggtgggacagggtatagtgaatgagtagagatggggtagagggaggatactcaaagacaggacagtaagaaacaaccactaaagtctctagacagatcctctgattctttttactattttttcaccctggaggatatttataattattgttttttaaatgctcatgatgtcacagataaagaacaccaattgctcccaatagaactctaactacagtatgtgtttacaagagcaaattactgtttatacacggacaggattgtgaatgaggcaaagaacattacaaattatatgttactaaagaaaagccaaaacatttccttttttttttctttttatgagaagacatcattacctgtatatgccccctcttctcagttccctcaatggacattggcattgatgagcccataagtacatgataagcctacaaggacaatagtgagtttatatttttatgtaatgattttagaacatgggataatatccagagtgatggaggtaaaactattcacatttccatattccaaactacttcaagaatcactagagtgcagaagttataactctaaatgctgaatggagaaatcatctgtcccaagaactacacccatatgactttccaataaatctatctcaaaaggcctaccatttaacaacaacagcaacaacaaaactttaaaagaacccaaatgaagttttgtataagttggtgtctttttttctatacattttgaatgacaaaaagctgctgtgagctacactgtttttattttattataaaccattcttattttataaaacacagccctactcccagaaaaaatatttttgtgaactaatgggggtcaagacatatatctgaggctaccatatgaccctaagaagaacccaaggaatgcagtattaggactgcctcattgtttgaaatattgttttaaggattaaatgagtaaagcccatgtacagtgctcagaacagggcatggcccataataaaagtgttggaagcatgttaggtgttcaaaatcagtgtttgcattccaatggagttccaggaaaagtgaattccaggaatttatgtttgggtagacctaaggtagttttgcaccaaaagaagactttgaaaacggagggtttcctgtccacttttcgccaccatcaattgcatcttttcttaactctctgtagaaaagaagctgagaaagagcagacagtgcatgtctgcactgaagtacaactggccaagggccggacatggtctctcttctcttgcttctgtgctgtaaacggctcctctgagcagttccttgagattcgtaagccaaaggcttttgttagattgtgaggcaaggtagagggcagggcgcaggtataccatttgtcacaacaagcttccttaccactcctgttttatttaaaactccgctcctgttttatttaaaaccaaaacactcaatccaccatgtgggatccttagtagcacacatctcaaaagcttgcactcattcagggttggaatgggcagtgaagcttatctaggcacatttcttcacagccctgtcatcggggttcaaattcgcaaatggcatgaactgcctagcaatagtgccactgtttttactgtagggctgtgacttgcctccacctaagggagtttcagtgatatgggcttagggaatacagggaaatagacttgtgcagagttgagaaaacctcagaattcaaattcgcatctcaatgaatcacgtacccgacttaaagtaaggtaaccattaaataggaatgcatatcttgccttcccaagctacttcctacatcaatgtaattatgcttcgtccatctttagatgagaggcaggcaatccatgttagatctactttaaaagaaaaaaagatgttggggttttctggagttactcaatttctccacaatgttttggcaccctaaatgccaagcatcgctgaatcaattgctaaatttcaaaaggcatgccctggcttcagatacattaattttctggaataacaagcagtccattttaatgaacataagatactatttccttcatcttaccactcataactgagcttaatgataaaatgtggggtggctcagaaccactggtgggcttcagtggttttctactcaagaacaatgtcaactacagaatgggggttagatacaaatccacagggtgtgcttgctattatcatgaagagcaaaaaagctcctccaggccccccaccatcatgccaacacactttgatctcacttccccttgtgaacgcttgagaggataagcctgtccctgtatatgaagccttagctgcagtgctggatatatttacgttaccctttgcaagcctaaaagaacaagatcaaaggaaaataagactggtgcccattagagaagccatttgagaacccataagtcatccataaaggagttatataatttaaaaacatacaagcacctactctgtcccagaccctgccccgcagtagccaacaatccactcagtgatacagacacagacatagatactggatatggcaattattctgttacttcagaaagaaaccatttcttcttaactaagccacaggcagtatatctacaaatgggtttagagttggcttgaaattgattctgactttgaaatgctggtaagggaataagtcatatctgtcaatgcttatccttccttcttataggaataatttttaaaaaatcattattctactggactattccaagggaaagttcatgagggtggtagactcctgggaatatttctcaatgttctagctcccatcttttgcttcaggtgaggtacaggccaaactgtggactgcaactaactcacaggaaagccatgggatgttttaaagtttccttggagaagtcgggtgtggtggctagcacctgtaatcccagcaatttgggaggctgaggcaggtgtatcacttggggtcacgagtttgagtccagcctggccaacatgatgaaatcccgtctctactaaaaatacaaaaattagccaggtgtggtggtgcacacctgtaataccagctactcgggaggctgaggcatgagaatcacttgaacccgggaggcggagcttgcagtgagcagggatcgtggcactgcactccagcctgggtgacagagtgagactctatctcaaaaaaaaaaaaaaaagtttccagagagtaacagcggcacgttcagattcagcatggactactactattatttgaaactactaacaaatggagctagtaggtatttctcttgttacaggggcactgtgaaaaagttcccagacacaaaagcaccatgaattgagaaagtccgggagctttaggaatctggagggaggaggctctctccatcagacttcaatgtcctcaagcaacaggcaaaagggcatccctgctctccaaggtcaccttgaagggagttgccatgactcagccttgtgttcgaccatgccttcctagggaaggcctgcagtgggtgtgcgtctgtgcagatccatcagcttaattaatcagtaaagaactttgctccccccattagtctgtgcttctcattggtagggcaccttcagtcaggaatctgtttgagtggagaagtaagggtttgggttgagcaaaatcccatcccaacccctatctcaactgagcagaacatcctatgaaagagacagggcaggtataattatctcagtttttgagatgagaaaactcaggtccatctgagtctaatgaggttaatggattttcccagagtctcaaagctactagagcagagctgtgccttgacccaagtcttccatgtctaaacctcctcgcgttataccacagctgcttagattttgagcaagaattagtgcccttccctgcttcaacacacacacgcagtggagaagcaagcagtcattcccctcaaggcaagaactgtcccatatcacaccctccccatacgggcttgtggaattacttggctcctggagctgccaggcagccctaaagcatccaaaggagagaagctgccacattgttaccctgctgaggcagctgggaggctgtctcaaagccagccttcacttcctcaaagcttagtccccgccctctagccctgcttctaccctaggtcatctctctcctctttgcaggaaaaatgtctgtggaggggttcaaggacctgcagggatgcagacccgtgattctctgacaggagcatgcgtcagatgtgccagggaaggtgtgttaaagcagaggtcgcagggcctgacccccagagttgccgagggtagggccaaagaatatgcatttctaacacattcccaggtgatgctgacgctgctggttcagggaccacactcggcgatccaccaacataaagtgacttgtctcttcccaggatctcacttattgctccacacagagcagagatacttattgagcaaacattaaggagggcatctcttgatcatctcaaaaaaaaaaaacgtttcaacaacttctatcatcagctctgttttggacccagtggtaaaagttaaagtccctgccttccaggaacgtgcaagctaaagatagacttaattcatgtagacatgcatagaaagataagactaccatattcagattataagaaatcccactgaataaaacaaaaggcttacaatagaaactgcaaaattccctgggaagtctccaaagtttgcactttttaattttcagtgataccatcatcatgccgtggatcactgtgcagatgttacaactgtatttaatcacaattctaaagccagattgggctgctccaacctaatggcatgtgagtccttgaactgccatcaaccggatctgacagcaggcatggctgcagcaggcagttacagaaatgggtttaaatgtgggtgactcttggtatcaaagaactgtgaactgttcagctaagcagaggaatcatcagaataatgatcatttttcactctaccccctctcccttgcttgttcaaagtaaaaaaaaaaaaagcccttaattgcttcttgaactacacacaagtgggccgttgactgtgactgtaattcagcatggagaagcaagggaaacactaaaaccgattttgttgcggtaatgccttaaacggagaaaacactgcagtgggatcagcaggcacaggacgctgttaagtagaatgatacctccttaaagcacggcttgagatattgtcagctgttaaagtaatatttaatcgtagatgataccaggtgtgatcaagggggaatatattaatacagggggtgtggtgggggcaaggaaagggtagtgaggggagaaagataaggagagagaacaaacaaatgattttagaaggacagcacattacgggtgccctaccggattcaggctcctaatgaagaagacatgtttaggggaactgaagaattgtggattcagtcatttgccatttaccttgaaagacacgtccagataaatgattacatcttcagaaacttgaagcgtttccttcattctcgactatgggtacctagatagggttatgaacgtgaaaggcagaaactgttttgcccatactgcccttccatccaaagccatgaccctctgtctaggtggcactggctacagggaacagaaaacagatgcctgcaactgagaagcctactgccaactacaagctgtttgtaaacacttctctccatgtttacctaagaaagatgcaggctttccaaggaaagcctccttttgaaaaatgtgcctttttatttctctgtgctgttaggtccctaaaataaaaactaatgcccataattctttataagtctcccatctcactccatccagaagcatctcttcttcccttagatgttttttcaactaccttacaaaggtagcgcttccatttctgtaccctcacatgcaggcctgccctcttgcctgaatattctacttcttctgtaccagcagagagtagggtgaaggcccaccacttttgtcttctgttctccgcatagtggctatgttacatcctcaatgacactgaactgtaaccttgcttgcaaaacaaacctcggtgaagagagcaagcactcttgtactggaaaaagcctgatacctacttcttagtgaagtaaccactggataataagaaaaaagtagctggtagtaattaacatctattaatacttactatgtgccaagtccacactaaaggctttatttttaaattaaaaacaatttttattttaagacggagtctcgctctccccaggctgcagtgcagtggtgcaatctcggttcactgcaacctctgcctctcaggttcaagtgattctcctgcctcagcttcctgagtagctgagattacaggcacgtgccaccacacctggctctgtgtgtgtgtgtgtgtgtgtgtgtgtgtgtgtgtgtgtgtgtagttttagtagaaatggggtttcaccatgttggccaggctggtctcgaacttctgacctcaagtgatccgcttgccttggcctcccaaagtgttgggattacaggcatgagctactgcacctggcccaaactaaaggctttaaacaggttctgccattcagtaccaacagtaactattctaggcagatactattatgatcctttcacagagaggaaaaccaatgctcagagaggataaggagattgcaaaagtcatagtaacagtggtaaagtcatgctttgaatccacatttctctgactttggtgtaaaagctcttatactctattaatggccagaaactgtaccacaaccagggcacagcctacacagggacaatttgaaggagggtatggctatctatctatctatctatccatccacccacccacccacctacctacctacctgcctacctatctcatggaatcaggggcttaaatgtctgccacatattggacaatgatctgattgttctaatatactatttctaaactttataacagctctacaaggtccactctttaatcctcatttaagaaataagaaaacccagagtccatatgaatgaataacttacctacctttccacaagtggtaggtacaagtgattaaatgactaagtccacatgcctcccactctgccttcttagcttcacgtgcccaaaactcccttactaaccaattacagacttattaccatcctcctcctaatttcccaaaagaaaaaaaaaagtactagctctaatctacgactattacaagaccatcctcttgcatatcttatctttgtgagcatcagaaatgatgccaccaattcatttagacagtgccttcaaattctcatataaaaggtacttactatttaaaaaatggaaatgtataacagtgatactattaatagatcaattaaggagatttaaatcacttatttcattgccagatcgtagacacagtactatactattcattgagtttataaagctttctccatgacataagcctgactttattcccctgatggcatgatatgctctctcactcttaaccagtcacagtcccactcccatcaccaagtatcgtgcaaggatttcaagggtctcttaatagtagctacgtcgactagttcatctcctactgatttacctactcagtttcagaggaattaggtaaaaaatgcataactccattggcattgttgaatttttttctaaactcttgtgatagggatggaaaaaaaggacagagatagagcatcagttagcaaatatttactgagaaggtataatgtgctctgctctgaggcactggatacccagcagaataacccttgcccttatccacaatgagctggctagggagttttacacgagctttacatttgctcgcctgggcactcttgggtggtggtggtgaagagctcgtgttttgaattagacctggtttgaaacctggttttgtggctttatttcctgtgcgaccatgagcaagttacttaagctcttaagggctcagtttctgtctttgtaatggagatcataatactcataataggatgggaagaagtagcaaatcctgtatataaagaggccagcatgtgcccagcacacagtaaggattatgggaatcaaggacctagcacacagttgaacagaagagagctggttcatgggagctgcttctcaggtagctcaggaagctgttgagttattcagagcttccctctcttatttattcagggcttcgcgctcttttccttggttgccaactccccacttccctacctccaaaccccatgcaaatttcacctggttaacctttattcatcctttagtctaatctaaacctccattcccttttcgtcctgaaattcccacctgatcacaaaagcacctaagcttacccatatctttgcacctgtcactcgcctttgagagttcctattttcttgcctataccccctgccagagtgagaaactagagggcaggaccatgtgtcagcactatgtccccagctcctggtacaataatggacagtagcaggtgttcaataatcatttgtttagaaggcgaatggatgaatgcaaatagataccatttccaaacctgcatagatctggccttaataaaaagggcatggctcaaatgcggcatcaaattctgctgccccatcttgtgcctggtatcattaaatctccagataagaaggaggaatggctgcagtgtcactttgaggcctttctaccatgacgtcagctgctcgtcctgcacacagtgggtatagagtacgttacatggcttagctggctctttcttaataagatcattgttgctagatatgggtgtgaatgtggatgcagttcagatgtttataccaacgactggcataaataaacgaggaaagaattcaggtcggcccaatcattagtaacagtatcttcttgctctcctgggagctgtttcagattttggcttcatcctcacccctacataaagagacaaggatgggattgcagcttctagaattacaaccattttgtcaacttgtcatttgactcactgtctggccggtgcctctccctctgggtccagagacattttgcacaggaagaaagcaataaagtgaagtcacagggccgacgaattctccaatcttcaaagtacctcgttctgccccacagtacatacatatttctggtaagcgccatggagagcctcacatctgttacctcctgcaccgctgggaatcaaagcatttatccccatgagatgttttctaaaggcctgagggcactgggccattttatcctccctcccttggagagagcttctctgactacatgaaaatacctgaaaaggctaactttgtctgttccttattgccttaaaaataagagtactcttaacctttagggatttatatttggaagagggaaatgaactagatacagcttataaaaaggcaggaaagtgagtcattttttaaattgtttacaagcttgggaccaaaaaatatacatatttgcagatctttgaatatacactggtcttatttccccgtgtatattattccttttctctactatctttatgcttttcaaagaaaactaagtggggccaggcatggtggctcacacctgtaatcccagcactttgggaggccgacgtgggtggatcacggggtcaggagatcgagaccatcctggctaacatggtgaaaccccatctctactaaaaattcaaaaaaattagccgggtgtggtggcgggcgcctgtagtcccagctactggggagagtgaggcagaaggatggcgtgaacctgggaggcagagcttgcagtgagccgagatcacgccaccgcactccagcctaggcaacagagcaagactctgtctcaaaaaaaaaaaaaaaagaaagaaagaaagctaagtggaacctatacagcaagtgctagacacctagttgattattcgaataactaggatttacaaccattaattagtaaaaattagccctgggaaataataataactagaattctagaaagctgggaaacagcccatatttagggtttcggctttactacttactaatcatttccaaaacatggggatactacacagtcacctcacaggtttactgtgacaatcatatgtaaaaataattttgtaaagtgctgtacttcttagtagtgacaggtctttctacagttgccccttaaatgacataggtttgactgccgaggtccacttacacacggcagtcaaccaaacgcagatcaaaaatacggtatttggccgggcgcagtggctcacacctgtaatcccagcactctgggaggccgcggcgggcgaatcacctgaggtcaggagttggagatcagcctggccaacatggtgaagccccgtctctactaacaatacaaaaattagctgggcatggtggtgggcacatgtaatcccagtgactcaggaggctgaggcaggagaattgcttgaacctgggagttggagattgcagtgagctgagatcacaccattgcactctagcctgggtgacaagagcaaaactccatctcaaacaaacaaacaaaaaaaccacatacacaataatacagtatttgcaggatgcaaaacctgcccctacagaggagtgacattttgtaaacgtgggttctgcagcaccaacttcatcacttgagtatgtgtggacaggcagtcgaagcaatccccatgaacaccgaaagatggctgcagttcttcattgggactgaaggagaaaggccaatggggttgctctttcacagaaagagttatatcaacatgtttttttagatgctaaatcatgtttataattaaattggttatttctttagatttcttttctctaggacattctaggattctaagagaagagataaaatacgaataattgatttgatctgtttaatactgagaaagaattggagagtgttgtcctcagtagaagcttagaaagcttctaaagaaggagaggctggatgaattccccaagatgacatactaaaaaatagaaccaggctgggatggaagggctcctgactcctccttcagtgctctatgctaaacaaaaccttccttttcgcctttccacatgaagcccacatctgagaccacaaaagcgtccctctcaaaaaggtgtggaattgttgtgaaagctgtgcctggaggacaagggctgcgcctgactgttcactgcaggattctttctcttgtgcctccacagtaggcaagcaggactgatgttccgttgtcccgaggctgacacggcttccctctcccagcctgaaagcatccaaatgggtcacactggcttcactaatagtgaccatgttattaaaattccaggcagaatccaaagtgcaagattaagattacaaaacgcctagttccggtagggatcagagaaaagaggagacccattcctttagatgatctgggccaagaggtagcagttccttcatacaaagccatctatacctatggactttttggaatggggtaattaattccttagtccctctgaatctgaggctgaaatctctccatgttcagaagcctaacatatttcacaaaatcctctggtgcaggaaaagcccaatttaaacagacccaaataaccccagaatacactgttgccgactccacatctgttgctgtgtttgttcatctggaaaggattctgtagttctcaggcactaaaggggaaaattaggaaagggaaaaaaaagccccctcagctcacacttccacccacttctccaagcaccttctcccttacggaaaattgctcttcccagaaaaaatcaaatagagtcagcctcttcaagcaaaacaaacagaagatggaatacgtaggcttctcttgtttatcaagtctaaaagcatgaggaaaacagagggagaacataaaaggaggggaaaaaaggagtcctttctggttggcttcagaataatatgaagaaagcacaaacaaaccctgagccactcatgcgcagaaagctctgtctccacccctttagggttgaaccaacatttaaggcccaagagttagctgggtaagaggttggtaagggacttcctaccatggagattattcccttacaggtaacgtgaagtgagagacataagaatattgaagggagctctctcacctcagactggctccaagaggggctatcgatgccactcccctaactcgaattttctgtcaagcctctcagagatggtgaacaaatcatttcctctctctgtttgagagtgctctcatctgtttggttctttgggaaagcacaagattcttctagatcccattaaccatgcttgatgagaagtccatctgcctggacattcacccaccatgtcaggaaaataaaaacctaggtagcaactgtacagattctaagtcaaaaaagatagagcaaattgcataccctctctaggaaaagcaaaccactgactttctgaggtcttttgtttaagcccaaagataattacaagagatggataatttatttgacctttttcagaggtacctaaatataggaaatagttaacactttcctgtgggacttgctatatcttcttagaagcgaaggaatatctctatgtatgtctctgtctcatttcctaaatttcaactattctattgccagtttgagttctcttggcagaatcttcaagtgttctcagtaacagatgcctggaggagagggatgctatgagttctgaaacagagcaatgcacagaaccggggaagcagctgctccgctctagtcactgtgtatacaacttcaccaaaagtgtttaggaaacagatcattctggaacctataccacctattcaaaattcaggccctttcagttctacccatcctttttttttttttttttctttcctatgctgtttgttttctgccatgagctttagcaatctgtttatgttgtgagtgtgtgtgtatttgtgtgtgtttccctctccagcctggctgaattatccccaagtgactcttaatcctcaaccataattcccagtgattgcactgacatgataacgggggagcccattttcctcccacccctcctcactccctccccccttgttgctaagctcagccaaggatgctctagggagctgttcatttaaaagaggaagttcacagcagggtcaccaggcttttaaacagagagagaggttgcccagggtaagaagagagctcaaagtcacaaaccctttcctttgtcctgtgaccccagcatgtggggacatcagtcccaagtcgtcactctttctgaggccactgacatccccacagcatacctggctgggcactgtgactagcagaggtctggactgggaatcagaaggccagcacctaccctgagctagctgtttcatggtgggaaagtgacctgcccactcttgccctcaatttccacaatcacaaaaatgggctggacagatctggctggatgatgaatcaagcggtacttctcacatttcactatgcacagtcatcatccgaagaccttgttataacagactcgtgggcccgcctgaaaaggttttaattcagtaggttggggccagggcctgaggatctgcatttctaacatgctccctggtgatgctgatgctgcaggtctgaggaccacactttgagaaccactgatccatggcccctttcactccttacatcccactgctctattcccaggatggcacaagagcagtcagaactatttggccctggtcatgtgaaaaattccccaaaggactacaaaagtcacaggcctctcccacacttaaatagttttgtttttccatgcccccagcatccactcacttatatgcaaagacaagcagcatagatatggagtgaggagaactactggcttaactttaagttgccaacagttgctacccctgggaggccacttgcagttataaaacagaaacaagttgaaatagcaaaataggaataagaatgaattatataggctcctcttgcctaggttgctatgctgggtcatagtttgtcaactgcacaagtcacctggaacagtgcaatgtaaatttggtagtctcacacattgtgtaaagaggtataaaaaataactccaaagcaataggaaaagaagtactatcatgcagaccttcagatatttaccttgttccccgctctataatccttttcaaactgcaaaaccagaaacctttctgccatttggcaatctgactatcatccatcaaatatttacaaattcctgcatacgtccatgatcacagagttatctggcctggtgcgaaagagcaaaagcactgggctggggatgctgggattatgtctgagaaggaattctggttctaagctcctgctttcagatgccaaagtattttgaccgatctgaaattctaattatttaactgcgatagtttatgctaaggcatagttgtaaatgagaacttaatgaactcagagtaatgtcactaggccagagttctcagcccctctacctgtttgaaaatctttgctatattgagtcactgctactaagaatattatatgcatcagaggaactaaaatcaaataaatattaagaaccactgcacagggacaaataaaattttgagtcaaaattttactctttaacttaaaatttgatttggccgctttagagattgccaaatggaatgggagccagataaggggtcctttcccaaaagttctaaaaaagttttttttttttctctaaatttcccaatagcttttaaaaaatctgtatttctttgaattgggggctagcaaactatggcccactgcctattttttttaaataaagttttattggaaaacagccaaactcatttgtttacgtattatctatggcacttctattgtacaacagcagagctgaggagttcctacaaaaagcatatgggcagggtgcggtggttcacgcctggaatctcaatgcttttgtaggccaaggcggaaggatggcttgagtccaggagtttgagaccagcttgggcaacacagcaagtcccatctctacaaaaaatttaaaaattggccagccatggcagtgtggcctgtagtcctagctactcaagaggctgaggtgggaggcttgcttgagcccaggattttgaggtcacagtgagctatgattgcacctgggtgacagaataagaccctgtctccaaaacaaaaacaaaacaaaacaaaaagtgagcatatgacttgcttaaaatatttactatctagccctacacagaaaaaatactggtttaaataacagaaaggaaataatgacaacacttacacttaaagatgtgatgtataacatgtatactccaaccaattaccagataaattaattacaaacctgttggatcaatcctgtcaagccaatgtcagaacccactcctttttcctggctctcagcagtgtcttcaaatgcaaagtcataatgctttgaaattcactcagctgttttaacaaacttttgagagcctattctattcaaagtgctaaaatcaatttaagtactgaaaatttatacatacccatatccaccaaaaactaaaagcagagccatactaatcacgaatttctgcatgtgatttcagtcatataaaaacaacatatgaggaaggggacaaatgaggtcttgagaagccataagtctgcagttggcagataaaatgccatctcagataatcacattcaattgtcactaatgttaatatatgttgctaacagtcgagcttgcacaccagaggttagctttactgcccatgtgcagatgtttgcaatactgaatctctgccataaccctgtgggaatggcattttttatgtgttctgcagtgaatttatggccagggagccataaatgttatagttctttaaaccttttgcttttggagattgtcacagtgcttgaaaagtagagagacacagatgtcttctgttagcaagtcatttctcgatgtgctcagggatacggcctacgccagctcctaaagttccagtcatctgtgttatcaatgctacacagtttgaaaccccactcttgacttggttcaattcggatctacagagggttatcaaggcctgaatgtgccaggtgctgggctaggctctgagacaaggcccttgacctcaaggcactcacatgttggccagagtgacaggtcatctatgaaatatgacatggttagtgtcaaaacagagctcgagaacagacccatcagagagggcgaaatgacaacctgtggaagtctgctcgcaggagaggccatatgcctgtacaaagtcttgaagggccagtgcaagatatgtaagcaaagaaaagtgtgtgcatgtgtgtgtctctgtgtttgtgtttgcctctaagtgtgtgtgcatgtgttgttcatgcaagaaaaactgcacaaagccacagctgcaagaaacgggatgatttgttccagaatgcacatgtagtttggtactaaagaagcaaaaagcggtgggggatggggcgacaggagacatacagctgtagagactggaaagactgtgggcttagcagagaggtaggcagatcttgattcaaattctggctctatcacctacaggtagtgtaacctcaagtaacttgccaaatcccataaacctcatgtcctcatcagtaaacagaacctcagaggattaatacgaaggtgaagggaggcatggctgggtctgagagcaaaatgggctagtaaactagtaaactaacaacgaagccaccagggaagaaaaacactcattctgtacagcaagaaaaggtcttccattttctttaaaaaattctatctaaagtctcctccatcatcactgaataatgatggaagaagccatttaaaagaggaactgaaaagcacagccaaacctctaaaatctcccaatcacccatgtcatcaccatgcaggtgagaaacactgctagggagactgtgaatcacaaatacgattgacactgttcaaaacggtagcctcctaaacatctgccccagtgtctacacccaacaccagctctgtttgctacatgtgcccccagaaccattgggagtgtaaaacagaccccctgaagtaacacaaaacccacttctgacataccaggagccatacaacacatgcaaagtttctttcaagataaatgaatcagcacctcaagcataacaaaaggaatgaattttctgttaactgggcttttccagtttctcttagagataataaaaagctcccagtgaatatgagtaaatccccctactgtagaaaaaagtccaagataagtggccacccttcctcaaagcctgccttagttttatgtgagagggaattccacagaagaacagagaccttgctaacttgggaaaacatcctgtttctcacagatgtagctttgttcattgctttttcttgcatgaacaatacacatatacacatgtgcacatacatgcacacaaacatgcatatatatacacagaaaatggctgagacctgcatggctgagacctgcatctttcaggaacttggtgcaaggtgaaaaggatgcctttcacttgcttgaatacacaggccatccttggagatcacttctaaaaggtctctagacagaagatcctgaacccagaaaggcagtcctggtgtagccccaaatgaaaaagatcaccttgatcaagaaattctcctttaaaggtttcagagccacatttttgtgtgcgtggtggagaacagacctatccagctgcagcaaaaaccatcaccgtaggctctgaagtcctgggattggtttcctgagttcctctgtagcccaccgagcagtgacaagcagcaggctccaaggatgccctgacctcatcaagctgttggcaaatacagctttccaaagatggagggtagaacattcccaattaccaggccaatgaccattctgagggtagataaaactaagcaaatgaatcatccaagggcaacctttaactataagacctgggggctggaattcactctatctctagcccccacttcaactttcaaagcaccaaatggggcaagcccagggtttttgcccagaagacttttccttcagagacatttctccattcgtaatattcagtaagcagagaaggatgcaagagtttttctctagagtggggtaaagtgaggatagtgcctgtctaggaaccctggtctgggttctgaggatcaaccatttcaccaattcctgggtcaggctgcatgaatcactttcaagaccttgtattttttattctgtttactaagagatctgaatcaactagatgatcccaaagctaccttccagttctcagttttatgattctaagtgaaaataacccaaatcaaggtgcccctctgtgaatatgaatgaggcagttgccaacacactgtcatttgggggctctaaaaaaagaaataccccagcctctattggagatccctgagaatcttgccacctagtgattcttggatcaagcattaaggctgctaaaatgtactcattgtgtaatttgggaatgcttgcccattaactcattatcggccatttagtcacccatgtaaagaaagctatacaataaagtcagccaaaggttatgtaatttttgttgaggcagaacaggtcttaaatctctagcccagggagatgacagcagccaaaatccatctatactgaaatgattatggagctctagacaagatgagacaagagacaagctgtttagttaatgagaatcccaaatctctcccggtgaaacaggaatcagtggtctccagctaccatgtcacacagccacactcattgtgatctgccactgttattcacccctgcctgatagcttttgtcacccccaaaacgccccccaaaattcaccacctcgacacacgcagtcatttatgagtctcagaagagctgaaaacagtgtctgaaaacctcatgatctcactctgtccctgctaatacctaaaacagtccactgttccatttacacaggcttttcttcagcagatttacaaggtaacatctgcttcggaaacagatgtttatgccagaattctcttctgctcattaatgcttttccggttaacatctaactatctcactcattagttcttaataatactttttgtatccgagccatgccaaatacgcactctttagagctctgcattattgttgcttctgttgccgttgaattacgctgctgaataaaggaaaagtaaaaataagcccctctaagaaggctgctatgtgtcagagctctatctttgtgaactgaacaagctgaaatcaattaaaagtgtgtgtttagagaatgcatctcagctgtctaattgcaccacctctgctttagggccaaagtttgactccctgccaaattgccatcaaaatgggcgtccgtaagcgctgctgtactccctccgccactgcctgggcctgatggaagcacttgtgtaacgaaggaagcccagtgcaccccagggcttggcacacacactcccacttcccaggggcaatcctcagctgtggggctccggcagaagatgccatgaaacctctgggatgaaggtcctgggactagataaattattccacccgacttcctcagtcagccagccttaatagattgactacaggaagcattcgcatgatgctctttatttatccacaagcaacttcacataacaagaattaattcaggaaaggtagactcgacatacctttgctgagtgcctagtagtgcgttgggctgctaagtattttatacccatccattattagaaatgtaagtactgcttgtgtgtattcataggcaagggaaaagataaagtaaggttcattttttcctgatttgttcctacaagggtatatgttaaagtggtcttttaaacttgtttctacaatggcatatgttaaaaatggtctttaaacactttgaaacacttgatggtggcccccaagactagcttttatgtttccagaagccaacaccgtagtcaaacaattgaacaaaccaagatataaataaagctaaagttggtctatgcaataatggaaaagccagtcctctagggaacttgggccaacacaatgtattgtttgggatcaggagaaaggatgcttaataaatcatcaacaatagtttccatggttacaataaaatgtatagtcacctatattgtttagttttataaccattcttacagggaagaaataacgaagggtgctggtgataagcaaatatgaaactcacttaaaggctggcagtatgttcaaaaaaatgtgaaataaaactgaaactaagtctaatcaaggaaacttctagtttttaggtctctcggtaaccaacatttcttggtcccaatgaacgacattgcagctccataatctgctctgttctttttatagtaggttcttccctttctgcctaagtggctgcttttcagcaaaattacttggcaaacaccactttatcaagtataaatcagatatgctactctggaatctaaacccacaaagaatatgccccataacactacatgaaaatgaaaaggagaaacactgcattcttgctgccaaaagaaatgtaaaaatatgaatgaaaatgattgctgggtgtgccttccatgagattccatttaaacaacattccccatttacttacatctctacaatctgatgggcttacatattgcaaaatgaaataaaagcacattttatgaggaaattaaaatgttatgaactgccctgggtggtgttggcattatacacagaatggtgagtcctaaccacagtcaaaaccttgttcccctccagtcaacagatatcatctgaggctttgaagcaagtgctaagggaattcaagctggagatttaggggctctccacagtgcctctctccagataaactccaggggattccagggtgacagagtaggtgaatgctgaagtaggtataaataaagtatgacattgcacctcccagccctcttgtttaaacactccccacttccagatctactctgctgcttcttcctctatctgctgtcaatactgctgcctcgttctcctggacttctgaagtgtttccttagatcctctagttagactgatggctaatacctatctcatgtgactgcagtcacagtatttactcatttattccacaaagagataaggaaacaaaaaaaggtaatattcttccatctttaagagttttcttaaatcccaactagaaagataaacttcctttcctattactgtgttcctaccaatatgaacgcattaggtgccacaagagaccatgctagacccaaagtttccctaagacagagctcaagggcttgcactaagcaggtgtcaggtgtgggtctgccaagggcaccagccaaacaaatgatataggcatgaggccacatggtggactatctgggcattatcccagatcctatgcctggagatacagaccaacaatgctgcggctacagagctggtgactttctcatccctgtactcagaagttacttcggtcacaggggacatgcagaaaaccatgcaggagagtaatctataccccgatatggtagtaactaaagatgatgggtcaacaataagtaagcatgctcatctggacttctatagaattgctctttgcttgaggaaagcacctttcacatcaaccctttggaagtggtggtgtggcaaagctgttctcatgacccataactcgatggccacctctgaagctaatcaactgagaaggtgaaaaaggagcaggcacattttctcttgttccacaaggtctacaagtagttgttacccactgacagagtttccagaactccatgaaacggggtttgggcaggcacatactgaacgaaaaggaaacaatgtctgccatgtcaatgacctaaagaagacagagatgacctcaggtgaggattacaaacttctctgcttccgtcgccaagtccttcaaggcacgtgatggccagagatattttccaaggttcaacatggcctagggctttgtctcagttgtaggacttaggcacaggagagagcctcatgctggtgaacctggcaggtcaagatgttgatattcattagaaagacttagccttttctcctaagcatagagcatcaggaggtatccattcctggggtaactactcctttatgtgagtgaacaaaaataatgagatttccatagattccaaggagatatcagaatagtcagaagtcttgcccccagaaagacctatagatttaagaggcagagattcaccttccagttttaggaaggaagatctaggccattaaattgaccttggaatggtatttttccttacccattctaagtaatcaaatatgaccgtatgatctaatcaagcagatccaggtagtaggtatctcagctgttgctgtctggtgtgttttaagagacaccagtacagagctcagccctgctccagccgtaggcgatgcccatccaatgaatatagaacacaccatgggaaagagtttcatcagcattggtcccacttctctcaaacaagatgtggtaaggtccaaaaaatgcacccagcatgtcttatgctcattgttctgtggggaagacaaaattgagaaggaattagttatttccagcacagataggaaagatcaggaaggaaatagaaaacattatttgagccactactgggtatccagggctgagccagatgctggagatacaatcacaaagaagacccagttactgcccttcaggggcttggtgcacccagcagacaactacttgcagcaaaccttaggtagaagaacaacagatacatgggcatatgcctcagcaatgagaaagaggcgttcctctgcctgaggaagaattcagaaaagatgctactggagcgggtttcaccaggcagagaaaaggggaagaggattccaggaaaaaagcactgcatcttcttgagagcccatagtctttctgcatcaacctggtttcttcagtgttcaggacagtgcctggaatatcatggggactcaataaaggttactggatgaatcagagaattcagggcatggatgaacagaatgtcctttgggtgtaaaggtgtaaagctgtaatcagggaaggccctggtcagtccttggttttgaaagatttttttggtgttctggaggctgagctggcttgcccagggataagctagaatgctcaggtgggcggctgctgcaatgctctgaagggtatatgccgagatgatcatagggggtagtttttagaagtattttagatacttacagtaggaatttatttaccaaaaatatattttttaaaatacctatcttttaaaaaagacaatgccttttaaaaggcttatttcctggaaagaaagagcttttaataatatgtactaataattgtaaaggaagttacatacaaaaccaataaagaaaagactgcattcaactaaacaaggttaatgcctacccatctgaggaatcttggctactttgtaaatatcaactcagtctgcgggctgggccctggtgacaaatgctttctccaatcttatggagaatgaggttgtgcaaggacacaaaatctaaaagtatataaactagaggttttgagcactttttaaaaagcagcagaaccctttgcttaagcaaaatcttatgcagaatcctataggcaaatcagattacaaataaggatgcttgttcgaggtggagtgctggggactggaggaccccaaggtccatgattttccatcacctcctggccttttgaggcagcccatacaggccctgaacaaacacccaggggccccttgggacacaaactactttctaaaagtcaggacaacttccaaactggcccatcttttctactaaaggcctggtcctcagaatgatgagatggcccctgaaggatctggactgctacttcctgctgcttatttgatcattgatagggggtttggaattatgaatcacaagccaaagggcagagtccaaaagcttgtctgcaagtggaagaagtgagaggagcaggagattggctcttcttggtgaatcccagagctgaggctttgcagatgaggaaggcaagaccccatgcggacagcaccttaccaggcccacacccacattgggggagtgtgaggcagagccaggtgtgaaggctcctgaagtttcttctaggtggctttggggaatggctgtgtacactactgtcccttatagagctgcagccttctcggaatcgggtacatgctttatccagtgtgctctggtataagttcacaagcagtgcagcatggggcaaatccaatgacattttgttccttcccagagactgataagctcatttagtagcgacaattcacagtccaaaagaaaatgctgaatctcacttacagacatagtaaaattcaggcaaagacagccagatagcactggaagctattttagacatgcatacatattttaataccataaatctttatttttcttaacaaaatagtccacaagattatctgttacaaccaagtccccatgagagaggttataatccccatttcagagatggggaaactgacttgtccaagcttccagggatgagacaagagctggatcttccttgcacacagctgcccgtggagctcacacaaagagcttccacagtcagcaaaatgtaggctcctagtgcctagggaaggcagctcagagtcattaaaaaccggtcctgtcccatcccaaaaggacatctggataaatacacactggggagccattttgtgagtgttcgtgatacatttcccatcgtgccctcagatcagcttctctctggtgcagcgctttgggaaacacttctctgctagcctgatatacagatttgagttatttcaaatcgataaatatttactgggcatcgcccatgtagaaggcacatgtgcatggcaatggatacaaaaaataaaaaatagtgagtaacacaaggtcttggcatccagaggctcttactctactaagggtgaacaacatgaagaattttaaaacaaggcagaatgtgagaagtactacaaagaggaaaaagcaaacaagagggggagtgtttccgatggggcagactgtggaagagcttgtggaggaagcaggatttgagcagggtccagaaagtcgggaaagactgactcgcaaataaacaggagtgaaaggagggaggagcctgtcttgactggtctgctttccagcacattgggctggttaaatatctaaattgtaataggctttctgcatgcaaaataaataaaaggaattgctacatacctggaatttgctgcaaactttccccaggatttaccaaggtcccacattttctggccttgcctctttctctgacctcagttctgtcatccctctcctccctcccttcacagtagccaccctgttctccaagggggctccaggactttctgcttgtcatcttccctctgcctggaaggtaaactccatcagagcagggacttttgtgttacttacaattttatcctcagtacctggcacagagtaggagttcaattagtatctttggaataaataagtggataaaataaagttctcaagtacagtacaaaggaggtgacaaatgtagaatttcttcttggataatttctctggctgtttttaatttttaaaatacatctatctgggctgtaaatcgtgacttcacctgccctaaaccacaaggactaactagtgttaattaagtctgatacaccattactcttcattcccaatgtaccattgcagcttttgaatacaggatcatttcagtctgcacaagaatgcttggccttttaattccaacttcacagttgagaaaactgatactcaaggcaaagaatcttctcagtagtcagagtcaataactgcaggaactaagactggaacccaagttttctgcctggtatgttgggcctagaagggaactgctattcctatctctccatctttccttccatctttccttccttccttccttccttaatccttccttccttccctccttctccccctccttcctccttccctccctccctccttccttctctccctccctccctccttctttccctccctcccttccttcctttcccccttccctgcctccctccctgtctccttccttccttcttccctccctccttccttccctctctcccttttctccctcccccctttttttctccctcccttcttccctccttccctgcctccctcactgtctccctccctctctgtctccctccttcctttcttcattccttcttttctacttttttaagaaacaaggtctggctttgtcacccaggctggagtgcagtggcgtgatcacagctcactacagcctcaaaatcctgagctcaagtgacctcccactcctgcctcctgagtaactaagcctacaggcacatgccatcatgcccagctaatattttgtattttttgtagagacaggagtctcactatgttgcccaggctagtctcgagctcctgggttcaagcagtccttccgacttggcctcctcaaatgctagggttaaaggtgtgcacacccagcctgctactcctattcttaacatcaagctgtaaagggcttccatgtatcgacaagggaatgtggtgtgatctgaggaaaatctcaccctacaaacaggaaatattaagcaagttttgacagttactcctcctttgctttgctttaaagtgaacttaactcctcttgattactgttattggaatgtctaaacttaaaaataataagtactgcttaggagcaatcgttattttaactgtgtgaattaagagcataagtcttttgtttaaaattctcttgcgtgttctactgaatacttccaaaggttccgggctgtaattcccttgcaggcaacgtacgcttcagtgaaatttttcatttgcaaattaggttcgtttacggcagaaaatgaaaagtcatcatcagacagaccaagaaatggggccaatctttacctagaaggagtaattagctgaaatatctgtggggaaatttttatctttcacgtattgtcaattttacaaaggtatgaaagaatcactctaaaaacctcaagaacatatctaattacggtttaccccagtgactgttcataactgactgtttactcagattggaatgggaattgcagacattccttggatgagaccacactccacaatatggaattcagtaatgaggttccggttcacaacctcccagtgcaaagtttgggcaaggtttagatggttctgtagatgtcagttctaattatctcctaaaggacagtctatactgtcccccactaaatccccagtgagggaagggaaacctttccttggaacattacctccctatttatttaattttctagataaatcaggaaagatacaaggagaatggaaaggtaagctcacacatcacaggcatccttgacagtagtgggacattagactgctgaccagacacaggttggtggttatctataaaacgttacttattacttcaaaaccaacacacgcaacgcatacctcctaccgaaaaaacaagctcttttcatcacaattgtgtaccatgttcagctctggccatttttatttccagcaagttggattcattccatttttaatggcaactccttgaggaaacgctctttttaaacctgtgttttgagaaatgaagttaatgggccagaactggtttatcatgaaatactcatcaagtcaggaaacaaagttcaaatccttctacccttaggtgaatgaaattcgtttgtaggacactcctggagtaactatctaaaggtcatctttctagttagtgaagacagttctaaaatagtaaacttgggttcactgctattaccttttgtcaaacttaatttaaaaagaaggaaacaagtctgatactaaatctaataaagtagtcaatcatcttaaattataggaatagaattcaaaagagccagaaattgtctcctttcctctccccaccaacatctgggaatgaatggtcaattttcttttttttttttttttttttcttttgagatggagtctcactctgtcacccaggctggagtgcagtgacacgatctcggctcactgcagcctccgcctccgggttccagcgattctcctgcctcagcctcctgggtagctgggattacaggcacgtgtcaccaggtccagctaattttttgtatttttagtagagatggggttttgccatgttggccaggctggtcttgaactcctgacctcagatgatctaccctctttggcctcccaaagtacgaggattacaggcatgaccagcggtgcccggcctgagcggtcaatttttaaagtgttctcctaatttatcagagcattttgcaaagctggaagaacaggctgtacatggaagaagcagaacagtgtgcccttctccacttcagggctccagggctatctgtggctagagaggtctcactgtgttgtccaggggtgtctgtggctagaaatcttcagagccacctgtggctagagagctgggaccattcatttggcatggggctgcactccccctaatggaaaggggccatgacacattcccgtggctctggttttcagtattctttatcagccatcacattatctatcaccagcacatgccctcagttacaattaactagagcacggcttatcttacactccttacagtttaggctaatgtctttctgagatttgggaatggttaatcacatccccggtatgttgattcttaccagctttaatttcagaaaattatactacctggaacaccagcatgagaaactatgtactcagaccaccctgtatataactctgttgtaacacttattctactgtgtggattgatagtttatgactgtctctttcaccagaatctccttgaagatagataatgtgccttagcttgcacatattaactgctcatcagatgcttgtagagagaacaaattaagttaacagtgactagctgctgaaattcttctccatgaaagtacagagtcacagcaacctgttacaaatcactcattcattcactgttctagtcaaccaacatttaaaatatacggaagacatccagatgaacaaaacagacatggcccctcctcttagggtagggacggttaatagagaagacagacaatgaacaagtaatcacataaatgaatatccagttggaaattgtaacaaagtaaatggaagcaaagtagggtcatgagagactgaaaaaaaggcttgtttattttgagactggaaggatcagtaggggtcagctgtggagagaataagataaaaatttcgaggcactgggaacaagatgtgcaagggccccgaggtagggaagagcatgatacattcacgaaactgatagatcagtatggctagaattcagcagcaggaagggtaaactggaatgatcctagaaattgaatctctctaaaatcgaatctccccttcttttctctgagtatccttcctttaaaataagaaaataacgtcacacaaggccttgtaaacctggtaaagggcttttaattttgtcctcaggggaaaagaaagcctttcaagcaggagagtgacagaaccagatgtgcatttccgaaaggacattctccctgctgtgtgtggtggaggaaaaggaggtggacagcagagggcaaaagtgggagatggtacagagggccactgggagtcagggtcaggacctggaccgggtggggacagcagacaggtttgctatgaatgctggaagtaattctcagggtcttggtgatagaatccatatgagacagaggtgcaatgtgtgcctgggtttgtgtgtgctcggagctaacctggaatacctagcctgcccagctcccaaaccatctcccaaggcacacagggaaggcggggctttggttaagaacacaccctaacaaaccccaggtcatcccccggatcctagttctggcacaagctacacatacatttctcccagccctcagcacaaggttctgcaccccggcccgtgtcattgccccactgaggaaagtggatgcttgagagaatctgtgctttcctccttgtcagcagttgtcagcagggtgcagacacccactcttggggtctccatatgagaagccccccctcaacccgactgacttgacaagctcaggggtgccaatgagtggactacaaaacgtcacacaggcagtgaaatctaatgtctctgtctcttccttgagtggcctataaacatccctcccttaaaagaacaaaagaaaagccctgcttcccattgtgagttctggccttggctgccccaactgtcagagccacagctgaggacctctggcctcccaagcctttcgtttttgctctgtattccctctgctccaggcccctgacatccaaagctcttcttaaaacatcctttgatatccaatttccttttgatatggcccctactgtcaaaagcacatttttgttttcttgctggagaactgatccaaattcctcttctgtgtacccacaacttcctggttctgctcatggatccccgggctggtgcgcttaatcctcacaatcactcaacctgctcttttccagggatgcctcctacactgaagcatgcacctagtttttctttctttaacatacaacattctaatctagcttttcttgcttgacccttcttttccctacatgacagcgtgttacacattcagattcctcccagttaatagactggatgcttttttaaagaggaccaacagaggcttttccaagccccagcaagaaactccagtactttgtttaagaatcattctgtattttgaatatgaatgtctcttaattttgaatgcccagtgaggttaaagatagacaaaaattattgagtgcctactatatgcttggcagggagatatctgtttaataaatgtctttattcagacacgttcctatctcccgtattccctaactcctttcacttattttaggtgggtaactcaagcgcagtgtgctctggagtatgagagaaagcaatgttgtaagcaaccatggagaaggcatggtgagatgtgggctgccctcctctcctgggcggggctgaggaacttggcagtggaggatgggctgtgagcatcagcaggctgctttggggcaggcaggagggagccttcaccatgactgcatgggtaaccagtccccagacaattaagagttaactggataaatttagggttatccaggacctcattgctcctactactcctttgattccggtaaactcagtgtaatgacttccactttccagaaataatccatggggttaagaactttctccaagaactcacagggagggtggggtgccccctgcagcagaaccctccccacatggagctgactttgcagcccaccaccaacacacacaccatgaccttgtccctggtgcccacagagtgtctggctccattaccactaaggaggctctgcctgccactgctaggagacctcaacgactcaaagtcagagtgtgcacacgtttggggctccattctaattctcagggcattcacactgtcctggcaactcacccccagaacagatccagatatggcagccagcagataaagacctttatgtgtgggcaacaccaggatcatttgcatgtaggaaagaggccatcccccaccccgtccatttacacaggcagaatgtgccctgccacttggacctaaaaagacctcggcaagcaccacaaggtttatgaaaccaaagagaaccagcaacaaactcactgaatcagagggaagtagcaggggcttcttcccctcccctgatgttcacacttggccaatttgtttaatttccttggcaactatggacacgctaaactcacaaaagttaattctctgagagaagaaagatgaatcttagataaacaaggctgcatttggggaggtgggaaaagccacatgatgcatgttctcatctccccttccacccaactcacctgtcatcttcctgtgcttcctcattgcaaaaccagcattcctctcacggtcagctatgcacaaaatatccttctgttctcctggtcacatcaaagcaccttcacgctatgcagacaggtcattgagggaacggagaaaattaacaaacgcacctaggttatttctattaaaattagcccctcagccggtaggctctgtcagtttccattgaacacaaactctgacaagtctgttgaaaacttttaacctttccaggttgtgtcaacagcttgcaaacacaacaggaggatggtgcctctgagttctgcctttccttttggaatagaggaggtatcagaatttgttaccaccagctttcatgtttatcttcactgctctgctcactccccgctgccacttaaggagcatacaaacaccttactggataaagacaaacatctgtcaattgtctataaggtcctgatgagatttagcttttgcctacttctcccctcatgttttagcccactctcccccactctctactcagctccactgaaggctaccttatggaattcttcaaaaaagcaggtagagttcctcctgccacagggtctttgcatatcctgttccttagcatggagccctcttcttacctagtgatatggtttggctgtgtcccacccaaatctcatcttgaattatagctcccataattcccacatactgtgggagggacccattgggaggtaattgaatcatggaggcagtttcccccatactgaaccatctgatggttttataaggggaaatccctttcacttggtcctcactctctcttgtctgctgccatgtaagatgtgcctttcgttttctgccatgatcatgaggcgccccccccaccgcccagccacgtggaactctgagtccattaaacctctttttctttataaattacccagtcttgggtatgtctttgtcagcagcatgaaagtggactaatacagctagttaacccttactcatctcttgggatctcaactcaaaagtaactttctcaggagagggatggtctaaaatttatactctcacagaccttttacatttataatgaagcatgttccatacttgggtattatatatagtatttatgaaattatttatctaaggtctgtttgcccactagaataaaagtttcatgagagcaggaagaatgtgtgatttgttccaacacggaacatgatatatactcactaagtgtgtttaattattagattaattaataattttatcatgtcatacctctagttaaacattttccagtggttcccatgatatttcataaagtctgaagtcttccaaaaccatctgtaatggaatctcacccaatcataggaattcaagattatttattattaatcccctcaaaggtactctcctcttctgccaaggtcattggttgactgtgcctcaacgattgcccctcatctaaaatagcttcttttatctcccctctgattattcaaatctagtaatgcatgaaaatgcaggggcatgtggacaccataacacaatgtaaggaatgcagctctagctcagagtcctaggttcaaattcatctatcatgacatattatgtgaccttgaccaagccacttacatgctctgagcttctctcttttaaaagaacaaaagtgatatctacaaggctactgcggaagttaaagcacatggtagatactaggtaattattagctccacttccattcttcaggtgagaccatcaaaaacctatatggtgaaaagttgacataatggagaagcagcatggaccaagttcatctacaaaattagttgccaggaaaacacaggtttatcttcataagctggcaaggagattctcaaaagtggtatatgggttcattcccactggtgtcaggcagaccctggaggtaggtctgctcttcctggtagcaaagcaatctatggtcacaatgatttgtttcttaaagggccctaaagaaacactagttctcatcaaagtttagcatcctgtgtctttgaccatcttgttcaatgagaaagagtttaggcagcatctgctacatgttcaacattctagttattactagagaggatgaaaaatattacacatgggcctttcccacaaggtattaatagtatagccagacaggaaagaattgccttgatgaggtgagaccatacagaattgagttttaattgtgtgctatagactaagttcagaggagaaaaagcaatcaaaataattactcattcatttaataaccatccgttaagtatttaccaaacacaggacaatgaactaaaaaactaaaacacaaccagctttttaggagcttgtaactctctccacctgtgatcccctttgttccatccatccaaatcctactcacccatgaaggccttggtcaaatcacacaacccccatgaagccttccttaaccattctggaccagctccccctcctcccatctatacttctcaaacattgtctatttttcacactgattttaccactcacctcacatttgcatggcctgtgctgtcaaatacagtcatctctacttgcataactctcatttcactttttttctcagtatatacatctttccatctatttataaaccctgggaggccaagggcccttgaatcttctgccgcaggtttaacacaaatgcatttttatttgaattaaagtaggtcttcctacgagcagttcaaagtagaaagaggggataaggatggaaagtgccctttatggaacacgtgctatgtgctgggtccttccctcaggcctatttaaatccttataatcctagaagaaggtactgagtcttcttggaatccttcctctcctcctacacacatcatcctgaacatggtcactgagcagccagcatctgcccaccttggccctggctacattcattgctggagtgggagtatatttaactgtttccaaaagcagggaggtaattacttgctgtatccaatgagctggaatcacccgtgctctgcttgtttctaatacgcccatcaaccaaagctaaacacacaggagaccaccattagaaaacgcaggctctttttgcatgactgcctatttgaacaaactcacaaaggtcttaaatccaagtaagaccatctaagaatgcaaaagtttaaaaatgataggtggcagttttgccaggatgtacgaaactgcagtactttttttatttttaaaggaagtccactattctccatttcccaaaaagttctttgttcttttgctctaacaaagtaaattattcctcaccttgggcaagttggtaggaacgtgagaaaattacattaaatcagacatccttgagatcaaaatagattggaacaggggttctctttgtttaaaatagatcttcaaagagaaagcaaaagagcttaagggaagaaaaagttgtcaaacaacctcaagcactctggaagcacctaagatctacaaactattgatatgttaattaaaatttacttttatctagtataggtgtttgctggtcatggtctcattaccctgtggctcttttggcccttgaataaaatttcatttcttgaaagacattagaaaatgcttctttttctctctttcagatggtttcctctcccttattgcaatttaacaagacttcactctggcttaaacctggacaccgaatcccagagagaatacactatccattcactccatccaccagtaaccttctgaccagatcaaaaacaagccatattggacaagatacagaaaaagtagaaaattttaatcagtgagtaattaataactctgtattgaccagttgccagagtaggacttctccggattttaaaatgtctagagaaagaaaatcctgttcagcgataacccttctatttcaattctgcaaagccctcactgctgaaaattccttcagggcccaatacaaatgtccatgggatagtttatctcctctggttctattccagagaagatgtcccttccaggttcttgaaatttcttccttaagtgatccctagtaccgatcctgatcttgaaccagtcagaaaataaggtcatgcaaaatagtaaacttaaaccatcagaagtcaaattcagattcttaagtgtctaaggagtcttgtgactttgcagtgagccaatgattttttttaatattagttcatgttttcttttaaaaagctgatcccctgcacaatgttactgctaacagaatttttactttcttccggaacagaggttggcaaactgacctgtgggctgaatgcctgtttatataaataaaactttattggaaacacagctataccgatttgttgacatattatctatggctgctttcttcttacagcagcaggcagagttgagtagttgtaagaaagaccacattgcctgcaaatcctaaaacatttactgtatggccatttacggaaacgtctgtagacctttgctactactaaaccattaccactaaaatgcacagtatcaaaattactactctaaggtttgaggaaaacatgctggctatcttaaaacctaaagccaatttttattgtatgattaattcaacagtggtcattctggagaccttcaaagaacgataatcaccttttatgatctaatttgccatcaccatctacaaaccctgttttgctatctcatttgacacaccctaccaaaaaattaggaatgtgccaatactgtctgtaaaaagcactaaccagcagcaccatatgatgataacaggtcaggcaccgtggctcacacctgtaatcccagcgctttgggaggccaaggcaggcagatcatgaggtcaggagactgagacttcctggccaacatggtaaaactctgtctctactaaaagtgcaaaaattaactgggtgtggtggtgcacgcctgtaatcccatctacttgggaggctgaggcacgagaatagcttgaacccaggaggcagaggttgcagtgagcctagatcgcgccactacactccagcctggtgacagagcaagacttcctctcaaaaaaataaataatattaaccagtaccataagcactgtgctaagcatgttacgtgtattgtcatgtgagcaagatgtaagatacacaagggtagggttttgtctgtttggtttactattgagtccttggaacttagaacagtggctagcacattgtagccactcaacaaaaatttgataaatgaatgaaagttctcccataaaggccacgggatttatcctggtactggcaaagtgacacgcagagatttgaaaccaggtggtttcagtcaacacctcactgcctctgttatcacatggttcagccagcacaccctcatccagcccatcttgttttcaattaaataaacaccctttggcaatggaataactaaatctaacctgattaaatagtaagcatttattgggagttgatttacttagcactgtattagaaactacaaacctaaaaagaaatctaagatgcttttgcctgtggcacatgcagaatagtacgcttgttaaaagcatgcgctctgaaacactgcctaatgttcacatcctaactccattatttccttgctatgttaccttggcaagttatttaccttcccagtgcctcagtttccccatctgtaaatgggtgtgattatagtatctgagagcttgatccacaataacagtgcctatggcattctaagtactaatatgtacctgtgagtgatttgttattacagtcatgtgtcccataaagacattttggtcaataagggaccaaatatgacagcggtcccacaggattataatgaaactaacaaattcctattgcctagtgatgtagccatcaaaatgtcttatggcaatgagttaatcacacatttgtggtgatgctggtgtaaacaaacctactgcactgccagttgtataagagtacacacagactggccaggcatggtggctcacgcctgtaatcccaccactttgggaggccaaggtgggcggatcacgaggtcaagagatcatgaccatcctggccaacatggtgaaacccacctctactaaaaatacaaaaattagcggggcatggtggtgcacacctgtagtcccagatactagggaggctgaggtggagaatcacttgaacccaggagacagaggttgcagtgagctgagatcacacctctatactccagcctggcaacagagcgagactcagtctcaaaaaaaaaaaaaagtacacacagaattatgtacagcatataatacatggtaatgataataaatgaccatgttactggtttgtgtatttattataatatgcttcatattgtcattttagagtgtactcttattttttttaaatgataactataaaacagcctcaggcaggtccttccagagatattccagaaggaggcattgctgttataggcgaggacagctcaatgcctgttattgcccttgaagacctgccagggggacaagatgtgggtgtggaagagagtgatactgatgatcctgatggtcatagagtcatccataagccctagaactctcttccactacttcctctggtaaatttctactcatccttcttgttggaccttaaatgtcacttccctgcactaaccttccctgagctccttgtcgtccaactggatcagtattcacaacgcaatcctcatacaccgcacgccctgcacttctctccccatggatatggcgctcctggacttgtgcaataactgtcagctacatgtgtggagttgtttgtttccttgtgtcttgtttccttctgtattcctgctccacacataggagacttccacaaatgttcctggcctgaatgactgtgcagtgtagacctcccccaaaaaaggagagattgttgtgagtttgaaagtctgcagaaaagtgagaccagagatagtgagacaataaaatgaaggaggctgaatggtttgcaggtctcgatttgattttattttctctttttaaggtgaaggaacaatagcagtatgtgatttccagagaagaatgtgtatagcttaccctcaaatctcaaaacctccgttaagtagttctagaggaggtagggctgggttttgtcttctgttgagacagatgcagtgattattggaaggcatgcttactggtgcactggttcctttaccacaagtctgggaattaccactgtattccccaaggaggaagaaaacctgggtagggagattttcttttcaaataacattgatttggtgactgatggcaacactacaaaataaacttttacttttgttaattcaatacggctcttgagtggtaactgttcaagtttatatacatataagtatataatatctttcttctgctctctaatttgcaattattcaattcagaaatcctgattcttactaaagcataaggtatgggttctcttaagattctcacctatcttatttctgaagatattaccaagtatgcccttatttttgtgaaagtataaaccttatctccatttagctatcacagacggaaaataaaaatgttttaaaaactaaggaaaaagaattggtcttaatatgcaatgcaaatgagtgaattttataaaaggcaaagataaaaaaattataatccctttggcatgctattcattaagaaaattcttcctaaggactatgagttttaaatatgctcagcaagtcaatcatctattcattcattcaatatttattgtgctttcatttattcactcattcattcaattcaactaatttatcgagcaaccctgtgtataagcctcctgccaggtgtgggaggttgggttcactgaattagacagtacctgagtaactgtgccagtgcagatgggaataacgtaaactccacactattcaaagtgtgctccacgaactgctgccggtcctcaaattggtcattgttggtctggggcaagagaagtacagaaactgagagtaagccttttaaaccttgcccatatatgtgattgtgtaattttgtgtctgttaactctaataataaaaaatggagcttgcatttttaactgcctttttcttttacattgtactttatacaagtattgatccgtcatggactggggggcatggggccagttcttgaccacagaaagtctgagaagccttgctccaggaaaggaaagtagcacagtgccaggaaagagggagagtaggagagtgtgcgcgtttccagcctgggaaagggaagcggaaagcaatctgaaaagcctcccccagggggagtggcatttgagcaaagcctaacaggatggggacggtttggaggcaaagacaggagaaaggacgttttgaggcaaagagaaaggttgaggccaggaagtaaagggtttatgcagggtgccacgcgtatttaacgctctgtgaagcacagagcaggtgagtaataacgataataatagcagctaacatttattgaacacttaccgcaagccaggctctgtgctaagaacatggtgggaattatctcatttgttccttccaactacctgcagggacactgatttgtgaaaatcgttcccagacagacgaaggatattaaataggaggtgagagtgcccctcggggcaatgggcttcaagagcacaggcagacgggagtcagatgccgttcagggacagctgggcaccaactctattgtctgtctcctcctagacgaggatgttgccttactgggcctgagtcaggcttgtcaatgtcctctttaagtggtgggcataatattgtcctgcaagttcttttggaatggtgatgtgagcccaaggacgagaatgaatgggcaggtaaacagaaagcattggcttgccaggtctagcacagcccagccttgctgcagaccttcttcacaaccctggggacagctctgctgggctgtgctgcatctggctcctgctatgggttgccccctggaataggtaagattttgtgcctctggctcattaaatgcagaccttaatctaaccttacaaggtaagtgttctgctctttctagttagtacagaaatgctgcatttgcttttaagtaagtgagaagtgatttgtaaagatgtttcgaactcaggactaactgcctccagagatgcaggaagtaagaccagaacagtaggtgggggccaagacatagatggaggccctgattcccaggcttaggacctgaactttgattctgaggacagcagggaacataaaaatcatatgggagcttctttacctccacaaagaacattctttggctcagcaggacaatatggtgggaaatgacaaagtaactcctgtggccctaggtcaggttctcttgaggaaaacaaaaaggctggaatgatacagctcttcgtaaaccaggtgcctccagtgcctgcggttattcccaagtccacattttgcagacagggccctaaaatgtctagctaggaagttcctgagcctgtttttttaaaattctacacacacacatgcacacacacacgcacgtgtgcacacatgcggatatatacatcctcaccttttcttgagattactgctcagaagaaggcacatttggtttggtctgcttaccagtttgtgaagcacttcagcaccttttaagatgtcaagtgccataaaatcaacgtccttgttatcgtggtaaattgaccttcgttgccaaggcaaagtcagagacagagttaaccatgacagccacgaatagctgttctttgagggccaaaatcatgattttcaatgtttttccatctgaaataggggaacattactcactacagcctataactgtttcctgtcccatgaagctaaattcctacgccagcaatatggtctcaacagaagccctgaaaacagaaatgtcactccgcaaagttcttatttcagccaacaaagctttaagtttagacttaactgtgaaactgaaaatttggctcaccacagagggaactggagagactttttttttaaacaccaggagactgatgtcactgctttgcctatccaatgtcatctcatccctctcccccaaacccaagcaaactctgcagtgagtgacaaacggctgaaatttcagctttacccctcagctagcaggcacttccaaactcatttaatgctcaggtaagttttagctttaaaaaacttggtggggaaaaagaccaggtaatttatcccctattccatgaaaaacaggggagtggggacctatgttaatatgatctttagcagaaaaatgcagtgttgttaggcctggtttctcatacagatttgtttactgtatccatatttactaaaatgtttgttgctgtgactgcaagaaatcagggattaatatttacctctgttacatgaaagaacttactgtcccttttctgcaagtatttggagtcagagattccttaagtaaaaatgctataggccaatgctaaacctgaaaaatggcttagcaagatgctgagttctaacccactctgatgaaattggttatataattggccttgcatcacggatggttatccctatactttgttcttgtcatttcaatcagcccaagcaagtgcactccttctgatttagagacccaaccgatatttgcccacacagacatggtcaggacaacccccagggccttcgtatgttggctcttggcccagacggtataagagtccatttacgacatcaaaatattatgtaaactccctcatcattagagttatgcttttaacctattcatttaaaacgctgactagttatttagcagtgctttaaaaaatatttctaaatcccagaagcaactacatttatgtgaaagatagagcagaacatgttgcgtgtacagtaggcactatttggtggcaggagtctgtggcttcctctacccccagtgaagcctagaggactgcagggatccagcacccacgggtttagagtcttgggtctggtccagtgaagacactgctctctttcatatctccagagtccaccagggagctggctttcgcatcctttaatttggctgcctttactgggaggtgcttcaccatgaaggcttggtaatggatattccaaaaaaaaaaaaatgtaaataggagccacattcaagagcaccatttaaaatgaaaacccacatgaggtctcccagcaaaccactaactttaaagggagcctggctgactaagaagacaggacactggatcctggacatgctgcaccacacagcctgccggccacagccctgcttcttctgaccatggaatttccaaaacagactccctcaaggaaagccaagagcacatttttgtggcattagagtgaagtgaggtttctctttattagagagagatggcattggaaataggctcattttccctcataaggtaccagtctccaaaagactgccttcccggagaagtaccctgggaaggaaaatgcctcagttacggtaccacatggtttgggggactcaagctgtctccaaaaagccctgagaaggaaggatccatttcagcatcacaatttttctgaaccaagcggggatcaacaatgtgggcaccagaactaaatgatccagtaattattctacaaggaggtcccaaagggcccaaaagccatgatgtaatgaacaagaggaggctcagctccagagggcttcctttaggaggtgagtcatgagctgtgtttcgcactggcagagaggaaagctacgtgggtagggcagaaaaaagtgagctgtgtctaggggacaagatgaattggataggtgactcagtgtcaaagatccaccattagtgaaacactgtagaccaggcaatgtaaaggtgtcccataggaacccactgttgatccttcagcacttaaaaaaacaaacaaacaaacaaaaaacaccactgttcttgacgcaggatgaaccattttagcagtgaggggcaagatgaattgggacagcagggagactagctatgaaaatggagtaatcattcaggtgtggtacagatggcattggaatgaagacggtgaatataggaatgcaaattagtaaattaggctcaaccaagagatgactcctgagcaaattatcagacctactgcccaaccgtcagcccagttttaggattttagggttttagacaaaacagtatagggcttggctatgtataccactggcctacagtacaacctattgctaccctacaaataagagaacagcagttaaagacccccacatttcctcttcccctaagcacctcacaacatattcacctatcaccggataccccattcctggaccaagcggccattcctttgaggtgactgattcaacaaggtagtgaaataaagaacttacccagatgattacaaatgccattgaaatgtgacactttcaaattggagagggcatgaagctcaaatgatatgctcattttacggaggaagaagcaaagactgaaaacattgacgagctttcctcaggctctgagagaggtgaactgggtgctgggtgagttctgttcctggctctacccctgaaatactggaagaagctgagagaatttttttttcttttttctgagcctcagattccacatttgtaaatagaaaaaatataactaaatggctcctaggtccctgctagcgctaacttctcgtgtgatcagtgcttctaaaattgcaatgtgtccaggtggggaagttcatttaccccctatctggtttacgctcacttaagggagtgatttctttcctctgaggctctcatcttgcccattattcagagtgagctgcctcctggtgtgctgtcaaaatacatcagcttcaaagacaaacacacacctttcaatcccagtccaagagagtttactgtataatttatgataatgttaagtctgtttctcataaatgttaatggtgctacattttttttcatagatgggtaattctcagaaaagcagctggatgttaaaagttacttttttttttttttttaacataaactgcctcagccaacaaatctgattaaaacaaaactctccaggattgcaaggcacaaagattctgctaatgttagtaagtaaatccaaaaaaaaatcattcaaagattctgttcttataattgtttatctaccatgatttgattaagttcacattcacagacttttctccattttaatgtgtagatattaagaactttttactttaatccaattctttccactcctacaaattgctgaacttgtacattagtattaatataacatgcctaagtacctcccaaagtaaattctttcctgctaaaaatattttgctagcaaatattcggccttttctcatttatagaaactgtaacctttacttcgaagtgccatgcttcatcttttatactctatagaattgttttgactgctaaatgtgtttgaggaattctctcccagacgttagaaagttggattttgaaatcatttgaatctttcaaagttattccctgacgaaagaaaatgcatcaataatttcagattagttactgtactggagcttctgaaattccaaattttctattttgaagcatcaatttgtagaagaatgtaagtattcttaatttttgatgctgtaaaatgcaataacgatagacatattttaacacagaaagataaagacttcaaaagtacataaacagccagaaaaacatacaaaagaattagcttaaacaccttcaaattgcttgggctcaagatacctgggttctaatccctcctccacttgataactctgcaacctcattcattgactcatacatttattcaacaaaggcgtattcggtttgacaccaaggtactgtgctgggcattagttacagagaaatgctagatatggtctctatcctcaaagagcccatagtgtaggggaagaaacagccatgcaaacagatattcctacagtgtggtgggaacattaatacagatatacagagagtattggaaaggaaagagggtaggggtgggggaatgtcagggtttcaagttttcttaaggaaggtgattcctcaactgagccttcaggcctgccctgtctctcggcttgacagggcgcttgtgaggctctcgtaagataaagcccggtaaaggccctgtgaactaaagcacaaaagagctgtactgggattattttccatggtgagaaatagaaaagctacagcataatgagtgagttcttttgcatctctggttattaaggaaaacaaccaaacatgatttggaagagggttttaaaaaattcagtttcagcagattttctcactcttatttgtatgtatagaggacttaaaatgaaaggactatatatctccatttcacagatcaggtcatttaggcacggggccccgagagttaagaaagatggctaggggaaagagaaaaaaaagtctcagccagaggtgagagagagcagctcaggaacctggagccggacggcaatggtgggggatcgcgttttccttctgtgacactctcctcaagggtgacgctacccctgccaaatagggaggaggaatgattttttttttccttcataaaaacaagtcagaaaggaaataaaatccacatttaaaactcccaactgttttttgaaacgagtattttcttcatttcttttccaaggcagacagagcaggtgttaaggctgagttcctcttgtcatgtgaaacaaagatggccctgactaccatgtactgggcgacctataatactgacatcaagcgcaaaaaggaaacaaaaagaaaataaaaaaggaatgcgtgagggtcggagtttttggaagatgaacatgagatgacagcatgagctgggtgttgaagtcgggaagatgcagttaacagaaggggggggggggcgccatggagcagtcgtgtgagccaaggtgcaggaacaagcactcagcttatccagagggaggaccgcttcccagagatattttcaggggcaactttcgcttttttggtttgtttcgtttcttgaggcagggtctcgctttgtcacccaggctggagtacagtggtgcaatcttggctcactgcaacctccacttctgggctcaagcaattctcccacatcagcctcctgagtagctgggatcacaggcatgtaccaccgtgcctgcctaaggttttaaatttttttttgtatatgtatatatatatatatatacacacactatatatatatatatacacacacacaaatatatatatacacacaaatatatatatatacattttattttttccccccagagacagggttttgtcatgttgcctaggctggtctggaacacctgtactcaagccacctgcctgtcatggccccccaaaatgctgggattgcaggccaccataaccggtcatcggggcaactatccttcagggcttcctccagtagggctccccaggttggccttgagggccacaataaaaaatctgacttagctatactccttccctgtccccaaccacagttattcttgtggatgaggcaaatggcagcaggacagctggagtataccagagttgactcatttattttatgcatgcttagtgtggcatccctggggacatgaaattccagtgaaatccagtctttgtgctggagaagctcatagatctgtggaggaggcagatgcccacccactcactgtacagtacaaggggttgagggcaacaaaagagaagtgtgcaaatgctagtggcaacaggtgaggcggggaggagttttgtgaaacagagatgatggtaaaggagaacatgagtgcacagggataaaaacacacagtacgttttgaagacaaaagaaaagccagtgtcagatctaatgtggatgaccgtctgcttgggctgtggttctcagccctggctgcccattagaatcatctggagagtaaatacagatgccacatgtcctatattttgatatgggtggtggctagacagatgtatttctatgtaaaaatttattaggccatatacttaagatttgcatcctttactggcttaaatcacacctcaatgaaattaaaatactaatccttatgcttcaacccagaccaatcaaatcagaatctgatatgcaagcagagctgaagaccattgttccaaaggtctgatatgcaagcagagctgaagaccattgttccaaaggaggaattttaaaaaaacatacctggctgggcacggtggctcacgcctgtaatcccagcactttgggaggccgaggcgggcggatcacaacttcaggagatcgagaccaccctggctaacacgatgaaaccccgtctctactaaaaatgcaaaaaaaattagccaggtgtggtggcaggtacctgtagtcccagctactcgggaggctgaggcaggagaacggcgttaacccgggaggcggagcttgcagtgagcccagattgcaccactgcactccaacctgagtgatagagcaagactctgtctcaaaaaaaaaaaaaaaaaaacataccctacttcaaaggacacatatttttaaacatgaatcaaagccttagattccactatatactacggagaaattaacaaaaacaactaaaatttattgaggttaaaaatcaagccttatttctttttttattattttttttttgagatcgagtctcgctttgtctcccaggatggagtgcagtggtgtgatctcggctcactgcaacctccgcctcccaggttcaagcgattctcctgtctcagcttccccagtagctgggattacaggcgcctgccaccacacccggctaatttttttgtatttttggtagagacggggtttcaccatgttggccaggctggtctcaaactcctgacctcaggtgaaccacccgcctcagcctcccaaagtgctggggttacagacgtgggccaccatgcccagccaattaagccttacttctgatccttaccaccactccataacgcagactaagttatagcaatactattttacagatgaggacattaaggctcagagaggtcactgtcttgctcaacggcacagagctagcaggaagtggaactgggtggctgtctgcagtggagggatgcatatgtctccgaagagatccaagtatctttccttaagggaattactaaatatcatcaaatgacttttgtagcccaccaccatatctaactcaagctctaacaacttctttaaaaagaagcttttgctgctacagaaagaatttctgcaaagcaggaagcctgaagtcagcaatgattaaactgccccttgaaacccttagctacttgcacgtctctttgtctttggggtctcatctcagcaattcgtttcagcttcagtctgcaccaggatctcaaatctgtcatggcgagggcaagaagaaatgccctcctaacaagactctgggcatcgctggagctgcctgcaatccagacttccaaagactcatattcttcatgagcaggtaacgaagctcataggaacaggagaaactgcacaaaagcagaaaatgacaattcagaacacacacccatccagtgatggcattaaggaaatcctcaaagcccttagcaatgtaactgccaaaagaaaaaaaaaaaatgacttcctataaaaaaaaaaaagggcccaagtagaagttataataaggatccatatacatactgcaggttatgaaaattactgcagcattaaaagtgatagtagaataatgtcatctagtgtatatgaaatcctggacaatataagatgggttgcttaaggataaaggctaatactgcttagaaacaccagggaaataagaactgtatgtaagaggaaaaatattcacttggtatttctggatcacctctctgctctttgcaggagagtaaacagcatttccggatggcatctcagcagttctttacattgagagaacttctttctttcttaagccaggctctgctgtttgagctgaaaagttcgggaagacattattccacattatttcttcactccccgttctatttctaaaatctcacaatggataacagagagggctctcttctattgtggagaagactgagaactaagggaagcatttgaaaaggggcagttttggaaaactgcacaccaacggtcttttctaagaatccagacacaagacctatgcagctggaatatattttaaagtgtctcctccaaattctcaattttaaaaatgaggaaaagaagactcagggcagtgaagtgacttgcctgaggttacactgacttcatggcagaactgggtctagtaaagccgtaatttacattttatatatggctgtataacgtttaaagccctttctcagatatgatctcataaataccctacggaggatatcactttttttcagatgaaaaaattgaggctaagagaatcagtaatttttttttccctaagcttacacagctagtaaggggtggatctttttaagacaggtgtctggaatccctctctggtatccagaaattgcctgtgccaagtgtgtggctagcatgctaacgtccacatctgtaccaggctccatttgtcctgatttgctctaaatgtaagctacgccatcctctctgcccacaccccagataaggcttcttgcctgtgcattactgagtaaaatatattcgggcagcttcaggcacatgctgtactgagaaaattgagacaaaaggctaaggatgtttgggcacaggcaagaagctagattacaaaggtacatcactttcatattcatttgtacatttttcctcataagaaaattaggctttaatgtaacctcaatttcaaccttgttgctttatcgcccagagcccattagagagctatttcccagggccaggaacttatgattggaggtcaggaggctggggttttaatcgactcatgatgaagctgctttcctggggtgtcactcactcttctgtctcagctctgccctgttctcagggcggtgggtagggggtgcaccctacataagcagtgaggatttttcttaatacaccagaggctgagttaactgccaatgaggcgaggggggagcagggaaggggatgggaaacggcttcgttcattcactcacagaccaacatatatcaaaactgagcagctaaagcttgcaaatacactgcccaagataatgtaagggcaggatgtgttccctgccctgggctaaaccaggtgtctaatccatattagggggcacatgaagagcccctgaggagtttcacgtgtcccaaaacaaacaatcctcaaaaaattcttcatataaaactatctgcaaattgggaatgttctcacccactggttctagatgcacactggaaacaccgaggtaggcttaaaaaatgttgatgcttgggctccacagccctttggagattctaatataattggtctggggtgtggcatgggcactgggattttttaactgtcccttccccgtcttccaggagattctaacatgcaggcaagtttgagaagcacagctccagcagaggcctaagccagatttcccagccggcctctgacctgaaatgtctccctaacctccatgtccatacctgggaaataagagggaagggcatgacccttctgtctacttcctacatgctggggccaaccattccaggtacttgacacctctgggtaggatgctggtgagaacaccggagcaattcacttcagcctgctgcaaaatcctcgaagtctcgcttatcctactaaataaaatgtttatcaggcctcagacttcaaaacatacatgcgaacagccactggaggcctgtgagaaggttccttacccgccagcacctagcacaatgccagctctgctgattcccttcaaagcagatttcccttgctgcttcctgaggtcagcctcctacctcttagcccattatgcagcctggcacccctgccatttaggtgttggctgcttttcctttaagcaattcccttatcggggctcagggataatgcaaacatcaggaaaatactatttttatattctagtgggtacagcttataataattcatgctggtaggttttgtttcctatatatttggatcccgactgcggtctacctccaggcaggaacaaaatggatgcagttggaggcagcgggggaggctcctgaagcgtttgatgccgattcagcaccctctctgcccctctgagagcagagtgtggagtctcacaagtgttgcttctcatcaggaagctcaggagaccaacagcaagagggacgcactggaacatggctttctagccagagaatcccaagagaagaataaccctttagtttccgatgtaggtcattctttaaaagcaatgccttgtctatatttatttaactattttttaatcttgttttatttttttcccagcataacttttcctcaattcctttgcttttcaaatcctgcctgggagcaataaaacctctatcaataagactttaaaacccaggctctgttactaaggagccttgtaactctgagtactcaaagactgaacccctctctgagcctcagtttctccatctgataagaagatcacacttcactagctgattgctaaccttccactctgacctcacatgactctatcactgtaatcccctttttattccattataatctttgggtcttatttccagcatctaatccatggcaggcattaacatgatctttccttatacaacccattcttattccacccctgcaaaaacgcaaaagaaaaagtgtgtgtttggaaagggaggggatcaattggattttttcaaatttaaaaatgttcatcatcaaccttttctgtgattgcaatgttggtggtgatgaaaataaattgcctataaaatataaaactgtacctttttggtccactaaatgtcatattttacatctattaacactagtattcataccaaaagccaactatcgtattattgtaaaaagtgcatcttgtgagggcaaaagggataaggatactaaaaaacgtgacactgaatgccctacacatgtttatggaatcttatggtgtttgggtattatccttgttatctcaggtagaaaggtgttatcaaattataaacttgggggctgttgctatcaagagcagttaatttctttattgatactattagattacaaaatatgtctattccactaacccgacaaaaagagcacagtggtgtgaaacaagtgggcacaaagagccaacaaatttcgtggaattcatgcttatttcagttatacagtatatcagattgttcgttagatcacaatgaatatgttattatttgatcccaaatattcctttttgcaaaaattggattacaaaagtaactttattataccatttcaattatttccctatgaactaattctttttaaaaattgacaatgcttctgattcctctgtttagcaagaattttcttgttctgtccttcctcttttctcctcccagttccaaatcagaagggtcaacaggaatacacttaaaagtcctattttccaccaaagccctaatatcaaatgcttttgatttgaataaaatcggttccattagcacattcttaaaaaatcaattggctaaaaggtagtgaaaaaccatcacatttcctgtgagcaggattgtattgccacaggaatggtggcataggatccagaaaagcaaaatttcatgttgggaagctgtgctatgataccaattgacataagtattaatgttgtgatctttttgaaatcttgtattacattaaattatagtttcgcagctgtgtaaggagcaatgggaagaattctggtcacttttctttaaaaagctcctcctctggggctacaaggaaccaggcttggctaacataagcagccctccagttgacagccagacatagagtctccacaccctaaaatcatcaaaggctctcagatgtcttttcccctccagctttattacagcctaactgacacacaaaaattgtatgtgtttataatatatgcacaatgtgtatacaacctgatattttgatatatgtacacatggtgaaatgattaaatccagctaatcaacatatccatcaacttacacacctttttttgtactgagaacatttaaaatctactgtcttagcaattttcaagtttataataaattatttactatagtcacttcattgtatgacatccagaacttattcatcctaactaaaattctataccctttgaccaacatcacttcattccccctccttgctttttaaaaaatgactactgtatagggacagtgaagagtatgaaataaggaaactatctattttcaaagagttgtaattaacaagctactggttttttcacctcctattgtagatgccagatagaatattcacgtcttatcttgtttgaacatcaaaacactctcccacatacacctgataaatatcactatctccattttacagaagagaaaatggaaatttaaagtgtttaagtaacttacacaggacctccctattggaactccatgagcctgcgatcagcccacgctctctccaccattccatgccgctggagtgcaccacaaagcaagataaaacaccaaagaggaaagcaacttaggttgttaagtcaataaactaaggcaaacaacactgcatgcattttattcttccaatatatttttggcggagaacaaattgccctgggagaggtattgtataatttcatttggagcctcatccttctggtagcagcaaactgaaacacacacacactaaaatcagattgcaattaaaatccaattataaatatattactatattagacacctacccaggaaagatccagcaggggaccttctctgaaaggcagtgtgtcacagtcttcaaactgcttccacgtgtacttctgactgtgccccctgaccttgagtgtgtgttaaacaatgcttggcagtttttctctgagtggaaaggactcaatttatgtctcatcatggagtaagtttaataatactattaccaatttgctttggagaatgacatgcaaggaatattaaatcttcctcatgcagactattaaacaaattaaacacagcatttaaactggtgggattcaagagatggaatctgtgtgaggttaggaaacggagccacaaaaaaaggtccacatgtgatgttcacaccttttcggctctttgttcaaactgtacgttatatctctgacttgaaatgtctggcaaacagatctccaaagcaatgggcagtcacatcccctctacccaaagctttgttttcttacaacatgatgcacaaacgaaatgaatggcaatcaacaccaagtatgcatcatgtctgacgattctggagtttcctttcagttgccttctagaagatttgtgctgctggcatttaagttgattttctttaatttgacagaacatttcaacagcagaactcaggcttccaatatttttcaatagttgtccttgagctcatttgtcatcattaacacgggccatccagacagatcacccagcacaactccattcacccgtccagttctccggtgagggtgcagtacctgggctggctctcaatatttttaatttatgaaaatgtctaaaggccagccaccggacccccacagtttctttttaagtggtctggcatagactatgaggccacactgtatgcatcagcttcttacagctataggacaggtgctaattaatctacctaattatgcagtccagtagaagaggcttacccataggattttaaatctggaggaaaaaaacaagggaaggagaaagggagggaaaatgcttttggtttcacactgaaacataatttcaagagtcagcttatttatcatttctacttaagttggaatgatttgtatattttccctatatcataattgctgtgtgtgtgtatgcacacgtgtgtgtgtgtgtgtgtgtctgtgtgtgagtgtgtttctgcaagggtatacttttaaagcactagaaaaaaacagcaaattgaccggagaattattagcttacctttattttttaaactgcaaatacagaaagaaaaaaaaaatctaaacagtatataaacttaaaatcagtcacatgaaatgtgcaggatctcaaatgatgctgtaattccagcaggctcctgtttgcagttaaccacttacagggccagtcactggaattccctgggcatccacacaaatgaatataattacagataccatgagcacagacctatgacgctgttgattacgttagataactcagggatacggggagagagaaatcctggggtgtgcaatcgatgttgtcacatatattcccatggtttttccagctttacggaagggttgaaatgttctttctctggttccaactgccagggacacatatgaatgctgtgatatctgtcagggaaggggaaataactcctgaatttcctccaggggagtaaaagcagatcacaaaggatctagtgtctcagaacacaaccaaatattggcaatgcatcctgagacaagagtcaagtgctaagcaaagtcaatcagcacacgatggccccaggaatgagagcaaccaacctggtcctgcacgctcatttacatgggacccaagaagagacactggccgtggcaccacgtgcctgccttgggcccactcccttctacgagtgcccttaaccctttacaaaataataactagtgtcatgaattaaaatagctgaaaataatttttaaaaatgaataatttaagaattcacatgtctcgttaacactaaatgactttccagctgggcagaaaatcaaactctgcatttggcagttttacaagtcattatggaaatatgtctactcttcatttgatctcctatttctagatatcttccccaattctagatattttccttctctatatgttacagaaggtatttcaaaaggctaaaaaattgggtgccatttgtgattcgagagggataaaaaaaagaaatagtaaaatacctggcgatttaaaatggcaatgttttcttgaaaacattgtgttaagtgaaagaagccagacataacaggccacatattgtaatgattccatttatacggaatatctagaaaaggcaaatatacagagacagaaggtagattagtggtttccagggactaaggagaggaggttatgggggatgatcgcttaatgggtacagggtttctgctcggggggatgaaaaggttctggaactagatagtggtgatggttgcacactgtgaatgtacttaaagccaatgcctggtacctttttaaatggtaaattttatgttatgtataatttgcaataaaaaatgtgatactgttttaaatggtagagtttaaagcttgggttctaatgaatgacagttcagtcaaaggatcagaaattccgggcactctgctaaccctaccagggcttcacaaggaatttaaaaagagaaggacaatgcttccatctccctggtttcctgtcttaatcttctgatcttgagatctgcctgcaactgaaagagatgcagaactgggaaaagaggaacaaggaggcagatccccactttcccccacctttcttaatcaaaaagaccaacacacattcagtaaacagggtttccaatgtattccatttcctcagagtgtttacaaacaacaagaaatgaaaggtgtataagattactgcttataaactccaaactgctctgcatggctgcaccctgatagtgtctcctttccttatcaaaaaggaagaagaaaaacaggaagaaagcagaaagggaatggagagaaggagagatgacagtatcattagacacctcttgggtcatgagtgcctaatgaatatctttccattgctctgaaaagaaataatatattagttataatattagcataataatttactggttatttcatctataaaatggacacaactcatatttgttttggaagggatgagataaatgtacacatctgatttctgatgctgggagttggctctacatgatctcagagccaaagacttcaaaatcttccacaaccctctcatttcacatgtggaaaaaaacaaaggctcaggaaagaaaatatctgaaaagatgatattttatggtgggctttataggttttgattctatgaaaatggaagaaccaagtgaatgctttgtggacgcactgcctttcgcagtgtgagatgttttggcaggaaggtctgcttagaattcagaatttatagatatgagttcaaactgtgtttcgccatttgatagctaaagtattgagtaagtaattaatatatttggggcttaatttcctcctccataaaatggagataagtatatctagatataaggtcacttaaaggattaaatgagaaaaacacaggtaaatgatttagcacagtacttggagcagaagtacttggtacatggtagttgttggtagcattactactattaaaatccactctagaatgggtgttccctaaacagttctttcaacttttctgcacatttcaaaatgttcataataaaatgggaatcacatttaaaaaacatagggcttcaagaagaaataaagaagagaaggtgagcatctatcttcacaattactcctggtatcactgagacccagccaagttttaaaaacaattcatcaatagtggtgaagcccaggtctcctgactccaaatataagtctaaccaatattatatgcatataaataacttcagtacacgtgtacagttcagacgatgcacctactactcagccctctgtaatatccagtgaggcaaaacccaagtcactcaagagtgggaaggattagcgtgctatggttggccaaccaggtcacaccacttttgaacactgggtgtaaacttgatggtcactaacattcctgaccatgtgcttttaccaggatctatgtcactaactctctaggtggcctcatcccacttgtgattcagcaaaatgctttcactctttgtgtatttatctgttaataaataaatccatgttttaaaagttttgaattgtctgtagaaaataaatctagactctttcatcagagacttctagcagatttcagcagcatttgctggagcaaggtgactccagcatttctctagaggacacagctgcaggctctttggagctactcctgggttggggtgagtggggactgaggacttcctggggaaagactgagggaaattataggggactttggccatccactggaaaactggaggaactgggatctagttactcatgctatagaagtaataatgttattaatagaacatgtgctacactactgactatccgttagacagtgctttaagcacttttaatgtattcactcatttaatatgaaatgaaaggcaatgtgccaacatcggagctcaatttggtacagtggaaaaacatactgagcagaaattccaacgtgggcagggctggggaaggagtagggcaggagtgagaaaaatgaaactggactccagttctgccaccaaacggatgtgtaactctaagcaagtcatttctcctttttttggtaaaatttcatacttggcaaataggaaaaacttcacttggaaaaaacagcactgaattggaactgggggtagatgctgtaaccctgattactagtggagatggaacttatgggtagaattcatgccccttggggcattctccattgcctccctcactttctccttccctccctccctctctctttttaaaatagaaatcagatttgcattcaagtcttttaaaaaaggaggaatttgctcactaatctatctattcctggtataaaatggaagtagaaattcattgaaatgcatgtaatctaggggtttacagaaacagtatcattccagaaaaatgaattcaatttgttttaatttcctcaaagtttaaccacattaaatgctagcatatatacatgtcaacaggaaaattattaggttttttttttatcttaacggatgtttgaatgattgataaaccatgacctccatcaagacaaaacaaagacaattcaacaaagtgtcttacagctcgattgttcttgctgtttacaaagttttttcacggtaaagtataattacccttgacccgattttataggcattacatatcccagttccggataaaaggataaaagacttttatccttcttttcaatattatttttatagtaatcacaagatactttaataagtaaggtcaaaagataaataatgaaaatgtagatttcaatatgctataattccagttgtaaaaaaatgaagtgcaataacttagggtttgttctttagcaattataaacataaatagaatttccttcagcttttacacagattctaagtctgctgtaacagtcctgctgtcagaaatgcaaacagctgaaagaacaaacaccaactttacctactattctataaataaggttaaactatactgctggcaggggaaacgcagcccataaatttggtaccaccatttgcttggtacatttatatgattgacctgtataaatgtatgctgttttcactgttgacacttttataaatataaagaactgctgaataaatccggctatatatctctttgtatcaaaatggaacactcgactgttgtgaaatctggcggttaataaaaatagcctgcttttttattagcttcatccaactacgggaacagaatagtttaacagtaactaagtatgcttcaaaaggtaactctctaaaagtaaaactgtaaatactagaaaatgtatcatactagaaaaggtataaagggaaacattttgttcattatccccccaccaaaaaaaaaaacttgccctgttttttaaggaaatacttttcaaattatgcatataaagtaatatcgatcaggtaatatatataatgttctgcatggtaactgctaatgccctgtgggggtgtaaagagaaagccattcttctttgcatcttcctgagccttgtaaccatggaatagtcacaatgtgcatggcagaactctcagaagacttaaggtaatgattggagtaacagtaaaataaattacatttaccctttccgcaaggttacataaccaccttatgaaaacaaaacaaacgaaaccaaaaatgacccaaagtaaaaagaatctggagaagcatctatgaggataaagaaacccggagagttgagggctgatggctgatcagagaatgaggtccgctgactctaatgtcaggcaagcccaggggaaagggtgagtcacaagtcgggatggccaaggagggcccagacagacaaaagttttgttggctcgaatggaggtactctggggccacgactacattcaccccatgaacttaccttctctgttctcctccaacctgagataaaccagtcctttcttgaaattgactgggtgctgtggcattatacttaaggtttctttttagttccaggaatctgggaacatttgctatgatgccacccccttaccttttctaacgcctacccttcttcctactgcatcatcaggctcaatgaaaataaatctttaactgtagcaaaatacacttaaattcttccacaggaaggcaaaggctcatgaacatcttgccaaaacacaactgaaaggagaggccaagtttgtttgttgaaatcactgtctggtttcttttactatatgtctgatttcttgcagactcaagcaggtaggtcactgatttctggaaccacaatttactatgtgaacagccctgggtttccttcctttgccctcagaactgttatttgggactcaggatgagcaccctgatttagccatttatggctcaatgaaactttatgtccctccctcagagtctaagaattggcttggccaagccagcctgaaagtgcagaatggtctgccggcttattgatgatctagagtgttcatacactaaggaaagtttcctcatcagtttgattttaaaaagattccctttcccacttaagaacatctagtccagtaacaacaaagagcatgggctctgcagactgctgctgggctgtgaataccagctccctatgtaaggttctgtgcctcggtgcctcatttacaaggccagaggttctaacagcatctcataaactctgcaaggcaggagcaaagaatccctggaaaacattgaggagggtgccaggaacagaggaggcactcaataagtattagcctttactattaacccattaaaaatgctgcaagaattcctattctcaaccccttgggtaggaataataatacaaaactatgcaatggtccaatgttgatttattcaaacacaaatgtgcttataaaatcacattctagatgatgaaatgcacaccacaatgttcaaaccttagaccttgttctggttgtccttggcgcagtatacatgacacaagcaagcatctgacaggtgtgaccacactttgagactcttcagagttctatgggcctttggaagggtgggcagtttccttcttcagtgggtcactcactcactccccaatcttttacttactaccgcctatagaatcatagaccctgtccaatataccactatcctgagagatttcaagccaaaaaatacccttccaggccacttccatgccactatcctgagagatttcaagcaaacccctgtccaacataccactgtcctgagagatttcaagcaaaaaaatagcagtggctcatgcctgtaatcccagcactctgggaggctaaggcaggcagatcgcttgaggccaggagttcaaaaccagcctagccaacatggtgaaaccccatctcttactaaaaaaaaaaaaaaaaaaaaaaaaatccataaaaattagccaagcgtggtggtacgtgcctgcagtcccaactacctgggaggctgaggcatgagaaacacttgaacacaggaggtggaggctgcagtgagccatgattatgccaccacactccagcctgcgctacagagagagactctgtctcaaaataataataataaataaatttaaaaataaatgtttgctttaacaaaacttttgtattatgtgttcctaccataactttggaaaactaatagtatctattctacttacagcaagtgcagacacaaactaccaataaagcctattttgtttcccaaagtgttagaataatatctaagtgtgatagtttttctcacactttgatgctattctcacatttgtaatgttagaaacttgtatttccacatcaaaaaaaaaaaaaaaaaaaaccacaactatcaccaaatcctaaaaccatgcggctacaagattccagtacatccttatccccctgcagagctgcttttgccgggtaccagggaagcagagagcaggactgctagaagcaggggtggtgaactaagaggtaggtagatatgataagctagcccattggaaaatctaacagacaccgagcatcactgacagccaaaccacacatggtctcacattaaacaagagagagccaaataagtgcctaacatcttgacccaactagccaacttgctgccacctttgaaacactagtaaaactaacccatagctgtatataggctaagatgaagaaaatgaaaatggaaagctgtgaggggaaataaaagcttccagctcatcaaacgttcaagataataggttaccaagatgtccaggtggtatttgtttgaacatctttgtttatcacttgtcttcctttttaggtatcgaccctggtttaaatttagtgtgccgcttccagatttattttccactcttcttgaaagggggtggaagagttcctggccatagaagcacagaagctggccttccctcccccacccaaatattaccacccaccctcccatctgaaagatttgtccacaagaccatgtgagaatttcttcttatactacctaaattatcctcctatataccatttccccccattttgtttcttaaacagttatgtgatgctgacaggcactgttatccagttgttacgtgtgatgctagagttgggtccattttagtggtgctgaagttcatagttaaacaaatttgtagccagtatcaaatgtttggagtctcatctacagttattatcaacaactcaagcaaaatcatttaagtcctttttttcttttaaagggtagttactatttttttcattaaagaaagaaatgcaatagactacaatgagacaaaacacatgagcacatgttaccacaagacagaactggggaagaaaagggattttatttctcgtaaagaaacaagaagtggagacgcagtcgaaagagctgtccttcagaacgaagggtttcaatcagtataattcagagttactgggactcatgaaccaactcaaggcttgaagtgaggatgctaatcataatgatggcaattataacacattccacggcaaagcatttgaaactttgttcacagtgccttcctctacaggacaccatctcttcctaacatttatggtcttaaaataaggctcatgaatatcacctttattttgagtccaaagtcaagatggcctcagctttacataagatatttcctggaatttgctcttttggcatccactcattccaagaagagaaggtccagcatccaatgactggagaccaaagctgataagagtcccctctaaaaaataaataaaaaagaaagaaagaaagaaagaaagaaagaaagaaagaaagaaagaaagaaagaaagaaagaaagaaagaaagaaagaaagaaaaaagcaagggtgtccagggtggcagagttctctctccagaccaaaataaacatgaccaacatgtaaatgaaaaataagatcctaaccaaatctagctctgtttattctaaagttatcctttgaagactacaaactccaacatgttttatttctctccaggctcttcatcattcactccctctgtagctcatacaatacagacaatatcagcaacagcagttatagctctaactttcattttctctctggcgcccaaagtggcccaaacctggagactgtggctcaactgccttttgtgtttttgaacattaactttcttaaaggaacagaccttaagttcttcctacaaaattagtataatgcacacacttatccccatttgtaaaatgccctctttcctggcagcacgtgcccatggcctcactgaacctgcagttaaaagtggcatcagcttgcagcagcagtcacagagctgtgccactgtgctgggccgttcctaacacagatgttctccagagccacaaacacacctcctcttgggctcagaacacagctaaagtgcatttagcattttgaaatttaaaacatgtgcttagatgagtgccactcttgctgaacaatcaatttgcattacattaaattaacagtaatggagggctataaaattacacattttatgcattaaatttaatgatgaaataataggtaataacaggttaccaattctgacataactatcacacaatcagtaaattcactcaacaataatgaataacttcaaacatcccatttcctgggtaacaatcttgaaagagaaacatataaattggaaagttattgtccaccaggaaaacatacttaccctggaaagagacatacagggggccattaacctatagcatatggttaccagagacttttccatgctttctttatattgagtcatttgggaagaataaatacaaaatcacctctattttgacatgctgtttccatatcattcatttttatggtaaaaaacactaactcacatgcttggaataggatgagaacaaaggtggtagttcttggtaatccaagaaagtgagaaacatatgtatttggttcttaagattcatttgggtttttaaattaaacaacatgatttatttttacttgtttttttctctaattatctatgagcatgagacacttttcaaaaaagaagtacttaaaaaaagtgactcacatagacgtgggatggagctagatggtttcgtgtatgctgaatgatgtatgaacaaaaatattcggagagcagacttcatacaatataaaaacctaagtgcttcatgttggccgtcattactcccccagggttacgaagaccactctgaaaatgctccagttgcaatgtttgcctgttttgagcaccgatttttggatgccctttgacaaaaatgtgtgagtctttatatggcaagaaatccaagtccctccatgcctccagatcaaactgctacccctcagcaaaaagcttgtaccccatagatagagaagctcctagagatacagggagggccttttcctgcacagtctaggctgcattctgtggaacgtctgtgcccctcgggacatcaagaggtgctctgagggggaaaaaaagccattctaagcaaaaacaaatgttctgcaaatgctggcctaaacagagataaatgccatgacagggacactgcataaaataaaataaaaaaataaattaaatttaaaaaaaacacaggccgggcgcagtggctcaagcctgtaatcccagcactttgggaggccgaggcgggtggaccacgaggtcaggagatcgagaccatcctggctaacagggtgaaaccccgtctctactagaaatacaaaaattagccaggcgtggtggcgggcgcctgtagtcccaggtactcgggaggctgaggcaggagaacggcacgaacccaggaggcggagcttgcagtgagccaagatcgcgccactgcactccagcctgggcgacagagcgagactccgtctaaaaaaaaaaaaaaagttaaaaacgtttctttttaaactgcaaaactctctatctttaatgctaatatgcactgagaagcaacaaaggggtgatagggcaggcagtgctccccaaactaaactgaccacagaaatattttccacagaacaactacagctacctcaccaatcaccatcgttccacggagcacagtctgggaaacacttgtctaaatagattagaagaatcaggacattttgccccaaaagacccaaagtcttgcttactttcttagaaaacaaaaacaaaccaacaaagtaatgaaagaataaaaagtaattcacaaaaagactgggacataaaaaaggagggcgagtcttaatacatcaacttttggatttgcaggtgagaaaatgtgaccaagttaaaccagaggccacctaaactggcagtccaacagtacttctgtggctttaagggacttcgttctcactgtggggagcagagcacttcagagaagctgatgtgctcgattccgcagggagagcttcagcggaaccccttgctcaccaacctcttaatgaaatcgagagagtcgactactcctgcctccgtggctggcaccagggcaggagagacagagtgagtttaagatctgataggagaaaagaacccaaaaataaatcacaagaaaaaataaaaagatgtccacccctaaaagcttgtagcttcattttctgaaaattctagccccttgccctgggttttctttaaaaatatagttaaatgaattggattgaaaggaattgttacctgattggaagttcctctcacaccagaaaagttctgtgagatgctggaggacaccatttggcacttcccagacttcatttgcacattctcagttgtactgctataaatgtaaccactggtgtgcatatacattcacagtacactgaatgtacaatgttgaacttatttttcgagagagaaaaatttctcttcaacatgtcaatggtctcattttaccagtgtctgctcacttccaaaaatgcaaagacagaggaagaaaagttcgttctgtcttcactcgccttatgtatacgcagaaggcccaacacggtacctaaaattttcagcaataccatgattccattaagagctctggatacaggtgcttttaaagtaggttaaggaattatgttgcctggtagggatacttaacataccagcacctgtaggtgtgcttgattaataacccccgccaaaattctactcatccttaaagactcagtttaaatgccatctccttcaacatatattctgtgatgttgccacccggatgtgacttcttcctcactttttaattgttatctgcttgaactccaaaacaatgccccgatccagagcaatggaaccagggaagatacgttccaatggcagacagaagtgacgaggaatgatctgatccctatgggagccactggtgaactagagatctacaaggggaccccaaaactttagcaaggaatagcaatgtggagatatggatgggagaaaaaaaaacctcatagcagaggcgcagagctgaccttacagcagttttatcaggggtcagccctttgcctagggtttaacgctggtactctgggcagtggcggggggtcagggggaaaagaagaaactattgtaccttcatatttggagaatatttttagtcttgtgttgacgtgtgagctgccagcacaaaatacaccaaacaccttcctaactccctcaaaccaaataaataaatgaaaagagaggctgttgaaaaccttgacaagcagcttgtcaagaaaagctgttttttcacacaagaaacctcctttcagaaccctaaatcctaccaacttccattctatttgcagtacccttatctgttagtatcacaacggaaaagtgtaaattggacccaaaaaaatcctctttatttttaaagccaaaaactgatcaaggagttctgtctacatttcaaaacactgtatgcatatttcagagatatatttatagaccatacaaagaggtgcaatattgacttctggggttaatgcaatatcccatagatttatcttatacattaggttcttcaacctatgttactgagaataaatttttcatgatcagttaagcttgtaatcgatgtagaatttggaatgaagtatttatcagaacaatttgtgactggaatgatttaaagccaatacacatgttatgtaatcttctgccctgttataaaatccaacacaattgcttaggactagcgagagacacccagagagcaaaagaaaatctagaaaagtggcaaaatgatccattttaatcccactgaccagcatgagaaaggaaaaaagaaaccagaataatgcatttttaaaaaaattttagaaatctattggagaagaaacctcagaaagactttagaaaaggcgtcaacagcttcagagatacaagactgctgaggctcaaacagtactacggcttgatttcataaggacaagattgaccctacccagaacagccagaatgagaaatggggagtgtggctttatcaggcacacagcaaggtcccgcaagcctgcctggcaggcccctacctactgctttgggtttaaatatcctcaaatcgccctgcaaaatacaaacaggtcgactgcaggaggcacagagacaaactttcacgtgagcttggattggactaacacctcattagcaaagagctgcctcactcagggtaggttcaggagggggaaagagagcctgatgcctgagcaggtgagtgcttccaggtggctcctgggctaagtggaaaaggggagggacaggagggtaaatatggggaaagcctctgaacaaagtacaaagaagggaacagaaggaactaagacagcagttaccctttcacattttgtcagaggatcactctgtgaatataacagtaacaatcttaatttcaaactacatgcaatatagaccatttataaagtttttttttttattgttgttaccctgaatatctctaggatttttctgtggattcccagagtgtttcagctgaattctctagctccccacctcctctgagcacttgctggcatatttccaagctcctctggcatctctcaattcctcaggaagatacctattagccccttcatcttccttttccattttgaataagacagtccaatcttgacaattattaactataactcatcaaatatgttcctctaaaaagacatatttagggaagcactgacaaagacactaacagacaagctgcttcatgctggttcccattaaaatatttaaatatgttttcaggaaagaaaacttttaagttatttttccaaaacagctataacactgatttcaaacctgacaaaaataaccagaaagaaaagtcagatcactctaatttataaataataatgtaaaaatatgaactcaaacatgagcagacagaatccaccagtgcaataatagaataagataccaccaccaaatagagcttattaaagggataccaggatcattcaagaacagaacttttacctctgtcattcataatatcaatacattatagcagaaagatcctataatcatcttcacgggtgctaaaaaagcattcgacaaaatcaaaatccattctgatttaataggcccttaataaaatagaaatccatgaatattttttgatatgggaaagagagatatagatacacatgcatcagctcaaaagcctaaatcatactaaatgataccctaagaggcattcctattaagacaagaatggtcattgccaataccctataattttacactttctaattagtactagtgcaatgaggagaaagtcatgaataataaaaattagaaagagacaaaattattatttttgcagattatacatatatgtacctagaacgccaaagaggatcaactgaaaatggatggatacattaggagagaaggcagatgcttataaagctagtacacataaatagcttatataaacaaaagccaattaaatatacagaagaaaggtatcatttttaagagcaaaatgggcatatatttaaaaaaataaatttagaaaagtatagaattcacaagaaaaaaattttaaatcctacagagagatgtaaaagctggcaaaataatggaaagacagactttgtacttagatggaaagactcattgtaaagatgtattctcccctaaatttaatgtgaatccaataaaaatgtcaataagagtattttgaaacttggaatgttaattctaaattgcacctgagaaattaacctgtgagcattgccagtaaaattctgaaatataaggttattaactctattggctattaagacatacagtaaagctaaggaattagaacagtttgttattagcaaaccaacaatcttctgagggaaaaaatagttcagaaataaacataatgcacatagaaacatttgttatataataaagttgacatttcagatgtgggaaaatggtggattgtctaataaatatgttggtacaactggccagttagtagggagaaaataatgctggttccactctcacttcttacataaaaataaatctcaggtggctcaaatatttaaatgtaaaaaataaagatcttagcggaaacaaaggaacattagaaaaacaataatcttagcataagggaggctctattaggcaaggaacaaaaaccaaatgctatcaatcaaaagagaaagaaaaaaatgataaatttacattgcattcgaaatttctgaaaggcaaagaaaaccacaacaaagtgaaaagcaaatgacaaagaggcaaaagtatctgcaactaatatgttagataaaaggctaatttctcctaaacagaatcccttcaagtctctaaggaaagaacaagaaccttgtgtaaaaatgggtagggttattgtcctctactgggctccctgggaagcagatttaggaggtggagagtcatgtgcaggtttattggggagtattctcaggatcaacacccacagaggaaggaaaggagccaggactgttcagagacgttaggcagtgatgaaatcacaacagagacctcagctgattccacgggcagctcgagctgcgatggccattcagagttgtcccaaactggtaaaaaaggagctgagccttttagtttttggatgtagggtattccgaggaaaggggcgtgacttggccaggggagtgtgttcagcgaaggctgagttccttctgctacccacatgcacagcaactgaggactgagaacttgggtcctacagagggatctgggaagctcagcacagctgccatgactgttagtaggaggcagtccatagaaacagaaaagcaaataatggctagtccatatacaaaaagatgctcactccattcataacaaaatgtaaatcaaaacaagtatcatctctcttatcagataagcaaagataacatggttggcaacagagttgttaatactgatattcttaatgctgttgagtggaatatgaaactctaggatctcttggaggaaaatttggcagatctttctaaatttgaaatacaccctttgacccagcaccacatttctaggaattgtttctatagacagagtcacatgtatatccaaagtatgcactaaagttattaacattggctactttgggggagtatgtctggaagtgaaagaaggataggaaactataagtttcgctgtatatccttttacagtatattgaattttttattctgtatgtgttatttttaaaaatattaatggtcaaaaaggaaatctgaacaggaatttgagatacctatctataaagatatcttgatggtatacgcctctatctaaaagaagcctttttttgtttccatactactatatctaaaatatcttctagattatcttacactcaatgtcataaacttacttctctatacaggatatctgtacaaagattttaaaaatctagatgtatttatcttatgcatagcaaactacaccaattcaactcaaatcctggcagttgttaacacttttggaaagggaactgagctactgatatactactgtgtgcctactatactaataggcactttaatacattatctaatgtaatcccaacaatcctgcaagttacgtcttatcattcccaatttacagatatggacacagaatgcacacaggttaagtatccagtgctctgtcatacaactgaatgtgggggagtccaggctacatctagatgtgtacttccttcgataacatgctcctacctcccagggtattttccttttggcttccaaaacattttgtaagcaaccactggtaacctcaaataagtggtatgatttccattataaagaagaaaagactgagaaagagtaacagagaaatgtctttctctagctcagaaagctacaatttcacatagtcctaaaatgcctgtcttcatctttctgttatctccttttgaatacacttcaatccactcataacccttttcctaaaagagaattcaaaagactgaggtggaatctctgcctcagtcttcctctttgaattgccatcagaaaaacgatcaggggaaatatgttcagccaagagaagggggcagtatcccagcaccatcattttccttttaaacactaaactccaggctatatactggaaacctatcttagggcccattatatgaatcccacagaaagagacccacaaaatttggagacaaaaaagcaatagggagacaaagtgaaggatgcttctctcaaacatcaggacaatttacttaactaatgagttatgagatagcaggtagcttgagtttcccaatatccaacggaattgtttcccaaatgaaaacaaccaatgccaccaaaaattagacttgagccaatggcagaaatcctttttacaatattttaatcgtaagtaatcagaatgcatgatgggttggtttaaaaatatgtcgaggatttttcccctagatagtgttgctgttatccaaaggaaagatgctattgcttctgctccactgacactgtttatcacttcgcccagacccttcaatagaaattgctgtttctcactgccgaccatctgttgtcatctacatgaaaaatctacataaatccctactagttgctgtatttcagaagtgccccccaccaaagaaaatcacagattaattgttgctgctttaaaactctaagaaagggaaatgaatctaaatataccttcctccccccaacacacatacacatacacacacacacacacacacacacgcacacacagcaactttcatctataatttagaaaatggatgcagttcagcaacagttaaagactaatttcttatgctttttgtgcatttacataattgattcactagataatgcactctgcttccttatttaataaacatgttaatgatttcagacaattactcaaagctgcctacaagtgtctgcctaagaaaagcaacaaaaaataattaaaatgaaaatacacaccaaaaggcacatccttcatatcacattacacaagatattaagtcaatatgtcaccctgtcaccagtcacttgctacctgctgttatacatttattcaaattctaatgtattagctgaggctgatacattggttagacacccaagcgggcagacacacagagctagaaaataaacctggtgctttgtcagggtagaggcagtaaaatagcagcagcaaaggaggggagacaataaaacacgggacagaaacagaaggttgaagcagacgctttcacaagaaaaccctcttcaggctattcatggtggggggcagtcacgggggaactaaatggattccatttcctctgccacctctgagtgcttggagagcaccaagcgggccagacatcacaataggttagattttggcagatgcctcatgcattctggccattttcgggcttattttattccccagaacctttgcatgcgtcaaccactagtcatgccttgaaccacacagcaccgtggtcgtttccaccacccaagagaaccgtaaaggtggaaaggggcattaaaggagctcagatgccagacagccacgactttggccctctgtggtgcctggccagtcccactaggcttggctcttccagttcctgctggaagccatgttgcctgggcaccgtgaggctcaccctccctccccagccctccaggaagagagaggtgggtaacccaacaggtgcaataggactctgaagaaggaatatgagagcttccagcccttgctagaagctagctgattctggctggggaagtcctggttccaaacctcatagaagataggttggaagcaggaaaaaaagatgaaattatttgaggagaaagttagctgtccatcagtaacttcttccgctagaaaaggagtgtaggaagaagagtaagtaaacaagaggcttgcttgaccaggtgacactcttcacatttctaagcccaagtgtcctagctggagttaacccatgacttcagtcctaaaagaaaggttgatggtcagtaggcacgtgcgcacacgcgtgtgtgtgtgtgtgtgtgtgtgtgtgtgaaatctttaggtttttttacctgcctccttcactgtataagcccaacctgttcactgtgtatcatgcagaggaaacaggcagaaacttggcagggcaggaacaaggatagttcatccagaattaccttaagaaataggcattttatcaggaaggttatggagagccactaggggacttgaaacaaagggtgacagaaactgttttgcttccagaaggatcattctggcagtaaggtggaaaatggcatgaagggaacaaagagaccaatgaggaggctgtcacatcaatccatcgatgccgaaggcgtgagccaagggactggcagtggaatctgagtgacatcagcggcaacatggggctaaaagaggagccactgaagttttgaggatcaggccacagcagtgatgtggaaggagatgctggtctcagagtggaagggaaacaggaagtgggcaggaggtaggtgggtatcagggtggaagaggaggtatggtccttaacacagctttgtttcagttggatgctggcattcaggtgcctaaggtacatccaaatgaagtattcagaagatggtgccggaattctgcctgtagtttcactctcccacatattaaatggtccactagactacaaaggcagcaaaagggatcttttacccgggttatggcatcaccccgctcaccatcagaaagactctctctagtctctggaaacaacaaggcatgaaacagtagatccactcctatcaagtagcaataaaatacctaatcaataaattaatttaaaccacccctcccttgaaaaataaagaacaacataaatagaatgggaaggaattgcttaatgacattaattgcactcctgcaatttcatggccaattcattcatgttagaaagtggagcagataattctctaaccaaatgtccaatattattatgaaattcttataaatctactcagcagttaatttaaaattagattagaatgggatcatgaagcctgactaggccgaggggaaaggtaacctaggtgaccttttacagaggcaaaaatctacccaggtatgaaagttgattaaccaaagggagtgcacacaccctgcctaaaaagcgtgtggactgcagaagggaggggcagctgcatctacggatagacccatgatgggggctccctctgcagctctgttggggcttcacatcagacaatgtgctcggtcttcttgatgatgccttctacaaatgaacaaaagctacattccaggattccaaatgctgaggtgtggcttacgtaatcaaatgtgagccaggtgttagagacttcatccattcagctgactctgttcctgtgctatctcctacagaaaaggcagcctcctcgccagcttccaccagaaatccaacaatcccagacctattgtgattgttcgtgttactgaaggtctgcagagccatggcgggggagttcccatcagagagtctctttccatgtctctgtgcctagcagctccatctctggtctttcttgtctctcttcatctacagagaaacctcatcttgaaatctggatacccaaggacttcactctatcctacaacgaactcatcagacaagtttctcatcaaaagaaccccaccaccactactagaaaagaagttacttcagcggttaagaagacactattctctctaaatcatttccttcttatttatttatttattgcctttcctatctccctccagaaaggatctgaagaaacttacagcaaaggagtgatgtgccataattcagctatgaggaagggagggagaaaataccctgaccccatgatgattagaactgttgagattccatatgaactccagccaggagctccaggtagccacaacagaacggaaagcactattctggaatagctatttatttcatattgtcataatgataaaacatcctgataccccagaggagaaaacttcagggcagctttcaaagcatcaacttggaaggccaaattattggataagaagtcccattttgtctcattcatagccatgtgacttcagacagttttccattttctttattattgacttaaggaaagaacagatatcggactgggagtcaagaattactggtgtgatgatgaactctgagtccaatggcaaacagcttcacctttccagtgaaacaggaggcaagaaccaaacacagagctttccatctccaatgtcatatggtttttaagataagtatcattggttttcaaagagtactacacatggttaaactcctttctatgtggagagacaggactaacaccccttataaattaactcccaagcttatatagtatcttcaacagcctgtggttctgtgtaacaataagccacacatgacaaggggtgttccaccatatttcttagaagtagaagaaatacacaatcagaaaaccatacgcgaagcatttattggcctccttcagttaatcctctttgggcttataaagctctacatcaattgccattctttaaaatacagtgtacagtttaaaaataagcactgtagagccatcatttgcacacacatgaacattcacaaataatatgtacatacaaacagacagtctcatacatttggtctatatttaatgaccttgttcagccctccctatgctaacactagtatgtataacaatcttaatttaaacccatactcaaaagataacattcctaatgaaacacaatttcaaattggagttaaatctgtctcctagaccaaaatatacaaaaaggctcttgcttatatttttaaacttcatgtgacttatttaaagattcaaggttttcgctgaaatgaggcatagatgactaaactcatttcggctaagtagtaactcaggcagaattctacctgtggatttggattaatactcctcatcaaaacatatggaaagcagtttgaccaggggaaactatacttttctcttgttctgtttaaggcaatggtctgaaaaaaaaatgtgctgggaggaaaattgccatttctctacttatcagtgggcatttgtaatcattacattgtgtcagctgccctttggtgctttcattttttaaattaatttaaatagaactatgcatatctgcagagcttttaaattattagaaggcaaagacttaccttaccaagaaagagaatacaggtattggaacttcatggattacctgacgcaagatagcaagtaagttgcacacatgctgtaattcctacccatcatccagagcagacatcaccaatagatcatgaatagcactcttttactctatgcccaatgtagccttagatttcttttcattgctaccaattgatagtacatgagatgaaagctttttgtattctgtgatgtcatccaagcctgatgttatgagaaagacaccaaacaaactccaagttgggtaagatacacagtagttaggcaatagagccaggcctacaccctgaactctaagctctaaatacagtgctcttccactagacattaagcgcaatgttgtacacttaatatgtaatcctaaataggctgagtgaatagatgaaactttcccctttgttcttcagtaccttctccttttcttttggaaagatatgtctagaacaaagctcctaatcattattaagtcataatttttgggtaccaaatgaagcttactaggcaaataagaaatactgcaactcatccatctgttcaaaatactggagtgtcccattataaatcatctcatgatatcaatctaaatatcctgcatgttaaatcccacaggataagaactgcacacctctgattttgctactattgatctgtgacaccttgaactgaatattcccttctctggccaccattgtctttacctgtaaaacgaaaagtttcaaagatctgacctctaatatactttttgaatacgaagcttatcaagcatgtactttaaattcagcagctatttattaaatgtctcctggaagcagagcactatgacaaatgcaaggcaaagccaatggaaaaaaaacctaaattctggattctgccctccctctagttcctgcattcactattagcacatggtttgtcttgccactcgccaggcccatatcacaaagagggcccactgtgctctagagttgtggaaaatcgttgttcccctttctccatgaagctgtcagtcagagtagtttgggaaaaattccagtgcgatttcattctccgcagctcaatagcttctctatatgcaaactaaaaacaaaaaacaaacaaatacaaattccaccaaatatcctggtggagaatcataaacccggaaaggcagtggcaggaaagcaaatgttataaacacatattttaaatgaacgtttttctgaagtcaacacctaaaactcacattctcttaaagcttccccaactcctaaactggagaaatagttgagttcctgcccagctatcaatgaaaagaagctactagaaggaagtggaataagcaagcagtcccgaggaatatgaaaaaacatgcccattcactgtgaggaaaagagtcattacagatctaatagatgtttccttccaaatcaaacatgtttatgagcaaaagtaatatttatagttaaatatcatatatttatatttaaatgttacataatcatatatattataaaatattatatgtaaatattatattgttaaatatagttcaaatctagaaaaaatattctattgtgtttcacttattcattcaacaaatatgtactaaatccttttgtgtgctaagtaccattctaggtgccggggcatttagtgaacaagagatctttctgcccttatagagctcacatttatataaaaatgaagcctggaaagcaactttttaggacatctctctaagcatccatccatccacagactcaaagatatttattaggtaactacatcatgccaggctttaggttaagctgggagaaaatcaagaacctaagatgcaagcacttgtagataaataagcaactccctacagaataatgcaggtctggacaaagcactgtggacaggctgctactcctttaaatgtagctcactgaagagctactttcatggaggtacggacaaagcattgtggacagaggggtgatcaatgttcttcacattttagaggaagacaagtcacaattgaactggcctttgaagggtgggtaggtgtgtaccaggtcaactaagggggaaaaggtgtcctgattgataatcctatcagaaaaaaagtcacgagagtacacagagggttggacatccacaagaagccctggagcctgcagcactaggtagggattggaaggagaggattccggaaaggcaggttggagccccaaggagctggtctcaatgtcatgtccaggagttcgcccttaacctgcaggaatggcaagatgaacccatttttagtaaatatctggttcaattaaggctacaccatgtatacctaagtggggtgggatggtttatccctcaatgttttgattctcctccaactccaaaaccagtgagggaaattttactaattattactaagaaaggacatgggagtgtgaatggcacaggctggacagagcccaacacattcagagagagagaattttcttcctttcaacagctgcatccagtgagcagctgctaacccactcatagtgccagagagactcagtgggtctgatggctgttaacgggctttattaccttgttgagtacctcaaactccagttactaattacagggcatcgacttgaatgtttggctatataatttttgttaattgatttgcatgaggggatttgggcatgatcagctgtaaatgttcttccggctctaaaactccatgactcttctctattgctacatgcatcaataatgaccttgtgtattttggattgtgggtttcatgcacaattgctaagaacccttcaattgctaagaaccctcaggagcaaagttgttatgcaagggcacacaatgacatggaggcccaggccggaacaggacgcagccattatcattcatgctagctagcatttattgatctcctatcaagaaacagatttggtaaggccaagccacttctagccatttagacaccttgcctgcagtgggctcacacagcttatagacacgaagcaggtggttctgcttgattagtgaatctcaaacccttatatcctgcacttcctagccaaatcctttctatatttctccttcactttccaataccaggtctttaactcaccccttttctcatgcccagttcaccctttaacctccccaaatccacatctcattttgaaggcattcctccccaccaacaacattactctttggggtctttgactgacattctttttcttggcatttcctatttgtgggatgaaaaggggtacaaaagtaaaggccaagataggaaggacccacaggtaggctgattcaatatttacataccagacttccctgagaccatcagcgaactgctggtagaccaagcagttcacactaactctcagagccataagcctttctaatgccctggctttcaaggtgaaaaatacaattactaagaactgtgagccacagcactccattaccaactgagcttccgggcaagagatccttggaaaaatctctgtagtggaaacaagtgattctcagtcacagacaggtcacagatctacgtgacctgtcatccagatgggtcatgagccatttgttgctaagagtagtacaaattttaaagtttcaaaataattaaactttacttcgtaaattacaggagattcaaggttatcatacagtcaagtccctctcccagccctgcattctggtatgtttcatcaagtgggaaggaaaatggtggtcttagagctagggtacccattgtgtctttgcctcagtgtgagtgtgtgttccacatggaaatgttattagggcagttgtggcaaaaaatacacactgacaccgtcggctggctcaagaatagagagtgggctgagaaatgggaaaaacaatggttctgcctctcgcattgtgaaagggaggtcacccgggcaaggagtatttctttgggcacagatgcagagattatcacgttcccggatccagatgttcgaagaaagttacagttagacaggacaaatacattgtggagttctaatatacagtatggtgactgtagtgaataacaatgtgactggcacttggtatatttcaagacagcaagaagattttaaatgttgtcaccacaaagaaatgacaaatgtttaaggtgatggacatggtaattatcccagcttgatcattatacaatgtatacatgcattaaaacatcacactgtgtcccgtaaatatgtacattatgtgtcacctattaaaaattaatttaaaaagatgaatatcagcatgttacttcaaaaataattaaaaataaaattccattaaccttcaaataaatactaaataaataaatttaaggtgattttctatagctaaagaaaagatagaagaaatacatcttcaggcatataaatcttaaatcttgaaactagccaaatccaactcaagagaaagcaccaaaggggtttatattttgagaaggaaaaaacagtgtgaggaaaacagaaggttaatgaacaaagctagaagagttgcccggttttccctttttaaatacgccctagctgtttggggagttgtggccgcagccatgggaagatctttggaagattccttgggctatcaggcaacagagaccgatcaatgggaaagattaagcaaaataatacacttgtctatgatgcctgacaaattctgtctcatcttcagctgtgaggggaaaaaaaataatagtttcctccaataacattaattacccaaccacagaagaaacttgacaaaggctgatgatgtgtttacaaacagcaaagctggtgaatcaccaggcccagatccaaggattcagatacctcagaaccacagctttctccttgccacactccaggtggaaggagaccccgcgtttcaacccagccaaggcaggaatgcacacacgggcactctggactttgtgttctggaaaacgggattatacagagaagacaccgttgacgtctcagaacccaacaggctgggtgttaatccagctgtaaccattcactctccttgcacatgacttttctggaagatagtccctgaaattttgcagaagaaaaaaaaaatctcatgatctgctcaaaagccaaaggactgttcctactctttactgggtgagaagccagttccttgtcacttctctttcttttttttaagagcataaagcagaggaaaagagaggaaaacaaggggggaaaagtttgaagatatgtattaagatatgttaaaatctgttcctgttgccattttagtatgattctagattttttgtttgtgttataatttttgcaaatggtccaatagtgtggaaaaggaggctgcctgagatagtcggttccttgagttgtttcttttaatcagaaaagaagaaacaagcagtttcctttctgcccccacaggccggcacccctacagtacatgagtcataaaatagctcctggaagagccagttccatcaagtcttctcagcaactctccattaccttccccagagacctggagagatggcgccagagaacagcccagcaggaatctgtgggagtgaaaagcaaacaggaagcctgagaccctaggaggtagaagcactctgagaaggaggaaagttctggaagctacagcattataagagccatcctttagggtataaagatgaaatacagcaaaggcttggaaacagaaagacccttaaaacttgacgtcttctccagactcccccatgttataagagatgttaaatctgaggtgaaaagaggttaataaatttgtcaaagtcacacttttataacttagtactggcccatatcaaggatttgctttttcaaaggattttccaggttgcaaaatatggccagtgcagattcagcccaataccatctatcttttgtaatgaatggtgagaaggatgttcatcttgaagaacctgggtactgccagagcctccagttccttctaaatcagccaaacaatagtttgatcaacatattttcaaggtagagtataatttatccttttccaagcttcagaaaaccaaacaaccctgcatggtacatgtagtaaatctgaaacagaatatttaattaaggtagcacacggcacatggtaggtacttagtaaatgttcgcaggatgaaaaaagaatgaccaaaaccaagtattttgaccaagtgagaatagattatatcctctgaaccattaagttttgacacctcttagggaaataaaaatagcccttttggcataaatgtaggcaacatcatgaatattgaaaggaactttcaatccagagacctctgtgttgggcatgacacccaactagctgtgtgatggtagggaggtaggttaactcttctgagtttcagctaaacataaaatgttaaaaaataccttttaaagttaatgggttatttgtgtaaactaagtgatatagtgaatatgaaactacatttataaagtttaaaatactggactcagctaggtatttgcactacacagatacaatatatttgatcctcacagccgtttgtacccagcttacttaccccattgttctccaggagccaagatttaagggacagccctcctcaccatgtgctggcacaacgaaaggcactgggcacacacagataagacaaagaaaaaaatctttgcgattgattttaagcagctctctcccattagtgtatatgttttaaaggaatctgattctctttacatctagctgagtgactggccctagtttcgtgactgccacacagtaggctgttattaaatgactgttaaataaatcgataaataaatgtgttcatggtggaaggaatgaaaacaaacccagcattgggataatcgccccatccctcagacccagattagtaaaattccataatatgcaaagctgaagagagcaacagagtcgggcctctgaggtatgtgtatgttcctcagctggagccaaatcccagaccctggagagcatggaaagccacagttcaattcatgagaggacgtgccaaagcccaaccccagctgcacactgacttgtcggaaaacttaccaaattccctttcagaagggtttgctgtgaccactatcccaaatggagtgttggtcacatgtcagacttggacgccaagtccttgtccacagagtgtgggatgagcaattccatcctgacagatgtgatccctggagtgctcgaagtgacagtgtggagttttccactcctccagacagcgggcaaatatgtgctgatctgacttggcttaaacgaagacctgacagccttctcctctctggaagtgtcatctcaactggagatcagccaggatgtctttgcaagttgtgggttctcaactttctagaactggcgggggctgggaaatctgcagcattaattggatatgaacttttcattcctcctccaagctggctaatgttggtcaaaggcatatgatgtttaacctattttatgtctaaatggctacatagctcattacttcctaggtggctgccaacctttgcctttattgaataaacaatttttgagcacttgctatatgccacccactcttctagattctttacaagtgtccacttatttactgctcatccgctcccccgaggtaagtactattatttccctcagttcgcagatgtggtaatagagacccaaagaggctcagaaactgttcctggtctggattgttgcgggagctgtcgtgtcagctgaaacaatatttgatgaaagactgtgcactttggagaataaaatggctctgttcctcttcaggagtgagtcattctgaagcacgttctatggcatttaaaggatgaaggcaaggatgaagtggggaggtccgcaaggaaaagtacattgggaatattgcattcacatctgcacctttaaccaaggacagaggatatcaagggaagtacacattcatgatgtggtaggatcttttctcagattcaatcttagtcattttacgactagacctcaataaatcgcaagcatggtgtaacatatataaatatacagctagacataggtagatataaatagatagacataactagacaaatcagactctgatttaagaacaacttcctaccctttgttaactggaaaataatcagctctcatagatcctcctacacagaatgaaagggggttacttagcctatatcaagagtcccatttatcagcctttttgaaggaaatgccacaccccttcgagacacatctctccctataaagaagcagctttgcctttcctatttacccatctacccttgctgaacatcattaaaacattaagccatcatttaacctgagagataaaatttaaccctgaaaatgtacttccaattttttttacttaccagcttgtcacccacagctaatccctttcttccatcagaaacccttgtcaaaaactgatggttattgcatgctaatttcaccacaaatacctgatctgaattctaagtaattagcaaatcaggtaacctgtgagatgctgatctttttttataactacaaaaaagcttgtcacggaggatattttagttcaagaacatttccaatcaggaaacctaacatcgtgttccaaaataccacactgtattgcattcatacatttaggtgacatattgactgtggataataatgtacctttgcggcaatcacactgcattttgaatgtgcaatggcaacgaggtgtgcattatgtatgttttaccagtttgggcagctgcccataaatagggattagctattaccaaattcattttgtgaggttcagtttcctattgtgaatgaaaagcatttgtttgctcaactagaaatatgtatgtgtactgagaattttcattttgtgaggatctgaagatgggtacactcagatgataaaagaaaattcccacatagttctgaaaatcaaacgattgggtagtggaccctgggatagaagatgactcattccagttccttctctgcgatcaccaggtgtgtgacctcagtttccttacctataaaacaggaatgcaaataaacacctacatcaaaaggttgttgagaagaataaaagaaatgatgtgacaatgttatacaaacttaaatcaacactccacataagctctcatgttcctggcacgaagcactaatccaagaactgacaggacctacttcaaacaaacaaaaaataacagcaaagttgcataaacctgcttccattactgatgctcataaagcggttccctgtttatagatactagcttattaggtctatagcctacagtagtatacgtaaagtaactacgaggtgagaaggataacttttttataatttacaagttcatgttacattacacattttcacagcattgctgttttaatgttgaaccacatttcacactatagctatcttattgagctttaatattcagtaaatatgtttattcttattagaatttcaaacaaatataaaaatctctcgaaaaacagaattctgcaaatgttaagcatgaaacaacggcgaagaaggggactttgctgagaatgccatgagaacctgatgcttgcccatagctggtgctcagtgcctgcttgatgaagaaatggatgagtgaataaactatagaggtgataagaaacatagtggcaagtggagaatttcagaactgcatgctattttagagctatcataattgatcacagaaaagatggagaattctctgggaaatattagggggttatgaagagagctgtcttcacaaacgaagacataaaagtcacaatgcagagtgaacacaaagaaaattctttttatttcttcactgagacccaaccaatcatttgcccaatgaatgaaggtttcccatggaaatctgggaagaatgtttctggggcaagtaccaatctatcaaacccactttgcactggggcaagcacggatgtttggagacgagctcccattaaaagccaattgtatttcactgaagcaaaaggacaggggattgggtgcatttgggaggcggagggggtctgacaaaataggggtcatcttcttactcagaagcccaatatgtaaaacaggaaaaggctgagttgctctgactgaagcaatgggaggagagatgatgctggagccagaaggattgtggatcccatatgaagtctcaactccatggtcccccaagcagtgggaacactgctcttgtggactatctttctgaatttttttgagagctttacagtaatatagggcagaagagcagcagcagtcaccttgatccagggtttgattttatttaggcagtatgatataaaatcggaagaatttgcgttttggatttgagagacctgggttcaaatgctggctctgccattttccagctacctgggcaagtgctgaacctctctgagctcagttttgtcttctgcagaacaagaataagtaacatctatctcacagactggctgggagaacgtaatgaaataatgtatgcgcattcacatagcatgtgctccataaatgtcagttttctcctcttcccatcttttcttaatgttttattgttttgactgttcttatctccactactgggcttgggtgcacataactacaaaaatagaatctcaaaaaaaaagttcttatctagtatttgaatctttaaacagcaagcaacttagattgtagataatttgaagatgctaattacaggcaatttcttctcatagccaatatgaagtgcaaatctattagtctaaagacatatttatcttccccccgtgaaggccacttaaaaacagaaactcatggggtccaaataaaaatacaatgatatactgtggcaatagttcaataaattatggtataatcactatgaactgtatatgcagccactgaaaatcacgtttttgagccatttttaatcacgtggcaaatgcataagatatttgatgcaaaaggcagaatgcaaatatccaaaaatagaaatgtagatatatacacacgttaaaagtggtcctaaaagtgaatattttattgttattgttttctattccaaaataagcatctacttttgcctacagtcagaaaaaaacgaaaaatggccttaaaaatatttcacagtaaagaaatgatatagctgttatgatctgtaacgaatgttctttgcagtgtaatgtgtaactttcccctgctgtaggcatccatataaaagtgtcttggatcatcactattcccacagaaagatgtgtctggtaaccacatgatctggtcctcggtcctgggtcattacagtggtcatggtttcaaatgaactaaaacattttaaaaagcaaaagaagaaatatcttagtccgtattttaatagactttagccttgacaaaaggccacacacgaaagcacccacaagggctcctgttcatggaggagatgctgccagtaggggcatttctggtgctaacagtggtcttggtgagggactctaccaactgtgagtaacataagggggaaaggtgacagccgtccatggccctctcttttagccctgacatttaaaaataatttttataaattaatagaattctagatctggctcaacccaaaccagctgcctcttactacggctaaagaaaccaaggtaggaaaaggttaagtgttttattaaatatctatggacccacagttagcaaaagagccgagaccataaatgaagtttcccaacacacaatccaatcctccttcacttacctaataactactttggccagctcaataaatgggctgtctgtgaccagtttccagcttcttacaagtcttcaacataaaactggaaacaaggccactattactggggaatttggcagaacacagaattgttgtatgctacatttaatagggtcagagcaggtcttgccacctatgcgtcactcaccgcactcagcagaacgattcataaggtgcaaggacctgatttatgttgggtgataagtcaatgaatgaatcaatcaatgccaatggctccaagtggcaagagaaacacacttaacttagtaacacatcatgatttccttccatctattttagtggggtttttaaacattctacttgctgttttccagttaactatctatttctctgtttatctgtgtgtggatacatttgcatccatcagttactttagtatcaatatgccaaatcatggaaggccacatagaaattaaatggacaaggggtctgggtcccagagcagagcctaagaggatccgtgttccaggagacaccagttggtcagggcaaatagaacactagcgatcagcgtcatgatgagacggggcacctagcaatatctattcagaggcaagtcagttttccagaagacataaattctgccaggtaaaggcctcctctagagggcaggacatgtataaggttctggaatctgacaaattagacaaagcaagaaaacaccaccagcagccaacacatagacctgagtctaattgtcagataaaaacaattcaagattcgtacttcctactaaagaaggggagccgatgagggaagacacgaaattgagaccagatacgtgccaagcagggcacacaggtgacatcgaagcagtggtagctggtcagagaggagtcacagctgctgatctgctcaggggcaatgacaaattccacagagtttgtcacaggaaatctggtgtcatcttctcatctcaaaaccatcacacagctcgcacacaatcacacaccattcactgagagccttttacacacaaaggaccacactgagctcttaacatgccatttatttctccaaaaagattgttgcctgcatgatccacatagagaaacctaagcttggcttagatgaaaccacttacccaaggtaacacagcaagtgatatagagggatttaatccaaattagtcagatcactgagtctgggctcaataaactgttagatagtttaaacacctatgcaaccaaaaaaccccaaagcacacacaagatcttacaactggaggtttcatctctcaagagagtgtaggtgtctgtgcatcaatggtacagccaataggtgagcccaggtgtctcagtggcctgtatcaaaaaaaaaaaaacatgtggagcctgtagtcttaactacgtattaatgggtactttttctgactttgagtataaggtttcatcagcactttagagatattttccacatttgctgtctctctgtagtgtccaaacccataaattaccagcagcggctggcaggctgaaaattttcatatgtggtaagaccactctactccaggcttattagaaagattgggagtgaaggatctgtggaatctttaaaaagtaaaaagcttgtttttcctgaacaatcaggtgtcattgcttttttatcaagaatagtaacacaaacctaagcaatgcaaccattgccgtatacaggtcctgcttgtatgaaaaggctagaacggtttgcaattaggacagcagttgtatgctcttaaatacctacaagccctttgttcctgttgggtagatcatatgagctctggatgaacttgctccagcaaagccctttcctcctgagcaatgctagttacatctttttttttctcaacctctgacacagttatcacaaattctgcatcagtaaggtctaaattaacactatgttctgtaccagatctgcagattatatagaaggctactgttaagggctaaagagatctggaagctgaaagactgatttttgaaaaattaagagaggtatggagggataacagaaaaaatataaatgttccaggtaattagagagcactttccaagaagcaccacaaaattgcaagtgcccatcaatactaaagaatatcatgctgttgacagcacagcagagaaccttttcaaagacagatcggcagctttacccaaagcacccttcaccctgcaccacctacccctctcctgtggctccatcacaccctccaaagctcctactgagaagaaggcatcctgcttctctctgtaggttcccctagcaaaccccaaagaataaactgcgtaattgtgaaatacagaatctgtgtgtgaaaaaacacttgtttcattcttttcaccttcctgctgcctcaacacagggagtatcttccccacgtcaacaccacaccaggcatctgggggcataagccagttttccacgagatttgggctagaaatatttattgtggctgcaactccaactgtcatccattcggattacttcttgcaggaatcatagccccatcttctcaacagttcaaaagtggctgtgtgtatccagctcccctctttatttccagagcatttctgtgattttagagctgctaagcctcaccaaagtcaagtcctttatctaattccctcttttgatccagtgtctttatcctagaccacggccagtggttggtgggtttcaaaactctttgtcttttttctgtagaacttttaccctaaagaaattccattctaaatgccaatatgtaaaatagatcaaaggcttgattagaagagagttggagagctggggtcccaccaatccccaaggatggggaacctgagggttctgtggatcacttgagagtggaaacacaggaacatgactagggaaaggaggggttcacagaaatgaaagaggggcaaacaacatcccactttaaacatgaaagctgaaaatcttcaacccattcttagttgcacagggcatgtggaaatctcaaacacagaggcctgccttacaaacattaataatatctaccccttactccagacacttgcagagacctcatttaatccccacaactactatctgtggtttatagattttcagcttacagatacaaaatgtgaagcccaggatgatgaagtaacttgtccaaggccacatagacctaagtggcagaagtctgacctgagctcgatgtgggactctgaaacctttactcttaatgcatgcagggctgccatcaggtgcaagattttcaaactcttctgagtggggggcatcagcccaatgaaaggatattccagtatgtggaagagaaatgtagcaaacgtaaagactgatgccatctttcacttttttttttaaaagactgaaacatttcaagaactctttccttaagaggttactgaggacctcgatgaagatgcaagaaagacactgacagtattcacgatctattaaactgaccagtttctactaaatacctacaacatgcccaagcaccagaaagacacagatgaacatgtctcttggaataccagaataatttccccacgtcagccttgtgaatctgtttagagaggagggcccagggacagcaataggaataaaaacatgaacagacacagaacaggagcaggcagaagaacagaagaaaagggatgaggcaggagaggagtagttaatcttacacaacatttggacttttcaaacgtaattgcacatccattgacaaccgttatatcaccttatatttacccagtgctttttgtttgaatctcacagcagcatgatattataggaaggggaaatataaaaccaagttttacagctaaagaatatgtggcctcagagaggtcatctttccaaaagtcacagagggagtctccctctgttagagggagagccagagctaggatctggacctcaggactcctagcacagtgctcatcccaccacacagagcactacttgtgaagcagaacataccctttacatgttatccacatgttatccacagctacaatgcttgccagtggccagcatggtaataaagactccattctcatgtacatctccataattagattacttttccccatcctcatccccacaacctactcaccaacaattatctgagcccagctatgctcaccccttcttaagacctgccctctctggaattacagtagacaatgacaaagaagttgtagttgccagatgtctcaaactgcagtgacacacatacacaaaatcacagaatcggctgcacccctaatgcttctctgttcaaaatccagttcttcttgtaatgacatctaatcaggccctggaatcagctgaaacgagagcttctgtaaaaatcactcttcactcggtactcagcagttaagtctcttaaatgtcaacctgctaggaattactttaaaagatttttttttccttcattacaaatctcaaagctattgagtcttttcaacttccagatggatcctgatattcatatagtccagaaaatgacaatgttctttgtctgctaggtttgaacaattttgagttacttaaagaatgtgtccacattattacagacactcaggttaataataaacattgagatccttatccagatatttataagcctttagaactctttaaaggatgcaaataatttgaccaggattttttttttttttttttttttttttttttttttttttttatgaagaaatttctctacaaccaggactctggctaaatccattagccctacaatttggctatgtgaccaccaggtggtgacagtgtgccacaattcaggaccagcaaggttggcatcagggagctttccccacacttatgttgaaaaccaacctttcaaatttagatctcacttaatcccctgccacatttaaggtgttacttttaatacagcatctcaaccaccacctctgggttaggtccttcataatctgtagaaccgaaatcttttaatgtggcattcaggaccctccaaggtggtcccaccccacccaccactctcctacacagtccctgtattacagccacacttcaatgcatgtttcctgcacattcacacagatgcaaagatggttctaacatttcttgcttctgtatatttgctcttggggatatcccctgatgttcacctaccttttcaggcacctataaaacatctggaaacttgctcagacaaaactccaccaaacagttgtaaaagcccagagttctactagtatttaggaatatgctgagtgttgtttcctgtagaaaacttgtaatgtatatatataatatatattaaaaacatacatatatacacatatatacatacatatacatatatatgtaaatcattacatatatacacatatatacacgcgcgtgcgtgcgtgcgtgtgtgtgtgtgtgtgtgtatgtattttgagacggagtcttgctctgttgtccaggctggagtgccgtggcgtgatcttggctcactgcaacctccaccttctgggttcaagcgattctcttgcctcaccctccctactaggtgagactacaggtatgcaccaccatgcccaactaatttttgtatttttacaaaattacaaaatagtaattttgtaattagtagagacagggtttcgccatgttagccaggctgttcccgaactcctgagctcaagttatctgcccacctcggcctcccaaagtgctgggattacaggtgtgagccactgtgcctggcccttgtattatatattaatcttgatatttttaggataaataaaaacgtgtgtcttaatgagcgctagatcacataacctgccttatctacttagctatttctcttgaacatctttccttgtcattaaatgatacatgaagcgttttatggttcccctcaccaggagtctgctcagtctggtggacagtatgctgggcttgaaatcaaaacaccgagattcagtcctagttctagcaggtgctagctgtgtttgggcaagttgtttaacctctctgagcccaagctgcatgggtgtaatgcttacctcccaaagtctctgacagcctaaatgagatcactcatctgatcatttctagcttggaacctgccttggagtgacctctcaattattactcatttctatccactcagttgatgtgatttctttctccctccaagccacaccactctttgtaccttcctgtgcctccatcctgctggatctcaccttaaaggagcttgggaacttgctgtattccccctgccagagcataagaacactcctgaaggcagggctggcctgactcctctgactggccccagggatcccctagcatatgccaagtcccctgcagacgccaggcatctgtggaactgaatggggaatccagcctcccttcgccttaacccttgccattctgggccttgcactcttacagccctgtacacagcttggaaaaaaaaaaaaaaagtctggcgtcttttaaggccctggcttgacgttgatgctaaaaaatactttcaatctggagcttggctctttggggtcccgatgatacctctctgcctggtatcctctgcctacagcttctctcttggtggccagctctgcctcctcttctgcaggttcctcttctgtggcagcagaggataaccttgttaagtgagaggaagagtggtaccccctctctgcctcctcctcacacgggacgtaaacaccacggcttcagcagggagctagtccatgctgaggccttctccagcctttctagccttgatgtttctttattgttgtctgtggcttggtttcgtttttccattttcatgaaaaaaaaaaaaaaaaagctttcttttcttggcccttcttccagcagttgattgatttgcattggatgctgaagccacttcctgtttttccttcaaaccccccagcaactgtcttccttacaaacggcctcagaaaaaaaagaaacagctcacattcctggtacagggcacctgggaagaaaaattcattggatttcatcaggaagtatgatgttccttgggcagcatcccagggtggacctttctgttgaccctatcaggatggtaaaattgaaaagaacccccagaaggcagtcctcactctgcaggacacctactcccagaggcaccgtgtccatcataatagttctaagcgtgtgtactagaattggatgtgggtgtgtttacttctgcactgcctcctagctgtgtgacccaaggtgagctgctgtgccttgctgatccccagtttcctcatttgtcaagtgggttgagtcataagacttcctgtattggtttcctgtggctgcagtgatcaattaccataaatgcagtggcttaaatcaacacaaatctactaactgttctgaaagtcagaagtcttcaaatcaaggagttggcaggcttgtatttcttctgaaagctgtagggagaaatctgttttcttgcgttttctactttctgcaggccacctgcattctctttgccctttcttccactttcaaagccagcagtgtagcgtcttcaaatctttctcttcctgtttgtgtgtcctgtgcttttgtcattaaatctccttctttcactctgactctcctgcccgcctcttataaggacctgtaattacactgagctcgcctagttaatccaggatcatctcccaactcaaggtcctaactgaatcgcatgtgcaaggtcgctttccatgcaaggtaacagattgccaggctctagggattggggtatggacttcgctattttgcctgccatacttctctcataaaaccattatgaaaatataaaaagagcatatatgtgtatttttcagcacaatcctggcacattgtaagtgctccaaatatacagccatgattatatcaatataccaataccagcactagcagtcaaaagagaagtggttgttaatgcttagttaggtaaagcagagccatttggatcaaccttgaatgaaagcaaatggaagcgtaattggggctggatagtgcacagacacatccttttacagtttcatatcctcactcttcgttttaaaaacaaatgtttactgggcaccctctagataccatactttccattcctcacaatagtcgtttctggtagatgttaccgccttactttacaggtgacgacagtaagacttaggttacacaatttggtcagattgttcagctggtcactagcaaaggcaggatttgaatttgctattgtctgatttaagcccgccctctttccaggctccaggacttggcgacatgctggctcatactcactctgatcatcaaaactacaccagacctgccccacgggcagctggcacacttggctttcagggcagaaatcaagttcttgcttctccggtgtcctccacagccctacacccatccaggggcacacggtgggtgggctatgccatccttgtgatcttgctaggaacaggagagcccaatgagaggcctaagtgcttctggggcaatggttctcagccctggcatgtgtcacaatgacctggagagcctgctaagccagactgttggccccacccccagagttcagtaggtctgtatttgcatttcaaataagaacccaggtgatgctgattctgctaatccaggcccacaccctaagaaccacccctctgcagggatccggaagtaaatttattaaaggagaatacactgctcagatgtggggtattaacactcactggtccccacccactccacttctggacttctgcagagctgctagccctacttgactaataattcccagcagaggggcagtctccccataacctatgacacatcgctcactttcctccactgctcctggaggtggcccccattgggaatcttagctttactggctacatctttagcagagaggcctgggtcatctgtcctccctgtatcttcagctcagccaaacaataaaatgcaagacacaaaacgttgcctttgaaaatgaggcagctggggagaggaacgatgcctttaaaagggcaaaggttctttgggacaccgatcctcaacatctcaccctgcagctcaaagtcaaggcttgccagggttcaagttctcaagtgtgcttcagtggtgttatttagatgtgaccctataggctgaagggcatgcacattagcatattttgtaacagctgttgatgaagatgttaagtcttgctcaggggaccagttgcagtgagaagcattttatgagaacaatatatattgtagacatctgaatatatttccatgagaaaataaggatgaagaaacaaaaaaaaatggtatagtgtccttacacagcagatgaatatttaatacactggagcttatctttaagagaaaaaaataccctttgcaatttttcatgcttcctacaatagcaatccatatacgaaatgacaaacactatagccacccatataaataccacgtatttcattattcctttcttacggtggcacaaaggccagctgctacatgaagtatcatgaaaacataaattagtggttataaatagcatatttaaaggatgaggccatctaaaatcggttggcttaacagaggccaagaacaagtctgaggaattgataagacaggagggaaactcaggtagtatatgcagatcccaggacagcagcccacagatgctccaccaggggctctcaaaacagagttcaagggggataggtctcagggccccggaggaatgatcctactttcagttgacccttgccacctcaggagggaccaattcagagactgcttatcaccactatttttaacttcttggcaatataaccagtacaatgggaaaatcgcccaaagtaaatacatactctcctttgattcttctcctggaaagcagttttctactattttccgttagaatcatttccagggtaaatcacacttcagaggcagagcttaagtctaagggtcccctaaggagcatgtatcctgggctgggaggagctaaaaaaaaggcatgtctttgctctctgctgtagatgctgtgtccaagcaagtcctttgagaagcctctgcaagtttttcaccttcaagcctcctgcgttattactatttcctgagttttgctaccaaacaaaattacctgtagtcatatataattatttttccatgagacagcttaatattgataacatttttgtggtttttaaattttattttatttttccttttccatctctctttcctggtattaataacatttttgaacattttctttctactaggcactgtacgaggatcctctcatgtaatcctcatctcaatcctatgagctgggtaccactattacccccactttatatacaggaaaactggatcacagcagtgcagtaacttgctcaagatcttgcagcttgaaagtggtggtacaaatctaaaatccagatctgtcttcaaagtccatgcttttaaccactgcactgtgcagcctgaattcatccattcaccatattatgttaatacagttccatattaaagagaaaactgtttaaactattttaaaacttaggaaggataaatgcataacttgtgttggaattttttaagcacataaaatagtttcaggcaacccattcaggtcttcatggacccctagctgtcctggacctcacattagaaatcactgacctagacccacctgaacatcatttgccatgtgaatcttctaggtctgcacaaaacacctagttaaaaatatcgtctgatgctctggaataacaagtcaaataaaatcaaaatacggaatgacattcaagcctctttttttgagtgtgtgagatggggtcctgctctgccacccaggctggagtgcagtggcgtgaccacggctcactgcgacctcaacctcccagattcaagagatcctcacacctcagcctcccgagtagctgggactataggcatgtggggcctgtgccaccgtgcctggatgattttttgtagaaaggtctacgttgcccaggctggtctccatcaaggctctaattaaactggtccttcctatcttttcagatccatcttccagatctgtggtatgcacactgggtctgaatcagcaggtgaggggcctgggaatctgtgcttttagcaaactccccaggagacctttattggcagaaattttggaaaacatttccatcctgttcctggccattcacaaacatggtaactctgacctcctggggcaactcaccatttacaaggcacattacctactctctcagctttctgccagggctcaagcccattctccagcctgaaatgtatgtctcatgctttcctcccaggcctggctcaaaggtctcctctggaaagccttctctgctggcttctgttagaatctgtcacgtcccccctgcccccacaccacccagcttacattctgccttcttccatagggagccatttcctagtttcacccagtaagctctttaagagttaggctggttcttactaaccttggcttccccagctcttagccaaccactggccatagaaaattcttaataaggatcagcagatttaatttgtcactggcaaccgcaagtagccactgttctggaaacagacttctcccttctcacgcagcttatgccactggcaaaagaggggcgggaaatgtgatccaggattaataatgcacagatgtttctcaggaagtagtatatcactgtgtcaaaacttcctgtcataaattctgacaaaatattttagtatttgcatttgtcatccttatcaaccgctctcatacatgaaatggagcaaatgactcctgagcctgactacaccttcccaggctccagtgtaaacctcagccatacaaccctacatttttaccctgcatctgttccgtagggaaagagaattttactgattgccagctaatgtttattgcatactcactatgttccagagactaaagcctccattcttatgcatatctgacccgcataatggctctctaaggtggtattaccatcattttctacatgagagcactgagcccagagaggttaaataacttgcccacagttgcacagctagtgaatttggggtttgaacccaaatctgcttgactgcaaagcccatgttcttaactattctactggtttttaaataacaagagcctcatgatttcacagggtataaacaatgacatcaaaatagaagtgaaagaaggaaagtctctgggtctatactatggctagccggaaaacactatttcagcagtaatggctttgcatcacataagttcactctgtctagagcacagggatcatcaggcaaaagtcctggtgggcaagcacagcacttcaagatgccacgagggctgtgtccatggtcctgaaaatttaggaaaatttaggattcaaatttaggaaatagtacaaggctgcccagcccagtcctcaatgagcacaaatgccaagctgcctcaagggcagagtctcatgagattttacaaaacacaagggccaaggagactagggagttccctcacctcattttctcattttaaagataggggccaggcacggtgactcatacctataaccccagcactctgggtggctgaggtagaagaaatgcttgagtccatgagttcaagaccagcctgagcaacatagtgagatcctgtttctaaaaaaaaaaaaaaaaaacttgccaagcatggtggcatgtgcctgtggtcccagctacttggaagggctgatgtgggggcgtgggggattgcttgagcccgggaggttgaggctgcaatgagccataattgtgtcactgcactccaacccgggacacagagcaaaacccagtctcgaataaaatagaaaggaagatgttgaaactgaggctcaccaaagttatgtgtttgcccaggccacagagctaatgagccacaaagctaagtctcagacccatatttcttgctctgagttgggcttgtcttctttccttaagttttatttcttaatctcataagaaaatgtcacaagttattgtagcagtgaaacaatgagggcatacacaatgaaaaaaacctctcctatctcacgccaaccacaggcttctgccctgcaaagatcaccaatgtcaatagtttggtaatacaccatcataaaggttcctaaattcatctctatatctacaaacacacacacacacattctttctttaacaatatggagtacatagacatttatttactttgaatattttagcacttaacatgtgttgaatatattcccacatcaagcagatttagctctttcttattaaatgctgccccacacaccacagtcaagaggttgcacatgtgttcaaacactctcttcttggtagatagtcagactatttggtgttccttctgcgaaccgccctactgtcatttaagtaacaaactctgttgatacaggagtggcctctaactcatttagtctcctgtggatcaaaataaaatcctggtctcctaaatgggtgcggctgggagatcacttgcttttcagagagtagtttccatttcctgtacatcagatggtcagccctttaagcatgccaatctgcaaaaagaaaatatttctttttactttcatgtttcagagatgggatcttgctatgctgcccagattgatcttgaactcctgggctcacgtaatcctcttacctcagtctcccaaaatgcttggggattacaggcatgagccaccatgcctggctaaaaatgaattattcttatcaactgcttaaaaacatgcttactaagccatatgaacatgggcaagctgcagtttcttcaactataaaatgggaaaataataacccttacagagttgtgtaattcatagtaaaatgagatgacacatataatgtgcctaatatgatgtcaggaacacagtaggcatttagtaaaaatgactactattattattgttgttaaaattacggcatttatacactaacaaaagaggtacgcaggttttaacataaatgttcatgctttatatgtcctgacttcaaattaacatgtaactggcctctggaacattcactgccctacctacatttattgaatgcctgctctcataggtcgggggaaggggatggcaaagaggaagcaaacaggattggttggccttaaatggatatcgatgattgaagatttaaaagacattgaagacaaaatccctacacagccattcagtgtttataacgcaccttctgtgaagcgatggaaggagttctgatgtttaattctagaacttttcagcatccacaaataatgctacttccagcagagaagaggaagatttgctgctctgagttaaagctagagaatccaagtgagcacaaaggcacttcaaggaaaatgcaattagaaaaacaggtgagtggggacttgggtttccagaaatgcgtgcttagaaatactgacaggcttgggcttttcacccgagacgttttacatctttaaatatgtttgtaatttcagtggtctgcacactccagattttgttttgaaagggaaactttataaatcactgtattattattagaaataattaaactaaaaactaagatgtggttgcacacatgtttacaacgatgtgaaaaatacggctgtcagcaccagggcccagcttccatcacataactgttcgtgcgttttaatggacatttgagtgttacaaatctggccagggtgggagtcaaagagaggcataaaattatataataagaataaaaataaaaataaaaaacaagaaaggaaccggaggccggtgcagttgctcacgcctataatcccgtataacccgagccctttgggaggctgaggcaggcagatctcttgaggtcagaagttcgagaccagcctgatcaagatggtgagatctcgtctctactaaaaatacaaaaaattagccaagtgtggtggcatgtgcctgtaatctcagctgctcgggaggctgagccaggagaatcccttgaactcaggaagcggaggctgcagtgagccgagattgcaccactgcactccaccctgggcaacagagcaagactccatctcaacaaaaaaaaaaagaaaaagaaaaaagaaaggagaaaaagaaggaaagaaggccaaaggggaagaaatgaggaagggaggcagataaaaaccttccttccattttcttattcttagcattaaaaaagactccaagtgttacactggaaagtgtgtttaaaatactcggattctaaaaaagagcaaagaacctaatgtatgtttttcaaaatcctttgattctaaatccattcaactataaatctgagttattactttgaaagctagctacatcctgactttcctaaagtgatacaaaatattcaatcccaggccaagaaaaatcccaaaccaaccaacagaaggcaaggaaaattgaatacagaagcttgcaacttgaattattcggatccaaggaaattaaaactctttcatcctttttccccagttaatttttaaaacattttaaatacattgccctaaatatttgaaaatataatctgaaagtgctcaaattctattttatgagcagaaaaatatggataaatatatcaattttatctagaatgctcacagccatttctttcaaggatattggaaaatactggtagtgctgtgtctactaaaacacttctaaggcatcagaggaaaagctttttgatattttgattgatttaactctaaaataaaccatcaccccaagattctttttaaaaataaaagatactctatgtgaagaaacaaaaaatcatgcaattctttcaatatatacacaaatactaaaaaggaataaacaggttgtgagttaattacaaaaaagaaaataagcttacatataaatgacaaacaacctagcaggagacaactgttaaatggaaacatgacacccatggcaagtccttgaatagctaaccatatagactatacccgcttttgaaaatatcttctgatggggtaaaatgtattgctatatctaacccattatttaatgttttaacatgacccatctacatactttttcctttggtacaaagaaaatctaaacacatgcattcttttctcttttgtggattcaaaccaaaataaccatggtcacatgaaggatgcgtgatctcctctgccgggatgtaatatggacccgaggacctcagcccacagctctgcctcctcaggttcttttcaaggcacctccaggattcagtatctccactccatagagggaagcagcatgatttagcacagcagttcccacaagtgtggtccgtggtcccttgcaggggtcgactcttccaaggaaacccatgaggtcaaaacaattttcataatactttgacaaatagtagagttttccaggggttacatgatgtgtgataccaccacacactgaatgcagaagcagagctgggaatccagctgttttctattaagccagacataaaagagatacgcaaaaataaaaaagaatgccactcttctaactggtttttgttttggaagatttttgtttaattacaatatgttatttatgttaggatgcaatgggtttataatattttaaaacacatgtattttaaattattttctctattttcagttcttggatggtaagtatcaataaatgtaattcacataaacaaaaagctctttaagatcctcaataatctttaagagtataaaggggtcacgagatcaaaaagtttgccaaccagtgatttagcataacgcctgacatatagtaaatgtgtggcaaatggacaaactgatggattaaagggttttaataactgctttcaaatgttcagagttcaataaatgaatatggccagtaaagatctttggataaccatcttcaggtcctccacacctgcttacacatgatttaaaagcaaatgatggtaagaagacaaaaccgtaggctgggtgtggaggctcacgcctgtaatcccagcactttgggaggccgaggtgggcagatcacctgaggtcaggagttcgagaccagcctagtcaacccagtgaaacccgtttctactaaaaaaaaaaacaaaaaaaaaatagctgggtgtggtggtgcatgcctgtagtcccagctaccgaggaggctgtggcacgagaatcacttgaacccaggaggcagaggctgcagtgagccaagatcatgccactgcactcgagcctgggcaacagagcaagactccatctcaaaaaaaaaaaaaaaaaaaaaaaagacaaaactgtagagcaacaattactacactgaagataccagttaagtatgacttaaagacaagtaaagggaggatccaggtaggtagcagtacaaatacgttttcatcatcaatggcttcatttatccatcctatcactacttatttccatttcagagaaataatatcttctacgaatttggagaggatgttgttctaaagggttgtatgagatttaatacaattaaactatgcaacatcttacatggttcagtgcttataaccctacaaggttatagggtcatttgtgcggaccaattagttaccttgctgtgttctgcggccacagtgttcacaactttctaccaattttcttcctggcaatatcttattcatcttgcaaaatccagtttggacaacacctcttccaaaaagctttccctgaattcttcttttaaagagacagttaaaaattccttcctctcttacctctgtatgttgtgcctatgtctatggtaacacattctattgaaattctgtatttttgctgtcttccttactagaccatgagcaccttgaaggcagggcctgtgggttgcccacttttgagttccagcacctagcacactgccaaacatggcagacactttaaaaatccacacaaagaaaggccaggcgtggtggctcacacctgtaatcccagaactttgggaggccaaagcaggtctcctggatcacctgaggtcaggagtttgagaccagtctggccaatatggcgaaacctcttctctactaaaaatataaaaattatctgggtgtggtggtgtgcacctataatcccagctactcgggaggctgaggtaggagaatcgtttgaacctgggaggcagagcttgcagtaagccgagatcatgccactgcattccagccagggagacagagcgagattccatctcaaaaaaaaaaaaaaaaaaaaatctagtcagtcaccttacaggccaataggactagtattagaattaagtaaaatgctaaggaatactaagacaatagtaacattccatatgtttccggcccagtcagaaatccagcatgtgtgtcttagtgagttggtcttaacatgtttgagaatgaagggtagccattctaccattaaacagccactaaagagagccctttcctaaaaacattatctcctggaagaacattgagctcttttcatccttctgaaacgatgcaaattgcaaatggtaaggcaagaatttcaaatgataaattaaaccaaggtaaaaactcacaaagcaaaaagcagcactaaagtgaaaaagggtcaattagcagaaaatgaccagaaagggggaaaatgtgacaatctgggatgcttatgggacgtcaaagagggtttgaaattcatgctctgaaattaatcagactttgttgccaccttttcagtgacatgcccatcagcaaagaacaagcattgtcattagcagaacaaagaaaaaaaagtgtatgcctaggattagctttggcaaaaaaaaaaaaaaaaaaaaaaggataaagtaggtcatttccatgttcagctttaagaatacggccatatggtaagaattaagatgttgcccagaatctaatatgggagagatgtctgcatactccaaaagaagagagaaataccaaacaccagtagcactagagtggaaatctgagattgggtaactaaaggcaatctaatcttgtgaaaagctacagagaggaaaggtcttgaacataaagagcttgtcctttcttacagccatccactataattggatgtatacccttttgtgagactttgaaaatagcaatttatttctcattcattagcctgatttcaaaatacccttaatggatgtctcaattacagagactccaaggtcatataacacccagacacccttcatatctgttttctttactgtattgtaactcagttttccttattagaggtagagttttagccaagaaggaaatctcaccatggaactacagaatgttaccagtgaaagtctctctaggaattgactaatctaacctcagccactttaggaaaactgaagcccagagaactcaagttcctcgcctgaggtcacacagctcagtatcatcaggaacagaccagtcctcagggtttccttcctccacttcagtgttgttgccatgatagcaaaacaaagtagtgcagatactctttcagaaatgtgcgtttggaaaaattgctagccctgagcaccatttcctctctacataaataaaagcaatgctttacacctgctaccatcaccctgggaacatccatggtgtgtgagtttattccctggagccaactgcaggaagatggaagacagagcatcgcatgaagccacagtgctgtttccagtaggagaaaggttagaatgaaccatgacaaaggcttgaaaaggagcttgtggtaagtttaaggagaagtagaatatttcctagccccaaagtatctgttggttacaaagggaaacacagtgactttatagtggagatggctggcagacaccaccttaactagggaatcagatcgaggttcacatcaccagaaatgggacagctcgatggcatgacacaatataccaatgatatgatatgttaaggagagcccttcacctctgtgtggtgctcttcccctaaatccacaggctccctttaaccaggagaaaatgccagagaacccaaattggggggccttctataacgttcctaaccaatgctcttcacagggatcaagatcaagatcataaacaacaaggaaaaccaaggaatcatcacaggctgggggagactaagtagacaacacaactcaatgcaatgtggaatcctagaacagagaaaggacgctggcagaagaatgagtcaatccaataaggtctgtaggtggtggcattgtgccaatactaagtttttaattgataacttgtaccatggttacagaggttaactttggggcaagctgggtgaggagtatgcaggagttgcctgtactatctttacaactgttctgcaagtctaaaagttatttcaattttttaaaaaatgtggccaggcatggtggctcacgcttgtaatccagcactttgggagggcaaagtgggcagatcacctgaggtcaggcgttccaggccagcctggccaacatggtgaaaccccatccctactaaaaatacaaaaattagctgggtgtggtggcaaacacctgtaatcccacctacttgggaggctgaggcaggaaaatcgcttgaacccgggagggagaagttgcagtgagcctggatcacaccattgcactctagcctgggcaacaagagtgagactgtttcaaaaaaaaaaaaaaaaggaaaaaaactggctcatggatggacagagaacagagctgaagcttttccctcctttcaaacccttgttagaatcattcatatatcactctttctttcaaaagcagtttgcactagttcttcttatcctcatttattctgattttttgtgtacccatctcttaaaaatggtaatgttttaatgacaaagaccagggaataatctttatcactgctaagagcaccttgtcctgtgtttttccacaaagcaaatgctcaataaacaactctgctacatgaatgaatgggttacaatcaatagtctcatgtcctcctttcatacctctcttcccagcaattttgtcagacagacacgccttgtctaacctttcccatccttggaatgggaaggcaaagtttcctggctgctcccacacacctctgccctaacccagtgatcctctcctcatctgttaattcagagggctgaactgacacagagccatctcctatcaaagcccagttcccatgtccacagaactcaaaaacacatctctgaacagctgatgtgagaatgtacttgcttcccacagatgagttccacgcattgcactgcatttcacaattttgccccatcttcccattccataagttaaaacataaaatttgcatttgcaaccatgtgtctatcccttcacaacacactccccttacacactgaacgctgagaagcaatagctattcacatttccctgtgctctttgcctagactgctcttcacctccttttcagtccagaaaaatggtcagttatcttcccaaacttcacgcattacatcatctcctccaggaagccctccccagacacccctcaatttcccccctaagataagtctctttctccttagaattaaggagagtctctctttccttagaattaatcacttcctgctctgtggtacctatgtacctggtatgaaattctgtttcggtagttgtaacacttaatcttaatcatctatacacaaccatctcctcaactatcacaggagctccttgagagaagtaactttgctttatttattgtatatacttcgccccctaggggagtacttggcatacagtcagccatacagtaaaggtttgctgaatcaaaggactgttaggagactgttaggctgggagtgatggctcaaacctgtaatcccagtgctttggaaagccaaggtgggagaattacttgaggccagattgttcaagaccagcctgggcaacatagtgagacccctacaaaaaataaaaataaaaattggctgggcatggtggcatgtgtctgtagttgttgctacttggaaggctgaggtaggaagatacctcgagctcagcagttcaaggctgcactgagctatgattgtcccactgcactccagcctgggcaaaggagcgagaccctgtctctcaaaaaaaaaaaaaaaaaagaagaagaagaagaagaagaaggactgttacttctattctttggctcctaccacccaagaacttatcaaggtggcagacacatggaacatgcaggcgttacctggaacaaatgaacccagactgcaaagctgtttcgcaggtccttttgcttgttgcagagagctcatggtttggatgtgtccctctgtaaatgaggtttcagcacactgatgaagcatgaagtgattatctgctgacactctgatttctctgagcctctgcagcaaactaaatgatatttagcctccagacctgttgatcccatctttttttttttcctatgagcattaatgttcaataagaggacaagaaatgaatttaggcaaccagactggcaggatctctatacggctactcaagtataaagaaaaagtgaaatcttcccagaatgttctcatcagaaactccatctctgccaactctgtaatcagagtggttttccttgattgccccgacattggcaaaaccttaggatagctcctaaacttctggccagccacactgctatctcactggtcccccaaactagaaatcttagatttgtcagtcactgaattttctctcttttggctcccacattcaagtgaaaatctcatgctattgatcatgcaacaactgaaataacctaaactaccactctgttccattctgtggcaggactcaagttccagcctttgatgccttaattctagaacatccctatctgcacctcaggcccagcctaatctcatctcttccccatggctctgagggtctcctcaggagaaggtcgtcggcagtcacacacccttctctctgatctcttatcacacaggcaccatgaaatgcccagaccgagacctgcattgctgccattatttttccctggaatgccccaccctgtttctctactggataaactcctatacatccttcaccacccagctctaaagccacagtggttaaccttcactctaagaaaacacatctgattattcagtactcaatactaaagttctctctgtggctggctcctcctaaaacgtgaaaaattaaccacttatgatttgtctgcaaaatacaatctgtttgttgaatttaactatttaactgctatcatttaagccttcatatgcatctgtcatgtctttgattagactacaatttcttccttgctcagcacactgcaacctagggtcatctaaaaagacatgctggttaagtgactaaaaagcaaacatcatccagtatcagccccaggattatccctgtaattctaagaccctgatgtgcatcagaaccacctgaaaagcttgttaagaatccagatgccctggccaggcacggtggctcatgcctgtaatcccagcactttgggaggccaaggtgggcagatcacttgaggtcaggagttcgagaccagcctggctaacatggtggaaccctgtctctactaaaaatacaaaaattagcctggcatggtggtccatgcttgtaatcccagctactcaggatgttgaggcaggagaattgcctgaaccggggaggtggaggttacagtgagccaagatcatgccactgcactccagcctgggcaatgatgtgagaccctgactcaaaaaaaaaaaaaaaaaaaaaaaaaaagggaaaaagaaaaagaatccagatgtcatggcactgtcccctgggagggtctaccaaaatctgcattttccaagaagcccccactcctcccagttaactgtgctgctcctcaaacatgaaaactactccttcctactgtgggtttggtgagctccagtgccctgcttgcccttcgggctcactctgtctggagtcagaggtcagaggtaaaatcaggaggagtcactaaagaagaaaaagttcagagccctctgtgctggcttctcttgggaaatggctcccaatcttggaggcagctgagaggtgattgtatctggagagcacacggactacttatctgctctctctgaaatgccagtgagtttgaaaggcactttgtccaattagaagtgtggagaaatattcatcctgtccatgacaaagatgaagtgcttctttcaaaagcggcggtggcaggctgccaggtttaagaagtccaactattccacatcgagccagcagttattaattagttttattagtggcaggtccttaatgcaaaatgacagagggagacagagaatatccccgttactactaaaatacaaattgtccagatttaggttgtgttgttccccaacatgtacaggcggcccgccaggcccaagtggggaacggagaaggcagccagatgcctttctgcagagttccggactattaatggcatgacaaagagactcggatccttacctcaggtagctctcgagaggaaaatccaccaattttaattatcaaggaggaagagcctccagggggaggatagggagatctgagggaaaaaccaagaggaggaggaggggtggcggtagggatgggaagtgggcccgtgttattcacgctgttcaacacggcctctgcataacagcctcttccacagggaacagcgcagggctactttgctgagaattagtcttacactgtcaaccagttttttatgaccattaatcacatttgtatttataagcgttaagacaggaaaatcaaatctcatgcttcaaagcatatgtttatcaccacaggcataaaagggaaagaaaaagttgacaagcccgcactgttggcaagagctgctgcgtgtctggtggcttccccagaagcaccctgggggctctgaagaacgttttgtaagggagaagacagaactgcccagtgcctcactttgttaatgtttctccttctttctgcaccagaaattcctaaggcagaaatttaaagaagttccccaacatcctctccctcaaccctcccctaacacacccctgaactccctgcctcagacctgccaggccttcttcctctgccccacaagacagaagatcccgacaggctttgagtgatgttgctctcaccacagcttttcttttagcagctggcatattccctgtcgttcccccgaaatacccaatgacccaaccccaagctgtctgggcttcaaagaggtttccccacccgacacacctcagggccaccttcctctagatgggagtggggatagggaaactctgcaaaaggtcagaaagtgaatcgtctttgcgggccaaaaggtctctgtggcaactactcaactctgccattgtggccccaaagcagacccaggcaatgtgtcaacaagtaggtgtggctgtgttcgaataaaactttatttacaaaaccaggctgtgggtgggccgggtttgacccaccaacggggcctagtttgctgacccttattctggggcagcagtgcccaatctaagaacccaggtaccagtgagttctgcaaaactggagggaatattttaaaaattctaatggaaaacgtgcaactgtcttcatcacaacagcacaggctaacccggatctcttggctggaaccatatgggccacctgttttaagagcacctacctcacattgtctgagtaacaactaggaaataatcattaatgatttaaaaataataatttaaataaataattaaaaaatcaaaatacagctggatgatcaaagtctttcaaaacatgggtccacaatggagagagggcaggtgataaaagtggccccactggtcctcttcttcctttgatagcaaagaggggtctcaaaaacgtctaacgtcacatgtttcctaagagattccctcaaggagctcaacacacttttaatgaagtagaacatcatctcctaacctacgagtgaccaaggtcagggtgaaaaagccttacccccactttcaatattaagaactaatattgcaagtactcaccgaggaagaaaaaattgtgtaagctcatcagaaccaagggcattaccaacccactctcagattttctagaacagtatgaaaaaatacacagcactggggaaagaaaataagagcaagggggatgcaagagcaaggagcccctgcttctcttgctgagttgccaggtaagaaacagcaacccacgagcctaaaagccatgtcttcttcatctttgaccccttagtgtttaacacagtccttaaatgtcccttgaataaacgcatttttacattcatgatagacattataaaagatttaaaaatgaacatgagatgatctttgccttcttaaggttaatggtaaaataatggagaacgacaaaggagaaagacataaataacatccagtgcctgtatccacgcactctatttgctggctcccactcggcagctatgggctcttgtttttgagaggatcttctccagcctgtctatctggtttcccacctcctagctgctctgcagtagatgattcaaaggatggctggagaaggagccctgtggggccagcacaatgtcaatatcccagcaagaaggagggctgcagcctccacagggccccaggtgctgaagacagaacagatatctggccaggtgtggtggctcacacctgtaatcccaaaattttgggaggccgaggtaggcagatcacgaggtcaggagatcaagaccatcctggctaacacggtgaaaccccatctctactaaaaatacaaaaaattagccaggaatggtggcgggcacctgttgtcccagctgctcaggaggctgaggcaggagaatggcatgaacccaggaggcggagcttgcagtgagccgagattgcaccaccgcactccagcctgggtgacagagcgagactctgtctcaaaaaaaaaaaaaaaaaaaaaaaaaaccacagatatccatcattattccagcattatttatcatggaaaaaaaacaataccaaactgcaaacaacctacatgtttgtcaatagggatgaataaattaatacatgtctacaccaggtgaaattttgcaatttttaataaaaagaataaatgagatttatatctattggcctgaagtgaagctcattatatcttttaaagtttatctgttcctcaaactccaaaagcctggtgaggctaattctcatgcttatcaataaaaattacttttctccgtcaattagtatttggtccagaaaaaaaaaaaatcagtgtgtcttgctgtaagaacatcagtgtgctcagagctaaaattaggaaacacacacaaaaataaaacctgactttacaaggggcattttcctattaacaaaagggacaccaataagttctataaaattgattgttttacacggtgcatggaaagcatgatgttgcatagaaactaaagtgatatatgtcctgcataaagtgaggcctacctttaaatatcagaagatgctttcctaaaaaataaaatcatgagatagattacataaagagttcaaaggacgctgggcatggtgggtggctcaggccaataactccagcactttgggagggcaaggtgggcaaatcgcttgagcccaggagtttgagaccagcctgggcaacattgcgaaaccccatctctacaaaaaatacaatgggagtctaagggaggctatgggaggctaagggaggctcaggtaaggaggatctcttgagcctgggaggcagaagctgcagtgagccaaaatggcaccactgcactccagcctgagtaacagagtaagactctgtctcaaaaaaagaaaagaaaagaaaaaaagaattcaaaggagaactgacatatcacccagtgggtatattacagaatgcttgcatgtatgtgtgtgtgtgtatggttttatatatatttatataaagtataaatgcttttgcttatatatatgaatctcattttcccactggctttccttaaaaactaaacaaaacacaaacaccttactgatcgttagtagctcgtaagctgatttttagcctttcagctgagaggaaatggtccaaaaaaaaaaatactaaatgcatcagggagatttttcatacattcacatttccatgtgggaagcagcattatatagtggaaacaacatagtctttaaaacagaagagatttgtattgaaaggctggctccaccgttacggatttgggcaaagctctgaacctctgtttcctcatctaaagataggaatagctgcactttccttgcaccatcatcatgcggaatggaaacactacacatgaagcctctggtacaactcttggcagagtacacactcaggaattgtcatctgtattattatttcacaagctgacattttttaaaggaaagcacacctaggctgccatctccttgtagcaaaaaaaaaaaaaaaagaaagaaatcagttctgatcaagggcacatctaatagttgagagtgaaatgtgaaatgggaagatgacaccaccacacaaccagccccttcctcattcatttagatgtgtcccaggacaccacaaggctggctattgtacttcttaggctgtgtcaaaaccattttagtcaagcccagtgctttgcagataaacacattgccaacctttaaaatattcatcttcccctctatcgttccttccaatggaattgagacactgactgcttattggttctcccttcccaaacaataagaacagtaaagtggtactcatgcagacgcagcacacatagtaatccaaggacaactctgtccatcaaggaagcttcagcaagacccaaggtaccaatgggctcatttatgattctgtgtcctcacattctgtagtctcgcatctgttctgaaaatctgatggtttataaaataacaggaatatttaaaaattaggtctgtagagtgggataggtctgaatgtcaaatactattgccattcaagcttcgcttctctaagaaaagcctgcctagaatgaagatacaactgctgtccaggcttaatctaaaccttgcttaatggtgcacaaggtacttgggttgacagagctacgtgtagattttaggcggtagctctccatagagcatgttgcatgcaaacagaggtcgtgtcagcacatgtcacccttaaccaacacggtgctatttaagtaagtgccaacctgcagtttcagcaattgtgatttattgagaagggtggtgtgaataatgcggaggacttgaccattggcctttaattcctctcatttagacaggctgctcttcgctataaaatagtcattctgtaaattaatgtgttttattttaaaagtgacatgttgtactggcttatgcctaaaggcaaattactctggattgccagtttcctaaccaggctacaagggatccagcatactctacccagagtagaggaaaaatctatacaatcagtaaaagatgacaatatctaccatccgcacccaagacccaggtaccccattcaccaacaatgacatacctgctacaaaataaggggtacagtgctcagtaactgaggacctctctgcagctcagcactgggctctgcctcatctaccaggaagcaccccaaagacagtgtctgccacaattcactgtggtctacactgccctgagacccaaagccagtcaggcagtgagtgagtctattgctttcccttggttagcaatgaataatgatttatggaatagattataatgcacactgctaccagtacacatcccaacctaccatgctcctcactgagtatgtgatttgtttcctagagacttgagttcacctcccagctctgagactctggttgtcagagagttccagtgagacccttaacatctcagtctacattttctaatctgtgaaacggagctaacacttgccttacagggctgttgtgaggtcaaacagacaaggtacctatggcagtgattggtcaacagaacagtgtttgcacatactagttgttgctattcctattatcttataactccttggcacgaaaccttcaacgactctctgttatcaagtgaataacaatgaaactctagcccaacaatcaacgccctcaccagcccctattctctctcctatatctttcaaactcccaataggaaccatctattccaaatatacgtcattttacttatccccgaacacatgatgccaattcctacccctcacactttgtttctaccatcctgaaatacttgtacttctgtcttcagcaaagcttagcctatctaaattctatactttcataaaacaataatatatttttagaatctatatgtgttccacaagaataggcacaagacccagtcctaccactgggtgtactacatcccagccctgcacaaagttatactgctgcagggtggagaaggaggtgtcacatgaaccagcctaagctagtgagtatttttttaaggattcattatagaaaaagttagactttttcccttaggtctcttgctgtagaggaactgcctgtgaatagagaaaagccaacacaggaacactttgactccctggatccagcccttcctgaagtttgatctcctccttaaactttctagttatatgagcccattaattctcatctttacttaagatagtttgagtctgtttttctcatttgaactcaaaagagctatgaccaataccaataataataatagcagctccatttgcttatgaagaaacatcatgttaattgctttacatatgcaatatcctaacaattctgtaattttacagttgtggaaattgagacccagagaggctcaatcattttctcaaggtcacacgaatagtgacagtgtcaagtgtcaccagtcccagcttaatgcatttccaccatatgccaccttgagacactaaccttagcggatggctccaggggcacgtaggaagggttgttgctcttaacgcggcccctttttcaagaattgctgtagttggaagcagctccacagtaatttcctatagccctggggagtatgcttttaccaatggcacctctagatgcccttcactctctcttgcagcagggccaagactgataacgaatggcccgtgggaagcgcacgaagtccaacgtgaatcaacgatagcactaatgaaattgcttcaagttctagagcagaaggtaaactgaatgcctttcagagacatttgaacttgtgcccttccaagttcccagagaagaaagaaaatgcacatggggtgcaagccaagagtaggaacaagccatcacatatttcttatttttacttaaaatctgtaacacaggccgggcgcggtggctcatgcctgtaatcccagcactttgggaggcagaggcaggaggatcatgaggtcaggagtttgagacgagcctggccaacttgttgaaaccctgtctctactaaaaatacaaaaaaattagccgggcgtagtggtggtgcatgcctgtaatcccagctactcgggaggctgaggcaggagaatcgcttgaacccgggaggtcgaggttgcagtgagctaagactgtgccactgcactccagcctaggaggaaaaaaaaaaaaagctgtaacacttcctcacttcgaccatattggtggagaaggcagtattccacatacatcattccatagacaatggccatttgtctattttttcacggttcatatttttgaatgcaacattgtacatttcagcgtggcagtaaaagggcttcctgaaccttatttcatcatggcctaaggcttggaggttattaggtggtatagaggatttctaaaacacaggtagagccacacggcctgggtttgtattccagtcatataattttccaatcgtgtgaccttgggcaagttaattaacctttctaagctggcgttttcaccttgtaatatagagataattgcagtaccattctcattgaagtgctgtgagaattaagtcaatgcaagtaaaatgattaatatagcaccagaacaaaaaaaaaagccctttagttgctgttgttgttaataataataatattgttaatgttgttatttcaacatcaccaattatgatttttttgtgacacagtgatgtctttaggatctaaagaggtatacaggtggatttaccttatcccaaaatagccccggtctttttaaaaaatgcattctgtagttcttctgactctgtaagattttaggttgtcagctgttactgctgtcaggatggatgttacttacattcagcttccaatatataatacagtgcagccaagctcgtgaaagttatgcattaaacaagattcataccattaagggttgcagtaactctctcagccactagaggtctactccacattcatgggttcgctcttcccagaggtctgcaggtctagccagagctccatgcttcaacaaaccaaaccacactagatacggcaaggatttccttaacctggcattcacagttctccacagaggggttccgatctacagttctaatcaatcccactatgtattacacacaaaccatgactcccagaacaaatgcatattctcattgttttccacatggacctcagcctcttcatctctgtgctttgaccctactattgaccccattgataagcagttgccggccttctccacacacaacccccagcagtctttccacctgtccaaattttcatccttccaaaactggtcagatccacatttataagaagcttacctagtgatctatcttctcctttgaactcactgaattttaggtctataccactcactagtcaatgagtcacagcctatttgtgacatttctcgtattactctgtgcctttatttaactcagggcctactgacactttgcctcttcatctagatggtaagctcctgaggccacatcccacgagtgtcaaaagggacgaaatgtctgaccacttactgagcacctaatatgtacgtgaaaagcacaatgttggtcattttataatcttgatcaataagcctacttgacagatatgtctattccttttgcagaaattgagccttaaagagacaaaatgacttggcccctaaggcctcactgctattttagtagcaaaacccacaattgcttttgcaccaacctaatagtaaaccaagggtcacaattcaaatccagatctgaccccaaaagttacgtaattttgccccattatatcacatctatccaatattgcaggcagtaactactcaataaatatttaggggtaacttgaagagctgggtagcagcttatgctgaatagctgcaatatcagactatcatcaaccagtagcttgcatcaccaatcctcagaccccctgagtccgtgtgacaacttagcagctcagcagtttacctgataagccaggactatttagggatggaaaagcctccttctccagcattccagcagttctgaaggtcctgtgcctggcctcacaagcccattacaggttgcaaagatctaatgatcttctcagaaggaaactgaggagacaggaggcactgagaagctgcacaagcagcacttgcgtgattctcagagagtacatgaggctaacgcacacgctttccctgctagcagctttgtaattccagtagcactacgactcagttagccataatattatgaaatatgtctcaaacaactggatttcatttcaaacagcataaattaacaaattgcacatgtgcacagagcatctgcttacctaataattaagatatttaaaaagtcacctaatggcaccaaagtcagaataatggaataattgttacagtgttttaaaaaaattttaagacacataatccagtcacccgtgcagcgcatcaaacggagggctgctttttcctgatctctttgagcaccgtgtttggattagcatgatgtgaaaagcagcaactgctgttatgtaactaaaccctgcatatacagttgtcagtctgggtaaatttaactctgcaggtttaaggcagagcttgcttgccagagcagaacttaggaaacaacaaaaatttaaagacatattgccccagggaccacaggggaaagccgatgagggagctgttcaggcagcaaggtgcagaaggccagcgttacttcccggtgccacacccgggccttagccccctgtaatagctggtttgaaaacaatgactactgacaagagcatggttgttcaattacaaagctgtctgcattttccctctccctacatggcaataaaggcacttagggggcctaatgtagtttggaaagaaaggcactgaaacccagaatcagggggagactttaataacaggttgccttacagggagaacaaagtggatcccgtctccaggcaagggctcccccgttcccatggtgtggagaagcctgccaagagccgaaccgcggcctgagttctaagcaccgccggtcatgtggctcacgaggagcccatccatcttcctgcacctcaggtttgccagatggaaaataagggatgagggttaactctctggtggtcccttccaaatctctcatttctccctctggtttcattggcagatctatattcactacagacaaggaataactctgtaggtaacctctcattctaaaccgggctccgtcaggtgaggctgagagaaggacattcactgggaaccgtcaagatgtcaaaaaatatcaatcccatgggccatgtttccaatcctcctacctcctacccagacgaactcattacgaaacaggtttgtcctggatcccatccaaaaagacctggtgaagtcaagcacaacgaggaggttcccacttctcaggtgtctctccatgcacatctcaatgccttagggagagggtataaccagggaagagcccaccaccacacgctgaagggaagatccctcccagggggttcaagggaggctggagagtggtactgctttggctgctgcttgttttgtgtggtatcagggacatattccacaaggatgtgagtagactcgaagagatgctcaaatgactcagagcatttgaaagattttccactctgttttataaacgcaacagggccagactagaggaagcaagtgagacgctcatctcaggcgcaggatttaaggggatcccaaacaactcagccatctagataaataacattttagtgcaaatttaaaaaaattgatatggatgcaaacaatccatgatgagcaaaataccaaaatgttaaataaagagagcagcagtctaggtataagcagacagccaggttcttttaaaagagtgggtctggctcgtgtaaaataaaccattgtaacatcttccaatcccactttaaatttagatctaggaagataacctagatctaggagacttgagtgctgatgatttacccacattctcatctttgtcatatccacatctgcatttgctaaacattctcatcatggatgttcgggaatgagcaataccagccgcagaattgtactaggaggatatgccaacaaaaggtacgcagcttccatcctttgaaactagactgaacagaaattttcaaggacgactgtaggaaaattcatgtcctggaaagaagtattacccaaaaatgttcaattctaaaacgatatttctttgaaataattatttatttgagtagagataaagctttggcctgcattatattctctcaaaaaaaaaaaaaaagacaactactatatatactgatacctatttattttctggaagtgtagttcagctgatgccacccccaactcaaaaacctcagagggctcccgactgcctgtaaacttaaattcaaattccagagcccagtaatcaagaggcttactctccatactaattcctatgatttcccttaactcctccttctttcactcacccgccagcagccctgtccattctccttacccaggctttccagccttcctgcctttgctgaggctcttccctcctaggagcaggaaggcccttctctcaccacctgctagcccatctctccttttctaaatcttattcattcttcccatctcaattctaaaactgccttctctgcgaagccttagaactctgttaggtgctgaattatcagacaaagaaaagttagcaagtgatggccccaagtagcttttgcattttaatttaaccctaaattaacccaaatgcttaatttaccaaaaatgcctcattttcaaagcatactgattattccttctctgctctcgggagcagtgccaataggggcaggaaagaaagggaaaaaaaaatgagaaaaaaataaagcttcttttcctcatggactcctggaacaaagcagatattcaataaatgaatacacgaacgaatccaattttttatggacaagaagttagtccaatggccccaggaatcagatacagatgtacaagataaatattctctgtatcccaaaaaacccacacaaagaaacacacactactctcggcccaagcagggaaagaaagaaaaatcccgttttgactcctgaggcttaactgggattcccagctctcccagacctgtgctgcctgccctgggtgatttgtttccgaaactaaggacctggtgctcaaagcctgattttctccatgcaaagccattcaaaaccatcttagtcacacagatagaaggtgaaaatatattgcaagcaaactactggactgaggtctagtttatcaaaccaattacactgagatgttatgggaagggggggaaatgtaatcacatatgacaaggattatcaaaactgcttacacagtaaatcaggaaactgataacaggctgacaatggcatatacctgactgaggaatttcaggattccccaggcttgtaaaacagaaataacaacacagaacgagctgtgccgtgctgtcggggactgggatacacctgggtgaagggtggagggtgagaaaggcctgggacaggtgaagcaagagtctgtctcaaggacccttctccaagaccttgttttgcagggtgccctttcttgttacactcttcagaaacatcttaatgggtcctgaccttggtcaacacagaattagagcagtaagtcaggggtgacatgaggaaactccttggggaacagaaagagacacagagaaatcaaagttgtggtaaggactggggtctatcagagctccaccttgacaggagagtcgggaaaagagtcattctgcttcgtttctggcatcaactgactttctgaggaatggcctagaaagctatatggggcttcacgagtagggacgtgcaggcacactgagaagctctcgctcctttttggaccctgcctttcagggtgttgagaggccatccagggcaggcaaaggcatgcagagtggtgtcatgttgtaccccaaataaaagggcaataaattaactttctggaacatagagtcaccgcaggatccatcggggcccagagcaaaagcaaactgcaggagataccaaatgaatcactgacagacaagacaccaaaatagaggccctaaataaagcaactgacctggaaaaggaaataaatacctacattttaaaggagggctctcctagtcttccctgtgcctcactaggtttggggttttgttcacaattgtggcaccttgaaacactctaagaagtttggctgactcaggagggcacaggcttaaactttatcaacatcggagacggccgtgatttgcatcaagttcaatgctgtccttttggcagttgttgcacttaattgagtgaaaaaagctgtcagtctaatgccccaatcccaaggtagattcactctgaactaaccatctgccagggcttctcccagggtagtcaacacttatcatccagaggactggattcactttctcataattagatcattcctgaattaaattgacggtcccagggaaaaaaaaatgcaaagtgtgttttgagaccagaaagcggaagccgacttgttttaacaaatgcagaagactacatatttttccacagcaacagagtggcaaataaatgacttttcctaaattaggctgcacaacaattattatctttcatgccatcctttgaattatattcaggtttttatttggaaagttaaggcatttcttggaagctccacacacaaacccaaagaatgggtagctagctgttcacagtcccaggtacccaagcaaagtcaggccaggctgaccaatcttatcaaatgctgtgaatgtcaaagtctctgtgcatttgctggcacacccatgaacctgctcctcactcaaaataaagggaaagaattacacgcagtttcttgtatcccaaggtagccatttgttggagaggcctgggttaggggagtcaggtcaaacaaaccactaagacataaacctggaaccaggtcccaaaagcaacacaatcatgctctaagcaaaaacaggtgaagatatgaaacaggaggagagtctgaaggtttctctgtaaacatgatttcattccctgacagtaattgggtgatttgcctcgagtcagattcagtctcgtgggcacttaactgcacaaggtttttcaaacattgcacattaactcaaatttttccaggaaatatttctgaattaactaaagtgcttagtaattttttttctattgttcttcagaagttttcacaccacttggttatcactatttttctgatgaaacacagagacagaaaccagtgaaacactgtctcatagggccttctccaaccataggttaggaaagattaatttaactcaaaatagaatgagaccaatacattttttcctgaatatccagattagacatttccatgcttacttttgcaagggtatgatattagaggtaagataatggaaaacacaaagaacaaattagttcctcataacattacaagcgaaatcgaactgactattagattcgatgtaatatctatatatgtaatatgatatttctatttctcaaacttttaatatttatcaaccctgcttgatcttttttttttttttttgagacggagtctcactctgttgccgaggctggagtgcagtggtgcgatctcagcttattgcaacctccgcctcccaggttcaagcgattctcctgccttagcctcccaagttgctgggattacaggtgcgcaccaccatgcccagctaatttttttttgtatttttagtagagatggggtttcaccatgttcatcaggctggtctcaaactcctggcctcgtgatccgcctgcctcagcctcccacagtgctgggattacaggcatgagacactgctcccggcccaaccctacttgatcttaatagttacctgcagcatttcttaaaaacataaggtttttgggtccttcttctagaggtttaaattcagtaggtctgggcctcaataaccttttacacaaacttaccagatgcaaaaacttagagtggaacacagaggctagaatcaaagcaaaaagaataagaagaaacgtacagatgatgcaatgctggcctgggtcaggggcactcaccttcatctacacataccctaggagggtagggcctgtggtgctaacaacctcataggagcaggagatgagatcttgcagcctcgcttggccagaagctagaattcagatgcctattttaagagtacccttgaaaaacaaaccccttcatgtaagaaagactagaaaaactctaccccttgcccaaggaagtaaaaaaggaacttgccatctacctggaattccaggtagaaaaaacaaaaacaaacaaacaaacaaaaaaaagtaggcccatatgagaagctgaaatcctaaacctatggaatatgcaaacgtatttaggctctgaatttccactaccctgtgttgcaggatagagacacttgtacaacccaagaaacacagtactcagtgagaaaaataatttctgctgaagatgattttacagtcaaaaattacaatcatataaggaacaagttcactatacgtaagatacaaataacagaaattagtataccttaagtacttgacataattgactagtattaatataaaacaagcaagtctgaatatttttaagaagttttaaagaagaagatatagaaaacataatgaaggaacagaatactatgaccaaaaaataggcaagttttaaaaaattctagaaaggacagacaaacatagtcacttaaaattacacaaaggacatgacacaaaagaacacatttggcatgtttccatttatgtgaaattcaataagaggcaaaactaatctatgatgatggaagacagaaaagcatctagctttgggaggatattgcctcagaggggctttcaggggagctagaaatgttctctgtcttgatctgagtgatggtttcatgagtgttttcccatgtaaaaccatcatcacttcatgtatattaaactaccatttaggaatttcaataggcagtttaaacagcagagtagatagaatgagtgaaccattctgaaagaaccaaggaaactgcctgaaacatgagacagacagaaaaggagataaaagatataaaagaagtgaaacgggataaaatgagtagatcactcatatatccaacagaagcttcagaaaaaaagattaagaaaagacaaaagtgtccacgaacattctagaattaaaggaaaacatgagtcttcacaatgaacaagcacaagtcttgagcagaataaataaatagatccatgcttaaacatatcatagtgaccctgcagaacaccaaagaaagagaaaatcttaaaagcaaccaggaagacaaattacctgcaaaggaacaacaatatgactgacagcaaacttatcatccgcaacattagatgcctcctactggtcaaaggccactgccaagccgttgacaatgtggagaatgagttttgttcaaaatgtttgcagagagtacctattttttcactgaggctgcttagtgtcaaatgcatccttccttcattccttcaacagactgagtacccactatgtgccagcctgggcaaggaacgtttctgctttcaaggagctcaacactgtgaattcaggtgagttgtgagcgctgtaatgcagaaaatacaggtgctctagagggcaaaggaatgatgtcaaatccagaggagagaagtcaaggatagcttcttggaagagggagatccaagctgagactcaccagatgggtgggaattagcaagtgaggactgtgaactccatgacagcaggaccctcgtctgtcttcacacgaatgtatccccaggattcagaacagtaactggcacttaggaggtgctgcataaatgcttattaaatgaatgagtggataaatcgattgtaatggcaatcaatgagtggataaatcagagcagataaatcaacacaggtataagggaaagcacatggaggtgagaatgcagagcatgttggaggaccaaagttcagtatggctacaaaggcgagcacgtatgtgagtaggggaaggacagatgaaagatgagtctggaaggctggacaggggacacctgaggccaggttagagggtttgaattatattctatgagcaaccggaatccaatgtagggttttaagcaagaacatgagatatgagatttgcatttccaaaaatccactttggtcccagtgtccatgtcagaaaagtgagcactgttccataagggaaaagagcacttcctcactggtattatgacatgcagctttcagacttccacccaaaaagtatgcgcaagagagagcgagcaagagaaattgagactgtgcgtgaacaggtctaagaaataaacataaaatcctggctatccaaatcctgcagtgggtgtattttccaatcagccctgaggcttatggaagagataaaataggaaaggaatatgtccccagctccagccgaacattctgttcaggcttttcaatctaaaaacttcaatgtgctggtcggcaccattgctgttctcgtgtttggcctacgctgggccaaatcctgccccaaaatatcaacgtgtcatatgtgggcccagacaaggctttctaactcttctgaagtttgagttttttccccttcttataaaagcagtgagccagagaagagtccatggtaataattatggcttttcttgtgtggacagcatccagaaaggggcagcaagcccacagagcctggctgaataaagccattcctcagccaatgccaacttcagcaacttctctgttagcagctcttgttagagctgcaaagcaccggtagagctggcgagggtggggggcaattctgaggatatgtccaccttgcgttcaagggtcctgccgtgtcataaactctgcatctttcgtattcacagtacacagcacacgcctctgccaagccacagtcgcaggttgttctcaacaattggttaaagttacttgtcaggattgcacgcaggaattcctccagcaagatcagagtttcgctttgtctagtcagccggaagtcagctaagacagtgaggaagagagtaaaatctcacggagttctctagcacatccgtctcaggcctaggaagggcaacaggatacctaaggaatgaaaggaaaacctgcaaccagaagagtgaaggagctggcacaggaacagccagagggcaagagaaagtagaaaaacaatctctaggggcagctgtggtcagctgacttggctgaacactgcacaactccaaggagctccatttgcttaggctgcttgctacctcccacctccacacatggagaagggcacacacacagatgaaaagggaagccagggtgctggggctgttacggagacacatttaatgcagtcaggggaaggggatggggacctggggttggtggtatggtaggaggcacgagccatggtcgagagcaaccttctggactcagactcagcaactcttctaggcctcggtcctctaatctgcaacatggggttcataattcttgcttcctaaagacgcagtgagaattttaaggactgagcccagtgtgttcagaacctagagcagattaagctatcaataagagctcctaactattgtgaaccactatcacatcacataccgaactctaggataacattcttattaactcattgaggatgcagataatactttatttaatctttgtaacctcagcccctagtgcagtgcctggtgaatataagaactgattattgcagaaggaagggagggagagaggaaggaagaaattcttatttctatatcatggccacccagcaagcgtcaggcattattgtgaacactagcatattcacaaatactgtttgttgaatggaaagtatttattcatcagctacttataaaacaatagctgaggacttgctgtatgcaaagcactgtgttaaaaaccctgggaaacacgtggacaaccccacgacatccctgttctcaaggatctcataacttagccagagactcctacataaatcatcctagcaataatcaactatgataataccataatataggcccaaataaaagaggatgctgaccatcccgcccttcaccccgaccaccaaacaagatatggcatttttttcctatttccttcccgatggagagaagaaaaatttcaccactttaaagctgtgggagaaaaggataaggatgtgatcacacctggatgcagtttgctcatcctccagcccggcagcacacagccctcagcagccctctctgcccagttgccagatctcaggctcagcacacgggagggtctgatgtttactaaacaatggcctggcttatctttctccacaagaatcctaccatatggattcaacaaaggcaaagctttcgcaggacccaagaggcagggtgtgatgctctaaaggatcacttccaccagtgggaacagtctaacgcctaaattccaaaagatattactgatactgtttataattagcatgctaaataaaactgaggcaagctgctggctttcgtaggcctcatcccactatgcagttagaagaatatgtgtctgtgtatacgtgtgtgtatatatatatatgtatgcatatagacacatatgtatacatatatacacacacacacatgcatatatacacacatgcacacacacacatactacttgttgggcccaacctttctgaaatttataatagagaaagcctacaaaacatatttaccacacatgtgaagatgagaaaggcaaatggaatagactttctccttcatcctacaggacgtgctagccaaggatggattccaggaagttaaatggacctaagaacagctgaggctcaaaacatactacagattaaccacatttccagagctaggttttaaatgagagaatcatttgaggagcatccagaatactgacttgctaccctccattagctagaagctcagcaaatggaagtgcacatcgtggtttcactcacaacatgaaaagaacaacacacattaatacattagagttgtcttctctatggtttctctttaaagaaatcaacagccccaagacttagctcagtcctcttctcatcacatctaccttttcatcacaattacatttggcagtcttcgtgattccgagctgaaaagcaaagtatgaggctgtttccctctgtgggtttgttattgttcatgataattctgatgacttccagagaaaaatcctgaaagtgacattactaagttaggttaacagccagtgtccttaactcttgcttccaaatacttcatccaatgtgtaaaataaatgcaaaacaacaaacaggctgtcattgggaaagcttgagtcaagttccctaacgcagaaaccttacattcatattaatcacatagcaaggaaaagtacctacagctagtgctttcacattactgatagttactacatagctgcttaatcacattttcaatgacccagccagctcaatctactgacttggaagggtttaaaacacaaagctccggcctcttctgcaagggaaggcctgaaataaagacctcgcatttctctaagagagacctgttttttcccagtatgggggtaggcaagaggaggggaagcgctccaagggtaggaaaggaagagaaaggagtctatcagttgatgaatgaataaacaaaatgtgatacatccacataatggaagattattcagcaacataaaggaccaaggtactgatccattttatgacatagacaaacccccaaaacacaatgctaagtgaaaggaggcagacacagaagaacacatagtatatgattccacttaaatgaaatgtccagaaaaggaaaatctatatatagagaaaacagattaatggctgtcttagactagggctaggaaggaggagtaacagcaaacgggcatgtggatcttctggggctgatggaaatgttgaactagactgtggtggtggttgtacaactctataaatttactaaaaattattgaattgtatacttaagatgggtgaatgtaatggtaagtaaattatgcttcaataataatttttttaaagttggaatgaataaagaagtatattctttggtggttcctttaaaaatcacaggattatagaatatcagagctggcaggaagctgtagttcagtgcctctctgtactaaggagaaggtgaggtctcagggtgaaagccatttgcccagagccacttacataattaatggtgggctgggatcagaaccgaggcctcctggttacttgtccagtgtattcttcacaatttgtcttcattattttgcttcacataaacactcagggcattaaccataaagataataaaatatcctcacaaacagatgtgcctgattcaatgaccagaatgtttttgtggtatatatcatactggataacccatgatttggttattctctgcttgcgttagtacttatatttttcgttttcttgtcttctcagtatttgtttttaggtaaaatccatggctgtttataagctttaaattgaaggttctttccttaccctaaagattcacagatgagtttttcagaagctgaatcagctctaaaagcctcactgcttcagtacttctaatggccaacatcctaattcagagctcgccacaggggcttgtctttctaatagaaatgtaaaatagatctttatttgccacaaaattaaaatgtgatccaattatgcacaatatgaaggaacttgttgttgaattacaaaaaaaaaaaaaaattcacacactctaatttaaaacaatgataccccagccttaattaccttgggtttcactactgtgatttcaaacagtacaggaataggaagagaggtgaccatgcctaagataaaatacacataggaaaatacaactctgttgaaacaaacaaatgacaaagctaaaaaattttaactttttagagacaaaccaaccaccctgtaaattattagtatgctttaggcatcaacctatgttatgaaatgaatgtttgtgtccccataaaatttacatgttaaagcgctaatcctcagtgtgatggtattagaaggtggggcctctagaaatgtgagaaaataaatgtctgttgtttaagccacccagttgatggtgttttgttatagcagcctgagctaactaagacagccaaatactttacttttgtacagttgtgcagacctctgtataactcattacagtgatcaaggtcaaatggttacacaacatccctttctcaggaactcgatcaggggttattcatgtgcattaaagtatgtgagaaaatatttagcctccctaaatctgcattttgcaaggggctattcttgcactgacttacttatacatttatagtctatctcccaatgcttttgccttggcataaagtgaaaattaaaatagaactgcatatttagctcaacttccccgccacagaaccagtccctaactttctaaaatgtacttcagccttaaagtgatgcctgtctcgaaactgcttcacttttcaggtctctgtgtgtacaggggccagttggacagatgctcccgggatgctgagggttccctcaagaggcaggtgtctcctctagaaacatagatgttaaaatgtgcagttaacaaggaagggcagagcttcactaaccagcatgtgcagaagctcagaattgaagtatactgatgatcttacacttaagaagactccaaactgcccacagggatcagaacttttatagccagtctttctctgacaatgcccagtactgtttcctattccatctaaatgacccagctgatacctaaaatggaaagaaaaattccaaaactgaaggctgtacttataggcaataaggcgagtctaagacctaaactagataatttgagaacagggaaaaaagattccatttcgattcctgaaggttacccccatacctattataacagaataaaataaaataattcgaaactgcacaacctctaacttatcaaatcctatatatgcctcattttctcaaatgactcctaatttgtgtaaagaaaaaggcaaaaagagaaaggacagaagtatgtcaaggtgggctaaagctatgaatacccttttatgtaaactaagaaaaaaatagatacacacgcattttttaaaagggaactttttgaaaccttgagccgcaaagaggaaaaattcctggctaaattgcaccactcaaagacaactagacttacggtcataaatttcttctccaacccatttctttcaggattcttacagatccatagcattttgcaagctgacataggaccctttcaaacaatgcaacctaaccttcaccaacagctatgattctcttcctactcttctgcacagagaggccctgaccctcagctgtcgctggagctcgagatggtggccaaggcgaaagcagtcaagccggagaactcccgaaggtggttctcaggtaaccagctggttagatttcatcttgtgtgagtttagctttgcctagctaggccaaggaggcacttggcctgggtttagaatgatttctgtttttcttcagggctcaattataaacagcccaaagaaaggctctgctgtcctggagggcacctttcaagagaaacaaaaatgggacgctcgcttaacaaaaggggactgtttggccaccaacgtcctgaacagggtctgagtgtataactggaagggctttctgcaaagttaaaaagacagagaagaaaacaacagcaaaaaaaaaaaaaaaaaaaggatcatcacagaatctcccattccaaaccttccttccgctcagaagtgccaacagataaaatataaacccctttgaagaaaactccagccggagctcagctttcaggttttagaagacactggcatcccaaggccttcccactgtcagatcaaacacacacaaaatatttccctgatattttcccagtttcgcccacaccataaaaaacaggctttccttttaatctacttaccacactgtgggtgaaggcctctaatttcacagcacagagataacacaaataattcatatgacacattagtgaaatattgacagggaaaacatctagtcagagctcaccgaaaacaacagggagctcagtgatggccacagagggcagagggatgcctttccaacagggcagagccccctcccgccacactacttgagttgaagataaagtcagcctatttggatccgaattgttttaaggcaacaggtcttcataattacacaacatttttctggtccctcgatgggctgcaacatcatcaacctccttccaggacttccaggggctgctgcgtatgtgaaagtccctagaaaactgttaagtgccatcaacttgcagcaatggcaatcccacccagtcataaccaaggtcagcatccgcctggccaaacacttggtgcatttctttttctcttcctgatcaacttaaaaaaaaattctttcacttagtttcccatggctagacccagcctttgaagatctcaccccctttctcaagaccctctttcaacttcctctcctacgaagtcttcctcccagggcaataaggagacctatccacagctactattcattccatttctcccacccttaaggttctgccaagtgtggggcagattgcctttagagacaggacaactcaatgctgtctgtgtagaaagggttgtttgtttgtttgttttaaaaaaaaaaggctgcaacacttcaatcatcagttaggcatgttgggagagcaccatcaaagcagagaaaagtgaaatgcaacccgaaacagcaaagggtctaaaacctgactctgggcttacaaacgttctgactttatttttacttatttattttttgggacggagtctcactctgtcgcccaggctggagtgcaatggcgcaatctcagctccctgcaacctctgcctcccaggttcgggtgattctcctgcctcagcctcccaagtagctgggattacaagtgcacacctggctaatttttgtatttttagtagagaaagggtttcaccatattggccagggtggtcttgaactcctgacctcaggtgatccacccacctcagcctcccaaagtgctgggattacaggcgtgagccaccatgccaggcccattcttacttttttacaccttatgtagatgtagggtctccaagtcccaatccacttttgtgagagacttttctttgtcatcgtaccaatccaagcccttcaatttcccaaccacacccacttagaccttagatttattttctgctgatatcatttcaaaatccatgaacatcacctcatagatgtaaaaattcaccttctaatcctctatcaagagtgctgctcagagttaggactccagctctctagcctggccctcctaagtgccagatacttgctattgctatttttttgttttcttgcctaatgccacatgtaacatattgtcacctgctccctgctagacccccattccccgctgcccatcagatatgtccctggaacttccaactcagcccatcccaaattgaacccatgccttctctcctcttcacactctactccactacactgtcccagccaataatcccggcccacactctgcacttgactcctgccattccctccatcatgttcttccaactccacttcctggggaatcctaccgcagagtcaactcttcttcgccttccactcccaaccctcaccccagtcttggccttcaatatcagtcaccagaattattacagaatctcctaacttggttccttgtctccctccctaactccacataagtatatttaagtaccttaccaaaaagaaatcaggtatttttcatttgttcaaaattttgctataagacaaggtccgaaatgcttaggctcgcccctgcctactttctccaaccttatctcctactcctcaccagcatactctcaggccaagctacatctcacttatgttacctgaatgtgccatgaactctccccttgggtgcctcagcctggaatgccctgtcactttttgccaaaagaatctcctcatttttctaaaacccgggcaggcataaccacctcagtgagctttccctaactcctctcggggcattttctccttcttctctatgttataggtttcctaagtatctctactatagcatgctacatctttttaaagtaatgtctttcttgcccatcaattcacttaattcagctttgtcgttccattgactaacatgggacctgacacatagtaagtgcacaagaatatttgatggatcaatgcaaggaggcgatatattctattatactgcccttaaacatttgaaactttcgaggaatagattttcttgcttcatcccagtcctccctcagctggctcatctttcacatattgattctaaactgcacgtcactagcatcctgagggcattcaccgaatgctcatgtaaaaggcagagagatatgggacagaacactgaagacaatctataacctggctcccaaggaactgagaccaatgagaagataaacacagctgaagtcgcaaaatgtgaatccaatgaggactataactaatgagagctaaaaccagagtgtgtttgctactaagaaaataataatggaaaagaccaattaataaagagatgttgtcaaacgccatgacaattttcattaaaacattttattaggctgaatatgatattgatgctttttcattgaggtttgtattaaaacttctccactaaatatattcttaattcagatgccaggcattgatactgtctactatctccttaaatccttgcggggtttaaaacttacgttgttgatttcaaagacagggagtgaacagtggcttatgaagcaaattcgctttcaatatattgatcatcagagcaagcattatatatacgaaagttaaaggtattctaaactacatacaatctcatctctatggacaagtctttctgaggttctagattaccagatggtggtgttggcaatgccacagaagcaaaatccaaaagcgggggcaggtgagagatgggaggccatcagtataaccccttctagatgctgtggtggcagaatgcagagagggggccttggaggcagcaatccagactggagatggaccaggtaaaagttttcaggacctccctgcccataccaccctaacggttgaaaactcctggacaattactgccaaactatcccctgaagccagtcctcttgtgggcgaagggataatgtcactggaatgtcatcaaagtttaacaccttcttggacttttttttttttttttttttgagacggagtcttgctgtgtccccaggctggagtgcagtggcacgatctcggctcactgtaagctccgcctcctgggttcatgccattctcctgcctcagcctcccgagtagctgggactacaggcgcccgccaccacgcccagctaatttttttttttttttttttttttttgtattttaggtagatatggggtttcaccgtgttagccaggatggtctcgaactcatgacctcgtgatccgcccgcctcagcctcccaaagtgctgggattacaggtgtgagccaccgcgcctggcccttcttgtacttttaaatctacctgtcccactgggagcagccatgttggacactgccttctcaggtcctatttctgctcttagggttcatgtgtgacttaaggcatagaaatgtgcctctatctttctgctgtggaaagaaaattgtttgacaaatgtccttccttaggagataaatgacaaaataaaatgatcattcctgggcccttaatacttctttccaaaacttgagaaataccagttaataggggttctcagacatggtaataaggatgaagaggttgaaacaaacgtagaaagccttgttttcaaagcctggcattgatgccatcattgacttgacttgtcataattaatatgtgtccccattcataatcaacttgttaaaaggcaacataagccaagcatttttttatgccaaagtcatatatcttcttgatctgcctgacacaatatgtatgtgtgcatgtgtgtgtatatttatatatgtggctgtgtatatatatgtatatgtataaataaattcactttgcacagaaccaattatttttgttcactgactgttcaatattataggactggggtttctcttctcagctagagtctatttcttaaagaccagctcctctacgtctgcatgtgtgtgtatcactcacactaccacaatacaaattagacaaaatagatgcttaatggtgtaattcactttacaatggcactattattacagcattactctattttcattactaccgcatattagaatcggcttccaacatgtttgagtgaagaaataaaacaacctaatcacaatgccaattaattctgtaaaagtcatgcagtatatcaaaactaaaacatttcacagccatctcagaaagacaggattccatacttgcttcactatttttagccagctatgcctctactccttgaatactttgacctatcctagtccagttataagccaaaatcgataaaagaccctaagcaagtttaattgattctctaagaaaggatattataatccatcagcacaccctcaccttgtgctgacattattttcctgggtttacctaataccactgtggtaccaaaaactactctttctcacgctgttctctcatcagctcaaatactgtaacagcagagcaatttcaaacaggttgcgagtcttttagagtattgcttgcaaagtgcatgtaaattattagattacattacaagtgaaagactcagcagtgggtcaccatagtggagcattaatgtacagcaagttgaatggaacccttgcagacaagcttctccgatgtgatttttttttttggcagaaaggagaaagtgagtaaagggaagggagggcaaggaatgatgggttggtgaaaagtgaagtctctgagagcaccagggcaaggtgggaataaggtagcaaccccagcctcagtgcctggatggggcagccagagggcagtacaagaatagtgggagcagggagacagggaaaagggaaggaagaagccagacaggtatgggaggtaacgtcaggaaagctcaacaagtggctgatggggctgaatttcagtgatttgtcctcttttaattggatccagcccatggtagctgaactgagggattaatgaatttacctaaggtcacacggctagcacagcacacacctgggtcttggcccaggtctgtctcactcctcccagcaggcttgtaaaaaccacatacacatattgtctcccaacacgtccagctttggtctgagttgctcaagactagagtaggcctgatcgtgcaattgaggggatcagtggattcaagagaggcagaagtcacacaaacaagtgcagctgagtccaaaccgaaggccccattggaaatataagacagcaggagatgtgcctgcagagttgggaagtgcctagctggtgtactgagaaggcaaacacctctgcaggacaatgtggaagagagtatctgcatgcttaatgggcacctattttatgcaaggtatcgtgcatggagtaaaaacataaactgtggtcttgatctccttaagactaggctcatacctggaaaataactatcagacagcgtaaaagaggcctggcagaggaagaggttacatgttcactaaatgagcaaggcccatatgactgactgctgtaacaaacaggagtctgggagcttcaagagggagaaggtggatcttatctggagtgaaaatgatggtaggatttcaatgagcagagagagagatggggactaggtgaggcagaggaggaggggaaaggtgaaggcacatacaaggtagagagatgaaaaggccaagttcaaaacacatttagaagagaaccaccataaatgcctggtctgaggtgacccaggtatttcagtgagcttcttaagagaaatgccaccactcaaatataagatccagaaaggcagggagctcgcctctcttgtttgctgctttatccccaggccctagcacatagaaagtactcagtaaatatatgttgaatgaaagaatgccacccttgggctcttacacactgatgtcagctccaagcaaaagagggatcccagaatttatattctaagccagtctaggcagatgtgcctctaaatgtactagcatattaatgagcatgtgctaaaagtggcataaagatactgtatgattataaataataagtatttacattattttccctccccctcctcctccctgaagtcataatgagtaacacctggagcttaacatcagttactgtggaaacacttccttcctcccccactgctgggccatggtcccccagaaaggctgcttctacttcatgcccaggacaaggttttcaaatagtgaggagtggctcataaatagatcatgaaaccaatgtggtggctcgtaatctgtattttaaataatagagcaaacacaatcacgcatcacaagtgaagggtaaatattttacatgaaatgtttgtgtgtgtgtgtgtgtgtgtgtgtgtgtgtgtactagttcacaatgtaattaatatgtttttctcattgtggatcacggtattaatgtctcaaagatatcgccctgagaggcaagcggttccagtgttaggacctgtaatattcaagctgaatgacccttgttttaccggctaaatgtgcctgtcaagtggtatttctctttggcccggtaaacttgacccatcctgaaacactgagatgttctgtgtaacatactaagttcagaatcagttccttcaaaggatcccaagtttcacaacacacagtcttttgtggaagaaaaaatgatttattttttctaattacaaaagtaacatatacataatgtaagaacttcaaaaaatacagaaaagcacaaagaaaaagaaactcacaggtaatcccagcatccacagatgaccactttatcatttcatcattttggtattcgtgggtccaagttaatttactaatataactcacacacacacacacacacacacacacacacacacaatttccttctacaaaaaagatggcattccatgcacactgctatgaaagctgttacttttcacttagcaatggctgatagacactttttcttgataagaaatacttttctagtgcaacatgatttttaatggctacataatattccattcacagacttgatcctgagcatctctagacaaggtacagccttaaatcctctactttgagaaaacaagcttgctgcggagacacacatctttgctgtgggcctcctggctgtgtctagctctggtgagcactaagcatgagatgctcaactctatacctattaatagaaagtaaaaatagttttactttccactaaatcagagcatgagacttggacactattttcactatgttttagaatggctttactgacatagccacaagctcactggtggatttttaattaataataaaaatgcccagtggggttaaaaaataacaattactgacaatgttccactaataatgcatagccaaaataacccatgcttaattttgtacataatctactgcctaatgctagatcaacttgcacacatcttaatagcctcattaggctgggtgtggtggctcatgcctgtaatcccagcactttgggaggccaaggcgggaggatcacgaggtcaggagatcgagaccaacctggcgaacacggtgaaaccctgtctctactaaaaatacaaaaaaatcatctgggcgcggtggctggcgcctattgttccagctattcgggaggctgaggcaggagaatggcgtgaacccaggaggcggagcttgcagtgagcagacatcacgccactgcactccagcctgggcgacagagcaagactccgtctcaaaatttaaaaaaaaaaaaatcctcattattcgaactttggaggatcctggcacagcacacaagtgacaggaacatgaggtaagaaagtacaagacttgggttctagtcacagtcttgctgcttactaggaatgtgatctcgaacacgttacctttgtcagcatcagttcaaatagggtgggctaggctcgctgattcataaagccctttctggctttaacacactttagtctaataaaatacgaccaagtggtagcatcatgagtgagtatcacatatttaacatacaaccccaagttcaagactaaaaagtcagctttagagggttcaagagccctttcagtgtagcttcagttcttcttctgattccctgtgagtcctcaagaatgctagggaacctcaccaatccttgactgtcatccttcacactgtgaaattttacagcttgcaggttaacagcctggtctatagaaattgcccgggttcccactttctgcacacatgtgctcatccaaagcacgtgatgagtgccagaaatggtaaaatacaactctggcaatttcacacttgtcatcatcagtcaactaataagagcactaaaagaggaatcattttttgatgatcaggttatttcatttgcctttgctttcccaatgcttcattacctggacaattgagagttatgagcagttcaccctcccagttgccctgtcccttcagatataatatccccgtcacacaaacattcctgagagtacatgctgtattgtcacatggccttttcatcatccactggttttataactggaaagtgaaaatgaaaagcaatgcagtttatttaagaggttttagacttgctaaatatacatgtgtgtcctctgtgattggatgttgaaaatccattaatttccacacagccactcctccccatgactggcatcgatcatatgggatgaaataagcctctttgcttctggaagggcggaatcacatctggttgccttttctctgtctttgtccatttcttcaggtttctttaaaattaattggaagagtcaataaacacggctgccaattccctttacaccctaggaaagcagctcaccgtgcccttcagacctattcttgctgtttttccaagtactcccttacctgcctttgtcaattggcattctcgacaagttcgtcataacttctcaaagtgtcaacttttcctcttttcattgcccttgttaaagataatttaaaattagaaagtcacattcccagccatttcagagtcaatgctaatgtcattttcctttgcacagaagtctcttttccctctagaggctccctgccttcatccacagcccccactccccagccccaaacaggcattgttaatctctgcaggcactagtccattcccctatttcatccttcttatctttcccccaaaatacttcacccagtgaaacacactttagcttctggttctccttccttcactccacttcagagagaaatgtctgggtctagagattgtaaagtcaccttcaggaaagaagcatacagttgactgtcaattaatcaggataagacagaaaaaattacaccatgtgcagcttggcttctcagtacatgcatttatgttttgggatcaagaggatttcttccgtacaacctaaaattcatatttatggcttttgtttggctacaactaattcccttcctaactgcacagtagttaatagtctggaattcttaaaacagtgattaccatacttcatagtagattcaaacgatggtccctcatttccccctcattctatttcacctctattcttgcctgtttattcttggtagcattctttgcttatacaaaaaagtcagacgattttatattctataatttttattctcgtggc[450 bp omitted]tcccttgagcccatctctttaagaaaaaaaaaaaaaaactaaaaaaatagttcataatcaaaattaaaacacccaataacattgttaagatgattctaggctaggagattataaatcctctgtaccataatatttcctactcatttccatcctctgacacagagtttcagagaaaacatctatggtatagaagctctacctggggcagcctggagtcctccaccacctacaagggtgtgtgaaacctgtactctcagctgtcagtgggtgctgtacagggctccctagctgaccaccagggccccagttctgcggacaaaaccatcaccaggaaaccacagcgccatgccactgttaatgtgccatactatgtaatgtgataagacagtctgtaataatgacgtgtcagttaaggccatacaaatatgttaggaaaaaaaaattgttcttgcaccaacacaggggaattgttacctataattccttttagcattagcatgtaagagctggcgcaaaaagccggcctgactaaactgtgagctatggtacatttattcctcatcatgccccattcctctcttctaaggatttctttagacaatctccttgatgtctttgctccaaaatcaagagagaaataataataactgggctgtcacaaaagaacatcaggactcccaagctgaatttccaacactacaatatcaaagataatcacaagacaactgcagactatatcattaagtcaagtgggacatccctgagaaagtcagcttctgatggtgtggttccagggatgctttccatattcgtccagtgaaaacaacctgtgcttggaaagagggtttcctttggggcaatcgaaatgttctttgttgacattcttggaattattccttctaaccctagagtttcctaactttcaggatttaagagcctcatgccaaagataccccttcaatatatctatgtaagagttaggactacctggagtttctgtctaccattagatgggagaaaacttatgttatcataatacagtaaataacttacttgaaaatataatatccttcctgaatattcaagaatgactttaccgccaggcatggtgattcacacctgtaatcctagcactttgggaggccgaggcgggtggattgtctaagctcaggagtttgaaaccagcctgggcaacatggtgaaaccccgtctctactaaaacacaaaaaattagctgggcatggtggtgcgcacctgtagtcccagttccctgggaggctgaggcacaagaattgcttgaacccgggaggcagaggttgtactgagctgagatcgtgccactgcactccagcctgggagacacagcgaagactctgtctcaaaaaaaaaaaaaaaaaaaaaatgactttacatcctctttaactccaaagaaagaattaagaagagcctaagctctggatgaaatattcctataaagtaaaaatctcaattaactaaaatcaactaattgaatttctattttgctacttgcaacttagacaacaagggaggaaataacaaaacatactgatattgagcatttaacaaaaaaagaaagaaagaaaacaatttccaagtggggatcaagatagatttagtccaatctctgacactgtgtccatttacagttctataatgtacaattggaattcatactcagaacagtgaccttgtggcaccataagattctcaaacctcaaagaaagattcaattacattctcagtgttctttctagagtaggaaacgggactagtacgtttagaaaacgtattcaacaagtaaaggacaaaaaatactttgggttaatctactgttagtcagaaaaaccaactcatcagtaatgtcctggcacccttagagaaaaatcatggtttactgtgtattaatcaacacttaaacactgattctcaggttttttttaaagcattaattttaaaaatacaattttattttaacatacagcctaaaaagatgggtgaaaaatttaacagctcatttctaaaccaacacttcctgcgtgaattagatatcaaaaaaaaaaaaaccactaaaaaatgatagaagagaaaatgagagacagagagtattattcctaaattttgagtaaggaagataatcttcatattcagaaaagtattccaaattctggatgagtattcactccaacacttgaaggcctttcaaaaatactctccttgtttctgcacactttatcactaatctgggatgaatgggacaggaatctgtgagcgagcagatgaggtctacctcaaagtccctgtatattggctcatgggagacaatgaatgtgaacagccagatatgtcataataggagaggtgcgtttcctataaatttttttattatttgtttttgcacacatggcaatcacattacagctctttccccagatacctgggaaatgtggttatgcatttggcttccacagaagtgtaagctaagaagctcaattcatcaagtagcctgggaagatgaagggggaaaggaagagtaaactcagaacacatggcacatgcttaagataccataccatatgaacctctaataacctccaactccatctctcctgtcaacatggtaccgcaagctcctaaacacaaaaatgggagaaggtggatcttaattcagaagtgacatgtccaaggaaaagaacccatgggcttgtctcactcgaattccaaaggttagctctggacagagggcagtttgcttccaaaagtgattcagctgtcactaaaaatcctcagaacatttttatccggaggcacatctattacaattaacattctcacgcctccctgtgtcccacttcaggagtctagtgtggaaccagaagtgtgtgctacagcccccacctctgctaccttgaaaacaagctgaagggtctcatcgttaggggcttcaatgcaggctccatacttcagtttcagacgtagaggcattttctaaagccaagggctcctcaccatgccagtaggtattggaaaattccagcaggtgactaacattagaagagtctcctatagatgttttgaaccactcaggacttgaattctagattaataattcaattttttttaagaaataagggggaagcaacagaaaaggttatcataactatcatcaaatgccttttctataattattatattacatttttaaagggtattattataaatgtttttatgagcaatttaccggaaaattaaagtcctttagtttaaaaaataattattttatccctctggcaaaggcttttctcccagtcagcagctctttcaaactatggggcatcatttgttcactgtggcgagccgggtccatgtgaggaaagttgatctgagaatcaatctctagaaagggcgctaaattgctaggtaagagcacctactagaaagtgaatcagccaaaactgaagggggcaagagaggccacgcactttcaaagtcaaagacgtatgtggttctagaagtcctcagggctacacataaactacaggccctgttaactgattttaagtcaatctaagctgagcttccagggggttcgatctcaacccaactgagcttttcactgttaatcccatcttttggtttcgatttttcccttaggtctgccggccctaaaagccttcaaccttcagcactggtgttccaaaccaactgtgtggtggtacacagccctgtgtggatgacttcactgaactaaaatatgtaagcttctggcaagcacatataataacgagattctgaaaaagggtttttaacaacagttatgtcacgaggctcatggctccctgaagtccctgaaagccttgttaaattaaagattcgctgtggttttttttccgcttcattcctacttcccttgtcgcttcctgcctttcttttttctctttcattgtgttgttaagatggaactgagtgacaccagctatcattaatatcacctagaaaatggaagagtttcattaaaactgctaacattcccagcagttttatggacaggggaaggtcgtctttcagattataaagtcacacacctgattttgtaagctcaggcaataaaggtacacagtgcatccacacttggattcccaagagggaggaattcaacagtagcctcaagtctacctaggtaatgtctcatgaggtcactgcaatgtcatgagaattcagaccacaatttctgtggacttcaaacactgactgggtagaagctaaacctgctaccctttggaaagtatctcccaaatcagaaagcttcccatttcacccaatgccaagaactccactccaccctcctggaggttgaaaatgctaatcataaggtgatgatgtttgcttttcctttctagttgtgtgcctttatgttttaagtatttaaaaggcataatcacctagtgtgtaggttaatttctttccgatattgtaatttatgcaacattaatactggatgccagctccaattttcttactgcttacactctgggagccggcttgcatattctgccaactccattacatcatctgaaaacccaaacatttcccattttcaaatcactctcaactaccaggcatacttacacattctctctttttctccctagctcacacacataaagattggtacccctgaggagcagatgctacatctgaggttaaagtctgcaaatgcacataatttctggaagctattactactgctgtgttagctaaaggatgcctccatctctgaccttcctttttccattcagactgttatataacctagtgcctgcgtgcaggatgtgagttgagtgtttgggccttaccacccccctcccattaaatcttccaggagggacagacaggggctggttcaaagaatgagttggggtgggggcagagggtggggggaaggggatatgggtcagcaggtcagctgtgcaagatgtatcccactcctactatgcccctctcccctttttgctgagcctaagggggctggtggcactgaatgctccggcgttacataatttgcaagaacagcaagttacggatttgctagtcggctctgcagcctgccaccctgatcgcttgcaagaacaccttctggcaagaatgacacctgaagatgttaataacacagggtgtgggggggtcaagaaggagaaaggtggcagcacaaaccaaaaattagtgcagcttcctaaatactatgtcccccccattccaaaaaaaaaaaaaaagccccagaaacacatgaaggggattttctccagtgtttctgattaaccctgttacataacccgctcgcattccaaatccaccgtctcagggtctaaatatactctttgcagccaaaagctccccgcacacaaactcaccgagctagcggcaggtccaggcccccagccctcatccccttcccttttgtcccagccctcgccgcccccctcccgctgaaaccgcggttcgccgcggtcaccctttggaaatcgcctttaattaaatgtttttcgcgtgtgtcatcctgatggcttttactgtactcgaattccgtgaatgggaaagcgcctggacagggggtgtggctaaggtggggggggggatactgtaaaacagccagcacatgatcagccatattcctacctccaactacaacatcgagaggaagggagcagttcctggggcccccattcgcctctacccagccctccccaaccgccgccagaagccgagtgcaagaggagggggcgcgctgggccggtacccaagccggggctggagaaatcctctccgtccccagctccaggcggctcgcgcgagcacgcttcctccggagtgacaggcgcgatttatacattatttacaacagtaattaaagctgtagcttcctcctgttctttgcaaactccaggcgcattcaaataaataatcccccactctcgagaaaaacacacatcaggttccaataccttcaagaaagagtgagctttcctcaacagctcactttaggaaaggagggagcaactgagtcccccccatcccccccaacacacgcagacacagaccaaacaccaaaatgaagagtaaaaatcgccaggggaggagaaaacattgcttgcactatccaaccagcatacaacttgcactgaccatccccaggttcctgcagaaatgcttggaacctccgagagggaaggattcccagagcagaaataagtttcggtgcttgcttttgtagacgctccctccggatgcgcgtggagcgccccacaggaccgccgccctctgcgcgttggcgcgcacacgccccccgccagcctgggcgccgggctccgaacccccggtctgcaaacttgcgcatctcccctcgccgcgcccgccagacaacttggcgaacagctcgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcaggcggctcgctcttgcgggcggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctatggtacc
